US008969254B2

(12) United States Patent
Reinherz et al.

(10) Patent No.: US 8,969,254 B2
(45) Date of Patent: Mar. 3, 2015

(54) OLIGONUCLEOTIDE ARRAY FOR TISSUE TYPING

(75) Inventors: Ellis L. Reinherz, Lincoln, MA (US);
Vladimir Brusic, Brookline, MA (US);
Guanglan Zhang, Brighton, MA (US);
Derin Benerci Keskin, Somerville, MA (US); David Deluca, Allston, MA (US);
Honghuang Lin, Natick, MA (US)

(73) Assignee: Dana-Farber Cancer Institute, Inc., Boston, MA (US)

( * ) Notice: Subject to any disclaimer, the term of this patent is extended or adjusted under 35 U.S.C. 154(b) by 0 days.

(21) Appl. No.: 13/329,161

(22) Filed: Dec. 16, 2011

(65) Prior Publication Data
US 2012/0264627 A1 Oct. 18, 2012

Related U.S. Application Data

(60) Provisional application No. 61/423,991, filed on Dec. 16, 2010.

(51) Int. Cl.
C40B 30/04 (2006.01)
C12Q 1/68 (2006.01)

(52) U.S. Cl.
CPC .................................... *C12Q 1/6881* (2013.01)
USPC ............................................. 506/9; 435/6.11

(58) Field of Classification Search
None
See application file for complete search history.

(56) References Cited

U.S. PATENT DOCUMENTS

| 4,401,796 | A | 8/1983 | Itakura |
|---|---|---|---|
| 4,458,066 | A | 7/1984 | Caruthers et al. |
| 4,500,707 | A | 2/1985 | Caruthers et al. |
| 5,143,854 | A | 9/1992 | Pirrung et al. |
| 5,288,514 | A | 2/1994 | Ellman |
| 5,985,662 | A | 11/1999 | Anderson et al. |
| 6,670,124 | B1 * | 12/2003 | Chow et al. ................... 435/6.12 |
| 2003/0119015 | A1 | 6/2003 | Frazer et al. |
| 2008/0241823 | A1 | 10/2008 | Gut et al. |
| 2009/0099035 | A1 | 4/2009 | Petersdorf et al. |
| 2009/0264307 | A1 | 10/2009 | Gresham et al. |
| 2010/0279889 | A1 | 11/2010 | Mitra et al. |

FOREIGN PATENT DOCUMENTS

| WO | WO 9639154 | 12/1996 | | |
|---|---|---|---|---|
| WO | WO 9703211 | 1/1997 | | |
| WO | WO 98/02749 A1 * | 1/1998 | ........... | G01N 33/576 |
| WO | WO 2007/076577 A1 * | 7/2007 | ............... | C12Q 1/68 |

OTHER PUBLICATIONS

Gresham et al. (2010) "Optimized detection of sequence variation in heterozygous genomes using DNA microarrays with isothermal-melting probes" PNAS 107(4):1482-1487; published online Jan. 8, 2010.*

Avent (2009) "Large-scale blood group genotyping—clinical implications" British Journal of Haematology 144(1):3-13; published online Nov. 4, 2008.*
Saunthararajah et al. (2003) "A simple method to predict response to immunosuppressive therapy in patients with myelodysplastic syndrome" Blood 102(8):3025-3027; published online Jun. 26, 2003.*
John et al. (2005) "Interactive selective pressures of HLA-restricted immune responses and antiretroviral drugs on HIV-1" Antiviral Therapy 10(4):551-555; published 2005.*
Maksymowych et al. "Association of a Specific ERAP1/ARTS1 Haplotype With Disease Susceptibility in Ankylosing Spondylitis" (2009) Arthristis and Rheumatism 60(5):1317-1323; published May 2009.*
Vidal-Castineira et al. (2010) "Effect of killer immunoglobulin-like receptors in the response to combined treatment in patients with chronic hepatitis C virus infection" Journal of Virology 84(1):475-481.*
Authorized Officer J.H. Choi. International Search Report and Written Opinion in International Application No. PCT/US2011/065624, dated Dec. 3, 2012, 14 pages.
Ahlenstiel et al., "Distinct KIR/HLA compound genotypes affect the kinetics of human antiviral natural killer cell responses," *J Clin Invest.*, 2008, 118(3):1017-26.
An and Winkler, "Host genes associated with HIV/AIDS: advances in gene discovery," *Trends Genet*, 2010, 26(3):119-31.
Chen et al., "Activating KIR genes are associated with CMV reactivation and survival after non-T-cell depleted HLA-identical sibling bone marrow transplantation for malignant disorders," *Bone Marrow Transplantation*, 2006, 38:437-444.
De Petris et al., "Correlation between HLA-A2 gene frequency, latitude, ovarian and prostate cancer mortality rates," *Medical Oncology*, 2004, 21(1):49-52.
Geraghty et al., "A human major histocompatibility complex class I gene that encodes a protein with a shortened cytoplasmic segment," *Proc. Natl. Acad. Sci. USA*, 1987, 84:9145-49.
Gonzalez et al., "Killer cell immunoglobulin-like receptor allele discrimination by high-resolution melting," *Hum Immunol.*, 2009, 70(10):858-63.
Gonzalez-Roces et al., "HLA-B27 polymorphism and worldwide susceptibility to ankylosing spondylitis," *Tissue Antigens*, 2008, 49:116-123.
Guo et al., "Direct fluorescence analysis of of genetic polymorphisms by hybridization with oligonucleotide arrays on glass supports," *Nuc. Acids Res.*, 1994, 22:5456-5465.
Khan et al., "Genetics of HLA associated dseases: rheumatoid arthritis," *Tissue Antigens*, 1983, 22:182-185.
Koller et al., "HLA-E. A novel HLA class I gene expressed in resting T lymphocytes," *J. Immunol.*, 1988, 141:897-904.
Kulkarni et al., "The Yin and Yang of HLA and KIR in human disease," *Semin Immunol.*, 2008, 20(6):343-52.
Larsen & Alper, "The genetics of HLA-associated disease," *Current Opinion in Immunology*, 2004, 16:660-667.
Lebedeva et al., "Comprehensive approach to high-resolution KIR typing," *Human Immunol*, 2007, 68(9):789-96.
Lee et al., "HLA-F is a surface marker on activated lymphocytes," *Eur J. Immunol.*, 2010, 40:2308-18.

(Continued)

*Primary Examiner* — Tracy Vivlemore
*Assistant Examiner* — Karen S Weiler
(74) *Attorney, Agent, or Firm* — Fish & Richardson P.C.

(57) ABSTRACT

Oligonucleotide-based microarrays for tissue typing (e.g., HLA tissue typing) are provided. More particularly, the microarrays are high resolution arrays useful for diagnostic evaluations and determining donor/recipient transplant compatibility.

77 Claims, 14 Drawing Sheets

(56) References Cited

OTHER PUBLICATIONS

Lin et al., "HLA Class II DR-DQ and Increased Risk of Cervical Cancer among Senegalese Women," *Cancer Epidemiol Biomarkers Prev.*, 2001, 10(10):1037-45.

Maiers et al., "High-resloution HLA alleles and haplotypes in the United States population," *Hum Immunol*, 2007, 68:779-88.

Marsh et al., "Killer-cell Immunoglobulin-like Receptors (KIR) Nomenclature Report 2002," *J Immunol Methods*, 2003, 281:1-8.

Michallet et al., "The impact of HLA matching on long-term transplant outcome after allogeneic hematopoietic stem cell transplantation for CLL: a retrospective study from the EBMT registry," *Leukemia*, 2010, 10:1725-31.

Passweg et al., "HLA and KIR polymorphisms affect NK-cell antitumor activity," *Trends Immunol*, 2007, 28(10):437-41.

Pearson and Regnier, "High-performance anion-exchange chromatography of oligonucleotides," *J. Chromo A*, 1983, 255:137-149.

Poland et al., "Vaccine Immunogenectics bedside to bench to population," *Vaccine*, 2008, 26(49):6183-8.

Rammensee, "Chemistry of peptides associated with MHC class I and Class II molecules," *Curr. Opin. Immunol.*, 1995, 7:85-96.

Robinson et al., "IPD—the Immuno Polymorphism Database," *Nucleic Acids Res.*, 2010, 38:D863-9.

Yershov et al., "DNA Analysis and Diagnostics on oligonucleotide microchips," *Proc. Natl. Acad. Sci. USA*, 1996, 93:4913-4918.

* cited by examiner

```
A*02:01:01:01    ATGGCCGTCATGGCGCCCCGAACCCTCGTCCTG...
P1               ATGGCCGTCATGGCGCCCCGAAC
P1N              ATGCGGGTCATCGCGCCCCCAAC
P2                TGGCCGTCATGGCGCCCCGAAC
P2N               TGCGGGTCATCGCGCCCCCAAC
P3                 GGCCGTCATGGCGCCCCGAAC
P3N                GCGGGTCATCGCGCCCCCAAC
P4                  GCCGTCATGGCGCCCCGAACC
P4N                 CGGGTCATCGCGCCCCCAACC
P5                   CCGTCATGGCGCCCCGAACCCT
P5N                  GGGTCATCGCGCCCCCAACCCT
P6                    CGTCATGGCGCCCCGAACCCTC
P6N                   GGTCATCGCGCCCCCAACCCTC
P7                     GTCATGGCGCCCCGAACCCTCGT
P7N                    GTCATCGCGCCCCCAACCCTCCT
P8                      TCATGGCGCCCCGAACCCTCGTC
P8N                     TCATCGCGCCCCCAACCCTCCTG
P9                       CATGGCGCCCCGAACCCTCGTC
P9N                      CATCGCGCCCCCAACCCTCCTG
P10                       ATGGCGCCCCGAACCCTCGTCCT
P10N                      ATCGCGCCCCCAACCCTCCTGCT
P11                        TGGCGCCCCGAACCCTCGTCCT
P11N                       TCGCGCCCCCAACCCTCCTGCT
P12                         GGCGCCCCGAACCCTCGTCCT
P12N                        CGCGCCCCCAACCCTCCTGCT
P13                          GCGCCCCGAACCCTCGTCCTG
P13N                         GCGCCCCCAACCCTCCTGCTG
```

FIG. 2

```
A*02:01:01:01  ATGGCCGTCATGGCGCCCCGAACCCTCGTCCTG...
P1             ATGGCCGTCATGGCGCCCCGAAC
P2              TGGCCGTCATGGCGCCCCGAAC
P3               GGCCGTCATGGCGCCCCGAAC
P4                GCCGTCATGGCGCCCCGAACC
P5                 CCGTCATGGCGCCCCGAACCCT
P6                  CGTCATGGCGCCCCGAACCCTC
P7                   GTCATGGCGCCCCGAACCCTCGT
P8                    TCATGGCGCCCCGAACCCTCGTC
P9                     CATGGCGCCCCGAACCCTCGTC
P10                      ATGGCGCCCCGAACCCTCGTCCT
P11                       TGGCGCCCCGAACCCTCGTCCT
P12                        GGCGCCCCGAACCCTCGTCCT
P13                         GCGCCCCGAACCCTCGTCCTG
```

FIG. 3

Total number of unique probes at position 31 is 9

| | E1S1R1 | E1S1R2 | E1S1R3 | E1S1R4 | E1S2R1 | E1S2R2 | E1S2R3 | E1S2R4 | E2S1R1 | E2S1R2 | E2S1R3 | E2S1R4 | E2S2R1 | E2S2R2 |
|---|---|---|---|---|---|---|---|---|---|---|---|---|---|---|
| Max | 222 | 258 | 150 | 211 | 471 | 546 | 355 | 327 | 148 | 157 | 388 | 906 | 518 | 1130 |
| Min | 33 | 40 | 21 | 39 | 55 | 67 | 33 | 25 | 1 | 27 | 1 | 1 | 7 | 6 |
| Mean | 90 | 108 | 70 | 88 | 173 | 209 | 144 | 138 | 64 | 73 | 154 | 233 | 145 | 282 |
| Median | 62 | 98 | 68 | 60 | 126 | 149 | 105 | 99 | 36 | 57 | 121 | 97 | 97 | 128 |
| GeoMean | 73 | 93 | 61 | 73 | 131 | 166 | 115 | 106 | 35 | 60 | 64 | 79 | 80 | 107 |

A*01010101 vs. A*02010101: Times of winning

| Allele | Length | E1S1A1(A0) |
|---|---|---|
| A*01010101 | 1098 | 118 |
| A*02010101 | 1098 | 42 |

A*01010101 vs. A*03010101: Times of winning

| Allele | Length | E1S1A1(A0) |
|---|---|---|
| A*01010101 | 1098 | 8 |
| A*03010101 | 1098 | 47 |

A*01010101 vs. A*110101: Times of winning

| Allele | Length | E1S1A1(A0) |
|---|---|---|
| A*01010101 | 1098 | 14 |
| A*110101 | 1098 | 17 |

A*01010101 vs. A*2301: Times of winning

| Allele | Length | E1S1A1(A0) |
|---|---|---|
| A*01010101 | 1098 | 105 |
| A*2301 | 1098 | 40 |

A*01010101 vs. A*24020101: Times of winning

| Allele | Length | E1S1A1(A0) |
|---|---|---|
| A*01010101 | 1098 | 102 |
| A*24020101 | 1098 | 39 |

FIG. 10B

**Pairwise comparison between A*02010101 and A*03010101**

| Allele | Starting position | Probe | Melting temperature | HLA coverage | ELSLA2(A1) Signal | Voting |
|---|---|---|---|---|---|---|
| A*02010101 | 7 | GTCATGGCGCCCGAACCCTCGT | 64.2 | 90 | 153 1.51 | similar |
| A*03010101 | | GTCATGGCGCCCGAACCCTCCT | 64.2 | 69 | 180 1.78 | |
| A*02010101 | 10 | ATGGCGCCCCGAACCCTCGTCT | 64.2 | 92 | 248 1.33 | similar |
| A*03010101 | | ATGGCGCCCCGAACCCTCCTCT | 64.2 | 81 | 231 1.24 | |
| A*02010101 | 13 | GCGCCCCGAACCCTCGTCCTG | 64.1 | 94 | 6699 1.11 | A*03010101 |
| A*03010101 | | GCGCCCCGAACCCTCCTCCTG | 64.1 | 150 | 13346 2.20 | |
| A*02010101 | 14 | CGCCCCGAACCCTCGTCCTGCTA | 64.2 | 94 | 10867 1.21 | similar |
| A*03010101 | | CGCCCCGAACCCTCCTCCTGCTA | 64.2 | 51 | 20000 2.22 | |
| A*02010101 | 15 | GCCCCGAACCCTCGTCCTGCTACT | 64.2 | 94 | 3933 0.32 | A*03010101 |
| A*03010101 | | GCCCCGAACCCTCCTCCTGCTACT | 64.2 | 51 | 10254 2.12 | |
| A*02010101 | 16 | CCCCGAACCCTCGTCCTGCTACTCT | 64.2 | 95 | 1481 0.46 | A*03010101 |
| A*03010101 | | CCCCGAACCCTCCTCCTGCTACTCT | 64.2 | 51 | 4691 1.45 | |
| A*02010101 | 17 | CCCGAACCCTCGTCCTGCTACTCTC | 64.2 | 95 | 828 0.54 | A*03010101 |
| A*03010101 | | CCCGAACCCTCCTCCTGCTACTCTC | 64.2 | 34 | 1822 1.18 | |
| A*02010101 | 18 | CCGAACCCTCGTCCTGCTACTCTCG | 64.2 | 95 | 418 0.44 | A*03010101 |
| A*03010101 | | CCGAACCCTCCTCCTGCTACTCTCG | 64.2 | 34 | 889 0.94 | |
| A*02010101 | 19 | CGAACCCTCGTCCTGCTACTCTCGG | 64.2 | 95 | 557 0.42 | similar |
| A*03010101 | | CGAACCCTCCTCCTGCTACTCTCGG | 64.2 | 34 | 477 0.57 | |
| A*02010101 | 20 | GAACCCTCGTCCTGCTACTCTCGGG | 64.2 | 95 | 422 0.35 | similar |
| A*03010101 | | GAACCCTCCTCCTGCTACTCTCGGG | 64.2 | 34 | 645 0.54 | |
| A*02010101 | 21 | AACCCTCGTCCTGCTACTCTCGGGG | 64.2 | 96 | 504 0.64 | similar |
| A*03010101 | | AACCCTCCTCCTGCTACTCTCGGGG | 64.2 | 35 | 878 1.12 | |
| A*02010101 | 22 | CCTCGTCCTGCTACTCTCGGGGG | 64.2 | 97 | 201 0.33 | A*03010101 |
| A*03010101 | | CCTCCTCCTGCTACTCTCGGGGGG | 64.2 | 35 | 712 1.18 | |
| A*02010101 | 25 | CGTCCTGCTACTCTCGGGGGCT | 64.2 | 40 | 272 0.73 | similar |
| A*03010101 | | CCTCCTGCTACTCTCGGGGGGC | 64.2 | 35 | 172 0.46 | |
| A*02010101 | 26 | TCGTCCTGCTACTCTCGGGGGCTCT | 64.2 | 41 | 350 1.54 | A*02010101 |
| A*03010101 | | TCCTCCTGCTACTCTCGGGGGGCC | 64.2 | 35 | 113 0.50 | |
| A*02010101 | 28 | GTCCTGCTACTCTCGGGGGCTCTG | 64.2 | 41 | 500 1.97 | A*03010101 |
| A*03010101 | | CTCCTGCTACTCTCGGGGGGCCCT | 64.2 | 35 | 144 0.57 | |
| A*02010101 | 29 | TCCTGCTACTCTCGGGGGCTCTGG | 64.2 | 41 | 187 1.13 | similar |
| A*03010101 | | TCCTGCTACTCTCGGGGGGCCCTG | 64.2 | 92 | 121 0.73 | |
| A*02010101 | 31 | CTGCTACTCTCGGGGGCTCTGGCC | 64.2 | 41 | 98 0.91 | A*02010101 |
| A*03010101 | | CTGCTACTCTCGGGGGGCCCTGG | 64.2 | 92 | 52 0.43 | |
| A*02010101 | 32 | TGCTACTCTCGGGGGCTCTGGCC | 64.2 | 41 | 84 1.45 | |

FIG. 10C

Summary of voting
E1S1A1(A0)

| Winning | A*01010101 | A*02010101 | A*03010101 | A*110101 | A*2301 | A*24020101 | A*250101 | A*260101 | A*2901010 | A*300101 | A*310102 | A*320101 | A*3301 | A*340101 |
|---|---|---|---|---|---|---|---|---|---|---|---|---|---|---|
| A*01010101 | 0 | -76 | 39 | 3 | -65 | -63 | 11 | 29 | -21 | 7 | -18 | -9 | -20 | 10 |
| A*02010101 | 76 | 0 | 106 | 74 | 8 | 8 | 89 | 105 | 61 | 70 | 54 | 83 | 51 | 84 |
| A*03010101 | -39 | -106 | 0 | -32 | -90 | -97 | -22 | -6 | -49 | -27 | -51 | -42 | -49 | -20 |
| A*110101 | -3 | -74 | 32 | 0 | -67 | -70 | 10 | 25 | -24 | 3 | -25 | -12 | -23 | 9 |
| A*2301 | 65 | -8 | 90 | 67 | 0 | -2 | 82 | 99 | 57 | 58 | 62 | 79 | 61 | 78 |
| A*24020101 | 63 | -8 | 97 | 70 | 2 | 0 | 91 | 108 | 63 | 64 | 68 | 85 | 67 | 89 |
| A*250101 | -11 | -89 | 22 | -10 | -82 | -91 | 0 | 18 | -28 | -8 | -28 | -10 | -28 | -11 |
| A*260101 | -29 | -105 | 6 | -25 | -99 | -108 | -18 | 0 | -48 | -24 | -46 | -30 | -46 | -26 |
| A*29010101 | 21 | -61 | 49 | 24 | -57 | -63 | 28 | 48 | 0 | 24 | 3 | 5 | 5 | 21 |
| A*300101 | -7 | -70 | 27 | -3 | -58 | -64 | 8 | 24 | -24 | 0 | -21 | -11 | -21 | 8 |
| A*310102 | 18 | -54 | 51 | 25 | -62 | -68 | 28 | 46 | 3 | 21 | 0 | 4 | 4 | 19 |
| A*320101 | 9 | -83 | 42 | 12 | -79 | -85 | 10 | 30 | -5 | 11 | -4 | 0 | -2 | -1 |
| A*3301 | 20 | -51 | 49 | 23 | -61 | -67 | 28 | 46 | 5 | 21 | 4 | 2 | 0 | 23 |
| A*340101 | -10 | -84 | 20 | -9 | -78 | -89 | 11 | 26 | -21 | -8 | -19 | 1 | -23 | 0 |
| A*3601 | -11 | -84 | 33 | -7 | -72 | -71 | 3 | 21 | -29 | -1 | -26 | -17 | -29 | 2 |
| A*4301 | 19 | -99 | 17 | -14 | 96 | -105 | -7 | 11 | -35 | -16 | -39 | -20 | -35 | -13 |
| A*6601 | -18 | -98 | 14 | -17 | -90 | -99 | -6 | 9 | -38 | -16 | -35 | -20 | -33 | -14 |
| A*680101 | 54 | 39 | 67 | 33 | 46 | -47 | 49 | 65 | 19 | 50 | 12 | 44 | 10 | 43 |
| A*6901 | 41 | -32 | 72 | 40 | 34 | -34 | 59 | 75 | 20 | 36 | 17 | 47 | 15 | 51 |
| A*7401 | 2 | -85 | 37 | 6 | -78 | -84 | 7 | 23 | -12 | 6 | -8 | 3 | -6 | -7 |
| A*8001 | 56 | 13 | 88 | 62 | 10 | 10 | 83 | 99 | 70 | 70 | 63 | 78 | 61 | 78 |
| Avg | 12.29 | -61.57 | 45.62 | 15.33 | -57.05 | -61.19 | 25.90 | 42.90 | 2.48 | 15.29 | -1.67 | 12.10 | -2.33 | 20.14 |

FIG. 10D

OLIGONUCLEOTIDE ARRAY FOR TISSUE TYPING

RELATED APPLICATIONS

The present application claims the benefit of U.S. Provisional Patent Application Ser. No. 61/423,991, filed Dec. 16, 2010, which is herein incorporated by reference in its entirety.

STATEMENT REGARDING FEDERALLY SPONSORED RESEARCH OR DEVELOPMENT

The research described in this application was supported in part by grant (Nos. U19 AI57330 and UO1 AI90043) from the National Institutes of Health. Thus, the government has certain rights in the invention.

REFERENCE TO SEQUENCE LISTING

Pursuant to 37 C.F.R. 1.821(c), a sequence listing is submitted herewith via EFS-Web as an ASCII compliant text file named "Sequencelisting.txt" that was created on Feb. 3, 2012, and has a size of 103,990,947 bytes. The content of the aforementioned file named "Sequencelisting.txt" is hereby incorporated by reference in its entirety.

TECHNICAL FIELD

This invention relates to tissue typing using an oligonucleotide-based microarray. More particularly, the HLA arrays are high resolution arrays useful for diagnostic evaluations and determining donor/recipient transplant compatibility.

BACKGROUND

HLA variation is a crucial determinant of transplant rejection, susceptibility to a large number of infectious and autoimmune diseases, and cancer. The limiting factor in large-scale genetic analysis of, for example, transplant populations has been methodologic and directly involves the technical ability to accurately define the alleles of highly polymorphic HLA genes in a cost-effective and efficient manner. Although recent progress in the development of traditional probe hybridization, sequencing and array-based methods has allowed alleles to be determined with accuracy, large-scale efforts in genetic analysis of transplant populations are hampered by the cost and inefficiency of available methods.

In particular, current array-based methods are inefficient, because resolution of ambiguities is not guaranteed, and multiple arrays are needed to conduct a complete analysis of all HLA genes. Exemplary limitations of currently available HLA arrays include for example, that they are suitable for low-to-medium density genotyping but not for high-density genotyping; they do not have a complete set of probes (i.e. capture oligonucleotides that recognize target HLA encoding nucleic acids), but rather have only a selection of "informative probes", thereby making deconvolution of ambiguities difficult or impossible; they do not cover all currently known HLA alleles from each group; and they do not encode a complete set of classical and non-classical HLA loci. Current methodologies, e.g., microarrays, are typically limited to identifying one or several classical HLA molecules (e.g., HLA-A, HLA-B or HLA-C) per assay, and cannot simultaneously determine the haplotype of all classical MHC molecules. Nor can current methodologies simultaneously determine the haplotype of non-classical HLA molecules or accessory molecules (e.g., those important in antigen processing and peptide loading on HLA molecules) in the same assay, and thus do not efficiently provide a complete picture of an individual's HLA tissue type, as needed, e.g., to understand the linkage between certain tissue types and disease susceptibility, and for determining donor/recipient compatibility in tissue transplant.

There therefore exists a need in the art for new and improved methods for not only the identification of all alleles of any HLA molecule, but the ability to identify all alleles of all HLA molecules known at the time of identification, as well as certain other polymorphic molecules, in a single assay. This invention addresses these and other needs as described in detail below.

SUMMARY OF THE INVENTION

In certain embodiments, the invention provides a method for human leukocyte antigen (HLA) tissue typing, said method comprising: (a) contacting a cDNA- or cRNA-containing sample under hybridization conditions with a plurality of capture oligonucleotides specific for HLA polypeptides, wherein said hybridization conditions facilitate hybridization of a subset of capture oligonucleotides to complementary sequences present in the cDNA or cRNA; (b) detecting a hybridization pattern for said cDNA or cRNA; and (c) assigning to the sample, based on the hybridization pattern, an HLA tissue type; wherein the capture oligonucleotides are from about 17 to about 60 nucleotides in length and each capture oligonucleotide with respect to its exact complement has a melting temperature of about 64 degrees Celsius; wherein said capture oligonucleotides comprise subsets of oligonucleotides that collectively target classical HLA polypeptide-encoding nucleic acids ("classical HLA oligo subsets"), each classical HLA oligo subset targeting a different classical HLA polypeptide-encoding nucleic acid; and wherein each of said classical HLA oligo subsets comprises a set of overlapping oligonucleotides that cover every single nucleotide position in the mRNA sequences coding for the classical HLA polypeptides from 5' to 3' and are sequentially shifted by 1-5 nucleotides from the 5' end of the preceding overlapping oligonucleotide. In certain embodiments, in step (a), said cDNA or cRNA was detectably labeled during the making, and said detecting step (b) comprises detecting said detectably labeled cDNA or cRNA. In other embodiments, the detecting step (d) comprises the use of labeled detection probes. In a specific embodiment, the capture oligonucleotides comprise subsets of oligonucleotides that collectively target all known classical HLA polypeptide-encoding nucleic acids. In one embodiment, the capture oligonucleotides are immobilized on a substrate.

In one embodiment, said classical HLA polypeptide-encoding nucleic acids encode HLA polypeptides selected from the group consisting of HLA-A, HLA-B, HLA-C, HLA-DR, HLA-DP, and HLA-DQ.

In another embodiment, said capture oligonucleotides further comprise a plurality of oligonucleotide subsets that collectively targets non-classical HLA polypeptide-encoding nucleic acids ("non-classical HLA oligo subsets"), each non-classical HLA oligo subset targeting a different non-classical HLA polypeptide-encoding nucleic acid; wherein each of said non-classical HLA oligo subsets comprises a set of overlapping oligonucleotides that cover every single nucleotide position in the mRNA sequences coding for the non-classical HLA polypeptides from 5' to 3' and are sequentially shifted by 1-5 nucleotides from the 5' end of the preceding overlapping oligonucleotide. In a specific embodiment, the plurality of oligonucleotide subsets that collectively targets non-classical HLA polypeptide-encoding nucleic acids collectively target all known non-classical HLA polypeptide-encoding nucleic acids.

In another embodiment, said non-classical HLA polypeptide-encoding nucleic acids encode HLA polypeptides selected from the group consisting of HLA-E, HLA-F, HLA-G, DM, DO and MIC.

In certain embodiments, said capture oligonucleotides further comprise a plurality of oligonucleotide subsets that collectively targets nucleic acids encoding accessory molecules important in HLA-linked peptide presentation and/or processing ("accessory molecule oligo subsets"), and said method further comprises the step of assigning to the sample, based on the hybridization pattern, an accessory molecule phenotype; wherein each of said accessory molecule oligo subsets comprises a set of overlapping oligonucleotides that cover every single nucleotide position in the mRNA sequences coding for the accessory molecules from 5' to 3' and are sequentially shifted by 1-5 nucleotides from the 5' end of the preceding overlapping oligonucleotide. In a specific embodiment, said accessory molecules are selected from the group consisting of LMP2, LMP7, LMP10, tripeptidyl peptidase II (TPPII), bleomycin hydrolase (BLMH), leucine aminopeptidase 3 (LAP3), transporter associated with antigen processing (TAP) 1, TAP2, 2-microglobulin, TAP binding protein (tapasin), calnexin (CANX), calreticulin (CALR), protein disulfide isomerase family A member 2 (PDIA2), protein disulfide isomerase family A member 3 (PDIA3), ERp57, endoplasmic reticulum aminopeptidase (ERAP) 1, ERAP2, proteasome (prosome macropain) subunit althap (PSMA) type I (PSMA1), PSMA2, PSMA3, PSMA4, PSMA5, PSMA6, PSMA7, PSMA8, proteasome (prosome macropain) subunit beta (PSMB) type 1 (PSMB1), PSMB2, PSMB3, PSMB4, PSMB5, PSMB6, PSMB7, PSMB8, PSMB9, PSMB10, PSMB11, proteasome (prosome macropain) 26S subunit ATPase (PSMC) 1 (PSMC1); PSMC2, PSMC3, PSMC4, PSMC5, PSMC6, proteasome (prosome macropain) 26S subunit non-ATPase (PSMD) 1 (PSMD1), PSMD2, PSMD3, PSMD4, PSMD5, PSMD6, PSMD7, PSMD8, PSMD9, PSMD10, PSMD11, PSMD12, PSMD13, and PSMD14.

In certain of the above embodiments, said capture oligonucleotides further comprise a plurality of oligonucleotide subsets targeting killer-cell immunoglobulin-like receptor (KIR) polypeptide-encoding nucleic acids ("KIR oligo subsets"), and said method further comprises the step of assigning to the sample, based on the hybridization pattern, a KIR polypeptide phenotype; wherein each of said KIR oligo subsets comprises a set of overlapping oligonucleotides that cover every single nucleotide position in the mRNA sequences coding for the KIR polypeptides from 5' to 3' and are sequentially shifted by 1-5 nucleotides from the 5' end of the preceding overlapping oligonucleotide.

In certain of the above embodiments, said capture oligonucleotides further comprise a plurality of oligonucleotide subsets targeting blood group-determining polypeptide encoding nucleic acids ("blood group determining oligo subsets"), and said method further comprises the step of assigning to the sample, based on the hybridization pattern, a blood group phenotype; wherein each of said blood group determining oligo subsets comprises a set of overlapping oligonucleotides that cover every single nucleotide position in the mRNA sequences coding for the blood group-determining polypeptides from 5' to 3' and are sequentially shifted by 1-5 nucleotides from the 5' end of the preceding overlapping oligonucleotide. In a specific embodiment, said blood group determining polypeptides are selected from the group consisting ABO (ABO), Chido Rodgers (CH/RG), Colton (CO), Cromer (CROM), Diego (DI) (band 3), Dombrock (DO), Duffy (DARC), Gerbich (Ge), Gill (GIL), Globoside and Pk, H(H), I (I), Indian (IN), John Milton Hagen (JMH), Kell (KEL) and Kx (XK), Kidd (JK), Knops (KN), Landsteiner-Wiener (LW), Lewis (LE), Lutheran (LU), MNS (MNS, Glycophorins A, B and E), Ok (OK), Raph (RAPH), Rh (RH) and Rh-gp (RHAG), Scianna (SC), T/Tn, Xg (XG), and Yt (YT).

In certain of the above embodiments, the method further comprises the step of deriving from the HLA tissue type assigned in step (d) donor/recipient transplant compatibility.

In one embodiment, the classical HLA oligo subsets comprise the sequences set forth in Table I or the normal (indicated by "HPN"), extended (indicated by "HPE") and truncated "indicated by HPT") sequences set forth in Table X. In another embodiment, the non-classical HLA oligo subsets comprise the sequences set forth in Table II. In still another embodiment, the accessory molecule oligo subsets comprise the sequences set forth in Table III. In yet another embodiment, the KIR oligo subsets comprise the sequences set forth in Table IV. In still another embodiment, the blood group determining oligo subsets comprise the sequences set forth in Table V.

In certain of the above embodiments, in each set of overlapping oligonucleotides, each oligonucleotide is sequentially shifted by 1 nucleotide from the 5' end of the preceding overlapping oligonucleotide. In another of the above embodiments, in each set of overlapping oligonucleotides, each oligonucleotide is sequentially shifted by 2 nucleotides from the 5' end of the preceding overlapping oligonucleotide. In certain other of the above embodiments, in each set of overlapping oligonucleotides, each oligonucleotide is sequentially shifted by 3 nucleotides from the 5' end of the preceding overlapping oligonucleotide. In still other of the above embodiments, in each set of overlapping oligonucleotides, each oligonucleotide is sequentially shifted by 4 nucleotides from the 5' end of the preceding overlapping oligonucleotide. In certain of the above embodiments, in each set of overlapping oligonucleotides, each oligonucleotide is sequentially shifted by 5 nucleotides from the 5' end of the preceding overlapping oligonucleotide.

In one embodiment, said sample for HLA tissue tying is obtained from a human subject. In certain embodiments, the method for HLA tissue typing comprises the step of diagnosing or predicting the likelihood of an HLA-linked genetic defect, disease, inadequate or undesirable response to a vaccine, biologic treatment (recombinant protein, biosimilar or equivalent), or infectious organism, or condition in said subject, wherein the step is based on one or more assigned tissue types or phenotypes selected from the group consisting of: a classical HLA tissue type, a non-classical HLA tissue type, an accessory molecule phenotype, a KIR polypeptide phenotype, and a blood group phenotype.

In certain of the above embodiments, the method for HLA tissue typing further comprises the step of determining the likely response of said subject to a particular treatment regimen selected from the group consisting of: bone marrow transplantation, immunosuppressive regimen, antiviral drug regimen, antiviral drug resistance, antiretroviral drug regimen, and autoimmunity drug regimen, wherein the step is based on one or more assigned phenotypes selected from the group consisting of: a classical HLA tissue type, a non-classical HLA tissue type, an accessory molecule phenotype, a KIR polypeptide phenotype, and a blood group phenotype. In certain other embodiments, the method for HLA tissue typing further comprises the step of determining whether the subject is likely to develop antiretroviral drug resistance or cancer drug regimen resistance, wherein the step is based on one or more assigned phenotypes selected from the group consisting of: a classical HLA tissue type, a non-classical HLA tissue type, an accessory molecule phenotype, a KIR polypeptide phenotype, and a blood group phenotype.

In certain of the above embodiments, said capture oligonucleotides further comprise at least one set of negative control oligonucleotides. In certain embodiments, said at least one set of negative control nucleotides comprises two or more of the nucleic acid sequences set forth in at least one of Tables VI-X.

In one embodiment, a microarray comprising a substrate having disposed thereon capture oligonucleotides comprising the nucleic acid sequences set forth in Table I is provided. In another embodiment, a microarray comprising a substrate having disposed thereon capture oligonucleotides comprising the nucleic acid sequences set forth in Table I further has disposed thereon capture oligonucleotides comprising the nucleic acid sequences set forth in Table II.

In another embodiment, a microarray comprising a substrate having disposed thereon capture oligonucleotides comprising the nucleic acid sequences set forth in Table X is provided. In another embodiment, a microarray comprising a substrate having disposed thereon capture oligonucleotides comprising the nucleic acid sequences set forth in Table X and denoted by "HPN," "HPE" or "HPT" is provided. In another embodiment, a microarray comprising a substrate having disposed thereon capture oligonucleotides comprising the nucleic acid sequences set forth in Table II is provided.

In certain of the embodiments, the microarray having disposed thereon capture oligonucleotides comprising the nucleic acid sequences set forth in Table I and/or Table II, further has disposed thereon capture oligonucleotides comprising the nucleic acid sequences set forth in one or more of Tables III-X.

Unless otherwise defined, all technical and scientific terms used herein have the same meaning as commonly understood by one of ordinary skill in the art to which this invention pertains. In case of conflict, the present document, including definitions, will control.

All publications, patent applications, patents, and other references mentioned herein are incorporated by reference in their entirety. The materials, methods, and examples disclosed herein are illustrative only and not intended to be limiting.

The details of one or more embodiments of the invention are set forth in the accompanying drawings and the description below. Preferred methods and materials are described below, although methods and materials similar or equivalent to those described herein can also be used in the practice or testing of the present invention. Other features, objects, and advantages of the invention will be apparent from the description and drawings, and from the claims.

DESCRIPTION OF DRAWINGS

FIG. 2 shows a set of oligonucleotides (P1 to P13) covering A*02:01:01:01 sequence and their corresponding negative control oligonucleotides (P1N to P13N) generated based on the consensus sequence of HLA class I sequence group. The oligonucleotide sequences shown in FIG. 2 have, from top to bottom, SEQ ID NOs: 428783-428809.

FIG. 3 shows a set of tiling capture oligonucleotides (P1 to P13) covering the A*02:01:01:01 sequence. The oligonucleotide sequences shown in FIG. 3 have, from top to bottom, SEQ ID NOs: 428810-428823.

FIG. 7 is a table displaying the maximum, minimum, mean, median, and geometric mean of the probe signals at position 31 of alignment of all HLA-A, B, C alleles.

FIG. 10 shows an example of applying a pairwise comparison method on array E1A1A1 for predicting of HLA-A alleles. (A) The input page of pairwise comparison method. A list of representative HLA-A alleles are input in the text box and array E1S1A1 is chosen. (B) Pairwise comparison is performed between each pair of the input alleles. The times of winning of one allele over the other are summarized in a table. (C) The detailed signal comparison table of A*02010101 against A*03010101. Each allele is indicated in the first column (on left); the starting nucleic acid position is shown in the second column; the oligonucleotide sequences are given in the third column, labeled "Probe", and have, numbered from top to bottom, SEQ ID NOs: 428824-428858; the melting temperature (in degrees Celsius) is shown in the fourth column; HLA coverage is shown in the fifth column and the numbers represent the number of different alleles; the sixth column shows the array signal for each oligo; and the seventh column shows the voting results—"similar" means there was no winner and if there was a winner, the winning allele is identified. (D) The final voting table summarizing the voting situation of all the alleles is shown; each individual number describes the difference between number of winning in pairwise comparison; for example 106 in the row 3 column 4 means that A*03010101 won 106 times more than A*02010101 in pairwise comparison. The values in the bottom row are the averages of all results in each column, indicating the overall voting value. The highlighted cells indicate the likely winners, which need to be checked for potential masking.

DETAILED DESCRIPTION

Overview

Figure 1:
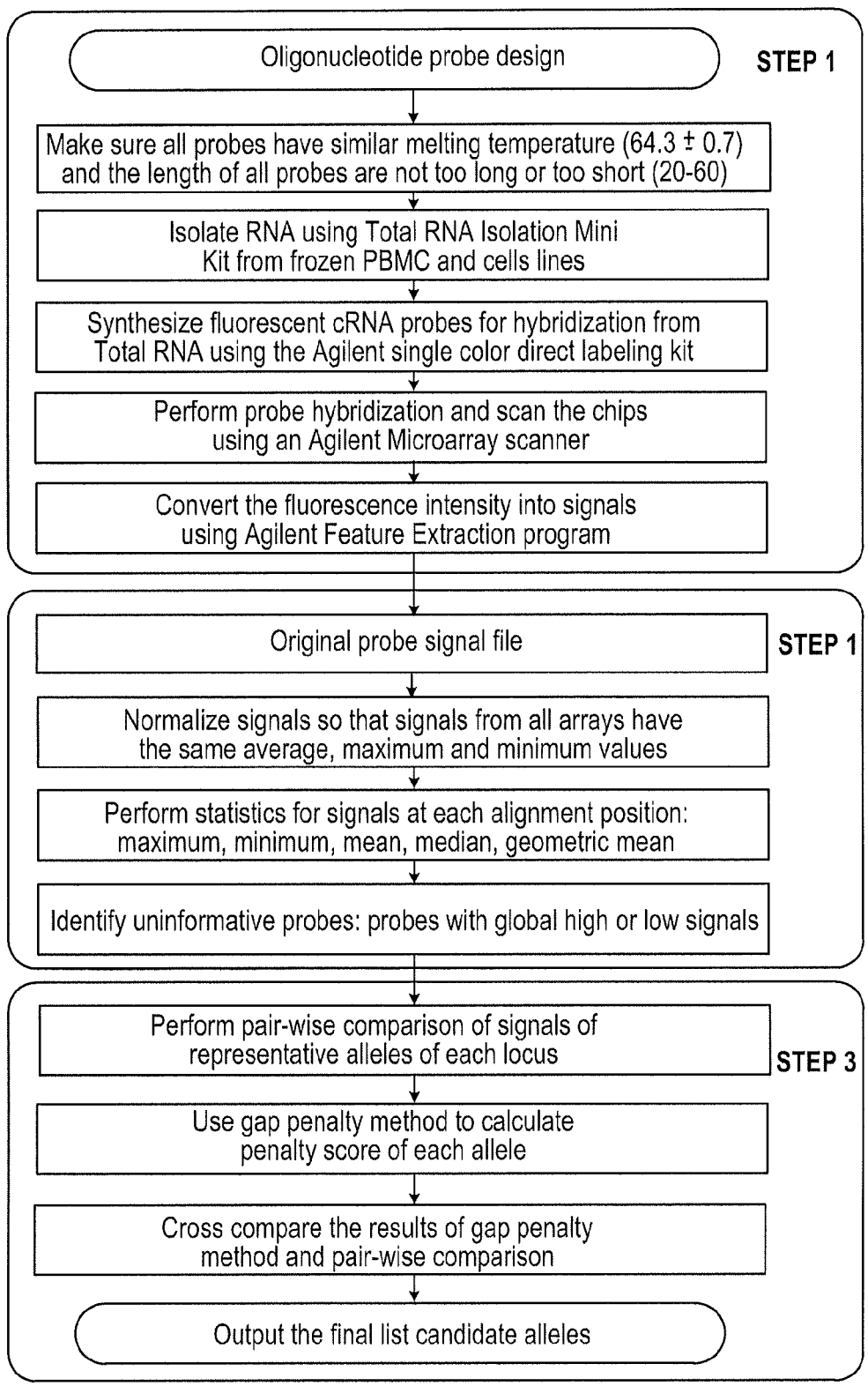
FIG. 1 is a flow chart of HLA typing using an oligonucleotide microarray. The whole process can be organized into three major steps. The first step involves oligonucleotide "probe" design and microarray experiment. The second step covers probe signal (i.e., fluorescent cRNA) preprocessing. The third step covers the signal analysis programs for identification of sample HLA profiles.

Various aspects of the invention are described below.

Provided herein are capture oligonucleotides and methods of their use for determining with high resolution the haplotypes of several families of polymorphic polypeptides. Within a specific embodiment, the polymorphic polypeptides are HLA polypeptides. Within one embodiment, the invention provides an array comprising capture oligonucleotides that target nucleic acids encoding classical HLA polypeptides. Within another embodiment, the array comprises capture oligonucleotides that target nucleic acids encoding non-classical HLA polypeptides. Within yet another embodiment, the array comprises capture oligonucleotides that target nucleic acids encoding all known classical and non-classical HLA polypeptides, and in certain embodiments, the array additionally or alternatively comprises capture oligonucleotides that target nucleic acids encoding accessory molecules important in HLA-linked peptide presentation and/or antigen processing, killer-cell immunoglobulin-like receptor (KIR) polypeptides, and/or blood group determining polypeptides. All of these different targets (e.g., classical and non-classical HLA polypeptides accessory molecules, KIR polypeptides and blood group determining polypeptides) are referred to collectively herein as "array targets."

Within certain embodiments, a key feature of the methods and oligonucleotide arrays provided herein is that they provide an efficient and accurate method for determining the HLA tissue type of a sample using a single assay (e.g., array chip). This feature provides a dramatic improvement over currently available "traditional" technologies, which are inefficient because they typically require multiple assays and follow up nucleic acid sequencing in order to determine the complete HLA tissue type of a sample.

Within certain embodiments, the arrays comprise sets of capture oligonucleotides that provide a highly dense coverage of the entire polypeptide-encoding nucleic acid sequence of each array target using an approach referred to herein as "walking." Using the "walking" approach, each oligonucleotide in a capture oligonucleotide set (i.e. a set targeting one specific array target) is sequentially shifted by about 1 to about 5 nucleotides from the 5' end of the preceding overlapping oligonucleotide. Herein, sequential shifting by 1 nucleotide is also referred to as "step 1", sequential shifting by 2 nucleotides is also referred to as "step 2", and so on. As an example of this process, if a first oligonucleotide has the sequence, ATGGCCGTCATGGCGCCCCGAAC (SEQ ID NO: 1), the next oligonucleotide in the set, if it is sequentially shifted by 1 nucleotide (i.e., a "step 1 shift") will have the sequence TGGCCGTCATGGCGCCCCGAAC (SEQ ID NO: 2), whereas if that oligonucleotide is sequentially shifted by 2 nucleotides, rather than 1, it can have the sequence GGCCGTCATGGCGCCCCGAAC (SEQ ID NO: 3), and so on. This approach produces a set of highly overlapping capture oligonucleotides, thereby providing dense coverage of each target sequence, which is important for high resolution typing of highly polymorphic genes such as HLA.

In other embodiments, the arrays comprise capture oligonucleotides that target accessory molecules important in peptide loading on HLA molecules and/or antigen processing, and/or killer-cell immunoglobulin-like receptor (KIR) polypeptides, and/or blood group determining polypeptides. In a preferred embodiment, the array comprises capture oligonucleotides that target classical HLA molecules and/or non-classical HLA molecules (such arrays being referred to herein in general as "HLA oligonucleotide arrays"), and, in addition, comprises capture oligonucleotides that target accessory molecules important in peptide loading on HLA molecules and/or antigen processing, and/or KIR polypeptides, and/or blood group determining polypeptides. The inclusion of these additional targets, e.g., certain accessory molecules, KIR polypeptides and/or blood group determining polypeptides, in the HLA oligonucleotide array provides an efficient tool for obtaining a detailed analysis of a patient sample relevant for a wide variety of immunologic applications.

For example, within certain embodiments, the arrays and methods of their use described herein are useful for diagnosing or predicting the likelihood of an HLA-linked genetic defect, disease, inadequate or undesirable response to a vaccine, biologic treatment (recombinant protein, biosimilar or equivalent), or infectious organism or condition in said subject, wherein the step is based on one or more assigned tissue types or phenotypes selected from the group consisting of: a classical HLA tissue type, a non-classical HLA tissue type, an accessory molecule phenotype, a KIR polypeptide phenotype, and a blood group phenotype.

Within another embodiment, the immunologic application of the arrays provided herein includes the ability to derive donor/recipient compatibility for bone marrow/tissue/organ transplant.

Definitions

As used herein, the term "HLA polypeptide" refers to an amino acid sequence encoded by a human leukocyte antigen ("HLA") allele. The term, "HLA haplotype" refers to a combination of specific alleles from different HLA loci expressed as a combination of HLA genes characteristic for a given individual.

As used herein, the term "all known" in the context of classical and/or non-classical HLA molecules means all of the HLA alleles for which the nucleic acid sequences are publically available at the time of assigning an HLA haplotype to a sample using the method claimed herein. The sequences are preferably, although not necessarily, available from publically accessible databases, which are constantly updated with all known sequences available, such as, e.g., the HLA database IMGT/HLA, accessible at http://www.ebi.ac.uk/imgt/hla/, the KIR database IPD-KIR, accessible at http://www.ebi.ac.uk/ipd/kir/, and the blood group antigen database accessible at http://www.ncbi.nlm.nih.gov/projects/gv/mhc/xslcgi.cgi?cmd=bgmut/systems. Allele sequences for, e.g., accessory molecules and other molecules, are also available at GenBank® (National Institutes of Health (NIH) genetic sequence database), available at http://www.ncbi.nlm.nih.gov/).

The term "tissue typing" as used herein refers to determining which of a number of isoforms and alleles of one or more families of polymorphic protein molecules are expressed in a cell (e.g., tissue). Such families include, for example, classical HLA polypeptides, non-classical HLA polypeptides, KIR polypeptides, accessory molecule polypeptides, and blood group determining polypeptides.

The terms "HLA typing" and "HLA tissue typing" are used interchangeably herein, and refer to the process that identifies the specific allele expressed for each gene at one or more of the HLA-A, HLA-B, HLA-C, HLA-DR, HLA-DQ, and HLA-DP (classical HLA) gene loci in a sample (e.g., cells such as white blood cells, or cells derived from tissues). The process described by these terms can also, but does not necessarily, include identifying the specific allele expressed for each gene at one or more of the HLA-E, HLA-F, HLA-G, DM, DO, and MIC (non-classical HLA) gene loci.

The term "nucleic acid hybridization" refers to the pairing of complementary strands of nucleic acids. The mechanism of pairing involves hydrogen bonding, which may be Watson-Crick, Hoogsteen or reversed Hoogsteen hydrogen bonding, between complementary nucleoside or nucleotide bases (nucleobases) of the strands of nucleic acids. For example, adenine and thymine are complementary nucleobases that pair through the formation of hydrogen bonds. Hybridization can occur under varying circumstances. Nucleic acid molecules are "hybridizable" to each other when at least one strand of one nucleic acid molecule can form hydrogen bonds with the complementary bases of another nucleic acid molecule under defined stringency conditions. Stringency of hybridization is determined, e.g., by (i) the temperature at which hybridization and/or washing is performed, and (ii) the ionic strength and (iii) concentration of denaturants such as formamide of the hybridization and washing solutions, as well as other parameters. Hybridization requires that the two strands contain substantially complementary sequences. Depending on the stringency of hybridization, however, some degree of mismatches may be tolerated. Under "low stringency" conditions, a greater percentage of mismatches are tolerable (i.e., will not prevent formation of an anti-parallel hybrid). See Molecular Biology of the Cell, Alberts et al., 3rd ed., New York and London: Garland Publ., 1994, Ch. 7.

Typically, hybridization of two strands at high stringency requires that the sequences exhibit a high degree of complementarity over an extended portion of their length. Examples of high stringency conditions include: hybridization to filter-bound DNA in 0.5 M NaHPO4, 7% SDS, 1 mM EDTA at 65° C., followed by washing in 0.1×SSC/0.1% SDS (where 1×SSC is 0.15 M NaCl, 0.15 M Na citrate) at 68° C. or for oligonucleotide (oligo) inhibitors washing in 6×SSC/0.5% sodium pyrophosphate at about 37° C. (for 14 nucleotide-long oligos), at about 48° C. (for about 17 nucleotide-long oligos), at about 55° C. (for 20 nucleotide-long oligos), and at about 60° C. (for 23 nucleotide-long oligos).

Conditions of intermediate or moderate stringency (such as, for example, an aqueous solution of 2×SSC at 65° C.; alternatively, for example, hybridization to filter-bound DNA in 0.5 M NaHPO4, 7% SDS, 1 mM EDTA at 65° C. followed by washing in 0.2×SSC/0.1% SDS at 42° C.) and low stringency (such as, for example, an aqueous solution of 2×SSC at 55° C.), require correspondingly less overall complementarity for hybridization to occur between two sequences. Specific temperature and salt conditions for any given stringency hybridization reaction depend on the concentration of the target DNA or RNA molecule and length and base composition of the probe, and are normally determined empirically in preliminary experiments, which are routine (see Southern, J. Mol. Biol. 1975; 98:503; Sambrook et al., Molecular Cloning: A Laboratory Manual, 2nd ed., vol. 2, ch. 9.50, CSH Laboratory Press, 1989; Ausubel et al. (eds.), 1989, Current Protocols in Molecular Biology, Vol. I, Green Publishing Associates, Inc., and John Wiley & Sons, Inc., New York, at p. 2.10.3). An extensive guide to the hybridization of nucleic acids is found in, e.g., Tijssen (1993) Laboratory Techniques in Biochemistry and Molecular Biology—Hybridization with Nucleic Acid Probes part I, chapt 2, "Overview of principles of hybridization and the strategy of nucleic acid probe assays," Elsevier, N.Y. ("Tijssen").

As used herein, the term "standard hybridization conditions" refers to hybridization conditions that allow hybridization of two nucleotide molecules having at least 50% sequence identity. According to a specific embodiment, hybridization conditions of higher stringency may be used to allow hybridization of only sequences having at least 75% sequence identity, at least 80% sequence identity, at least 90% sequence identity, at least 95% sequence identity, or at least 99% sequence identity.

As used herein, the phrase "under hybridization conditions" means conditions under conditions that facilitate specific hybridization of a subset of capture oligonucleotides to complementary sequences present in the cDNA or cRNA. The terms "hybridizing specifically to" and "specific hybridization" and "selectively hybridize to," as used herein refer to the binding, duplexing, or hybridizing of a nucleic acid molecule preferentially to a particular nucleotide sequence under at least moderately stringent conditions, and preferably, highly stringent conditions, as discussed above.

As used herein, the term "complementary sequence," when referring to a nucleic acid sequence, refers to the nucleic acid base sequence that can form a double-stranded structure (duplex) by matching bases to bases in a reference sequence. For example, the complementary sequence to the reference sequence G-T-A-C is C-A-T-G (SEQ ID NOs: 428859 and 428860, respectively). Within certain embodiments, a complementary sequence can have mismatches at certain nucleic acid residues with the reference sequence. In contrast, as used herein, the "exact complement" of a reference nucleic acid sequence refers to a complementary sequence that contains no base mismatches with the reference sequence.

As used herein, the term "hybridization pattern" refers to the raw data of a microarray assay, wherein, for example, the detectably labeled nucleic acid sample (e.g., cDNA or cRNA), or detectably labeled detection probes bound to nucleic acids (cDNA or cRNA sample) hybridized to capture oligonucleotides on the array, are detected in a specific pattern of detectable signal, the specific pattern being determined by which nucleic acid targets are present in the tested sample. Hybridization patterns of different samples can also be compared visually, as long as the samples are hybridized to microarray slides having capture oligonucleotides spotted on the slides in identical locations. Hybridization patterns can be determined using, e.g., pattern recognition algorithms.

As used herein, the term "classical HLA oligo subset" refers to a collection of capture oligonucleotides, the nucleic acid sequences of which collectively represent the nucleic acid sequence encoding a classical HLA polypeptide (e.g., a nucleic acid sequence encoding a specific HLA-A allele (e.g., HLA-A*0101 or HLA-A*0201)). As used herein, the term "non-classical HLA oligo subset" refers to a collection of capture oligonucleotides, the nucleic acid sequences of which collectively represent the nucleic acid sequence encoding a non-classical HLA polypeptide (e.g., a nucleic acid sequence encoding a specific HLA-E allele (e.g., HLA-E* 0101 or HLA-E* 0103)). Similarly, the term "accessory molecule oligo subset" refers to a collection of capture oligonucleotides, the nucleic acid sequences of which collectively represent the nucleic acid sequence encoding a target accessory molecule polypeptide; the term "KIR oligo subset" refers to a collection of capture oligonucleotides, the nucleic acid sequences of which collectively represent the nucleic acid sequence encoding a target KIR polypeptide; and the term "blood group determining oligo subset" refers to a collection of capture oligonucleotides, the nucleic acid sequences of which collectively represent the nucleic acid sequence encoding a target blood group determining polypeptide.

The term, "collectively target(s)" with reference to a set of capture oligonucleotides, means that, taking the entire set together, the nucleic acid sequences of the set are complementary to the full length nucleic acid sequence of their target.

As used herein, the terms "KIR polypeptide phenotype" refers to a specific set of KIR alleles expressed by a sample (e.g., cell), as determined according to the methods described herein.

As used herein, the term "blood group phenotype" refers to the specific blood group of a sample (e.g., cell), including ABO (ABO), Chido Rodgers (CH/RG), Colton (CO), Cromer (CROM), Diego (DI) (band 3), Dombrock (DO), Duffy (DARC), Gerbich (Ge), Gill (GIL), Globoside and Pk, H(H), I (I), Indian (IN), John Milton Hagen (JMH), Kell (KEL) and Kx (XK), Kidd (JK), Knops (KN), Landsteiner-Wiener (LW), Lewis (LE), Lutheran (LU), MNS (MNS)

(Glycophorins A, B and E), Ok (OK), Raph (RAPH), Rh (RH) and Rh-gp (RHAG), Scianna (SC), T/Tn, Xg (XG), and Yt (YT), as determined according to the methods described herein. The term can also, but does not necessarily, encompass a blood group subtype, such as subtype A1 or A2.

As used herein, the term "deriving donor/recipient transplant compatibility" means determining whether a tissue (cell, organ, skin, etc.) from a potential donor is suitable for transplantation into a recipient. Typically, a suitable donor will have an HLA tissue type that is compatible (i.e. the same or highly similar) to that of the transplant recipient.

"Polypeptide" and "protein" are used interchangeably and mean any peptide-linked chain of amino acids, regardless of length or post-translational modification.

As used herein, the term "allele" refers to a specific version of a nucleotide sequence of a polymorphic gene.

As used herein, the term "nucleic acid" or "oligonucleotide" refers to a deoxyribonucleotide or ribonucleotide in either single- or double-stranded form. The term also encompasses nucleic-acid-like structures with synthetic backbones. DNA backbone analogues provided by the invention include phosphodiester, phosphorothioate, phosphorodithioate, methylphosphonate, phosphoramidate, alkyl phosphotriester, sulfamate, 3'-thioacetal, methylene(methylimino), 3'-N-carbamate, morpholino carbamate, and peptide nucleic acids (PNAs); see Oligonucleotides and Analogues, a Practical Approach, edited by F. Eckstein, IRL Press at Oxford University Press (1991); Antisense Strategies, Annals of the New York Academy of Sciences, Volume 600, Eds. Baserga and Denhardt (NYAS1992); Milligan (1993) J. Med. Chem. 36:1923-1937; Antisense Research and Applications (1993, CRC Press). PNAs contain non-ionic backbones, such as N-(2-aminoethyl) glycine units. Phosphorothioate linkages are described in WO 97/03211; WO 96/39154; Mata (1997) Toxicol. Appl. Pharmacol. 144:189-197. Other synthetic backbones encompassed by the term include methyl-phosphonate linkages or alternating methylphosphonate and phosphodiester linkages (Strauss-Soukup (1997) Biochemistry 36:8692-8698), and benzylphosphonate linkages (Samstag (1996) Antisense Nucleic Acid Drug Dev 6:153-156). The term nucleic acid is used interchangeably with cDNA, cRNA, mRNA, oligonucleotide, probe and amplification product.

As used herein, the term "capture oligonucleotide" refers to a nucleic acid sequence that specifically hybridizes to a target nucleic acid sequence (e.g., cDNA or cRNA). A capture oligonucleotide is intended to be hybridized to a solid support (e.g., microarray slide) for the detection of the presence of a particular target sequence (e.g., cDNA or cRNA). One of skill will recognize that the precise sequence of the particular capture oligonucleotides described herein can be modified to a certain degree to produce capture oligonucleotides that are "substantially identical" to the disclosed capture oligonucleotides, but retain the ability to specifically bind to (i.e., hybridize specifically to) the same targets or samples as the capture oligonucleotide from which they were derived. Such modifications are specifically covered by reference to the individual capture oligonucleotides described herein.

The word "sample" may be used herein to refer not only to detected nucleic acids, but to the detectable nucleic acids in the form in which they are applied to the target.

The terms "probe", "detection probe", or "nucleic acid probe", as used herein, are defined to be a collection of one or more nucleic acid fragments whose hybridization to a sample can be detected. The probe may be unlabeled or labeled as described below so that its binding to the target or sample can be detected. The probe is produced from a source of nucleic acids from one or more particular (preselected) portions of the genome, e.g., one or more clones, an isolated whole chromosome or chromosome fragment, or a collection of polymerase chain reaction (PCR) amplification products. Alternatively, the probes of the present invention are synthesized and have sequences corresponding to a source of nucleic acids. The probes of the present invention correspond to or are produced from nucleic acids found in the regions described herein. The probe or genomic nucleic acid sample may be processed in some manner, e.g., by removal of repetitive nucleic acids or enrichment with unique nucleic acids. "Probe signal" means the level of fluorescence measured (e.g., by optical scanner) from hybridized oligonucleotides on the array.

One of skill will recognize that the precise sequence of the particular probes described herein can be modified to a certain degree to produce probes that are "substantially identical" to the disclosed probes, but retain the ability to specifically bind to (i.e., hybridize specifically to) the same targets or samples as the probe from which they were derived (see discussion above). Such modifications are specifically covered by reference to the individual probes described herein.

The terms "nucleic acid array," "array" and "microarray", as used herein, refer to a plurality of nucleic acid molecules (capture oligonucleotides) immobilized on a solid surface (e.g., nitrocellulose, glass, quartz, fused silica slides and the like) to which sample nucleic acids (e.g., cDNA or cRNA) are hybridized. The nucleic acids may contain sequence from specific genes or clones, such as the capture oligonucleotides of the invention, as disclosed herein. Other capture oligonucleotides optionally contain, for instance, reference sequences. The capture oligonucleotides of the arrays may be arranged on the solid surface at different densities. The capture oligonucleotides densities will depend upon a number of factors, such as the nature of the label, if any, the solid support, and the like.

An "isolated nucleic acid molecule" (e.g., isolated cDNA) is either (1) a nucleic acid molecule that contains sequence not identical to that of any naturally occurring sequence, or (2), in the context of a nucleic acid molecule with a naturally-occurring sequence (e.g., a cDNA, cRNA or genomic DNA), a nucleic acid molecule free of at least one of the genes that flank the gene containing the nucleic acid molecule of interest in the genome of the organism in which the gene containing the nucleic acid molecule of interest naturally occurs. The term also includes a separate molecule such as: a cDNA where the corresponding genomic DNA has introns and therefore a different sequence; a genomic fragment that lacks at least one of the flanking genes; a fragment of cDNA or genomic DNA produced by polymerase chain reaction (PCR) and that lacks at least one of the flanking genes; a restriction fragment that lacks at least one of the flanking genes; a nucleic acid molecule encoding a non-naturally occurring protein such as a fusion protein, mutein, or fragment of a given protein; and a nucleic acid which is a degenerate variant of a cDNA or a naturally occurring nucleic acid. In addition, it includes a recombinant nucleotide sequence that is part of a hybrid gene, i.e., a gene encoding a non-naturally occurring fusion protein. It will be apparent from the foregoing that an isolated nucleic acid molecule does not mean a nucleic acid molecule present among hundreds to millions of other nucleic acid molecule molecules within, for example, cDNA or genomic DNA libraries or genomic DNA restriction digests in, for example, a restriction digest reaction mixture or an electrophoretic gel slice.

The term "subject" means any animal, including mammals and, in particular, humans.

Human Leukocyte Antigen (HLA) Polypeptides

The human major histocompatibility genes are among the most polymorphic genes in the human genome. HLA antigens are encoded by a series of closely linked genes located at the position p21 on chromosome 6. Genes of the HLA region span approximately 4 million bases of DNA, and are clustered into three distinct regions designated class I, class II and class III. Genes within the class I and class II regions share structural and functional properties and are considered to be part of the immunoglobulin gene super family. Although distinct in sequence and structure, both class I and class II genes encode proteins that are critical in controlling T-cell recognition and determining histocompatibility in marrow transplantation (Rammensee, Curr. Opin. Immunol. 7:85-96 (1995)).

At least 17 loci including several pseudogenes exist in the HLA class I region. Three of these loci encode HLA-A, -B and -C alloantigens that constitute the major class I determinants The HLA-A, -B and -C loci show a striking degree of sequence and structural homology with one another and genes at all three loci are highly polymorphic (Bodmer et al., Tissue Antigens 49:297-321 (1997)). Currently, more than 1,193 HLA-A, 1,799 HLA-B and 829 HLA-C alleles have been described worldwide, and in the U.S. alone, more than 9.7 million different haplotype combinations have been estimated (Maiers et al., Hum Immunol 2007; 68:779-88). More recently, three additional class I genes, HLA-E (9 alleles), -F (21 alleles) and -G (46 alleles), have been defined (Lee et al., Eur J. Immunol. 40:2308-18. (2010); Geraghty et al., Proc. Natl. Acad. Sci. USA 84:9145-49. 54 (1987); Koller et al., J. Immunol. 141:897-904 (1988)).

Class II genes are divided into five families, designated DR, DQ, DO, DM and DP, based on their degree of sequence homology and their location within the HLA-D region. The HLA class II region is comprised of nine distinct genes: DRA, DRB1, DRB3, DRB4, DRB5, DQA, DQB, DPA and DPB. As with class I genes, class II DR, DQ and DP genes show a striking degree of polymorphism, with more than 805 alleles thus far defined at the DRB1 locus (Marsh S G, Hum Immunol, (2010)).

In certain embodiments, the microarrays described herein detect expression of non-classical HLA molecules. Examples of non-classical HLA molecules include without limitation, CD1a-c, CD1d, HLA-E, HLA-G, HLA-H, HLA-J, HLA-K, HLA-L, DM, DOα, DOβ, ULBP, EPCR, MR1, FcRn, HFE, ZAG, and MIC. Preferably, the non-classical HLA molecules detected by the arrays provided herein include at least HLA-E, HLA-F, HLA-G, DM, DO and MIC, although a greater or fewer number of non-classical HLA targets can be included on the arrays.

Role of HLA in Infectious Disease

When a foreign pathogen enters the body, antigen-presenting cells (APCs) engulf the pathogen through a process called phagocytosis. Proteins from the pathogen are digested into peptides and loaded onto HLA molecules (specifically MHC class II). The peptides are then displayed by the APCs to T cells, which then produce a variety of effects to eliminate the pathogen. Through a similar process, proteins (both native and foreign, such as the proteins of viruses) produced inside most cells are displayed on HLA antigens (specifically MHC class I) on the cell surface. Infected cells can be recognized and destroyed by components of the immune system (specifically CD8+ T cells).

Peptides, such as, e.g., infection or disease-related peptides fit into the binding clefts of HLA molecules, and, in these configurations, peptides are presented to T cells. The T cells are restricted by the HLA molecules when certain peptides are within the binding cleft. Each HLA molecule, however, is limited in the number of peptides (e.g. disease or infection related peptides) that it can bind. Thus, an individual's specific combination of different HLA molecules (i.e., "HLA tissue type"), which increases the peptide binding repertoire, is important for how an individual's immune system can respond to infection. The ability to precisely characterize an individual's HLA tissue type can therefore facilitate understanding of how an individual's immune system can respond to a particular infection. A large number of studies have reported correlation with specific HLA profiles and susceptibility to or severity of disease.

Role of HLA in Graft Rejection

Transplant rejection occurs when a transplanted organ or tissue is not accepted by the body of the transplant recipient, typically because the transplanted organ or tissue is recognized by the recipient's immune system as non-self. Any cell displaying an HLA type not expressed by the recipient is recognized as "non-self", resulting in the rejection of the tissue bearing those cells. Thus, it is imperative that tools and methods for carrying out HLA tissue typing with precision and efficiency in order to quickly determine whether a potential donor has an HLA tissue type that is compatible with that of a recipient.

Role of HLA in Autoimmunity

HLA types are inherited, and some of them are connected with autoimmune disorders and other diseases. People with certain HLA tissue types are more likely to develop certain autoimmune diseases, such as Type I Diabetes, Rheumatoid arthritis, Ankylosing spondylitis, Celiac Disease, SLE (Systemic Lupus Erythematosus), Myasthenia Gravis, inclusion body myositis and Sjögren's syndrome. For example, in Celiac disease, HLA tissue typing is the only effective means of discriminating between $1^{st}$ degree relatives who are at risk from those who are not, prior to the appearance of sometimes irreversible symptoms such as allergies and secondary autoimmune disease. For HLA typing to lead to some improvement and acceleration in the diagnosis of Celiac Disease and Type 1 diabetes, DQ2 typing is necessary. However, for DQ2 typing to be useful it requires either high resolution B1*typing (resolving *0201 from *0202), DQA1*typing, or DR serotyping. Thus, the arrays provided herein, which provide high resolution typing of classical HLA polypeptides, and preferably, all known classical HLA polypeptides, are useful for diagnosing such disorders.

Role of HLA in Cancer

Some HLA mediated diseases are directly involved in the promotion of cancer. For example, gluten sensitive enteropathy is associated with increased prevalence of enteropathy-associated T-cell lymphoma, and DR3-DQ2 homozygotes are within the highest risk group with close to 80% of gluten sensitive EATL cases. Thus, the arrays provided herein are useful in diagnosing, e.g., an individual's risk of developing cancer based on the assigned HLA tissue type of the individual (see, e.g., Luigi De Petris, et al. Medical Oncology, Volume 21, Number 1, 49-52, DOI: 10.1385/MO:21:1:49; Lin P, et al. Cancer Epidemiol Biomarkers Prev. 2001 October; 10(10):1037-45; Michallet et al, Leukemia. 10:1725-31, (2010)).

Accessory Molecules

In certain embodiments, the microarrays described herein can detect expression of accessory molecules important in HLA-linked peptide presentation and/or antigen processing, including, for example, and without limitation, LMP2, LMP7, LMP10, tripeptidyl peptidase II (TPPII), bleomycin hydrolase (BLMH), leucine aminopeptidase 3 (LAP3), transporter associated with antigen processing (TAP) 1, TAP2, β2-microglobulin, TAP binding protein (tapasin), calnexin (CANX), calreticulin (CALR), protein disulfide isomerase family A member 2 (PDIA2), protein disulfide isomerase family A member 3 (PDIA3), ERp57, endoplasmic reticulum aminopeptidase (ERAP) 1, ERAP2, proteasome (prosome macropain) subunit althap (PSMA) type I (PSMA1), PSMA2, PSMA3, PSMA4, PSMA5, PSMA6, PSMA7, PSMA8, proteasome (prosome macropain) subunit beta (PSMB) type 1 (PSMB1), PSMB2, PSMB3, PSMB4, PSMB5, PSMB6, PSMB7, PSMB8, PSMB9, PSMB10, PSMB11, proteasome (prosome macropain) 26S subunit ATPase (PSMC) 1 (PSMC1); PSMC2, PSMC3, PSMC4, PSMC5, PSMC6, proteasome (prosome macropain) 26S subunit non-ATPase (PSMD) 1 (PSMD1), PSMD2, PSMD3, PSMD4, PSMD5, PSMD6, PSMD7, PSMD8, PSMD9, PSMD10, PSMD11, PSMD12, PSMD13, and PSMD14. These molecules are summarized by the following nomenclature: CANX, ERAP1-2, B2M, CALR, PDIA2,3, PSMA1-8, PSMB1-11, PSMC1-6, PSMD1-14, TAP1,2, TAPBP, TPP2, BLMH, and LAP3.

In a preferred embodiment, the arrays provided herein can simultaneously determine HLA tissue type and an accessory molecule phenotype (expression of one or more accessory molecules important in peptide loading and/or antigen processing) in a single assay (e.g. on a single microarray slide). However, in other embodiments, the array specific for detecting expression of such accessory molecules can be carried out separately (e.g., on a separate microarray slide and/or in a separate assay). Within one embodiment, arrays comprising both HLA oligonucleotides (classical and/or non-classical HLA oligonucleotides) and accessory molecule oligonucleotides targeting, e.g., the accessory molecules described above, are useful for determining donor/recipient transplant compatibility.

Within other embodiments, such combined HLA/accessory molecule arrays are useful for diagnosing or predicting the likelihood of an HLA-linked genetic defect, disease, inadequate or undesirable response to a vaccine, biologic treatment (recombinant protein, biosimilar or equivalent), or infectious organism, or condition in a subject, wherein the step is based on one or more assigned HLA tissue types (including classical and/or non-classical HLA alleles) and an accessory molecule phenotype.

Within other embodiments, such combined HLA/accessory molecule arrays are useful for determining the likely response of a subject to a particular treatment regimen selected from the group consisting of: bone marrow transplantation, immunosuppressive regimen, antiviral drug regimen, antiviral drug resistance, antiretroviral drug regimen, and autoimmunity drug regimen, wherein the step is based on one or more assigned HLA tissue types (including classical and/or non-classical HLA alleles) and an accessory molecule phenotype.

Within other embodiments, such combined HLA/accessory molecule arrays are useful for determining whether the subject is likely to develop antiretroviral drug resistance or cancer drug regimen resistance, wherein the step is based on one or more assigned HLA tissue types (including classical and/or non-classical HLA alleles) and an accessory molecule phenotype.

Killer-cell Immunoglobulin-Like Receptor (KIR) Molecules

Killer-cell immunoglobulin-like receptors (KIR molecules) are a family of cell surface proteins found on natural killer (NK) cells. KIR molecules regulate the killing function of NK cells by interacting with MHC class I molecules, which are expressed on all cell types. This interaction allows them to detect virally infected cells or tumor cells that have a characteristic low level of Class I MHC on their surface. Most KIR molecules are inhibitory, meaning that their recognition of MHC suppresses the cytotoxic activity of the NK cell. Only a limited number of KIRs have the ability to activate cells. KIR genes are highly polymorphic, so that different individuals possess different arrays/repertoires of KIR genes. The polymorphic KIR genes are found in a cluster on chromosome 19q13.4 within the 1 Mb leukocyte receptor complex (LRC). The gene content of the KIR gene cluster varies among haplotypes, although several "framework" genes are found in all haplotypes (KIR3DL3, KIR3DP1, KIR3DL4, KIR3DL2). The KIR proteins are classified by the number of extracellular immunoglobulin domains (2D or 3D) and by whether they have a long (L) or short (S) cytoplasmic domain. KIR proteins with the long cytoplasmic domain transduce inhibitory signals upon ligand binding via an immune tyrosine-based inhibitory motif (ITIM), while KIR proteins with the short cytoplasmic domain lack the ITIM motif and instead associate with the TYRO protein tyrosine kinase binding protein to transduce activating signals. The ligands for several KIR proteins are subsets of HLA class I molecules; thus, KIR proteins are thought to play an important role in regulation of the immune response.

KIR involvement in tissue transplant has been reported. Specifically, it has been reported that certain combinations of HLA and KIR haplotypes may affect outcome in T-cell depleted haematopoietic stem cell transplantation (HSCT) (Chen, C. et al. Bone Marrow Transplantation (2006) 38, 437-444). Thus, the determination of the KIR phenotype of an individual can be useful for determining donor/recipient transplant compatibility. Examples of KIR molecules, the expression of which can be determined by the assays and method provided herein, include without limitation, KIR 2DL1, 2DL2, 2DL3, 3DL1, 3DL2, 2DS1, 2DS2, 2DS3, 2DS4, 2DS5, and 3DS1. Furthermore, within certain embodiments, the present arrays provide the ability to simultaneously determine both HLA tissue type and KIR haplotype of a sample on a single array, which provides a highly efficient and informative assay for determining donor/recipient compatibility, in addition to other diagnostic uses. For example, within certain embodiments, such combined HLA/KIR polypeptide arrays are useful for diagnosing or predicting the likelihood of an HLA-linked genetic defect, disease, inadequate or undesirable response to a vaccine, biologic treatment (recombinant protein, biosimilar or equivalent), or infectious organism, or condition in a subject, wherein the step is based on one or more assigned HLA tissue types (including classical and/or non-classical HLA alleles) and a KIR phenotype.

Within other embodiments, such combined HLA/KIR polypeptide arrays are useful for determining the likely response of a subject to a particular treatment regimen selected from the group consisting of: bone marrow transplantation, immunosuppressive regimen, antiviral drug regimen, antiviral drug resistance, antiretroviral drug regimen, and autoimmunity drug regimen, wherein the step is based on one or more assigned HLA tissue types (including classical and/or non-classical HLA alleles) and a KIR phenotype.

Within other embodiments, such combined HLA/KIR polypeptide arrays are useful for determining whether the subject is likely to develop antiretroviral drug resistance or cancer drug regimen resistance, wherein the step is based on one or more assigned HLA tissue types (including classical and/or non-classical HLA alleles) and KIR phenotype.

Blood Group Determining Molecules

Distinct molecules called agglutinogens are attached to the surface of red blood cells. There are two different types of agglutinogens, type "A" and type "B". Each type has different properties. The ABO blood type classification system uses the presence or absence of these molecules to categorize blood into four types: A, B, AB, and O. In each individual, two alleles encoding the enzymes responsible for determining blood group antigens are inherited, one from each parent. The possible combinations of alleles produce blood types in the following way: AA, AB, AO, BA BB, BO, OA, OB, OO. The A and B antigen molecules on the surface of red blood cells are produced by two different enzymes. These two enzymes are encoded by different versions, or alleles, of the same gene: A and B.

The A and B alleles code for enzymes that produce the type A and B antigens respectively. The A allele encodes a glycosyltransferase that bonds α-N-acetylgalactosamine to the D-galactose end of the H antigen, producing the A antigen. The B allele encodes a glycosyltransferase that joins α-D-galactose bonded to the D-galactose end of the H antigen, creating the B antigen. A third version of this gene, the O allele, contains a deletion of a single nucleotide (guanine at position 261 in exon 6), which results in loss of enzymatic activity of the encoded protein, thereby leading to failure to modify the H antigen.

Another level of specificity is added to blood type by examining the presence or absence of the Rh protein. Each blood type is either positive "+" (has the Rh protein) or negative "−" (no Rh protein). For example, a person whose blood type is "A positive" (A +), has both type A and Rh proteins on the surface of their red blood cells.

Determining the blood type of a sample, in addition to the HLA tissue type can be useful, e.g., for the determination of donor/recipient compatibility for e.g., tissue transplant. The arrays provided herein provide an efficient method for simultaneously determining both HLA tissue type and blood group in a single assay. In the transplant field, in particular, it is critical that donor/recipient compatibility results be obtained as quickly and cost-efficiently as possible, and the efficiency of the arrays provided herein address that need.

Further, the A, B and O blood types also contain subgroups. For example, there are six common alleles in white individuals of the ABO gene that produce one's blood type, including A101 (A1), A201 (A2), B101 (B1), O01 (O1), O02 (O1v), and O03 (O2). The different blood groups, and in some cases specific subgroups, can be associated with different diseases, and thus, determining the specific allele of a cell can be important for determining disease susceptibility. For example, O group compared to non-O group (A, AB, and B) individuals have a 14% reduced risk of squamous cell carcinoma and 4% reduced risk of basal cell carcinoma. O group is also associated with a reduced risk of pancreatic cancer. Further, the B antigen is linked with increased risk of ovarian cancer, and gastric cancer has been reported to be more common in blood group A and least in group O.

Non-limiting examples of blood group determining molecules that can be determined according to the arrays and methods provided herein include ABO (ABO), Chido Rodgers (CH/RG), Colton (CO), Cromer (CROM), Diego (DI) (band 3), Dombrock (DO), Duffy (DARC), Gerbich (Ge), Gill (GIL), Globoside and Pk, H (H), I (I), Indian (IN), John Milton Hagen (JMH), Kell (KEL) and Kx (XK), Kidd (JK), Knops (KN), Landsteiner-Wiener (LW), Lewis (LE), Lutheran (LU), MNS (MNS, Glycophorins A, B and E), Ok (OK), Raph (RAPH), Rh (RH) and Rh-gp (RHAG), Scianna (SC), T/Tn, Xg (XG), and Yt (YT).

Within certain embodiments, the characterization of blood group determining molecules by the arrays and methods provided herein are useful, e.g., in the context of blood transfusions. Prior to blood transfusion, the compatibility of the blood donor and recipient is dependent upon the blood group factors mentioned above. Compatibility is a clinical necessity due to the fatal consequences of blood agglutination which can result from incompatibility. By determining these factors of both donor and recipient using the array and methods herein, compatible donors can be selected.

Solid Supports

The solid supports, e.g., microarray slides, used in the present invention may be biological, nonbiological, organic, inorganic, or a combination of any of these, existing as particles, strands, precipitates, gels, sheets, tubing, spheres, containers, capillaries, pads, slices, films, plates, slides, etc. The solid support is preferably flat but may take on alternative surface configurations. For example, the solid support may contain raised or depressed regions on which synthesis takes place. In some embodiments, the solid support will be chosen to provide appropriate light-absorbing characteristics. For example, the support may be a polymerized Langmuir Blodgett film, functionalized glass, Si, Ge, GaAs, GaP, $SiO_2$, $SiN_4$, modified silicon, or any one of a variety of gels or polymers such as (poly)tetrafluoroethylene, (poly)vinylidendifluoride, polystyrene, polycarbonate, or combinations thereof. Other suitable solid support materials will be readily apparent to those of skill in the art. Preferably, the surface of the solid support will contain reactive groups, which could be carboxyl, amino, hydroxyl, thiol, or the like. More preferably, the surface will be optically transparent and will have surface Si—OH functionalities, such as are found on silica surfaces.

Linking Groups

Attached to the solid support is an optional spacer or linking group. The spacer molecules are preferably of sufficient length to permit the capture oligonucleotides in the completed array to interact freely with molecules exposed to the array. The spacer molecules, when present, are typically 6-50 atoms long to provide sufficient exposure for the attached probes. The spacer will typically be comprised of a surface attaching portion and a longer chain portion. The surface attaching portion is that part of the linking group or spacer which is directly attached to the solid support. This portion can be attached to the solid support via carbon-carbon bonds using, for example, supports having (poly)trifluorochloroethylene surfaces, or preferably, by siloxane bonds (using, for example, glass or silicon oxide as the solid support). Siloxane bonds with the surface of the support are formed in one embodiment via reactions of surface attaching portions bearing trichlorosilyl or trialkoxysilyl groups. The surface attaching groups will also have a site for attachment of the longer chain portion. For example, groups which are suitable for attachment to a longer chain portion would include amines, hydroxyl, thiol, and carboxyl. Preferred surface attaching portions include aminoalkylsilanes and hydroxyalkylsilanes. In particularly preferred embodiments, the surface attaching portion of the linking group is either aminopropyltriethoxysilane or aminopropyltrimethoxysilane.

The longer chain portion can be any of a variety of molecules which are inert to the subsequent conditions necessary for attaching the oligonucleotide probes, or for hybridization of a sample to the oligonucleotide array. These longer chain portions will typically be ethylene glycol oligomers containing 2-14 monomer units, diamines, diacids, amino acids, peptides, or combinations thereof. In some embodiments, the longer chain portion is a polynucleotide (e.g., a 15-mer of poly dT). Additionally, for use in synthesis of the oligonucleotide arrays, the linking group will typically have a protecting group, attached to a functional group (i.e., hydroxyl, amino or carboxylic acid) on the distal or terminal end of the chain portion (opposite the solid support). After deprotection and coupling, the distal end is covalently bound to a capture oligonucleotide (e.g., an HLA-A capture oligonucleotide).
Synthesis of Oligonucleotide Arrays on Solid Supports The attachment of nucleic acids or oligonucleotide molecules to solid supports to create highly dense patterns of diverse capture oligonucleotides on a single surface has been demonstrated by, for example, Maskos and Southern (Nuc. Acids. Res. 20:1679-1684 (1992)), Blanchard and Hood (Bioelectronics 11:687-690 (1996)), and Fodor et al. (Science 251:767-773 (1991)). For example, two methodologies that have been used to synthesize oligonucleotide arrays are described by Saiki et al. (Proc. Natl. Acad. Sci. USA. 86:6230-6234 (1989)) and Chrisey et al. (Nuc. Acids Res. 24:3040-3047 (1996)). Presynthesized capture oligonucleotides can be delivered to a solid support by high-speed robotics, and then immobilized on the surface. The resolution of the resulting oligonucleotide array is determined by both the spatial resolution of the delivery systems and the physical space requirement of the delivered oligonucleotide solution volume. The surface density of the immobilized capture oligonucleotides varies greatly with different solid surface and linkage chemistries (Guo, et al., Nuc. Acids Res. 22:5456-5465 (1994); Fahy, et al., Nuc. Acids Res. 21:1819-1826 (1993); Wolf, et al., Nuc. Acids Res. 15:2911-2926 (1987); and Ghosh, et al., Nuc. Acids Res. 15:5353-5372 (1987)).

In another approach, capture oligonucleotides are synthesized directly onto the solid support, nucleotide by nucleotide, through a series of coupling and deprotection steps. Both conventional solid-phase oligonucleotide synthesis methods and light-directed combinatorial synthesis methods have been successfully applied in this in situ fabrication process (Fodor et al., supra (1991) and Gilham, Biochemistry 7:2809-2813 (1968)). High reaction yields in both the coupling and the deprotection steps are critical for the success of in situ synthesis. The preparation of in situ arrays can be automated and thereby increase the complexity of the array compared to the use of presynthesized oligonucleotides.

a) Spatially-Resolved Attachment Chemistry

Preferably, a capture oligonucleotide is immobilized onto a solid support through a single covalent bond. Gilham (Biochemistry, 7:2809-2813 (1968)), for example, described the attachment of DNA molecules to paper using carbodiimide via the 5'-end terminal phosphate group. Suitable supports for covalent immobilization of DNA include glass, acrylamide gel, latex particles, controlled pore glass, dextran supports, polystyrene matrices and avidin-coated polystyrene beads and have been described (Guo, et al., Nuc. Acids Res. 22:5456-5465 (1994); Fahy, et al., Nuc. Acids Res. 21:1819-1826 (1993); Wolf, et al., Nuc. Acids Res. 15:2911-2926 (1987); Ghosh, et al., Nuc. Acids Res. 15:5353-5372 (1987); Gingeras et al., Nuc Acids Res. 15:5773-5790 (1987); Rasmussen et al., Anal. Biochem. 198:138-142 (1991); and Lund et al., Nuc. Acids Res. 16:10861-10880 (1988)). Several other solid supports, such as nitrocellulose and nylon membranes were employed for oligonucleotide immobilization using UV-activated DNA-surface cross-linking chemistry (Meinkoth and Wahl, Anal. Biochem. 138:267-284 (1984)). However, in these cases, DNA molecules were non-covalently bound to the surface at multiple sites, hampering reproducibility and stability.

Fodor, et al. (supra, (1991)) demonstrated the use of photolithographic technology to synthesize high-density oligonucleotide arrays on silicon substrates. In this process, crosslinkers are first made by exposing a photochemically-labile organosilane surface to UV light. The resulting pattern is then reacted with heterobifunctional crosslinking molecules. The oligonucleotide molecules are then bound to these crosslinkers to form a well-defined DNA pattern on the surface. Spatial resolution of 1 micron per DNA spot is feasible using this approach.

Three-dimensional immobilization matrices have been developed to increase capacity and are contemplated for use for the array provided herein. Yershor, et al. (Genetics 93:4913-4918 (1996)), for example, have produced DNA arrays by immobilizing oligonucleotides in acrylamide gel at a density of 20,000 to 30,000 different capture oligonucleotides per $cm^2$, two orders of magnitude higher than the capacity of two-dimensional supports, with density increasing as technology advances. The three-dimensional support permits high oligonucleotide loading and enhanced hybridization. However, because only short oligonucleotides can diffuse into gel matrix, the application of this approach is limited.

b) Spatially Addressable Parallel Chemical Synthesis

Solid phase DNA synthesis can be accomplished with a number of different chemistries. Froehler et al. (Nuc. Acids Res. 14:5399-5407 (1986) and McBride and Caruthers (Tetrahedron Lett. 24:245-248 (1983) have demonstrated solid phase DNA synthesis chemistries utilizing H-phosphonate and phosphoramidites, which covalently attach an organic linker molecule to a surface and build the oligonucleotide off the terminus of the linker through successive coupling and deprotection steps.

Based on this scheme, two distinct approaches have been developed to construct surface-bound oligonucleotide arrays. One approach (Fodor, et al., supra (1991)) combines solid-phase DNA synthesis with semiconductor-based photolithography. The major advantage of this approach is the potential to synthesize very high-density arrays comprised of 50 micron spots or less. However, the major drawback to this approach is the need for a photolithographic mask for each unique array of oligonucleotides. For example, an array of 25-mers would require 100 different masks. The expense of synthesizing these arrays is proportional to the number of unique masks.

Microfabricated ink-jet pumps, similar to those used in certain ink-jet printers to deliver synthesis reagents onto the surface of a solid support can also be used. Within this method, the surface is scanned across a set of ink-jet pumps using a computer-controlled x-y translation stage. In each coupling step, DNA monomers are delivered to the defined area at rates of several hundred drops per second.

Each of these in situ approaches permits large numbers of arrays of unlimited combinatorial matrices to be made in fairly few steps.

It is to be understood that the oligonucleotide arrays described herein can be prepared according to the above-described methods or according to any other suitable method known in the art.

In one embodiment, oligonucleotide arrays can be prepared by:

(a) contacting a solid support with an aminoalkyltrialkoxysilane in the vapor phase at reduced pressure to form an aminoalkylsilane-derivatized solid support;

(b) contacting the aminoalkylsilane-derivatized solid support with a linking group to covalently attach the linking group to the aminoalkylsilane-derivatized solid support to form a linking group-modified solid support; and (c) attaching a plurality of capture oligonucleotides to the linking group-modified solid support to form the array of covalently-attached oligonucleotide probes.

The solid supports can be any of those described above which are conveniently derivatized with a vapor phase deposition of an aminoalkyltrialkoxysilane. The aminoalkyltrialkoxysilanes useful in this aspect of the invention are any of those that can be utilized in the vapor phase at temperatures of from about ambient temperature to about 150° C. at pressures of from about 760 mmHg to about 0.1 mmHg. Typically, the aminoalkyl portion of the silane will be aminopropyl, aminoethyl or aminomethyl. The trialkoxysilane portion can be one in which the alkoxy groups are all the same (e.g., trimethoxysilane, triethoxysilane) or one in which the alkoxy groups are not all alike (e.g., dimethoxyethoxysilane). Accordingly, the aminoalkyltrialkoxysilane will typically be selected from aminopropyltrimethoxysilane, aminopropyltriethoxysilane, aminopropyldiethoxy-methoxysilane, aminoethyltrimethoxysilane, and the like. More preferably, the aminoalkyltrialkoxysilane is aminopropyltrimethoxysilane.

As indicated above, a more uniform coating of amino groups on the solid support can be achieved by applying an aminoalkyltrialkoxysilane in the vapor phase, typically at reduced pressure. This can be accomplished by placing the solid support into a vacuum chamber, evacuating the chamber, and introducing the silane. In some embodiments, the vacuum chamber can be heated to facilitate silane vaporization and even coating of the solid support. For example, when aminopropyltrimethoxysilane is used, the pressure will typically be from about 5 to 35 mmHg and the vacuum chamber will be heated to a temperature of from about 60 to about 110° C. After a period of time sufficient for formation of an aminoalkylsilane-derivatized solid support, the support is removed from the vacuum chamber and rinsed to remove any unbound spacer.

The resultant support can then be contacted with a suitable amount of a linking group to covalently attach the linking group to the aminoalkylsilane-derivatized solid support. In some embodiments, the aminoalkylsilane-derivatized solid support will first be treated with a reagent capable of facilitating linking group attachment to the derivatized support. A variety of reagents are useful in this aspect of the invention including diisocyanates, diisothiocyanates, dicarboxylic acids (and their activated esters), and the like. Particular preferred are diisothiocyanates (e.g., 1,4-phenylenediisothiocyanate).

Once the solid support has been suitably derivatized, a linking group is attached to provide a spacing between the oligonucleotide probe and the support which is optimized for interactions between the probes and the sample. As provided above, a variety of linking groups can be used in this aspect of the invention. Preferred groups are those that provide a spacing similar to that provided by a 15-mer poly dT spacing group. Additionally, the linking group will have a reactive portion that is selected to be compatible with the amino group of the aminoalkylsilane-derivatized support, or with the functional group present on the reagent used to facilitate linking group attachment (e.g., the isothiocyanate portion of 1,4-phenylenediisothiocyanate). Accordingly, at the proximal end (that forming an attachment closest to the support), the linking group will have a functional group that is reactive with an amino moiety (e.g., a carboxylic acid, anhydride, isothiocyanate, and the like) or a functional group that is reactive with an isocyanate, isothiocyanate or carboxylic acid moiety (e.g., an amino group, a hydroxyl group or the like).

In one embodiment, the support is derivatized first with aminopropyltrimethoxysilane, followed by attachment of 1,4-phenylenediisothiocyanate, followed by attachment of a 15-mer oligonucleotide, preferably a 15-mer of poly-dT.

Following constriction of the linking group-modified solid support, a plurality of capture oligonucleotides is attached to form an array of covalently-attached capture oligonucleotides. In this aspect of the invention, the capture oligonucleotides can be any collection of nucleic acids or polymer. Preferably, the capture oligonucleotides are those that represent one or more of the groups selected from all known classical HLA polypeptides, all known non-classical HLA polypeptides, accessory molecules important in antigen processing and presentation, KIR polypeptides, and blood group determining polypeptides. The capture oligonucleotides are typically 17 to 60 nucleotides in length, although shorter or longer sequences are also contemplated, so that each has a melting temperature ($T_m$) with respect to its exact complement of about 64° C. (e.g., about 64.0, 64.1, 64.2, 64.3, 64.4, 64.5 or 64.6° C.). In a specific embodiment, the preferred Tm is about 64.3. Preferred capture oligonucleotides have the nucleic acid sequences set forth in Tables I-V, below. The capture oligonucleotides can be prepared by any conventional methods known to those of skill in the art. Alternatively, the oligonucleotides can be constructed on the array using the techniques described above (e.g., photolithography, flow channel, ink jetspotting, and the like). In preferred embodiments, the oligonucleotides are constructed using conventional solution or solid phase chemistry, and then attached to the array's solid support component (e.g., slide).

Construction of the present arrays is preferably carried out in a manner that ensures that the capture oligonucleotides are present at a surface density of about 250 to about 450 angstrom$^2$/molecule, preferably about 325 to about 375 angstrom$^2$/molecule, or higher. Methods of measuring oligonucleotide density are well known to those of skill in the art.

Hybridization

Hybridization of DNA to a solid support has similar thermodynamic behavior compared to hybridization of DNA in solution. The stability of the double helix can be characterized by its melting temperature, which is strongly dependent upon oligonucleotide sequence and composition of the solvent (Wetmur, Crit. Rev. Biochem. & Mol. Bio. 26:227-259 (1991)). This strong-dependence of the duplex stability on oligonucleotide sequence, especially for short oligonucleotides, makes it difficult to design adequately stringent conditions for hybridization with oligonucleotide arrays, which usually vary widely in base composition. Thus, a large number of false positive or negative signals may occur when hybridization is performed on complex oligonucleotide arrays. Several approaches have been employed to eliminate the sequence-dependence of the stability of duplexes. Utilization of tetramethylammonium chloride (TMAC) in the hybridization solution is the most popular approach (Wood, et al., Proc. Natl. Acad. Sci. USA 82:1585-1588 (1985) and Riccelli and Benight, Nuc. Acids Res. 21:3785-3788 (1993)). TMAC was found to neutralize stability of duplexes imparted by sequences and allow the stringency of hybridization to be controlled as a function of probe length. Similar "isostabilization" function has also been described for other reagents (Rees, et al., Biochemistry 32: 137-144 (1993)).

The thermodynamic stability of solid-phase hybridization is also affected by differences between the perfectly matched duplex versus the mismatched duplex, which constitutes the fundamental limitation to sequence-specific recognition in hybridization. The binding of a capture oligonucleotide mismatched at a single base is compared with that of a perfectly matched capture oligonucleotide (i.e., its "exact complement"); the difference in duplex stability is used to identify the target sequence. In many cases, the differences in stability of a perfect match and a single-base mismatch are so small that discrimination between a perfect match and a single base mismatch cannot be achieved using common hybridization-washing procedures. Guo et al. described an approach to substantially increase the discrimination of single-base mismatches by using artificial mismatches (Guo et al., Nature Biotech. 15:331-335 (1997)). In this approach, an "artificial" mismatch is intentionally inserted into the capture oligonucleotide sequence, and the discrimination compares the stability of two mismatches versus one mismatch. An enhancement of the discrimination, as high as 200% of differential melting temperature, is generally achieved in hybridization with oligonucleotide arrays.

In vitro data indicate that nucleic acid hybridization in free solution and on surfaces is often a reaction rate-limited process. In a study of nitrocellulose membrane arrays, the hybridization kinetics was found to be proportional to the concentration of immobilized DNA. A mathematical model of hybridization on solid supports has been proposed that hypothesizes two different mechanisms by which nucleic acid targets can hybridize with immobilized oligonucleotide probes: direct hybridization from solution and hybridization by nucleic acid targets that adsorb nonspecifically on the surface and then diffuse to the capture oligonucleotides (Chan et al., Biophysical J. 69:2243-2255 (1995)). The hybridization rate depends strongly on both the nucleic acid diffusion constant in solution and the nucleic acid adsorption/desorption constant on surface.

Electric fields can be used to facilitate the diffusion of DNA targets to the immobilized capture oligonucleotides (Sosnowski et al., Proc. Natl. Acad. Sci. USA 94:1119-1123 (1997) and Cheng et al., Nature Biotech. 16:541-546 (1998)). In this system, oligonucleotide arrays are synthesized on the surface of a silicon electrode. Nucleic acid molecules, which have a large negative charge, can be moved in an electric field to an area of net positive charge and concentrate significantly on the electrode surface. The concentrating effect accelerates the hybridization of nucleic acid targets. Another advantage of this system is the reversibility of the hybridization in which non-specifically bound nucleic acid target molecules can be easily removed from the oligonucleotide arrays by reversing the polarity of the field.

Detection of Hybridization Events on Solid Supports

In certain embodiments, the nucleic acid sample (e.g., cDNA or cRNA) is directly labeled with a detectable marker. For example, cDNA or cRNA can be made from RNA obtained from a sample (e.g. blood or tissue) and fluorescent labels (e.g., dyes) can be incorporated into the cDNA or cRNA. In other embodiments, the nucleic acid samples themselves are not detectably labeled, but labeled detection probes are used that bind to target nucleic acids hybridized to capture oligonucleotides on the arrays.

Several methods for the detection of labeled nucleic acids or detection probes are currently available, of which the fluorescence-based methods are the most popular. Quantitative hybridization data available from these methods affords the advantages of rapid image analysis, direct comparison and digital archiving. Both the intensity of the fluorescent signal and the background depend strongly on environmental factors, such as dryness of the surface and the support materials. The influence of environmental factors on the strength of the signal and background mandates stringency for conditions and often precludes the use of highly fluorescent supports, such as nylon membranes.

In the analysis of complex genome systems, the use of multiple fluorescent dyes to simultaneously distinguish different nucleic acid molecules is an important methodologic advancement. Nucleic acid targets, including cDNA and cRNA and detection probes, in hybridization systems can be fluorescently labeled either directly or indirectly. The direct fluorescent label systems for nucleic acid molecules include derivatives of fluorescein and rhodamine dyes, which can be easily attached to the end of a nucleic acid strand.

Biotin is the most commonly used indirect fluorescent label. Biotin can be easily incorporated into nucleic acid molecules and detected using avidin or streptavidin by a covalently linked reporter group, such as alkaline phosphatase and horseradish peroxidase (Rees and Kurz, Nuc. Acids Res. 12:3435-3439 (1984)). The indirect nature of the biotin labeling method limits the applicability for quantitative analysis, but the sensitivity of biotin assays are as high as that which can be achieved using radioisotopes.

The fluorescence detection systems require that excess label be washed off; furthermore, after hybridization real-time monitoring of the hybridization process is not feasible. In order to observe ongoing hybridization events on the surface, surface-related detection methods have been developed. These methods are based on different optical phenomenon on the surface and can detect subtle changes such as the formation of nucleic acid duplexes on the surface, without interfering with the excess nucleic acid in solution. Duplex electron transfer, optical wave-guide, surface plasmon resonance and resonant mirror are a few examples of currently developed surface-based detection methods (Wood, Microchem. J. 47:330-337 (1993); Stimpson and Gordon, Biomolecular Engineering 13:73-80 (1996); Wats et al., Biosensor. Anal. Chem. 67:4283-4289 (1995); and Stimpson et al., Proc. Natl. Acad. Sci. USA 92:6379-6380 (1995)).

Oligonucleotide Arrays

Within certain embodiments, the present invention provides an array of capture oligonucleotides specific for nucleic acids encoding HLA polypeptides. The array is a useful tool for performing HLA tissue typing on a cell or tissue sample to determine, for example, whether a particular donor is suitable for matching in bone marrow, tissue (e.g., skin or organ) transplantation. Generally, the array will comprise a series of capture oligonucleotides which represent at least 80%, preferably at least 90%, more preferably at least 98%, and most preferably 100% of all known classical HLA polypeptides. In one embodiment, the array will comprise a series of capture oligonucleotides which represent at least 80%, preferably at least 90%, more preferably at least 98%, and most preferably 100% of all known non-classical HLA polypeptides. In one preferred embodiment, the arrays will represent all known non-classical HLA polypeptides. In another preferred embodiment, the arrays will represent all known classical HLA polypeptides and/or all known non-classical HLA polypeptides. The capture oligonucleotides are provided on the array at known or preselected positions to facilitate analysis. Additionally, the capture oligonucleotides are generally covalently attached to the solid support using a linking group that is sufficient to provide optimum binding of a sample nucleic acid to the oligonucleotide array.

Within certain embodiments, the above-described HLA oligonucleotide arrays (which can comprise capture oligonucleotides specific for either classical HLA polypeptides or non-classical HLA polypeptides or specific for both classical and nonclassical HLA polypeptides), further comprise negative control oligonucleotides.

Within other embodiments, the arrays provided herein comprise capture oligonucleotides that target nucleic acids encoding all known classical and non-classical HLA polypeptides, and, additionally or alternatively, comprise other capture oligonucleotides that target nucleic acids encoding other array targets, including but not limited to accessory molecules important in HLA-linked peptide presentation and/or processing, KIR polypeptides, and/or blood group determining polypeptides. In any of these arrays, negative control capture oligonucleotides can be optionally be included in the array, or can be included on a separate array (e.g., separate slide).

An important feature of the oligonucleotide arrays provided herein is the high redundancy (overlapping sequences offset by "walking" down the target nucleic acid sequences) of capture oligonucleotides. In one embodiment of the invention, capture oligonucleotides are designed to represent at least 80%, preferably at least 90% and more preferably at least 98% of the target polypeptide-encoding nucleic acid sequences (e.g., all classical and/or non-classical HLA polypeptides). Within certain embodiments, each oligonucleotide in a set of overlapping oligonucleotides is sequentially shifted by 1, 2, 3, 4, 5 or more nucleotides from the 5' end of the preceding overlapping oligonucleotide (i.e., each oligonucleotide contains a step 1, step 2, step 3, step 4, or step 5 shift from the preceding oligonucleotide in the set).

In order for the melting temperature of the capture oligonucleotide sequences to be comparable, capture oligonucleotides should be designed with careful attention to size, base composition, and placement of mismatched position within the hybridization sequence. Within certain embodiments, capture oligonucleotides can range in length from about 5 nucleotides (nt) to about 80 nt, about 7 nt to about 75 nt, about 10 nt to about 70 nt, about 15 nt to about 65 nt, or, preferably, about 17 nt to about 60 nt in length.

Within certain embodiments, the melting temperature ($T_m$) of the capture oligonucleotides (with respect to their exact complement) can range from about 64.3±0.7° C. In a preferred embodiment, all capture oligonucleotides have a Tm of about 64.3° C.

Within a specific embodiment, the oligonucleotide array comprises the capture oligonucleotides having the nucleic acid sequences set forth in Table I, below. The oligonucleotides in Table I are designed to collectively target transcripts (e.g., cDNA or cRNA) encoding target classical HLA molecules.

Within another specific embodiment, the oligonucleotide array comprises the capture oligonucleotides having the nucleic acid sequences set forth in Table II, below. The oligonucleotides in Table II are designed to collectively target transcripts (e.g., cDNA or cRNA) encoding non-classical HLA molecules.

Within yet another specific embodiment, the oligonucleotide array comprises the capture oligonucleotides having the nucleic acid sequences set forth in Table III, below. The oligonucleotides in Table III are designed to collectively target transcripts (e.g., cDNA or cRNA) encoding accessory molecules.

Within still another specific embodiment, the oligonucleotide array comprises the capture oligonucleotides having the nucleic acid sequences set forth in Table IV, below. The oligonucleotides in Table IV are designed to collectively target transcripts (e.g., cDNA or cRNA) encoding KIR polypeptides.

Within another specific embodiment, the oligonucleotide array comprises the capture oligonucleotides having the nucleic acid sequences set forth in Table V, below. The oligonucleotides in Table V are designed to collectively target transcripts (e.g., cDNA or cRNA) encoding blood group determining molecules.

The oligonucleotides set forth in Tables I-V, below, were designed to target the following alleles, however, it is to be understood that an array according to the present invention may also target other and/or additional alleles: A*01:01:01:01, A*01:01:02, A*01:01:03, A*01:01:04, A*01:01:05, A*01:01:06, A*01:01:07, A*01:01:08, A*01:01:09, A*01:01:10, A*01:01:11, A*01:01:12, A*01:01:13, A*01:01:14, A*01:01:15, A*01:01:16, A*01:01:17, A*01:01:18, A*01:01:19, A*01:02, A*01:03, A*01:06, A*01:07, A*01:08, A*01:09, A*01:10, A*01:12, A*01:13, A*01:14, A*01:17, A*01:19, A*01:20, A*01:21, A*01:23, A*01:24, A*01:25, A*01:26, A*01:28, A*01:29, A*01:30, A*01:32, A*01:33, A*01:35, A*01:36, A*01:37, A*01:38, A*01:39, A*01:40, A*01:41, A*01:42, A*01:43, A*01:44, A*01:45, A*01:46, A*01:47, A*01:48, A*01:49, A*01:50, A*01:51, A*01:54, A*01:55, A*01:58, A*01:59, A*01:60, A*01:61, A*01:62, A*01:63, A*01:64, A*01:65, A*01:66, A*02:01:01:01, A*02:01:01:03, A*02:01:02, A*02:01:03, A*02:01:04, A*02:01:05, A*02:01:06, A*02:01:07, A*02:01:08, A*02:01:09, A*02:01:10, A*02:01:11, A*02:01:12, A*02:01:13, A*02:01:14, A*02:01:15, A*02:01:17, A*02:01:18, A*02:01:19, A*02:01:21, A*02:01:22, A*02:01:23, A*02:01:24, A*02:01:25, A*02:01:26, A*02:01:27, A*02:01:28, A*02:01:29, A*02:01:30, A*02:01:31, A*02:01:32, A*02:01:33, A*02:01:34, A*02:01:35, A*02:01:36, A*02:01:37, A*02:01:38, A*02:01:39, A*02:01:40, A*02:01:41, A*02:01:42, A*02:01:43, A*02:01:44, A*02:01:45, A*02:01:46, A*02:01:47, A*02:01:48, A*02:01:49, A*02:01:50, A*02:02, A*02:03:01, A*02:03:02, A*02:03:03, A*02:04, A*02:05:01, A*02:05:02, A*02:05:03, A*02:06:01, A*02:06:02, A*02:06:03, A*02:06:04, A*02:06:05, A*02:06:06, A*02:06:07, A*02:06:08, A*02:06:09, A*02:07, A*02:08, A*02:09, A*02:10, A*02:101, A*02:102, A*02:103, A*02:104, A*02:105, A*02:106, A*02:107, A*02:108, A*02:109, A*02:11, A*02:110, A*02:111, A*02:112, A*02:114, A*02:115, A*02:116, A*02:117, A*02:118, A*02:119, A*02:12, A*02:120, A*02:121, A*02:122, A*02:123, A*02:124, A*02:126, A*02:127, A*02:128, A*02:129, A*02:13, A*02:130, A*02:131, A*02:132, A*02:133, A*02:134, A*02:135, A*02:136, A*02:137, A*02:138, A*02:139, A*02:14, A*02:140, A*02:141, A*02:142, A*02:143, A*02:144, A*02:145, A*02:146, A*02:147, A*02:148, A*02:149, A*02:150, A*02:151, A*02:152, A*02:153, A*02:154, A*02:155, A*02:156, A*02:157, A*02:158, A*02:159, A*02:16, A*02:160, A*02:161, A*02:162, A*02:163, A*02:164, A*02:165, A*02:166, A*02:167, A*02:168, A*02:169, A*02:170, A*02:171:01, A*02:171:02, A*02:172, A*02:173, A*02:174, A*02:175, A*02:176, A*02:177, A*02:178, A*02:179, A*02:17:01, A*02:17:02, A*02:18, A*02:180, A*02:181, A*02:182, A*02:183, A*02:184, A*02:185, A*02:186, A*02:187, A*02:188, A*02:189, A*02:19, A*02:190, A*02:191, A*02:192, A*02:193, A*02:194, A*02:195, A*02:196, A*02:197, A*02:198, A*02:199, A*02:200, A*02:201, A*02:202, A*02:203, A*02:204, A*02:205, A*02:206, A*02:207, A*02:208, A*02:209, A*02:20:01, A*02:20:02, A*02:21, A*02:210, A*02:211, A*02:212, A*02:213, A*02:214, A*02:215, A*02:216, A*02:217, A*02:218, A*02:219, A*02:220, A*02:221, A*02:224, A*02:228, A*02:229, A*02:22:01, A*02:22:02, A*02:230, A*02:231, A*02:232, A*02:233, A*02:234, A*02:235, A*02:236, A*02:237, A*02:238, A*02:239, A*02:24, A*02:240, A*02:241, A*02:242, A*02:243, A*02:244, A*02:245, A*02:246, A*02:247, A*02:248, A*02:249, A*02:25, A*02:251, A*02:252, A*02:253, A*02:254, A*02:255, A*02:256, A*02:257, A*02:258, A*02:259, A*02:26, A*02:260, A*02:261, A*02:262, A*02:263, A*02:264, A*02:265, A*02:266, A*02:27, A*02:28, A*02:29, A*02:30, A*02:31, A*02:33, A*02:34, A*02:35:01, A*02:35:02, A*02:35:03, A*02:36, A*02:37, A*02:38, A*02:39, A*02:40, A*02:41, A*02:42, A*02:44, A*02:45, A*02:46, A*02:47, A*02:48, A*02:49, A*02:50, A*02:51, A*02:52, A*02:54, A*02:55, A*02:56:01, A*02:56:02, A*02:57, A*02:58, A*02:59, A*02:60, A*02:61, A*02:62, A*02:63, A*02:64, A*02:65, A*02:66, A*02:67, A*02:68, A*02:69, A*02:70, A*02:71, A*02:72, A*02:73, A*02:74: 01, A*02:74:02, A*02:75, A*02:76, A*02:77, A*02:78, A*02:79, A*02:80, A*02:81, A*02:84, A*02:85, A*02:86, A*02:87, A*02:89, A*02:90, A*02:91, A*02:92, A*02:93, A*02:95, A*02:96, A*02:97:01, A*02:97:02, A*02:99, A*03:01:01:01, A*03:01:01:03, A*03:01:02, A*03:01:03, A*03:01:04, A*03:01:05, A*03:01:06, A*03:01:07, A*03: 01:08, A*03:01:09, A*03:01:10, A*03:01:11, A*03:01:12, A*03:01:13, A*03:01:14, A*03:01:15, A*03:01:16, A*03: 01:17, A*03:01:18, A*03:01:19, A*03:02, A*03:04, A*03: 05, A*03:06, A*03:07, A*03:08, A*03:09, A*03:10, A*03: 12, A*03:13, A*03:14, A*03:15, A*03:16, A*03:17, A*03: 18, A*03:19, A*03:20, A*03:22, A*03:23, A*03:24, A*03: 25, A*03:26, A*03:27, A*03:28, A*03:29, A*03:30, A*03: 31, A*03:32, A*03:33, A*03:34, A*03:35, A*03:37, A*03: 38, A*03:39, A*03:40, A*03:41, A*03:42, A*03:43, A*03: 44, A*03:45, A*03:46, A*03:47, A*03:48, A*03:49, A*03: 50, A*03:51, A*03:52, A*03:53, A*03:54, A*03:55, A*03: 56, A*03:57, A*03:58, A*03:59, A*03:60, A*03:61, A*03: 62, A*03:63, A*03:64, A*03:65, A*03:66, A*03:67, A*03: 70, A*03:71, A*03:72, A*03:73, A*03:74, A*03:75, A*03: 76, A*03:77, A*03:78, A*03:79, A*03:80, A*03:81, A*03: 82, A*11:01:01, A*11:01:02, A*11:01:03, A*11:01:04, A*11:01:05, A*11:01:06, A*11:01:07, A*11:01:08, A*11: 01:09, A*11:01:10, A*11:01:11, A*11:01:12, A*11:01:13, A*11:01:14, A*11:01:15, A*11:01:16, A*11:01:17, A*11: 01:18, A*11:01:19, A*11:01:20, A*11:01:21, A*11:01:22, A*11:02:01, A*11:02:02, A*11:02:03, A*11:03, A*11:04, A*11:05, A*11:06, A*11:07, A*11:08, A*11:09, A*11:10, A*11:11, A*11:12, A*11:13, A*11:14, A*11:15:01, A*11: 15:02, A*11:16, A*11:17, A*11:18, A*11:19, A*11:20, A*11:22, A*11:23, A*11:24:01, A*11:24:02, A*11:25, A*11:26, A*11:27, A*11:29, A*11:30, A*11:31, A*11:32, A*11:33, A*11:34, A*11:35, A*11:36, A*11:37, A*11:38, A*11:39, A*11:40, A*11:41, A*11:42, A*11:43, A*11:44, A*11:45, A*11:46, A*11:47, A*11:48, A*11:49, A*11:51, A*11:53, A*11:54, A*11:55, A*11:56, A*11:57, A*11:58, A*11:59, A*11:60, A*11:61, A*11:62, A*11:63, A*11:64, A*23:01:01, A*23:01:02, A*23:02, A*23:03:01, A*23: 03:02, A*23:04, A*23:05, A*23:06, A*23:09, A*23:10, A*23: 12, A*23:13, A*23:14, A*23:15, A*23:16, A*23:17, A*23: 18, A*23:20, A*23:21, A*23:22, A*23:23, A*23:24, A*23: 25, A*23:26, A*24:02:01:01, A*24:02:02, A*24:02:03, A*24:02:04, A*24:02:05, A*24:02:06, A*24:02:07, A*24: 02:08, A*24:02:09, A*24:02:10, A*24:02:11, A*24:02:12, A*24:02:13, A*24:02:14, A*24:02:15, A*24:02:16, A*24: 02:17, A*24:02:18, A*24:02:19, A*24:02:20, A*24:02:21, A*24:02:22, A*24:02:23, A*24:02:24, A*24:02:25, A*24: 02:26, A*24:02:27, A*24:02:28, A*24:02:29, A*24:02:30, A*24:02:31, A*24:02:32, A*24:02:33, A*24:02:34, A*24: 02:35, A*24:02:36, A*24:03:01, A*24:03:02, A*24:04, A*24:05, A*24:06, A*24:07, A*24:08, A*24:10, A*24:100, A*24:101, A*24:102, A*24:103, A*24:104, A*24:105, A*24:106, A*24:107, A*24:108, A*24:109, A*24:110, A*24:111, A*24:112, A*24:113, A*24:114, A*24:115, A*24:116, A*24:117, A*24:118, A*24:119, A*24:120, A*24:121, A*24:122, A*24:123, A*24:124, A*24:125, A*24:126, A*24:127, A*24:128, A*24:129, A*24:130, A*24:131, A*24:133, A*24:134, A*24:135, A*24:136, A*24:137, A*24:138, A*24:139, A*24:13:01, A*24:13:02, A*24:14, A*24:140, A*24:141, A*24:142, A*24:143, A*24: 144, A*24:15, A*24:17, A*24:18, A*24:19, A*24:20, A*24: 21:01, A*24:21:02, A*24:22, A*24:23, A*24:24, A*24:25, A*24:26, A*24:27, A*24:28, A*24:29, A*24:30, A*24:31, A*24:32, A*24:33, A*24:34, A*24:35, A*24:37, A*24:38, A*24:39, A*24:41, A*24:42, A*24:43, A*24:44, A*24:46, A*24:47, A*24:49, A*24:50, A*24:51, A*24:52, A*24:53, A*24:54, A*24:55, A*24:56, A*24:57, A*24:58, A*24:59, A*24:61, A*24:62, A*24:63, A*24:64, A*24:66, A*24:67, A*24:68, A*24:69, A*24:70, A*24:71, A*24:72, A*24:73, A*24:74, A*24:75, A*24:76, A*24:77, A*24:78, A*24:79, A*24:80, A*24:81, A*24:82, A*24:85, A*24:87, A*24:88, A*24:89, A*24:91, A*24:92, A*24:93, A*24:94, A*24:95, A*24:96, A*24:97, A*24:98, A*24:99, A*25:01:01, A*25: 01:02, A*25:02, A*25:03, A*25:04, A*25:05, A*25:06, A*25:07, A*25:08, A*25:09, A*25:10, A*25:11, A*25:13, A*26:01:01, A*26:01:02, A*26:01:03, A*26:01:04, A*26: 01:05, A*26:01:06, A*26:01:07, A*26:01:08, A*26:01:09, A*26:01:10, A*26:01:11, A*26:01:12, A*26:01:13, A*26: 01:14, A*26:01:15, A*26:01:16, A*26:02, A*26:03:01, A*26:03:02, A*26:04, A*26:05, A*26:06, A*26:07:01, A*26:07:02, A*26:08, A*26:09, A*26:10, A*26:12, A*26: 13, A*26:14, A*26:15, A*26:16, A*26:17, A*26:18, A*26: 19, A*26:20, A*26:21, A*26:22, A*26:23, A*26:24, A*26: 26, A*26:27, A*26:28, A*26:29, A*26:30, A*26:31, A*26: 32, A*26:33, A*26:34, A*26:35, A*26:36, A*26:37, A*26: 38, A*26:39, A*26:40, A*26:41, A*26:42, A*26:43:01, A*26:43:02, A*26:45, A*26:46, A*26:47, A*26:48, A*26: 49, A*26:50, A*29:01:01:01, A*29:01:02, A*29:02:01, A*29:02:02, A*29:02:03, A*29:02:04, A*29:02:05, A*29: 03, A*29:04, A*29:05, A*29:06, A*29:07, A*29:09, A*29: 10, A*29:11, A*29:12, A*29:13, A*29:14, A*29:15, A*29: 16, A*29:17, A*29:18, A*29:19, A*29:20, A*29:21, A*29: 22, A*30:01:01, A*30:01:02, A*30:01:03, A*30:02:01, A*30:02:02, A*30:02:03, A*30:02:04, A*30:02:05, A*30: 03, A*30:04, A*30:06, A*30:07, A*30:08, A*30:09, A*30: 10, A*30:11:01, A*30:11:02, A*30:12, A*30:13, A*30:15, A*30:16, A*30:17, A*30:18, A*30:19, A*30:20, A*30:22, A*30:23, A*30:24, A*30:25, A*30:26, A*30:28, A*30:29, A*30:30, A*30:31, A*30:32, A*30:33, A*30:34, A*30:35, A*30:36, A*30:37, A*30:38, A*30:39, A*30:40, A*30:41, A*31:01:02, A*31:01:03, A*31:01:04, A*31:01:05, A*31: 01:06, A*31:01:07, A*31:01:08, A*31:01:09, A*31:02, A*31:03, A*31:04, A*31:05, A*31:06, A*31:07, A*31:08, A*31:09, A*31:10, A*31:11, A*31:12, A*31:13, A*31:15, A*31:16, A*31:17, A*31:18, A*31:19, A*31:20, A*31:21, A*31:22, A*31:23, A*31:24, A*31:25, A*31:26, A*31:27, A*31:28, A*31:29, A*31:30, A*31:31, A*31:32, A*31:33, A*31:34, A*31:35, A*31:36, A*31:37, A*32:01:01, A*32: 01:02, A*32:01:03, A*32:01:04, A*32:01:05, A*32:02, A*32:03, A*32:04, A*32:05, A*32:06, A*32:07, A*32:08, A*32:09, A*32:10, A*32:12, A*32:13, A*32:14, A*32:15, A*32:16, A*32:17, A*32:18, A*32:20, A*32:21, A*32:22, A*32:23, A*32:24, A*32:25, A*33:01:01, A*33:01:02, A*33:01:03, A*33:03:01, A*33:03:02, A*33:03:03, A*33: 03:04, A*33:03:05, A*33:03:06, A*33:04, A*33:05, A*33: 06, A*33:07, A*33:08, A*33:09, A*33:10, A*33:11, A*33: 12, A*33:13, A*33:14, A*33:15, A*33:16, A*33:17, A*33: 18, A*33:19, A*33:20, A*33:21, A*33:22, A*33:23, A*33: 24, A*33:25, A*33:26, A*33:27, A*33:28, A*33:29, A*33: 30, A*33:31, A*34:01:01, A*34:01:02, A*34:02, A*34:03, A*34:04, A*34:05, A*34:06, A*34:07, A*34:08, A*36:01, A*36:02, A*36:03, A*36:04, A*36:05, A*43:01, A*66:01, A*66:02, A*66:03, A*66:04, A*66:05, A*66:06, A*66:07, A*66:08, A*66:09, A*66:10, A*66:11, A*66:12, A*66:13, A*66:14, A*66:15, A*68:01:01, A*68:01:02, A*68:01:03, A*68:01:04, A*68:01:05, A*68:01:06, A*68:01:07, A*68: 02:01:01, A*68:02:01:02, A*68:02:01:03, A*68:02:02, A*68:02:03, A*68:02:04, A*68:03:01, A*68:03:02, A*68: 04, A*68:05, A*68:06, A*68:07, A*68:08:01, A*68:08:02, A*68:09, A*68:10, A*68:12, A*68:13, A*68:14, A*68:15, A*68:16, A*68:17, A*68:19, A*68:20, A*68:21, A*68:22, A*68:23, A*68:24, A*68:25, A*68:26, A*68:27, A*68:28, A*68:29, A*68:30, A*68:31, A*68:32, A*68:33, A*68:34, A*68:35, A*68:36, A*68:37, A*68:38, A*68:39, A*68:40, A*68:41, A*68:42, A*68:43, A*68:44, A*68:45, A*68:46, A*68:47, A*68:48, A*68:50, A*68:51, A*68:52, A*68:53, A*68:54, A*69:01, A*74:01, A*74:02, A*74:03, A*74:04, A*74:05, A*74:06, A*74:07, A*74:08, A*74:09, A*74:10, A*74:11, A*74:13, A*80:01, A*80:02, B*07:02:01, B*07:02:02, B*07:02:03, B*07:02:04, B*07:02:05, B*07:02:06, B*07:02:07, B*07:02:08, B*07:02:09, B*07:02:10, B*07:02:11, B*07:02:12, B*07:02:13, B*07:02:14, B*07:02:15, B*07:02:16, B*07:02:17, B*07:02:18, B*07:02:19, B*07:02:20, B*07:03, B*07:04, B*07:05:01, B*07:05:02, B*07:05:03, B*07:05:04, B*07:05:05, B*07:06, B*07:07, B*07:08, B*07:09, B*07:10, B*07:100, B*07:101, B*07:102, B*07:103, B*07:104, B*07:105, B*07:106, B*07:107, B*07:108, B*07:109, B*07:11, B*07:110, B*07:112, B*07:113, B*07:114, B*07:115, B*07:12, B*07:13, B*07:14, B*07:15, B*07:16, B*07:17, B*07:18:01, B*07:18:02, B*07:19, B*07:20, B*07:21, B*07:22:01, B*07:22:02, B*07:23, B*07:24, B*07:25, B*07:26, B*07:27, B*07:28, B*07:29, B*07:30, B*07:31, B*07:32, B*07:33, B*07:34, B*07:35, B*07:36, B*07:37, B*07:38, B*07:39, B*07:40, B*07:41, B*07:42, B*07:43, B*07:44, B*07:45, B*07:46, B*07:47, B*07:48, B*07:50, B*07:51, B*07:52, B*07:53, B*07:54, B*07:55, B*07:56, B*07:57, B*07:58, B*07:59, B*07:60, B*07:61, B*07:62, B*07:63, B*07:64, B*07:65, B*07:66, B*07:68:01, B*07:68:02, B*07:69, B*07:70, B*07:71, B*07:72, B*07:73, B*07:74, B*07:75, B*07:76, B*07:77, B*07:78, B*07:79, B*07:80, B*07:81, B*07:82, B*07:83, B*07:84, B*07:85, B*07:86, B*07:87, B*07:88, B*07:89, B*07:90, B*07:91, B*07:92, B*07:93, B*07:94, B*07:95, B*07:96, B*07:97, B*07:98, B*07:99, B*08:01:01, B*08:01:02, B*08:01:03, B*08:01:04, B*08:01:05, B*08:01:06, B*08:01:07, B*08:01:08, B*08:01:09, B*08:01:10, B*08:01:11, B*08:01:12, B*08:02, B*08:03, B*08:04, B*08:05, B*08:07, B*08:09, B*08:10, B*08:11, B*08:12:01, B*08:12:02, B*08:12:03, B*08:13, B*08:14, B*08:15, B*08:16, B*08:17, B*08:18, B*08:20, B*08:21, B*08:22, B*08:23, B*08:24, B*08:25, B*08:26, B*08:27, B*08:28, B*08:29, B*08:31, B*08:32, B*08:33, B*08:34, B*08:35, B*08:36, B*08:37, B*08:38, B*08:39, B*08:40, B*08:41, B*08:42, B*08:43, B*08:44, B*08:45, B*08:46, B*08:47, B*08:48, B*08:49, B*08:50, B*08:51, B*08:52, B*08:53, B*08:54, B*08:55, B*08:56, B*08:57, B*08:58, B*08:59, B*08:60, B*08:61, B*08:62, B*13:01:01, B*13:01:02, B*13:01:03, B*13:01:04, B*13:01:05, B*13:02:01, B*13:02:02, B*13:02:03, B*13:02:04, B*13:02:05, B*13:02:06, B*13:02:07, B*13:02:08, B*13:02:09, B*13:03, B*13:04, B*13:06, B*13:09, B*13:10, B*13:11, B*13:12, B*13:13, B*13:14, B*13:15, B*13:16, B*13:17, B*13:18, B*13:19, B*13:20, B*13:21, B*13:22:01, B*13:22:02, B*13:23, B*13:25, B*13:26, B*13:27, B*13:28, B*13:29, B*13:30, B*13:31, B*13:32, B*13:33, B*13:34, B*13:35, B*13:36, B*13:37, B*13:38, B*13:39, B*14:01, B*14:02:01, B*14:02:02, B*14:02:03, B*14:02:04, B*14:02:05, B*14:03, B*14:04, B*14:05, B*14:06:01, B*14:06:02, B*14:08, B*14:09, B*14:10, B*14:11, B*14:12, B*14:13, B*14:14, B*14:15, B*14:16, B*14:17, B*14:18, B*15:01:01:01, B*15:01:02, B*15:01:03, B*15:01:04, B*15:01:06, B*15:01:07, B*15:01:08, B*15:01:09, B*15:01:10, B*15:01:11, B*15:01:12, B*15:01:13, B*15:01:14, B*15:01:15, B*15:01:16, B*15:01:17, B*15:01:18, B*15:02:01, B*15:02:02, B*15:02:03, B*15:02:04, B*15:03:01, B*15:03:02, B*15:03:03, B*15:04, B*15:05:01, B*15:05:02, B*15:06, B*15:07:01, B*15:07:02, B*15:08, B*15:09, B*15:101, B*15:102, B*15:103, B*15:104, B*15:105, B*15:106, B*15:107, B*15:108, B*15:109, B*15:10:01, B*15:10:02, B*15:110, B*15:112, B*15:113, B*15:114, B*15:115, B*15:116, B*15:117, B*15:118, B*15:119, B*15:11:01, B*15:11:02, B*15:11:03, B*15:11:04, B*15:11:05, B*15:12, B*15:120, B*15:121, B*15:122, B*15:123, B*15:124, B*15:125, B*15:126, B*15:127, B*15:128, B*15:129, B*15:13, B*15:131, B*15:132, B*15:133, B*15:134, B*15:135, B*15:136, B*15:137, B*15:138, B*15:139, B*15:14, B*15:140, B*15:141, B*15:142, B*15:143, B*15:144, B*15:145, B*15:146, B*15:147, B*15:148, B*15:15, B*15:150, B*15:151, B*15:152, B*15:153, B*15:154, B*15:155, B*15:156, B*15:157, B*15:158, B*15:159, B*15:16, B*15:160, B*15:161, B*15:162, B*15:163, B*15:164, B*15:165, B*15:166, B*15:167, B*15:168, B*15:169, B*15:170, B*15:171, B*15:172, B*15:173, B*15:174, B*15:175, B*15:176, B*15:177, B*15:178, B*15:179, B*15:17:01:01, B*15:17:01:02, B*15:17:02, B*15:180, B*15:183, B*15:184, B*15:185, B*15:186, B*15:187, B*15:188, B*15:189, B*15:18:01, B*15:18:02, B*15:18:03, B*15:18:04, B*15:19, B*15:191, B*15:192, B*15:193, B*15:194, B*15:195, B*15:196, B*15:197, B*15:198, B*15:199, B*15:20, B*15:200, B*15:201, B*15:202, B*15:21, B*15:23, B*15:24, B*15:25:01, B*15:25:02, B*15:27:01, B*15:27:02, B*15:27:03, B*15:28, B*15:29, B*15:30, B*15:31, B*15:32, B*15:33, B*15:34, B*15:35, B*15:36, B*15:37, B*15:38:01, B*15:38:02, B*15:39, B*15:40, B*15:42, B*15:43, B*15:44, B*15:45, B*15:46, B*15:47, B*15:48, B*15:49, B*15:50, B*15:51, B*15:52, B*15:53, B*15:54, B*15:55, B*15:56, B*15:57, B*15:58, B*15:60, B*15:61, B*15:62, B*15:63, B*15:64, B*15:65, B*15:66, B*15:67, B*15:68, B*15:69, B*15:70, B*15:71, B*15:72, B*15:73, B*15:74, B*15:75, B*15:76, B*15:77, B*15:78:01, B*15:78:02, B*15:80, B*15:81, B*15:82, B*15:83, B*15:84, B*15:85, B*15:86, B*15:87, B*15:88, B*15:89, B*15:90, B*15:91, B*15:92, B*15:93, B*15:95, B*15:96, B*15:97, B*15:98, B*15:99, B*18:01:01, B*18:01:02, B*18:01:03, B*18:01:04, B*18:01:05, B*18:01:06, B*18:01:07, B*18:01:08, B*18:02, B*18:03, B*18:04, B*18:05, B*18:06, B*18:07:01, B*18:07:02, B*18:08, B*18:09, B*18:10, B*18:11, B*18:12, B*18:13, B*18:14, B*18:15, B*18:18, B*18:19, B*18:20, B*18:21, B*18:22, B*18:24, B*18:25, B*18:26, B*18:27, B*18:28, B*18:29, B*18:30, B*18:31, B*18:32, B*18:33, B*18:34, B*18:35, B*18:36, B*18:37, B*18:38, B*18:39, B*18:40, B*18:41, B*18:42, B*18:43, B*18:44, B*18:45, B*18:46, B*18:47, B*18:48, B*18:49, B*18:50, B*27:01, B*27:02, B*27:03, B*27:04:01, B*27:04:02, B*27:04:03, B*27:05:02, B*27:05:03, B*27:05:04, B*27:05:05, B*27:05:06, B*27:05:07, B*27:05:08, B*27:05:09, B*27:05:10, B*27:05:11, B*27:05:12, B*27:05:13, B*27:05:14, B*27:06, B*27:07, B*27:08, B*27:09, B*27:10, B*27:11, B*27:12, B*27:13, B*27:14, B*27:15, B*27:16, B*27:17, B*27:18, B*27:19, B*27:20, B*27:21, B*27:23, B*27:24, B*27:25, B*27:26, B*27:27, B*27:28, B*27:29, B*27:30, B*27:31, B*27:32, B*27:33, B*27:34, B*27:35, B*27:36, B*27:37, B*27:38, B*27:39, B*27:40, B*27:41, B*27:42, B*27:43, B*27:44, B*27:45, B*27:46, B*27:47, B*27:48, B*27:49, B*27:50, B*27:51, B*27:52, B*27:53, B*27:54, B*27:55, B*27:56, B*27:57, B*27:58, B*27:60, B*27:61, B*27:62, B*27:63, B*27:67, B*27:68, B*27:69, B*35:01:01:01, B*35:01:01:02, B*35:01:02, B*35:01:03, B*35:01:04, B*35:01:05, B*35:01:06, B*35:01:07, B*35:01:08, B*35:01:09, B*35:01:10, B*35:01:11, B*35:01:12, B*35:01:13, B*35:01:14, B*35:01:15, B*35:01:16, B*35:01:17, B*35:01:18, B*35:01:19, B*35:01:20, B*35:01:21, B*35:02:01, B*35:02:02, B*35:02:03, B*35:02:04, B*35:03:01, B*35:03:02, B*35:03:03, B*35:03:04, B*35:04:01, B*35:04:02, B*35:04:03, B*35:05:01, B*35:05:02, B*35:06, B*35:07, B*35:08:01, B*35:08:02, B*35:08:03, B*35:08:04, B*35:09:01, B*35:09:02, B*35:10, B*35:100, B*35:101:01, B*35:101:02, B*35:102, B*35:103, B*35:104, B*35:105, B*35:106, B*35:107, B*35:108:01, B*35:108:02, B*35:109, B*35:110, B*35:111, B*35:112, B*35:113, B*35:114, B*35:115, B*35:116, B*35:117, B*35:118, B*35:119, B*35:11:01, B*35:11:02, B*35:120, B*35:121, B*35:122, B*35:123, B*35:124, B*35:125, B*35:126, B*35:127, B*35:128, B*35:12:01, B*35:12:02, B*35:13, B*35:131, B*35:132, B*35:133, B*35:135, B*35:136, B*35:137, B*35:138, B*35:139, B*35:140, B*35:141, B*35:142, B*35:143, B*35:144, B*35:14:01, B*35:14:02, B*35:15, B*35:16, B*35:17, B*35:18, B*35:19, B*35:20:01, B*35:20:02, B*35:21, B*35:22, B*35:23, B*35:24:01, B*35:24:02, B*35:25, B*35:26, B*35:27, B*35:28, B*35:29, B*35:30, B*35:31, B*35:32, B*35:33, B*35:34, B*35:35, B*35:36, B*35:37, B*35:38, B*35:39, B*35:41, B*35:42:01, B*35:42:02, B*35:43:01, B*35:43:02, B*35:44, B*35:45, B*35:46, B*35:47, B*35:48, B*35:49, B*35:50, B*35:51, B*35:52, B*35:54, B*35:55, B*35:56, B*35:57, B*35:58, B*35:59, B*35:60, B*35:61, B*35:62, B*35:63, B*35:64, B*35:66, B*35:67, B*35:68:01, B*35:68:02, B*35:69, B*35:70, B*35:71, B*35:72, B*35:74, B*35:75, B*35:76, B*35:77, B*35:78, B*35:79, B*35:80, B*35:81, B*35:82, B*35:83, B*35:84, B*35:85, B*35:86, B*35:87, B*35:88, B*35:89, B*35:90, B*35:91, B*35:92, B*35:93, B*35:94, B*35:95, B*35:96, B*35:97, B*35:98, B*35:99, B*37:01:01, B*37:01:02, B*37:01:03, B*37:01:04, B*37:01:05, B*37:01:06, B*37:01:07, B*37:02, B*37:04:01, B*37:04:02, B*37:05, B*37:06, B*37:07, B*37:08, B*37:09, B*37:10, B*37:11, B*37:12, B*37:13, B*37:14, B*37:15, B*37:17, B*37:18, B*37:19, B*37:20, B*37:21, B*37:22, B*37:23, B*38:01:01, B*38:01:02, B*38:01:03, B*38:01:04, B*38:02:01, B*38:02:02, B*38:03, B*38:04, B*38:05, B*38:06, B*38:07, B*38:08, B*38:09, B*38:10, B*38:11, B*38:12, B*38:13, B*38:14, B*38:15, B*38:16, B*38:17, B*38:18, B*38:19, B*38:20, B*38:21, B*38:22, B*38:23, B*39:01:01:01, B*39:01:03, B*39:01:04, B*39:01:05, B*39:01:06, B*39:01:07, B*39:01:08, B*39:01:09, B*39:01:10, B*39:01:11, B*39:02:01, B*39:02:02, B*39:03, B*39:04, B*39:05:01, B*39:05:02, B*39:06:01, B*39:06:02, B*39:07, B*39:08, B*39:09, B*39:10, B*39:11, B*39:12, B*39:13:01, B*39:13:02, B*39:14, B*39:15, B*39:16, B*39:17, B*39:18, B*39:19:01, B*39:19:02, B*39:20, B*39:22, B*39:23, B*39:24, B*39:26, B*39:27, B*39:28, B*39:29, B*39:30, B*39:31, B*39:32, B*39:33, B*39:34, B*39:35, B*39:36, B*39:37, B*39:39, B*39:41, B*39:42, B*39:43, B*39:44, B*39:45, B*39:46, B*39:47, B*39:48, B*39:49, B*39:50, B*39:51, B*39:52, B*39:53, B*39:54, B*39:55, B*39:56, B*39:57, B*39:58, B*39:59, B*39:60, B*40:01:01, B*40:01:02, B*40:01:03, B*40:01:04, B*40:01:05, B*40:01:06, B*40:01:07, B*40:01:08, B*40:01:09, B*40:01:10, B*40:01:11, B*40:01:12, B*40:02:01, B*40:02:02, B*40:02:03, B*40:02:04, B*40:02:05, B*40:02:06, B*40:02:07, B*40:02:08, B*40:02:09, B*40:02:10, B*40:02:11, B*40:03, B*40:04, B*40:05, B*40:06:01:01, B*40:06:01:02, B*40:06:02, B*40:06:03, B*40:07, B*40:08, B*40:09, B*40:100, B*40:101, B*40:102, B*40:103, B*40:104, B*40:105, B*40:106, B*40:107, B*40:108, B*40:109, B*40:10:01, B*40:10:02, B*40:110, B*40:111, B*40:112, B*40:113, B*40:114, B*40:115, B*40:116, B*40:117, B*40:119, B*40:11:01, B*40:11:02, B*40:12, B*40:120, B*40:121, B*40:122, B*40:123, B*40:124:01, B*40:124:02, B*40:125, B*40:126, B*40:127, B*40:128, B*40:129, B*40:13, B*40:130, B*40:131, B*40:132, B*40:134, B*40:135, B*40:136, B*40:137, B*40:138, B*40:139, B*40:140, B*40:141, B*40:143, B*40:145, B*40:146, B*40:147, B*40:14:01, B*40:14:02, B*40:14:03, B*40:15, B*40:16, B*40:18, B*40:19, B*40:20, B*40:21, B*40:23, B*40:24, B*40:25, B*40:26, B*40:27, B*40:28, B*40:29, B*40:30, B*40:31, B*40:32, B*40:33, B*40:34, B*40:35, B*40:36, B*40:37, B*40:38, B*40:39, B*40:40, B*40:42, B*40:43, B*40:44, B*40:45, B*40:46, B*40:47, B*40:48, B*40:49, B*40:50, B*40:51, B*40:52, B*40:53, B*40:54, B*40:55, B*40:56, B*40:57, B*40:58, B*40:59, B*40:60, B*40:61, B*40:62, B*40:63, B*40:64, B*40:65, B*40:66, B*40:67, B*40:68, B*40:69, B*40:70, B*40:71, B*40:72:01, B*40:72:02, B*40:73, B*40:74, B*40:75, B*40:76, B*40:77, B*40:78, B*40:79, B*40:80, B*40:81, B*40:82, B*40:83, B*40:84, B*40:85, B*40:86, B*40:87, B*40:88, B*40:89, B*40:90, B*40:91, B*40:92, B*40:93, B*40:94, B*40:95, B*40:96, B*40:97, B*40:98, B*40:99, B*41:01, B*41:02:01, B*41:02:02, B*41:03:01, B*41:03:02, B*41:04, B*41:05, B*41:06, B*41:07, B*41:08, B*41:09, B*41:10, B*41:11, B*41:12, B*42:01:01, B*42:01:02, B*42:02, B*42:04, B*42:05:01, B*42:05:02, B*42:06, B*42:07, B*42:08, B*42:09, B*42:10, B*42:11, B*42:12, B*42:13, B*42:14, B*44:02:01:01, B*44:02:02, B*44:02:03, B*44:02:04, B*44:02:05, B*44:02:06, B*44:02:07, B*44:02:08, B*44:02:09, B*44:02:10, B*44:02:11, B*44:02:12, B*44:02:13, B*44:03:01, B*44:03:02, B*44:03:03, B*44:03:04, B*44:03:05, B*44:03:06, B*44:03:07, B*44:03:08, B*44:03:09, B*44:03:10, B*44:03:11, B*44:04, B*44:05:01, B*44:05:02, B*44:06, B*44:07, B*44:08, B*44:09, B*44:10, B*44:100, B*44:101, B*44:102, B*44:103, B*44:104, B*44:105, B*44:106, B*44:107, B*44:109, B*44:11, B*44:110, B*44:12, B*44:13, B*44:14, B*44:15, B*44:16, B*44:17, B*44:18, B*44:20, B*44:21, B*44:22, B*44:24, B*44:25, B*44:26, B*44:27, B*44:28:01, B*44:28:02, B*44:29, B*44:30, B*44:31, B*44:32, B*44:33, B*44:34, B*44:35, B*44:36, B*44:37, B*44:38, B*44:39, B*44:40, B*44:41, B*44:42, B*44:43, B*44:44, B*44:45, B*44:46, B*44:47, B*44:48, B*44:49, B*44:50, B*44:51, B*44:53, B*44:54, B*44:55, B*44:57, B*44:59, B*44:60, B*44:62, B*44:63, B*44:64:01, B*44:64:02, B*44:65, B*44:66, B*44:67, B*44:68, B*44:69, B*44:70, B*44:71, B*44:72, B*44:73, B*44:74, B*44:75, B*44:76, B*44:77, B*44:78, B*44:79, B*44:80, B*44:81, B*44:82, B*44:83, B*44:84, B*44:85, B*44:86, B*44:87, B*44:88, B*44:89, B*44:90, B*44:91, B*44:92, B*44:93, B*44:94, B*44:95, B*44:96, B*44:97, B*44:98, B*44:99, B*45:01, B*45:02, B*45:03, B*45:04, B*45:05, B*45:06, B*45:07, B*45:08, B*45:09, B*45:10, B*45:11, B*45:12, B*46:01:01, B*46:01:02, B*46:01:03, B*46:01:04, B*46:02, B*46:03, B*46:04, B*46:05, B*46:06, B*46:08, B*46:09, B*46:10, B*46:11, B*46:12, B*46:13:01, B*46:13:02, B*46:13:03, B*46:14, B*46:16, B*46:17, B*46:18, B*46:19, B*46:20, B*46:21, B*46:22, B*46:23, B*46:24, B*47:01:01:01, B*47:01:01:02, B*47:02, B*47:03, B*47:04, B*47:05, B*47:06, B*47:07, B*48:01:01, B*48:01:02, B*48:01:03, B*48:02:01, B*48:02:02, B*48:03:01, B*48:03:02, B*48:04, B*48:05, B*48:06, B*48:07, B*48:08, B*48:09, B*48:10, B*48:11, B*48:12, B*48:13, B*48:14, B*48:15, B*48:16, B*48:17, B*48:18, B*48:19, B*48:20, B*48:21, B*48:22, B*48:23, B*49:01:01, B*49:01:02, B*49:02, B*49:03, B*49:04, B*49:05, B*49:06, B*49:07, B*49:08, B*49:09, B*49:10, B*50:01:01, B*50:01:02, B*50:02, B*50:04, B*50:05, B*50:06, B*50:07, B*50:08, B*50:09, B*51:01:01, B*51:01:02, B*51:01:03, B*51:01:04, B*51:01:05, B*51:01:06, B*51:01:07, B*51:01:08, B*51:01:09, B*51:01:10, B*51:01:11, B*51:01:12, B*51:01:13, B*51:01:14, B*51:01:15, B*51:01:16, B*51:01:17, B*51:02:01, B*51:02:02, B*51:02:03, B*51:02:04, B*51:03, B*51:04, B*51:05, B*51:06, B*51:07:01, B*51:07:02, B*51:08, B*51:09:01, B*51:09:02, B*51:10, B*51:12, B*51:13:01, B*51:13:02, B*51:14, B*51:15, B*51:16, B*51:17, B*51:18, B*51:19, B*51:20, B*51:21, B*51:22, B*51:23, B*51:24:01, B*51:24:02, B*51:24:03, B*51:26, B*51:28, B*51:29, B*51:30, B*51:31, B*51:32, B*51:33, B*51:34, B*51:35, B*51:36, B*51:37, B*51:38, B*51:39, B*51:40, B*51:42, B*51:43, B*51:45, B*51:46, B*51:48, B*51:49, B*51:50, B*51:51, B*51:52, B*51:53, B*51:54, B*51:55, B*51:56, B*51:57, B*51:58, B*51:59, B*51:60, B*51:61, B*51:62, B*51:63, B*51:64, B*51:65, B*51:66, B*51:67, B*51:68, B*51:69, B*51:70, B*51:71, B*51:72, B*51:73, B*51:74, B*51:75, B*51:76, B*51:77, B*51:78, B*51:79, B*51:80, B*51:81, B*51:82, B*51:83, B*51:84, B*51:85, B*51:86, B*51:87, B*51:88, B*51:89, B*51:90, B*51:91, B*51:92, B*51:93, B*51:94, B*51:95, B*51:96, B*52:01:01, B*52:01:02, B*52:01:03, B*52:01:04, B*52:01:05, B*52:02, B*52:03, B*52:04, B*52:05, B*52:06:01, B*52:06:02, B*52:07, B*52:08, B*52:09, B*52:10, B*52:11, B*52:12, B*52:13, B*52:14, B*52:15, B*52:16, B*52:17, B*52:18, B*52:19, B*52:20, B*52:21, B*53:01:01, B*53:01:02, B*53:01:03, B*53:01:04, B*53:01:05, B*53:02, B*53:03, B*53:04, B*53:05, B*53:06, B*53:07, B*53:08:01, B*53:08:02, B*53:09, B*53:10, B*53:11, B*53:12, B*53:13, B*53:14, B*53:15, B*53:16, B*53:17, B*53:18, B*53:19, B*53:20, B*53:21, B*53:22, B*53:23, B*54:01, B*54:02, B*54:03, B*54:04, B*54:06, B*54:07, B*54:09, B*54:10, B*54:11, B*54:12, B*54:13, B*54:14, B*54:15, B*54:16, B*54:17, B*54:18, B*54:19, B*54:20, B*54:21, B*54:22, B*54:23, B*55:01:01, B*55:01:02, B*55:01:03, B*55:01:04, B*55:01:05, B*55:01:06, B*55:02:01, B*55:02:02, B*55:02:03, B*55:02:04, B*55:02:05, B*55:02:06, B*55:03, B*55:04, B*55:05, B*55:07, B*55:08, B*55:09, B*55:10, B*55:11, B*55:12, B*55:13, B*55:14, B*55:15, B*55:16, B*55:17, B*55:18, B*55:19, B*55:20, B*55:21, B*55:22, B*55:23, B*55:24, B*55:25, B*55:26, B*55:27, B*55:28, B*55:29, B*55:30, B*55:31, B*55:32, B*55:33, B*55:34, B*55:35, B*55:36, B*55:37, B*55:38, B*55:39, B*55:40, B*55:41, B*55:42, B*55:43, B*56:01:01, B*56:01:02, B*56:01:03, B*56:01:04, B*56:02, B*56:03, B*56:04, B*56:05:01, B*56:05:02, B*56:06, B*56:07, B*56:08, B*56:09, B*56:10, B*56:11, B*56:12, B*56:13, B*56:14, B*56:15, B*56:16, B*56:17, B*56:18, B*56:20, B*56:21, B*56:22, B*56:23, B*56:24, B*56:25, B*56:26, B*56:27, B*56:29, B*57:01:01, B*57:01:02, B*57:01:03, B*57:01:04, B*57:01:05, B*57:01:06, B*57:01:07, B*57:01:08, B*57:02:01, B*57:02:02, B*57:03:01, B*57:03:02, B*57:04, B*57:05, B*57:06, B*57:07, B*57:08, B*57:09, B*57:10, B*57:11, B*57:12, B*57:13, B*57:14, B*57:15, B*57:16, B*57:17, B*57:18, B*57:19, B*57:20, B*57:21, B*57:22, B*57:23, B*57:24, B*57:25, B*57:26, B*57:27, B*57:29, B*57:30, B*57:31, B*57:32, B*58:01:01, B*58:01:02, B*58:01:03, B*58:01:04, B*58:01:05, B*58:01:06, B*58:01:07, B*58:02, B*58:04, B*58:05, B*58:06, B*58:07, B*58:08, B*58:09, B*58:11, B*58:12, B*58:13, B*58:14, B*58:15, B*58:16, B*58:18, B*58:19, B*58:20, B*58:21, B*58:22, B*58:23, B*58:24, B*58:25, B*58:26, B*58:27, B*58:28, B*58:29, B*58:30, B*59:01, B*59:02, B*59:03, B*59:04, B*59:05, B*67:01:01, B*67:01:02, B*67:02, B*73:01, B*73:02, B*78:01, B*78:02:01, B*78:02:02, B*78:03, B*78:04, B*78:05, B*78:06, B*78:07, B*81:01, B*81:02, B*81:03, B*81:05, B*82:01, B*82:02, B*82:03, B*83:01, C*01:02:01, C*01:02:02, C*01:02:03, C*01:02:04, C*01:02:05, C*01:02:06, C*01:02:07, C*01:02:08, C*01:02:09, C*01:02:10, C*01:02:11, C*01:03, C*01:04, C*01:05, C*01:06, C*01:07, C*01:08, C*01:09, C*01:10, C*01:11, C*01:12, C*01:13, C*01:14, C*01:15, C*01:16, C*01:17, C*01:18, C*01:19, C*01:20, C*01:21, C*01:22, C*01:23, C*01:24, C*01:25, C*01:26, C*01:27, C*01:28, C*01:29, C*01:30, C*01:31, C*01:32, C*01:33, C*01:34, C*01:35, C*01:36, C*01:38, C*01:39, C*01:40, C*02:02:01, C*02:02:02, C*02:02:03, C*02:02:05, C*02:02:06, C*02:02:07, C*02:02:08, C*02:02:09, C*02:02:10, C*02:02:11, C*02:02:12, C*02:02:13, C*02:03, C*02:04, C*02:05, C*02:06, C*02:07, C*02:08, C*02:09, C*02:10, C*02:11, C*02:12, C*02:13, C*02:14, C*02:15, C*02:16:01, C*02:16:02, C*02:17, C*02:18, C*02:19, C*02:20, C*02:21, C*02:22, C*02:23, C*02:24, C*02:26:01, C*02:26:02, C*02:27:01, C*02:27:02, C*02:28, C*02:29, C*02:30, C*02:31, C*02:32, C*02:33, C*02:34, C*02:35, C*02:36, C*02:37, C*02:39, C*02:40, C*03:02:01, C*03:02:02, C*03:02:03, C*03:02:04, C*03:02:05, C*03:02:06, C*03:03:01, C*03:03:02, C*03:03:03, C*03:03:04, C*03:03:05, C*03:03:06, C*03:03:07, C*03:03:08, C*03:03:09, C*03:03:10, C*03:03:11, C*03:03:12, C*03:04:01:01, C*03:04:01:02, C*03:04:02, C*03:04:03, C*03:04:04, C*03:04:05, C*03:04:06, C*03:04:07, C*03:04:08, C*03:04:09, C*03:04:10, C*03:04:11, C*03:04:12, C*03:04:13, C*03:04:14, C*03:04:15, C*03:04:16, C*03:04:17, C*03:04:18, C*03:04:19, C*03:05, C*03:06, C*03:07, C*03:08, C*03:09, C*03:10, C*03:11:01, C*03:11:02, C*03:12, C*03:13, C*03:14, C*03:15, C*03:16, C*03:17, C*03:18, C*03:19, C*03:21, C*03:23, C*03:24, C*03:25, C*03:26, C*03:27, C*03:28, C*03:29, C*03:30, C*03:31, C*03:32, C*03:33, C*03:34, C*03:35, C*03:36, C*03:37, C*03:38:01, C*03:38:02, C*03:39, C*03:40, C*03:41, C*03:42, C*03:43:01, C*03:43:02, C*03:44, C*03:45, C*03:46, C*03:47, C*03:48, C*03:49, C*03:50, C*03:51, C*03:52, C*03:53, C*03:54, C*03:55, C*03:56, C*03:57, C*03:58, C*03:59, C*03:60, C*03:61, C*03:62, C*03:63, C*03:64, C*03:65, C*03:66, C*03:67, C*03:68, C*03:69, C*03:70, C*03:71, C*03:72, C*03:73, C*03:74, C*03:75, C*03:76, C*03:77, C*03:78, C*03:79, C*03:80, C*03:81, C*03:82, C*03:83, C*03:84, C*03:85, C*03:86, C*03:87, C*03:88, C*03:89, C*03:90, C*03:91, C*03:92, C*03:93, C*03:94, C*04:01:01:01, C*04:01:01:02, C*04:01:01:03, C*04:01:02, C*04:01:03, C*04:01:04, C*04:01:05, C*04:01:06, C*04:01:07, C*04:01:08, C*04:01:09, C*04:01:10, C*04:01:11, C*04:01:12, C*04:01:13, C*04:01:14, C*04:01:15, C*04:01:16, C*04:01:17, C*04:01:18, C*04:01:19, C*04:01:20, C*04:01:21, C*04:03, C*04:04:01, C*04:04:02, C*04:05, C*04:06, C*04:07, C*04:08, C*04:10, C*04:11, C*04:12, C*04:13, C*04:14, C*04:15:01, C*04:15:02, C*04:16, C*04:17, C*04:18, C*04:19, C*04:20, C*04:23, C*04:24, C*04:25, C*04:26, C*04:27, C*04:28, C*04:29, C*04:30, C*04:31, C*04:32, C*04:33, C*04:34, C*04:35, C*04:36, C*04:37, C*04:38, C*04:39, C*04:40, C*04:41, C*04:42, C*04:43, C*04:44, C*04:45, C*04:46, C*04:47, C*04:48, C*04:49, C*04:50, C*04:51, C*04:52, C*04:53, C*04:54, C*04:55, C*04:56, C*04:57, C*04:58, C*04:60, C*04:61, C*04:62, C*04:63, C*04:64, C*04:65, C*04:66, C*04:67, C*04:68, C*04:69, C*04:70, C*05:01:01:01, C*05:01:01:02, C*05:01:02, C*05:01:03, C*05:01:04, C*05:01:05, C*05:01:06, C*05:01:07, C*05:01:08, C*05:01:09, C*05:01:10, C*05:01:11, C*05:01:12, C*05:01:13, C*05:03, C*05:04, C*05:05, C*05:06, C*05:08, C*05:09, C*05:10, C*05:11, C*05:12, C*05:13, C*05:14, C*05:15, C*05:16, C*05:17, C*05:18, C*05:19, C*05:20, C*05:21, C*05:22, C*05:23, C*05:24, C*05:25, C*05:26, C*05:27, C*05:28, C*05:29, C*05:30, C*05:31, C*05:32, C*05:33, C*05:34, C*05:35, C*05:36, C*05:37, C*05:38, C*05:39, C*05:40, C*05:41, C*05:42, C*05:43, C*05:44, C*05:45, C*06:02:01:01, C*06:02:01:02, C*06:02:03, C*06:02:04, C*06:02:05, C*06:02:06, C*06:02:07, C*06:02:08, C*06:03, C*06:04, C*06:05, C*06:06, C*06:07, C*06:08, C*06:09, C*06:10, C*06:11, C*06:12, C*06:13, C*06:14, C*06:15, C*06:17, C*06:18, C*06:19, C*06:20, C*06:21, C*06:22, C*06:23, C*06:24, C*06:25, C*06:26, C*06:27, C*06:28, C*06:29, C*06:30, C*06:31, C*06:32, C*06:33, C*06:34, C*06:35, C*06:36, C*06:37, C*06:38, C*06:39, C*06:40, C*06:41, C*06:42, C*06:43, C*06:44, C*06:45, C*07:01:01, C*07:01:02, C*07:01:03, C*07:01:04, C*07:01:05, C*07:01:06, C*07:01:07, C*07:01:08, C*07:01:09, C*07:01:10, C*07:01:11, C*07:01:12, C*07:02:01:01, C*07:02:01:02, C*07:02:01:03, C*07:02:02, C*07:02:03, C*07:02:04, C*07:02:05, C*07:02:06, C*07:02:07, C*07:02:08, C*07:02:09, C*07:02:10, C*07:02:11, C*07:02:12, C*07:02:13, C*07:02:14, C*07:02:15, C*07:02:16, C*07:03, C*07:04:01, C*07:04:02, C*07:04:03, C*07:04:04, C*07:05, C*07:06, C*07:07, C*07:08, C*07:09, C*07:10, C*07:100, C*07:101, C*07:102, C*07:103, C*07:105, C*07:106, C*07:107, C*07:108, C*07:109, C*07:11, C*07:110, C*07:111, C*07:112, C*07:113, C*07:114, C*07:115, C*07:116, C*07:117, C*07:118, C*07:119, C*07:12, C*07:120, C*07:122, C*07:123, C*07:124, C*07:125, C*07:126, C*07:127, C*07:128, C*07:129, C*07:13, C*07:130, C*07:131, C*07:132, C*07:133, C*07:134, C*07:135, C*07:136, C*07:137, C*07:138, C*07:139, C*07:14, C*07:140, C*07:141, C*07:142, C*07:143, C*07:144, C*07:145, C*07:146, C*07:147, C*07:148, C*07:149, C*07:15, C*07:16, C*07:17, C*07:18, C*07:19, C*07:20, C*07:21, C*07:22, C*07:23, C*07:24, C*07:25, C*07:26, C*07:27:01, C*07:27:02, C*07:28, C*07:29, C*07:30, C*07:31, C*07:35, C*07:36, C*07:37, C*07:38, C*07:39, C*07:40, C*07:41, C*07:42, C*07:43, C*07:44, C*07:45, C*07:46, C*07:47, C*07:48, C*07:49, C*07:50, C*07:51, C*07:52, C*07:53, C*07:54, C*07:56:01, C*07:56:02, C*07:57, C*07:58, C*07:59, C*07:60, C*07:62, C*07:63, C*07:64, C*07:65, C*07:66, C*07:67, C*07:68, C*07:69, C*07:70, C*07:71, C*07:72, C*07:73, C*07:74, C*07:75, C*07:76, C*07:77, C*07:78, C*07:79, C*07:80, C*07:81, C*07:82, C*07:83, C*07:84, C*07:85, C*07:86, C*07:87, C*07:88, C*07:89, C*07:90, C*07:91, C*07:92, C*07:93, C*07:94, C*07:95, C*07:96, C*07:97, C*07:99, C*08:01:01, C*08:01:02, C*08:02:01, C*08:02:02, C*08:02:03, C*08:02:04, C*08:03:01, C*08:03:02, C*08:04, C*08:05, C*08:06, C*08:07, C*08:08, C*08:09, C*08:10, C*08:11, C*08:12, C*08:13, C*08:14, C*08:15, C*08:16, C*08:17, C*08:18, C*08:19, C*08:20, C*08:21, C*08:22, C*08:23, C*08:24, C*08:25, C*08:27, C*08:28, C*08:29, C*08:30, C*08:31, C*08:32, C*08:33, C*08:34, C*08:35, C*12:02:01, C*12:02:02, C*12:02:03, C*12:02:04, C*12:02:05, C*12:02:06, C*12:03:01:01, C*12:03:01:02, C*12:03:02, C*12:03:03, C*12:03:04, C*12:03:05, C*12:03:06, C*12:03:07, C*12:03:08, C*12:03:09, C*12:03:10, C*12:03:11, C*12:03:12, C*12:04:01, C*12:04:02, C*12:05, C*12:06, C*12:07, C*12:08, C*12:09, C*12:10:01, C*12:10:02, C*12:11, C*12:12, C*12:13, C*12:14:01, C*12:14:02, C*12:15, C*12:16, C*12:17, C*12:18, C*12:19, C*12:20, C*12:21, C*12:22, C*12:23, C*12:24, C*12:25, C*12:26, C*12:27, C*12:28, C*12:29, C*12:30, C*12:31, C*12:32, C*12:33, C*12:34, C*12:35, C*12:36, C*12:37, C*12:38, C*12:40, C*12:41, C*12:43, C*12:44, C*14:02:01, C*14:02:02, C*14:02:03, C*14:02:04, C*14:02:05, C*14:03, C*14:04, C*14:05, C*14:06, C*14:08, C*14:09, C*14:10, C*14:11, C*14:12, C*14:13, C*14:14, C*14:15, C*14:16, C*14:17, C*14:18, C*14:19, C*14:20, C*15:02:01, C*15:02:02, C*15:02:03, C*15:02:04, C*15:02:05, C*15:02:06, C*15:03, C*15:04, C*15:05:01, C*15:05:02, C*15:05:03, C*15:05:04, C*15:05:05, C*15:06:01, C*15:06:02, C*15:07, C*15:08, C*15:09, C*15:10:01, C*15:10:02, C*15:11, C*15:12, C*15:13, C*15:15, C*15:16, C*15:17, C*15:18, C*15:19, C*15:20, C*15:21, C*15:22, C*15:23, C*15:24, C*15:25, C*15:26, C*15:27, C*15:28, C*15:29, C*15:30, C*15:31, C*15:33, C*15:34, C*15:35, C*16:01:01, C*16:01:02, C*16:01:03, C*16:01:04, C*16:02:01, C*16:02:02, C*16:02:03, C*16:02:04, C*16:04:01, C*16:06, C*16:07, C*16:08, C*16:09, C*16:10, C*16:11, C*16:12, C*16:13, C*16:14, C*16:15, C*16:17, C*16:18, C*16:19, C*16:20, C*16:21, C*16:22, C*16:23, C*16:24, C*16:25, C*16:26, C*17:01:01:01, C*17:01:01:02, C*17:01:02, C*17:01:03, C*17:01:04, C*17:02, C*17:03, C*17:04, C*17:05, C*17:06, C*17:07, C*18:01, C*18:02, C*18:03, E*01:01:01:01, E*01:01:01:02, E*01:01:01:03, E*01:03:01:01, E*01:03:01:02, E*01:03:02, E*01:03:03, E*01:03:04, E*01:04, F*01:01:01:01, F*01:01:01:02, F*01:01:01:03, F*01:01:01:04, F*01:01:01:05, F*01:01:01:06, F*01:01:01:07, F*01:01:01:08, F*01:01:02:01, F*01:01:02:02, F*01:01:02:03, F*01:01:02:04, F*01:01:02:05, F*01:01:03:01, F*01:01:03:02, F*01:01:03:03, F*01:01:03:04, F*01:02, F*01:03:01:01, F*01:03:01:02, F*01:04, G*01:01:01:01, G*01:01:01:02, G*01:01:01:03, G*01:01:01:04, G*01:01:01:05, G*01:01:01:06, G*01:01:02:01, G*01:01:02:02, G*01:01:03:01, G*01:01:03:02, G*01:01:04, G*01:01:05, G*01:01:06, G*01:01:07, G*01:01:08, G*01:01:09, G*01:01:11, G*01:01:12, G*01:01:13, G*01:01:14, G*01:01:15, G*01:01:16, G*01:01:17, G*01:01:18, G*01:01:19, G*01:01:20, G*01:02, G*01:03, G*01:04:01, G*01:04:02, G*01:04:03, G*01:04:04, G*01:04:05, G*01:06, G*01:07, G*01:08, G*01:09, G*01:10, G*01:11, G*01:12, G*01:14, G*01:15, G*01:16, G*01:17, DRA*01:01, DRA*01:02:01, DRA*01:02:02, DRB1*01:01:01, DRB1*01:01:02, DRB1*01:01:03, DRB1*01:01:04, DRB1*01:01:05, DRB1*01:01:06, DRB1*01:01:07, DRB1*01:01:08, DRB1*01:01:09, DRB1*01:01:10, DRB1*01:01:11, DRB1*01:01:12, DRB1*01:01:13, DRB1*01:01:14, DRB1*01:01:15, DRB1*01:01:16, DRB1*01:01:17, DRB1*01:01:18, DRB1*01:02:01, DRB1*01:02:02, DRB1*01:02:03, DRB1*01:02:04, DRB1*01:02:05, DRB1*01:03, DRB1*01:04, DRB1*01:05, DRB1*01:06, DRB1*01:07, DRB1*01:08, DRB1*01:09, DRB1*01:10, DRB1*01:11, DRB1*01:12, DRB1*01:13, DRB1*01:14, DRB1*01:15, DRB1*01:16, DRB1*01:17, DRB1*01:18, DRB1*01:19, DRB1*01:20, DRB1*01:21, DRB1*01:22, DRB1*01:23, DRB1*01:24, DRB1*01:25, DRB1*01:26, DRB1*01:27, DRB1*01:28, DRB1*01:29, DRB1*01:30, DRB1*01:31, DRB1*01:32, DRB1*03:01:01, DRB1*03:01:01:02, DRB1*03:01:02, DRB1*03:01:03, DRB1*03:01:04, DRB1*03:01:05, DRB1*03:01:06, DRB1*03:01:07, DRB1*03:01:08, DRB1*03:01:09, DRB1*03:02:01, DRB1*03:02:02, DRB1*03:03, DRB1*03:04, DRB1*03:05:01, DRB1*03:05:02, DRB1*03:05:03, DRB1*03:06, DRB1*03:07, DRB1*03:08, DRB1*03:09, DRB1*03:10, DRB1*03:11:01, DRB1*03:11:02, DRB1*03:12, DRB1*03:13:01, DRB1*03:13:02, DRB1*03:14, DRB1*03:15, DRB1*03:16, DRB1*03:17, DRB1*03:18, DRB1*03:19, DRB1*03:20, DRB1*03:21, DRB1*03:22, DRB1*03:23, DRB1*03:24, DRB1*03:25, DRB1*03:26, DRB1*03:27, DRB1*03:28, DRB1*03:29, DRB1*03:30, DRB1*03:31, DRB1*03:32, DRB1*03:33, DRB1*03:34, DRB1*03:35, DRB1*03:36, DRB1*03:37, DRB1*03:38, DRB1*03:39, DRB1*03:40, DRB1*03:41, DRB1*03:42, DRB1*03:43, DRB1*03:44, DRB1*03:45, DRB1*03:46, DRB1*03:47, DRB1*03:48, DRB1*03:49, DRB1*03:50, DRB1*03:51, DRB1*03:52, DRB1*03:53, DRB1*03:54, DRB1*03:55, DRB1*04:01:01, DRB1*04:01:02, DRB1*04:01:03, DRB1*04:01:04, DRB1*04:01:05, DRB1*04:01:06, DRB1*04:02, DRB1*04:03:01, DRB1*04:03:02, DRB1*04:03:03, DRB1*04:03:04, DRB1*04:03:05, DRB1*04:04:01, DRB1*04:04:02, DRB1*04:04:03, DRB1*04:04:04, DRB1*04:05, DRB1*04:05:01, DRB1*04:05:02, DRB1*04:05:03, DRB1*04:05:04, DRB1*04:05:05, DRB1*04:05:06, DRB1*04:05:07, DRB1*04:05:08, DRB1*04:05:09, DRB1*04:05:10, DRB1*04:06:01, DRB1*04:06:02, DRB1*04:06:03, DRB1*04:07:01, DRB1*04:07:02, DRB1*04:07:03, DRB1*04:07:04, DRB1*04:08:01, DRB1*04:08:02, DRB1*04:08:09, DRB1*04:10, DRB1*04:11, DRB1*04:12, DRB1*04:13, DRB1*04:14, DRB1*04:15, DRB1*04:16, DRB1*04:17:01, DRB1*04:17:02, DRB1*04:18, DRB1*04:19, DRB1*04:20, DRB1*04:21, DRB1*04:22, DRB1*04:23, DRB1*04:24, DRB1*04:25, DRB1*04:26, DRB1*04:27, DRB1*04:28, DRB1*04:29, DRB1*04:30, DRB1*04:31, DRB1*04:32, DRB1*04:33, DRB1*04:34, DRB1*04:35, DRB1*04:36, DRB1*04:37, DRB1*04:38, DRB1*04:39, DRB1*04:40, DRB1*04:41, DRB1*04:42, DRB1*04:43, DRB1*04:44, DRB1*04:45, DRB1*04:46, DRB1*04:47, DRB1*04:48, DRB1*04:49, DRB1*04:50, DRB1*04:51, DRB1*04:52, DRB1*04:53, DRB1*04:54, DRB1*04:55, DRB1*04:56, DRB1*04:57, DRB1*04:58, DRB1*04:59, DRB1*04:60, DRB1*04:61, DRB1*04:62, DRB1*04:63, DRB1*04:64, DRB1*04:65, DRB1*04:66, DRB1*04:67, DRB1*04:68, DRB1*04:69, DRB1*04:70, DRB1*04:71, DRB1*04:72:01, DRB1*04:72:02, DRB1*04:73, DRB1*04:74, DRB1*04:75, DRB1*04:76, DRB1*04:77, DRB1*04:78, DRB1*04:79, DRB1*04:80, DRB1*04:82, DRB1*04:83, DRB1*04:84, DRB1*04:85, DRB1*04:86, DRB1*04:87, DRB1*04:88, DRB1*04:89, DRB1*04:91, DRB1*07:01:01:01, DRB1*07:01:01:02, DRB1*07:01:02, DRB1*07:01:03, DRB1*07:03, DRB1*07:04, DRB1*07:05, DRB1*07:06, DRB1*07:07, DRB1*07:08, DRB1*07:09, DRB1*07:11, DRB1*07:12, DRB1*07:13, DRB1*07:14, DRB1*07:15, DRB1*07:16, DRB1*07:17, DRB1*07:19, DRB1*08:01:01, DRB1*08:01:02, DRB1*08:01:03, DRB1*08:01:04, DRB1*08:01:05, DRB1*08:02:01, DRB1*08:02:02, DRB1*08:02:03, DRB1*08:03:02, DRB1*08:04:01, DRB1*08:04:02, DRB1*08:04:03, DRB1*08:04:04, DRB1*08:04:05, DRB1*08:05, DRB1*08:06, DRB1*08:07, DRB1*08:08, DRB1*08:09, DRB1*08:10, DRB1*08:11, DRB1*08:12, DRB1*08:13, DRB1*08:14, DRB1*08:15, DRB1*08:16, DRB1*08:17, DRB1*08:18, DRB1*08:19, DRB1*08:20, DRB1*08:21, DRB1*08:22, DRB1*08:23, DRB1*08:24, DRB1*08:25, DRB1*08:26, DRB1*08:27, DRB1*08:28, DRB1*08:29, DRB1*08:30:01, DRB1*08:30:02, DRB1*08:31, DRB1*08:32, DRB1*08:33, DRB1*08:34, DRB1*08:35, DRB1*08:36, DRB1*08:37, DRB1*08:38, DRB1*08:39, DRB1*08:40, DRB1*09:01:02, DRB1*09:01:03, DRB1*09:01:04, DRB1*09:01:05, DRB1*09:01:06, DRB1*09:01:07, DRB1*09:02:01, DRB1*09:02:02, DRB1*09:03, DRB1*09:04, DRB1*09:05, DRB1*09:06, DRB1*09:07, DRB1*09:08, DRB1*09:09, DRB1*10:01:01, DRB1*10:01:02, DRB1*10:01:03, DRB1*10:02, DRB1*10:03, DRB1*11:01:01, DRB1*11:01:02, DRB1*11:01:03, DRB1*11:01:04, DRB1*11:01:05, DRB1*11:01:06, DRB1*11:01:07, DRB1*11:01:08, DRB1*11:01:09, DRB1*11:01:10, DRB1*11:01:11, DRB1*11:02:01, DRB1*11:02:02, DRB1*11:03, DRB1*11:04:01, DRB1*11:04:02, DRB1*11:04:03, DRB1*11:04:04, DRB1*11:04:05, DRB1*11:05, DRB1*11:06:01, DRB1*11:06:02, DRB1*11:07, DRB1*11:08:01, DRB1*11:08:02, DRB1*11:09, DRB1*11:10:01, DRB1*11:10:02, DRB1*11:11:01, DRB1*11:11:02, DRB1*11:12:01, DRB1*11:12:02, DRB1*11:13:01, DRB1*11:13:02, DRB1*11:14:01, DRB1*11:14:02, DRB1*11:15, DRB1*11:16, DRB1*11:17, DRB1*11:18, DRB1*11:19:01, DRB1*11:19:02, DRB1*11:20, DRB1*11:21, DRB1*11:22, DRB1*11:23, DRB1*11:24, DRB1*11:25, DRB1*11:26, DRB1*11:27:01, DRB1*11:27:02, DRB1*11:28:01, DRB1*11:28:02, DRB1*11:29, DRB1*11:30, DRB1*11:31, DRB1*11:32, DRB1*11:33, DRB1*11:34, DRB1*11:35, DRB1*11:36, DRB1*11:37, DRB1*11:38, DRB1*11:39, DRB1*11:40, DRB1*11:41, DRB1*11:42, DRB1*11:43, DRB1*11:44, DRB1*11:45, DRB1*11:46, DRB1*11:47, DRB1*11:48, DRB1*11:49, DRB1*11:50, DRB1*11:51, DRB1*11:52, DRB1*11:53, DRB1*11:54:01, DRB1*11:54:02, DRB1*11:55, DRB1*11:56, DRB1*11:57, DRB1*11:58:01, DRB1*11:58:02, DRB1*11:59, DRB1*11:60, DRB1*11:61, DRB1*11:62, DRB1*11:63, DRB1*11:64, DRB1*11:65:01, DRB1*11:65:02, DRB1*11:66, DRB1*11:67, DRB1*11:68, DRB1*11:69, DRB1*11:70, DRB1*11:72, DRB1*11:73, DRB1*11:74, DRB1*11:75, DRB1*11:76, DRB1*11:77, DRB1*11:78, DRB1*11:79, DRB1*11:80, DRB1*11:81, DRB1*11:82, DRB1*11:83, DRB1*11:84, DRB1*11:85, DRB1*11:86, DRB1*11:87, DRB1*11:88, DRB1*11:89, DRB1*11:90, DRB1*11:91, DRB1*11:92, DRB1*11:93, DRB1*11:94, DRB1*11:95, DRB1*11:96, DRB1*12:01:01, DRB1*12:01:02, DRB1*12:01:03, DRB1*12:02:01, DRB1*12:02:02, DRB1*12:02:03, DRB1*12:02:04, DRB1*12:02:05, DRB1*12:03:02, DRB1*12:04, DRB1*12:05, DRB1*12:06, DRB1*12:07, DRB1*12:08, DRB1*12:09, DRB1*12:10, DRB1*12:11, DRB1*12:12, DRB1*12:13, DRB1*12:14, DRB1*12:15, DRB1*12:16, DRB1*12:17, DRB1*12:18, DRB1*12:19, DRB1*12:20, DRB1*12:21, DRB1*12:22, DRB1*12:23, DRB1*13:01:01, DRB1*13:01:02, DRB1*13:01:03, DRB1*13:01:04, DRB1*13:01:05, DRB1*13:01:06, DRB1*13:01:07, DRB1*13:02:01, DRB1*13:02:02, DRB1*13:02:03, DRB1*13:03:01, DRB1*13:03:02, DRB1*13:03:03, DRB1*13:03:04, DRB1*13:03:05, DRB1*13:03:06, DRB1*13:04, DRB1*13:05:01, DRB1*13:05:02, DRB1*13:06, DRB1*13:07:01, DRB1*13:07:02, DRB1*13:08, DRB1*13:09, DRB1*13:10, DRB1*13:100, DRB1*13:101, DRB1*13:11:01, DRB1*13:11:02, DRB1*13:12, DRB1*13:13, DRB1*13:14:01, DRB1*13:14:02, DRB1*13:14:03, DRB1*13:15, DRB1*13:16, DRB1*13:17, DRB1*13:18, DRB1*13:19, DRB1*13:20, DRB1*13:21:01, DRB1*13:21:02, DRB1*13:22, DRB1*13:23, DRB1*13:24, DRB1*13:25, DRB1*13:26, DRB1*13:27, DRB1*13:28, DRB1*13:29, DRB1*13:30, DRB1*13:31, DRB1*13:32, DRB1*13:33:01, DRB1*13:33:02, DRB1*13:33:03, DRB1*13:34, DRB1*13:35, DRB1*13:36, DRB1*13:37, DRB1*13:38, DRB1*13:39, DRB1*13:40, DRB1*13:41, DRB1*13:42, DRB1*13:43, DRB1*13:44, DRB1*13:45, DRB1*13:46, DRB1*13:47, DRB1*13:48, DRB1*13:49, DRB1*13:50:01, DRB1*13:50:02, DRB1*13:51, DRB1*13:52, DRB1*13:53, DRB1*13:54, DRB1*13:55, DRB1*13:56, DRB1*13:57, DRB1*13:58, DRB1*13:59, DRB1*13:60, DRB1*13:61, DRB1*13:62, DRB1*13:63, DRB1*13:64, DRB1*13:65, DRB1*13:66:01, DRB1*13:66:02, DRB1*13:67, DRB1*13:68, DRB1*13:69, DRB1*13:70, DRB1*13:71, DRB1*13:72, DRB1*13:73, DRB1*13:74, DRB1*13:75, DRB1*13:76, DRB1*13:77, DRB1*13:78, DRB1*13:79, DRB1*13:80, DRB1*13:81, DRB1*13:82, DRB1*13:83, DRB1*13:84, DRB1*13:85, DRB1*13:86, DRB1*13:87, DRB1*13:88, DRB1*13:89, DRB1*13:90, DRB1*13:91, DRB1*13:92, DRB1*13:93, DRB1*13:94, DRB1*13:95, DRB1*13:96, DRB1*13:97, DRB1*13:98, DRB1*13:99, DRB1*14:01:01, DRB1*14:01:02, DRB1*14:01:03, DRB1*14:02, DRB1*14:03:01, DRB1*14:03:02, DRB1*14:04, DRB1*14:05:01, DRB1*14:05:02, DRB1*14:05:03, DRB1*14:06:01, DRB1*14:06:02, DRB1*14:07:01, DRB1*14:07:02, DRB1*14:08, DRB1*14:09, DRB1*14:10, DRB1*14:11, DRB1*14:12, DRB1*14:13, DRB1*14:

14, DRB1*14:15, DRB1*14:16, DRB1*14:17, DRB1*14:18, DRB1*14:19, DRB1*14:20, DRB1*14:21, DRB1*14:22, DRB1*14:23:01, DRB1*14:23:02, DRB1*14:23:03, DRB1*14:24, DRB1*14:25, DRB1*14:26, DRB1*14:27, DRB1*14:28, DRB1*14:29, DRB1*14:30, DRB1*14:31, DRB1*14:32:01, DRB1*14:32:02, DRB1*14:33, DRB1*14:34, DRB1*14:35, DRB1*14:36, DRB1*14:37, DRB1*14:38, DRB1*14:39, DRB1*14:40, DRB1*14:41, DRB1*14:42, DRB1*14:43, DRB1*14:44:01, DRB1*14:44:02, DRB1*14:45, DRB1*14:46, DRB1*14:47, DRB1*14:48, DRB1*14:49, DRB1*14:50, DRB1*14:51, DRB1*14:52, DRB1*14:53, DRB1*14:54, DRB1*14:55, DRB1*14:56, DRB1*14:57, DRB1*14:58, DRB1*14:59, DRB1*14:60, DRB1*14:61, DRB1*14:62, DRB1*14:63, DRB1*14:64, DRB1*14:65, DRB1*14:67, DRB1*14:68, DRB1*14:69, DRB1*14:70, DRB1*14:71, DRB1*14:72, DRB1*14:73, DRB1*14:74, DRB1*14:75, DRB1*14:76, DRB1*14:77, DRB1*14:78, DRB1*14:79, DRB1*14:80, DRB1*14:81, DRB1*14:82, DRB1*14:83, DRB1*14:84, DRB1*14:85, DRB1*14:86, DRB1*14:87, DRB1*14:88, DRB1*14:89, DRB1*14:90, DRB1*14:91, DRB1*14:93, DRB1*14:94, DRB1*14:95, DRB1*14:96, DRB1*14:97, DRB1*14:98, DRB1*14:99, DRB1*15:01:01:01, DRB1*15:01:01:02, DRB1*15:01:02, DRB1*15:01:03, DRB1*15:01:04, DRB1*15:01:05, DRB1*15:01:06, DRB1*15:01:07, DRB1*15:01:08, DRB1*15:01:09, DRB1*15:01:10, DRB1*15:01:11, DRB1*15:01:12, DRB1*15:02:01, DRB1*15:02:02, DRB1*15:02:03, DRB1*15:02:04, DRB1*15:02:05, DRB1*15:02:06, DRB1*15:02:07, DRB1*15:03:01:01, DRB1*15:03:01:02, DRB1*15:04, DRB1*15:05, DRB1*15:06, DRB1*15:07, DRB1*15:08, DRB1*15:09, DRB1*15:10, DRB1*15:11, DRB1*15:12, DRB1*15:13, DRB1*15:14, DRB1*15:15, DRB1*15:16, DRB1*15:18, DRB1*15:19, DRB1*15:20, DRB1*15:21, DRB1*15:22, DRB1*15:23, DRB1*15:24, DRB1*15:25, DRB1*15:26, DRB1*15:27, DRB1*15:28, DRB1*15:29, DRB1*15:30, DRB1*15:31, DRB1*15:32, DRB1*15:33, DRB1*15:34, DRB1*15:35, DRB1*15:36, DRB1*15:37, DRB1*15:38, DRB1*15:39, DRB1*15:40, DRB1*15:41, DRB1*15:42, DRB1*15:43, DRB1*15:44, DRB1*15:45, DRB1*15:46, DRB1*15:47, DRB1*15:48, DRB1*15:49, DRB1*16:01:01, DRB1*16:01:02, DRB1*16:02:01, DRB1*16:02:02, DRB1*16:03, DRB1*16:04, DRB1*16:05:01, DRB1*16:05:02, DRB1*16:07, DRB1*16:08, DRB1*16:09, DRB1*16:10, DRB1*16:11, DRB1*16:12, DRB1*16:14, DRB1*16:15, DRB1*16:16, DRB2*01:01, DRB3*01:01:02:01, DRB3*01:01:02:02, DRB3*01:01:03, DRB3*01:01:04, DRB3*01:01:05, DRB3*01:02, DRB3*01:03, DRB3*01:04, DRB3*01:05, DRB3*01:06, DRB3*01:07, DRB3*01:08, DRB3*01:09, DRB3*01:10, DRB3*01:11, DRB3*01:12, DRB3*01:13, DRB3*01:14, DRB3*02:01, DRB3*02:02:01, DRB3*02:02:02, DRB3*02:02:03, DRB3*02:02:04, DRB3*02:02:05, DRB3*02:03, DRB3*02:04, DRB3*02:05, DRB3*02:06, DRB3*02:07, DRB3*02:08, DRB3*02:09, DRB3*02:10, DRB3*02:11, DRB3*02:12, DRB3*02:13, DRB3*02:14, DRB3*02:15, DRB3*02:16, DRB3*02:17, DRB3*02:18, DRB3*02:19, DRB3*02:20, DRB3*02:21, DRB3*02:22, DRB3*02:23, DRB3*02:24, DRB3*02:25, DRB3*03:01:01, DRB3*03:01:02, DRB3*03:01:03, DRB3*03:02, DRB3*03:03, DRB4*01:01:01:01, DRB4*01:02, DRB4*01:03:01:01, DRB4*01:03:02, DRB4*01:03:03, DRB4*01:03:04, DRB4*01:04, DRB4*01:05, DRB4*01:06, DRB4*01:07, DRB4*01:08, DRB5*01:01:01, DRB5*01:01:02, DRB5*01:02, DRB5*01:03, DRB5*01:04, DRB5*01:05, DRB5*01:06, DRB5*01:07, DRB5*01:09, DRB5*01:11, DRB5*01:12, DRB5*01:13, DRB5*01:14, DRB5*02:02, DRB5*02:03, DRB5*02:04, DRB5*02:05, DRB6*01:01, DRB6*02:01, DRB6*02:02, DRB7*01:01:01, DRB7*01:01:02, DRB8*01:01, DRB9*01:01, DQA1*01:01:01, DQA1*01:01:02, DQA1*01:02:01, DQA1*01:02:02, DQA1*01:02:03, DQA1*01:02:04, DQA1*01:03, DQA1*01:04:01, DQA1*01:04:02, DQA1*01:05, DQA1*01:06, DQA1*01:07, DQA1*02:01, DQA1*03:01:01, DQA1*03:02, DQA1*03:03, DQA1*04:01:01, DQA1*04:01:02, DQA1*04:02, DQA1*04:04, DQA1*05:01:01, DQA1*05:01:02, DQA1*05:02, DQA1*05:03, DQA1*05:04, DQA1*05:05, DQA1*05:06, DQA1*05:07, DQA1*05:08, DQA1*05:09, DQA1*05:10, DQA1*06:01:01, DQA1*06:01:02, DQA1*06:02, DQB1*02:01:01, DQB1*02:01:02, DQB1*02:02, DQB1*02:03, DQB1*02:04, DQB1*02:05, DQB1*03:01:01, DQB1*03:01:02, DQB1*03:01:03, DQB1*03:01:04, DQB1*03:02:01, DQB1*03:02:02, DQB1*03:02:03, DQB1*03:02:04, DQB1*03:02:05, DQB1*03:03:02, DQB1*03:03:03, DQB1*03:04, DQB1*03:05:01, DQB1*03:05:02, DQB1*03:05:03, DQB1*03:05:04, DQB1*03:06, DQB1*03:07, DQB1*03:08, DQB1*03:09, DQB1*03:10, DQB1*03:11, DQB1*03:12, DQB1*03:13, DQB1*03:14, DQB1*03:15, DQB1*03:16, DQB1*03:17, DQB1*03:18, DQB1*03:19, DQB1*03:20, DQB1*03:21, DQB1*03:22, DQB1*03:23, DQB1*03:24, DQB1*03:25, DQB1*03:26, DQB1*03:27, DQB1*04:01:01, DQB1*04:01:02, DQB1*04:02, DQB1*04:03:01, DQB1*04:03:02, DQB1*04:04, DQB1*04:05, DQB1*05:01:01, DQB1*05:01:02, DQB1*05:02:01, DQB1*05:02:02, DQB1*05:03:01, DQB1*05:03:02, DQB1*05:04, DQB1*05:05, DQB1*05:06, DQB1*06:01:01, DQB1*06:01:02, DQB1*06:01:03, DQB1*06:01:04, DQB1*06:01:05, DQB1*06:02:01, DQB1*06:02:02, DQB1*06:03:01, DQB1*06:03:02, DQB1*06:04:01, DQB1*06:04:02, DQB1*06:04:03, DQB1*06:05:01, DQB1*06:05:02, DQB1*06:06, DQB1*06:07, DQB1*06:08:01, DQB1*06:08:02, DQB1*06:09, DQB1*06:10, DQB1*06:11:01, DQB1*06:11:02, DQB1*06:12, DQB1*06:13, DQB1*06:14:01, DQB1*06:14:02, DQB1*06:15, DQB1*06:16, DQB1*06:17, DQB1*06:18, DQB1*06:19, DQB1*06:20, DQB1*06:21, DQB1*06:22, DQB1*06:23, DQB1*06:24, DQB1*06:25, DQB1*06:27, DQB1*06:28, DQB1*06:29, DQB1*06:30, DQB1*06:31, DQB1*06:32, DQB1*06:33, DQB1*06:34, DQB1*06:35, DQB1*06:36, DQB1*06:37, DQB1*06:38, DQB1*06:39, DQB1*06:40, DPA1*01:03:01, DPA1*01:03:02, DPA1*01:03:03, DPA1*01:03:04, DPA1*01:04, DPA1*01:05, DPA1*01:06:01, DPA1*01:06:02, DPA1*01:07, DPA1*01:08, DPA1*01:09, DPA1*01:10, DPA1*02:01:01, DPA1*02:01:02, DPA1*02:01:03, DPA1*02:01:04, DPA1*02:01:05, DPA1*02:01:06, DPA1*02:01:07, DPA1*02:02:01, DPA1*02:02:02, DPA1*02:02:03, DPA1*02:03, DPA1*02:04, DPA1*03:01, DPA1*03:02, DPA1*03:03, DPA1*04:01, DPB1*01:01:01, DPB1*01:01:02, DPB1*01:01:03, DPB1*02:01:02, DPB1*02:01:03, DPB1*02:01:04, DPB1*02:01:05, DPB1*02:01:06, DPB1*02:01:07, DPB1*02:02, DPB1*03:01:01, DPB1*03:01:02, DPB1*04:01:01, DPB1*04:01:02, DPB1*04:02, DPB1*05:01:01, DPB1*05:01:02, DPB1*06:01, DPB1*08:01, DPB1*09:01, DPB1*100:01, DPB1*101:01, DPB1*102:01, DPB1*103:01, DPB1*104:01, DPB1*105:01, DPB1*106:01, DPB1*107:01, DPB1*108:01, DPB1*109:01, DPB1*10:01, DPB1*110:01, DPB1*111:01, DPB1*112:01, DPB1*113:01, DPB1*114:01, DPB1*115:01, DPB1*116:01, DPB1*117:01, DPB1*118:01, DPB1*119:01, DPB1*11:01:01, DPB1*11:01:02, DPB1*121:01, DPB1*122:01, DPB1*123:01, DPB1*124:01, DPB1*125:01, DPB1*126:01, DPB1*127:01,

DPB1*128:01, DPB1*13:01, DPB1*14:01, DPB1*15:01, DPB1*16:01, DPB1*17:01, DPB1*18:01, DPB1*19:01, DPB1*20:01:01, DPB1*20:01:02, DPB1*21:01, DPB1*22:01, DPB1*23:01, DPB1*24:01, DPB1*25:01, DPB1*26:01, DPB1*26:01:02, DPB1*27:01, DPB1*28:01, DPB1*29:01, DPB1*30:01, DPB1*31:01, DPB1*32:01, DPB1*33:01, DPB1*34:01, DPB1*35:01:01, DPB1*35:01:02, DPB1*36:01, DPB1*37:01, DPB1*38:01, DPB1*39:01, DPB1*40:01, DPB1*41:01:01, DPB1*41:01:02, DPB1*44:01, DPB1*45:01, DPB1*46:01, DPB1*47:01, DPB1*48:01, DPB1*49:01, DPB1*50:01, DPB1*51:01, DPB1*52:01, DPB1*53:01, DPB1*54:01, DPB1*55:01, DPB1*56:01, DPB1*57:01, DPB1*58:01, DPB1*59:01, DPB1*60:01, DPB1*62:01, DPB1*63:01, DPB1*65:01, DPB1*66:01, DPB1*67:01, DPB1*68:01, DPB1*69:01, DPB1*70:01, DPB1*71:01, DPB1*72:01, DPB1*73:01, DPB1*74:01, DPB1*75:01, DPB1*76:01, DPB1*77:01, DPB1*78:01, DPB1*79:01, DPB1*80:01, DPB1*81:01, DPB1*82:01, DPB1*83:01, DPB1*84:01, DPB1*85:01, DPB1*86:01, DPB1*87:01, DPB1*88:01, DPB1*89:01, DPB1*90:01, DPB1*91:01, DPB1*92:01, DPB1*93:01, DPB1*94:01, DPB1*95:01, DPB1*96:01, DPB1*97:01, DPB1*98:01, DPB1*99:01, DMA*01:01, DMA*01:02, DMA*01:03, DMA*01:04, DMB*01:01, DMB*01:02, DMB*01:03, DMB*01:04, DMB*01:05, DMB*01:06, DMB*01:07, DOA*01:01:01, DOA*01:01:02:01, DOA*01:01:02:02, DOA*01:01:02:03, DOA*01:01:03, DOA*01:01:04:01, DOA*01:01:04:02, DOA*01:01:05, DOA*01:01:06, DOA*01:02, DOA*01:03, DOB*01:01:01:01, DOB*01:01:01:02, DOB*01:01:02, DOB*01:01:03, DOB*01:02:01, DOB*01:02:02, DOB*01:03, DOB*01:04:01:01, DOB*01:04:01:02, MICA*001, MICA*002:01, MICA*002:02, MICA*002:03, MICA*004, MICA*005, MICA*006, MICA*007:01, MICA*007:02, MICA*007:03, MICA*008:01, MICA*008:02, MICA*008:03, MICA*008:04, MICA*009:01, MICA*009:02, MICA*010, MICA*011, MICA*012:01, MICA*012:02, MICA*012:03, MICA*013, MICA*014, MICA*015, MICA*016, MICA*017, MICA*018:01, MICA*018:02, MICA*019, MICA*020, MICA*022, MICA*023, MICA*024, MICA*025, MICA*026, MICA*027, MICA*028, MICA*029, MICA*030, MICA*031, MICA*032, MICA*033, MICA*034, MICA*035, MICA*036, MICA*037, MICA*038, MICA*039, MICA*040, MICA*041, MICA*042, MICA*043, MICA*044, MICA*045, MICA*046, MICA*047, MICA*048, MICA*049, MICA*050, MICA*051, MICA*052, MICA*053, MICA*054, MICA*055, MICA*056, MICA*057, MICA*058, MICA*059, MICA*060, MICA*061, MICA*062, MICA_, MICB*001, MICB*002:01:01, MICB*002:01:02, MICB*003, MICB*004:01:01, MICB*004:01:02, MICB*005:01, MICB*005:02:01, MICB*005:02:02, MICB*005:02:03, MICB*005:02:04, MICB*005:03, MICB*005:04, MICB*005:05, MICB*006, MICB*007, MICB*008, MICB*010, MICB*011, MICB*012, MICB*013, MICB*014, MICB*015, MICB*016, MICB*018, MICB*019, MICB*020, MICB*022, MICB_, TAP1*01:01, TAP1*02:01:01, TAP1*02:01:02, TAP1*03:01, TAP1*04:01, TAP1*05:01, TAP1_, TAP2*01:01, TAP2*01:02, TAP2*01:03, TAP2*02:01, TAP2_, KIR2DL1*001, KIR2DL1*0020101, KIR2DL1*0020102, KIR2DL1*0020103, KIR2DL1*00301, KIR2DL1*0030201, KIR2DL1*0030202, KIR2DL1*0030203, KIR2DL1*0030204, KIR2DL1*0030205, KIR2DL1*0030206, KIR2DL1*0030207, KIR2DL1*0030208, KIR2DL1*0030209, KIR2DL1*0030210, KIR2DL1*00303, KIR2DL1*0040101, KIR2DL1*0040102, KIR2DL1*00402, KIR2DL1*00403, KIR2DL1*005, KIR2DL1*006, KIR2DL1*007, KIR2DL1*008, KIR2DL1*009, KIR2DL1*010, KIR2DL1*01101, KIR2DL1*01102, KIR2DL1*01201, KIR2DL1*014, KIR2DL1*015, KIR2DL1*016, KIR2DL1*017, KIR2DL1*018, KIR2DL1*019, KIR2DL1*025, KIR2DL2*0010101, KIR2DL2*0010102, KIR2DL2*0010103, KIR2DL2*0010104, KIR2DL2*0010105, KIR2DL2*0010106, KIR2DL2*0010107, KIR2DL*00102, KIR2DL2*002, KIR2DL2*0030101, KIR2DL2*0030102, KIR2DL2*0030103, KIR2DL2*0030104, KIR2DL2*0030105, KIR2DL2*0030106, KIR2DL2*0030107, KIR2DL2*00302, KIR2DL2*00303, KIR2DL2*00304, KIR2DL2*004, KIR2DL2*005, KIR2DL2*00601, KIR2DL2*00602, KIR2DL2*007, KIR2DL2*008, KIR2DL2*009, KIR2DL2*010, KIR2DL3*0010101, KIR2DL3*0010102, KIR2DL3*0010103, KIR2DL3*0010104, KIR2DL3*0010105, KIR2DL3*0010106, KIR2DL3*0010107, KIR2DL3*0010108, KIR2DL3*0010109, KIR2DL3*0010110, KIR2DL3*0010111, KIR2DL3*00102, KIR2DL3*00103, KIR2DL3*00104, KIR2DL3*0020101, KIR2DL3*0020102, KIR2DL3*0020103, KIR2DL3*003, KIR2DL3*004, KIR2DL3*005, KIR2DL3*006, KIR2DL3*007, KIR2DL3*009, KIR2DL3*010, KIR2DL3*011, KIR2DL3*01201, KIR2DL3*013, KIR2DL3*014, KIR2DL3*015, KIR2DL3*016, KIR2DL3*017, KIR2DL4*00101, KIR2DL4*0010201, KIR2DL4*0010202, KIR2DL4*0010301, KIR2DL4*0010302, KIR2DL4*0010303, KIR2DL4*0010304, KIR2DL4*0010305, KIR2DL4*0010306, KIR2DL4*0010307, KIR2DL4*0010308, KIR2DL4*00104, KIR2DL4*00105, KIR2DL4*00201, KIR2DL4*00202, KIR2DL4*003, KIR2DL4*004, KIR2DL4*00501, KIR2DL4*00502, KIR2DL4*00601, KIR2DL4*00602, KIR2DL4*007, KIR2DL4*0080101, KIR2DL4*0080102, KIR2DL4*0080103, KIR2DL4*0080104, KIR2DL4*0080105, KIR2DL4*0080201, KIR2DL4*0080202, KIR2DL4*0080203, KIR2DL4*0080204, KIR2DL4*00901, KIR2DL4*010, KIR2DL4*011, KIR2DL4*01201, KIR2DL4*013, KIR2DL4*017, KIR2DL5A*0010101, KIR2DL5A*0010102, KIR2DL5A*0010103, KIR2DL5A*00102, KIR2DL5A*00103, KIR2DL5A*00104, KIR2DL5A*00105, KIR2DL5A*0050101, KIR2DL5A*0050102, KIR2DL5A*0050103, KIR2DL5A*0050104, KIR2DL5A*01201, KIR2DL5A*01202, KIR2DL5B*0020101, KIR2DL5B*0020102, KIR2DL5B*0020103, KIR2DL5B*0020104, KIR2DL5B*0020105, KIR2DL5B*0020106, KIR2DL5B*0020107, KIR2DL5B*00202, KIR2DL5B*003, KIR2DL5B*004, KIR2DL5B*00601, KIR2DL5B*00602, KIR2DL5B*00603, KIR2DL5B*007, KIR2DL5B*0070102, KIR2DL5B*0080101, KIR2DL5B*0080102, KIR2DL5B*00802, KIR2DL5B*009, KIR2DL5B*010, KIR2DL5B*011, KIR2DL5B*01301, KIR2DL5B*01302, KIR2DL5B*01303, KIR2DP1*00101, KIR2DP1*0010201, KIR2DP1*0010202, KIR2DP1*0010203, KIR2DP1*0020101, KIR2DP1*0020102, KIR2DP1*0020103, KIR2DP1*0020104, KIR2DP1*0020105, KIR2DP1*0020106,

KIR2DP1*0020107, KIR2DP1*0020108, KIR2DP1*0020109, KIR2DP1*0030101, KIR2DP1*0030102, KIR2DP1*004, KIR2DP1*005, KIR2DP1*006, KIR2DP1*007, KIR2DP1*008, KIR2DP1*009, KIR2DP1*010, KIR2DS1*001, KIR2DS1*0020101, KIR2DS1*0020102, KIR2DS1*0020103, KIR2DS1*0020104, KIR2DS1*0020105, KIR2DS1*0020106, KIR2DS1*00202, KIR2DS1*00301, KIR2DS1*00302, KIR2DS1*004, KIR2DS1*00501, KIR2DS1*00502, KIR2DS1*006, KIR2DS1*008, KIR2DS2*0010101, KIR2DS2*0010102, KIR2DS2*0010103, KIR2DS2*0010104, KIR2DS2*0010105, KIR2DS2*0010106, KIR2DS2*0010107, KIR2DS2*0010108, KIR2DS2*0010109, KIR2DS2*0010110, KIR2DS2*0010111, KIR2DS2*0010112, KIR2DS2*00102, KIR2DS2*00103, KIR2DS2*00104, KIR2DS2*002, KIR2DS2*003, KIR2DS2*004, KIR2DS2*005, KIR2DS2*006, KIR2DS3*00101, KIR2DS3*00102, KIR2DS3*0010301, KIR2DS3*0010302, KIR2DS3*00104, KIR2DS3*00105, KIR2DS3*00106, KIR2DS3*0020101, KIR2DS3*0020102, KIR2DS3*0020103, KIR2DS3*004, KIR2DS4*0010101, KIR2DS4*0010102, KIR2DS4*0010103, KIR2DS4*0010104, KIR2DS4*0010105, KIR2DS4*0010106, KIR2DS4*0010107, KIR2DS4*0010108, KIR2DS4*0010109, KIR2DS4*00102, KIR2DS4*00103, KIR2DS4*00104, KIR2DS4*0030101, KIR2DS4*0030102, KIR2DS4*0030103, KIR2DS4*0030104, KIR2DS4*0040101, KIR2DS4*0040102, KIR2DS4*0060101, KIR2DS4*0060102, KIR2DS4*007, KIR2DS4*008, KIR2DS4*009, KIR2DS4*010, KIR2DS4*01101, KIR2DS4*01102, KIR2DS4*012, KIR2DS4*013, KIR2DS4*014, KIR2DS4*015, KIR2DS5*001, KIR2DS5*0020101, KIR2DS5*0020102, KIR2DS5*0020103, KIR2DS5*0020104, KIR2DS5*003, KIR2DS5*004, KIR2DS5*005, KIR2DS5*006, KIR2DS5*007, KIR2DS5*00801, KIR2DS5*00802, KIR2DS5*009, KIR2DS5*010, KIR3DL1*0010101, KIR3DL1*0010102, KIR3DL1*00102, KIR3DL1*002, KIR3DL1*00401, KIR3DL1*00402, KIR3DL1*0050101, KIR3DL1*0050102, KIR3DL1*00502, KIR3DL1*006, KIR3DL1*0070101, KIR3DL1*0070102, KIR3DL1*008, KIR3DL1*009, KIR3DL1*01501, KIR3DL1*0150201, KIR3DL1*0150202, KIR3DL1*0150203, KIR3DL1*01503, KIR3DL1*016, KIR3DL1*01701, KIR3DL1*01702, KIR3DL1*018, KIR3DL1*019, KIR3DL1*020, KIR3DL1*021, KIR3DL1*022, KIR3DL1*023, KIR3DL1*025, KIR3DL1*026, KIR3DL1*027, KIR3DL1*028, KIR3DL1*0290101, KIR3DL1*0290102, KIR3DL1*030, KIR3DL1*03101, KIR3DL1*03102, KIR3DL1*032, KIR3DL1*033, KIR3DL1*034, KIR3DL1*035, KIR3DL1*036, KIR3DL1*037, KIR3DL1*038, KIR3DL1*039, KIR3DL1*040, KIR3DL1*041, KIR3DL1*042, KIR3DL1*043, KIR3DL1*044, KIR3DL1*051, KIR3DL1*052, KIR3DL1*053, KIR3DL1*054, KIR3DL1*056, KIR3DL1*057, KIR3DL1*059, KIR3DL1*060, KIR3DL1*061, KIR3DL1*062, KIR3DL1*063, KIR3DL1*064, KIR3DL1*065, KIR3DL1*066, KIR3DL1*067, KIR3DL1*068, KIR3DL1*072, KIR3DL2*0010101, KIR3DL2*0010102, KIR3DL2*00102, KIR3DL2*0010301, KIR3DL2*0010302, KIR3DL2*0020101, KIR3DL2*0020102, KIR3DL2*0020103, KIR3DL2*0020104, KIR3DL2*0020105, KIR3DL2*0020106, KIR3DL2*00202, KIR3DL2*00301, KIR3DL2*00302, KIR3DL2*004, KIR3DL2*00501, KIR3DL2*006, KIR3DL2*0070101, KIR3DL2*0070102, KIR3DL2*0070103, KIR3DL2*008, KIR3DL2*00901, KIR3DL2*00902, KIR3DL2*00903, KIR3DL2*010, KIR3DL2*011, KIR3DL2*012, KIR3DL2*01301, KIR3DL2*014, KIR3DL2*015, KIR3DL2*016, KIR3DL2*017, KIR3DL2*018, KIR3DL2*019, KIR3DL2*020, KIR3DL2*021, KIR3DL2*022, KIR3DL2*023, KIR3DL2*056, KIR3DL3*00101, KIR3DL3*00102, KIR3DL3*00103, KIR3DL3*00201, KIR3DL3*00202, KIR3DL3*00203, KIR3DL3*00204, KIR3DL3*00205, KIR3DL3*00206, KIR3DL3*00207, KIR3DL3*00208, KIR3DL3*0030101, KIR3DL3*0030102, KIR3DL3*0030103, KIR3DL3*0030104, KIR3DL3*00401, KIR3DL3*0040201, KIR3DL3*0040202, KIR3DL3*005, KIR3DL3*00601, KIR3DL3*00602, KIR3DL3*007, KIR3DL3*00801, KIR3DL3*00802, KIR3DL3*0090101, KIR3DL3*0090102, KIR3DL3*0090103, KIR3DL3*00902, KIR3DL3*00903, KIR3DL3*01001, KIR3DL3*01002, KIR3DL3*01101, KIR3DL3*01102, KIR3DL3*012, KIR3DL3*01301, KIR3DL3*01302, KIR3DL3*01303, KIR3DL3*01304, KIR3DL3*01305, KIR3DL3*01306, KIR3DL3*01307, KIR3DL3*01401, KIR3DL3*0140201, KIR3DL3*0140202, KIR3DL3*0140203, KIR3DL3*01403, KIR3DL3*01404, KIR3DL3*01405, KIR3DL3*01406, KIR3DL3*01501, KIR3DL3*01502, KIR3DL3*01601, KIR3DL3*01602, KIR3DL3*017, KIR3DL3*01801, KIR3DL3*019, KIR3DL3*020, KIR3DL3*02101, KIR3DL3*02102, KIR3DL3*022, KIR3DL3*023, KIR3DL3*02501, KIR3DL3*02502, KIR3DL3*026, KIR3DL3*02701, KIR3DL3*028, KIR3DL3*029, KIR3DL3*030, KIR3DL3*031, KIR3DL3*032, KIR3DL3*033, KIR3DL3*034, KIR3DL3*035, KIR3DL3*036, KIR3DL3*048, KIR3DP1*001, KIR3DP1*002, KIR3DP1*0030101, KIR3DP1*0030102, KIR3DP1*0030201, KIR3DP1*0030202, KIR3DP1*0030203, KIR3DP1*0030204, KIR3DP1*0030205, KIR3DP1*0030206, KIR3DP1*00303, KIR3DP1*0030401, KIR3DP1*0030402, KIR3DP1*004, KIR3DP1*005, KIR3DP1*006, KIR3DP1*007, KIR3DP1*008, KIR3DP1*0090101, KIR3DP1*0090102, KIR3DP1*0090103, KIR3DP1*00902, KIR3DP1*010, KIR3DS1*010, KIR3DS1*011, KIR3DS1*012, KIR3DS1*0130101, KIR3DS1*0130102, KIR3DS1*0130103, KIR3DS1*01302, KIR3DS1*014, KIR3DS1*045, KIR3DS1*046, KIR3DS1*047, KIR3DS1*048, KIR3DS1*050, KIR3DS1*055, KIR3DS1*058, B2M, TAPBP_variant1, TAPBP_variant2, TAPBP_variant3, CANX_variant1, CANX_variant2, CALR, PDIA2, PDIA3, ERAP1_variant1, ERAP1_variant2, TPP2, BLMH, LAP3, PSMA1_variant1, PSMA1_variant2, PSMA1_variant3, PSMA2, PSMA3_variant1, PSMA3_variant2, PSMA4_variant1, PSMA4_variant2, PSMA4_variant3, PSMA5, PSMA6, PSMA7, PSMA8_variant1, PSMA8_variant2, PSMA8_variant3, PSMB1, PSMB2, PSMB3, PSMB4, PSMB5_variant1, PSMB5_variant2, PSMB5_variant3, PSMB6, PSMB7, PSMB8_variant1, PSMB8_variant2, PSMB9, PSMB10, PSMB11, PSMC1, PSMC2, PSMC3, PSMC4_variant1, PSMC4_variant2, PSMC5, PSMC6, PSMD1_variant1, PSMD1_variant2, PSMD2, PSMD3, PSMD4, PSMD5, PSMD6, PSMD7, PSMD8, PSMD9, PSMD10_variant1, PSMD10_variant2, PSMD11, PSMD12_variant1, PSMD12_variant2, PSMD13_variant1, PSMD13_variant2, and PSMD14.

Within another specific embodiment, the oligonucleotide array comprises the capture oligonucleotides having the nucleic acid sequences set forth in Table X, below, or the oligonucleotide array comprises the oligonucleotides in Table X that have names beginning with "HPT", "HPE" or "HPN" as shown in Table X. In Table X, oligo names start with "HNN", "HPN", "HPE" or "HPT." "HNN" indicates that the oligo is a negative control oligonucleotide. "HPN" indicates a "normal" (unchanged) oligo, "HPT" indicates a "truncated" oligo, and "HPE" indicates an "extended" oligo. The "HPT" and "HPE" modifications were made to ensure proper melting temperature. The "HPT", "HPE" or "HPN" oligios in Table X are designed to collectively target transcripts (e.g., cDNA or cRNA) encoding a subset of clinically relevant HLA molecules as well as their 5'UTR regions. The Table also contains negative control oligos, which help better identification of thresholds for positive and negative signals. Further, in certain embodiments, it may be desirable to detect changes in 5' UTR sequences, since such changes may result in altered expression of HLA transcripts due to regulation of transcription. The clinically relevant HLA alleles targeted by the oligos in Table X include: A*01:01:01:01, A*01:01:01:01, A*01:01:02, A*01:01:03, A*01:01:04, A*01:01:05, A*01:01:06, A*01:01:07, A*01:01:08, A*01:01:09, A*01:01:10, A*01:01:11, A*01:01:12, A*01:01:13, A*01:01:14, A*01:01:15, A*01:01:16, A*01:01:17, A*01:01:18, A*01:01:19, A*01:01:20, A*01:01:21, A*01:01:22, A*01:01:23, A*01:01:24, A*01:01:25, A*01:01:26, A*01:01:27, A*01:01:28, A*01:01:29, A*01:01:30, A*01:01:31, A*01:01:32, A*01:01:33, A*01:01:34, A*01:01:35, A*01:01:36, A*01:01:37, A*01:01:39, A*01:01:40, A*01:01:41, A*01:01:42, A*01:01:43, A*01:02, A*01:03, A*02:01:01:01, A*02:01:01:03, A*02:01:02, A*02:01:03, A*02:01:04, A*02:01:05, A*02:01:06, A*02:01:07, A*02:01:08, A*02:01:09, A*02:01:10, A*02:01:11, A*02:01:12, A*02:01:13, A*02:01:15, A*02:01:17, A*02:01:18, A*02:01:19, A*02:01:21, A*02:01:22, A*02:01:23, A*02:01:24, A*02:01:25, A*02:01:26, A*02:01:27, A*02:01:28, A*02:01:29, A*02:01:30, A*02:01:31, A*02:01:32, A*02:01:33, A*02:01:34, A*02:01:35, A*02:01:36, A*02:01:37, A*02:01:38, A*02:01:39, A*02:01:40, A*02:01:41, A*02:01:42, A*02:01:43, A*02:01:44, A*02:01:45, A*02:01:46, A*02:01:47, A*02:01:48, A*02:01:49, A*02:01:50, A*02:01:51, A*02:01:52, A*02:01:53, A*02:01:54, A*02:01:55, A*02:01:56, A*02:01:57, A*02:01:58, A*02:01:59, A*02:01:60, A*02:01:61, A*02:01:62, A*02:01:63, A*02:02, A*02:03:01, A*02:03:02, A*02:03:03, A*02:03:04, A*02:04, A*02:05:01, A*02:05:02, A*02:05:03, A*02:05:04, A*02:05:05, A*02:06:01, A*02:06:02, A*02:06:03, A*02:06:04, A*02:06:05, A*02:06:06, A*02:06:07, A*02:06:08, A*02:06:09, A*02:06:10, A*02:07, A*02:08, A*02:09, A*02:10, A*02:11:01, A*02:11:02, A*02:11:03, A*02:11:04, A*02:12, A*02:13, A*02:14, A*02:16, A*02:17:01, A*02:17:02, A*02:19, A*02:20:01, A*02:20:02, A*02:21, A*02:22:01, A*02:22:02, A*02:24:01, A*02:24:02, A*02:25, A*02:26, A*02:27, A*02:30, A*02:34, A*02:36, A*02:37, A*02:38, A*02:42, A*02:44, A*02:45, A*02:49, A*02:51, A*02:54, A*02:55, A*02:58, A*02:60:01, A*02:60:02, A*02:67, A*02:74:01, A*02:74:02, A*03:01:01:01, A*03:01:01:03, A*03:01:02, A*03:01:03, A*03:01:04, A*03:01:05, A*03:01:06, A*03:01:07, A*03:01:08, A*03:01:09, A*03:01:10, A*03:01:11, A*03:01:12, A*03:01:13, A*03:01:14, A*03:01:15, A*03:01:16, A*03:01:17, A*03:01:18, A*03:01:19, A*03:01:20, A*03:01:21, A*03:01:22, A*03:01:23, A*03:01:24, A*03:01:25, A*03:01:26, A*03:01:27, A*03:01:28, A*03:01:29, A*03:01:30, A*03:01:31, A*03:02:01, A*03:02:02, A*03:05, A*03:07, A*03:08, A*03:10, A*11:01:01, A*11:01:02, A*11:01:03, A*11:01:04, A*11:01:05, A*11:01:06, A*11:01:07, A*11:01:08, A*11:01:09, A*11:01:10, A*11:01:11, A*11:01:12, A*11:01:13, A*11:01:14, A*11:01:15, A*11:01:16, A*11:01:17, A*11:01:18, A*11:01:19, A*11:01:20, A*11:01:21, A*11:01:22, A*11:01:23, A*11:01:24, A*11:01:25, A*11:01:26, A*11:01:27, A*11:01:28, A*11:01:29, A*11:01:30, A*11:01:31, A*11:01:32, A*11:02:01, A*11:02:02, A*11:02:03, A*11:03, A*11:04, A*11:05, A*11:06, A*11:10, A*11:12, A*11:13, A*11:19, A*11:20, A*23:01:01, A*23:01:02, A*23:01:03, A*23:01:04, A*23:01:05, A*23:01:06, A*23:01:07, A*23:02, A*23:05, A*23:09, A*24:02:01:01, A*24:02:01:03, A*24:02:02, A*24:02:04, A*24:02:05, A*24:02:06, A*24:02:07, A*24:02:08, A*24:02:09, A*24:02:10, A*24:02:11, A*24:02:12, A*24:02:13, A*24:02:14, A*24:02:15, A*24:02:16, A*24:02:17, A*24:02:18, A*24:02:19, A*24:02:20, A*24:02:21, A*24:02:22, A*24:02:23, A*24:02:24, A*24:02:25, A*24:02:26, A*24:02:27, A*24:02:28, A*24:02:29, A*24:02:30, A*24:02:31, A*24:02:32, A*24:02:33, A*24:02:34, A*24:02:35, A*24:02:36, A*24:02:37, A*24:02:38, A*24:02:39, A*24:02:40, A*24:02:41, A*24:02:42, A*24:02:43, A*24:02:44, A*24:02:45, A*24:02:46, A*24:02:47, A*24:02:48, A*24:02:49, A*24:02:50, A*24:02:51, A*24:03:01, A*24:03:02, A*24:04, A*24:05, A*24:06, A*24:07, A*24:08, A*24:10, A*24:13:01, A*24:13:02, A*24:14, A*24:17, A*24:18, A*24:20, A*24:21:01, A*24:21:02, A*24:22, A*24:23, A*24:25, A*24:26, A*24:28, A*24:29, A*24:31, A*24:35, A*24:46, A*24:51, A*24:58, A*25:01:01, A*25:01:02, A*25:01:03, A*25:01:04, A*25:01:05, A*25:02, A*26:01:01, A*26:01:02, A*26:01:03, A*26:01:04, A*26:01:05, A*26:01:06, A*26:01:07, A*26:01:08, A*26:01:09, A*26:01:10, A*26:01:11, A*26:01:12, A*26:01:13, A*26:01:14, A*26:01:15, A*26:01:16, A*26:01:17, A*26:01:18, A*26:01:19, A*26:01:20, A*26:01:21, A*26:01:22, A*26:02, A*26:03:01, A*26:03:02, A*26:05, A*26:07:01, A*26:07:02, A*26:08, A*26:09, A*26:10, A*26:12, A*26:16, A*26:18, A*29:01:01, A*29:01:02, A*29:01:03, A*29:02:01:01, A*29:02:01:02, A*29:02:02, A*29:02:03, A*29:02:04, A*29:02:05, A*29:02:06, A*29:02:07, A*29:02:08, A*29:02:09, A*30:01:01, A*30:01:02, A*30:01:03, A*30:01:04, A*30:01:05, A*30:02:01, A*30:02:02, A*30:02:03, A*30:02:04, A*30:02:05, A*30:03, A*30:04:01, A*30:04:02, A*30:06, A*30:08, A*30:09, A*30:10, A*30:11:01, A*30:11:02, A*30:12, A*31:01:02, A*31:01:03, A*31:01:04, A*31:01:05, A*31:01:06, A*31:01:07, A*31:01:08, A*31:01:09, A*31:01:10, A*31:02, A*31:03, A*31:04, A*31:06, A*31:08, A*31:09, A*31:12, A*32:01:01, A*32:01:02, A*32:01:03, A*32:01:04, A*32:01:05, A*32:01:06, A*32:01:07, A*32:01:08, A*32:01:09, A*32:01:10, A*32:01:11, A*32:02, A*32:03, A*32:05, A*32:06, A*33:01:01, A*33:01:02, A*33:01:03, A*33:01:04, A*33:01:05, A*33:01:06, A*33:03:01, A*33:03:02, A*33:03:04, A*33:03:05, A*33:03:06, A*33:03:07, A*33:03:08, A*33:05, A*34:01:01, A*34:01:02, A*34:02:01, A*34:02:02, A*34:03, A*34:05, A*36:01, A*36:03, A*43:01, A*66:01, A*66:02, A*66:03, A*68:01:01:01, A*68:01:01:02, A*68:01:02, A*68:01:03, A*68:01:04, A*68:01:05, A*68:01:06, A*68:01:07, A*68:01:08, A*68:01:09, A*68:01:10, A*68:02:01:01, A*68:02:01:02, A*68:02:01:03, A*68:02:02, A*68:02:03, A*68:02:04, A*68:03:01, A*68:03:02, A*68:03:03, A*68:04, A*68:05, A*68:07, A*68:13, A*68:15, A*68:16, A*68:17, A*68:23, A*68:25, A*69:01, A*74:01, A*74:03, A*74:04, A*74:09, A*74:11, A*80:01, B*07:02:01, B*07:02:02, B*07:02:03, B*07:02:04, B*07:02:05, B*07:02:06, B*07:02:07, B*07:02:08, B*07:02:09, B*07:02:10, B*07:02:11, B*07:02:12, B*07:02:13, B*07:02:14, B*07:02:15, B*07:02:16, B*07:02:17, B*07:02:18, B*07:02:19, B*07:02:20, B*07:02:21, B*07:02:22, B*07:02:23, B*07:02:24, B*07:02:25, B*07:02:26, B*07:02:27, B*07:02:28, B*07:04, B*07:05:01, B*07:05:02, B*07:05:03, B*07:05:04, B*07:05:05, B*07:05:06, B*07:06, B*07:07, B*07:09, B*07:10, B*07:13, B*07:14, B*07:15, B*07:20, B*07:21, B*07:22:01, B*07:22:02, B*07:33, B*07:36, B*08:01:01, B*08:01:02, B*08:01:03, B*08:01:04, B*08:01:05, B*08:01:06, B*08:01:07, B*08:01:08, B*08:01:09, B*08:01:10, B*08:01:11, B*08:01:12, B*08:01:13, B*08:01:14, B*08:01:15, B*08:01:16, B*08:02, B*08:03, B*08:04, B*08:05, B*08:12:01, B*08:12:02, B*08:12:03, B*13:01:01, B*13:01:02, B*13:01:03, B*13:01:04, B*13:01:05, B*13:01:06, B*13:02:01, B*13:02:02, B*13:02:03, B*13:02:04, B*13:02:05, B*13:02:06, B*13:02:07, B*13:02:08, B*13:02:09, B*13:02:10, B*13:02:11, B*13:02:12, B*13:03, B*13:04, B*13:09, B*13:11, B*13:13, B*14:01:01, B*14:01:02, B*14:02:01, B*14:02:02, B*14:02:03, B*14:02:04, B*14:02:05, B*14:02:06, B*14:03, B*14:05, B*14:06:01, B*14:06:02, B*15:01:01:01, B*15:01:02, B*15:01:03, B*15:01:04, B*15:01:06, B*15:01:07, B*15:01:08, B*15:01:09, B*15:01:10, B*15:01:11, B*15:01:12, B*15:01:13, B*15:01:14, B*15:01:15, B*15:01:16, B*15:01:17, B*15:01:18, B*15:01:19, B*15:01:20, B*15:01:21, B*15:01:22, B*15:01:23, B*15:01:24, B*15:02:01, B*15:02:02, B*15:02:03, B*15:02:04, B*15:02:05, B*15:03:01, B*15:03:02, B*15:03:03, B*15:04, B*15:05:01, B*15:05:02, B*15:06, B*15:07:01, B*15:07:02, B*15:08, B*15:09, B*15:10:01, B*15:10:02, B*15:11:01, B*15:11:02, B*15:11:03, B*15:11:04, B*15:11:05, B*15:12, B*15:13:01, B*15:13:02, B*15:14, B*15:15, B*15:16:01, B*15:16:02, B*15:16:03, B*15:17:01:01, B*15:17:01:02, B*15:17:02, B*15:18:01, B*15:18:02, B*15:18:03, B*15:18:04, B*15:20, B*15:21, B*15:23, B*15:24, B*15:25:01, B*15:25:02, B*15:25:03, B*15:27:01, B*15:27:02, B*15:27:03, B*15:29, B*15:30, B*15:31, B*15:32, B*15:34, B*15:35, B*15:37, B*15:38:01, B*15:38:02, B*15:39:01, B*15:39:02, B*15:40, B*15:45, B*15:46, B*15:47, B*15:48, B*15:50, B*15:52, B*15:53, B*15:54, B*15:56, B*15:58, B*15:61, B*15:63, B*15:70, B*15:71, B*15:86, B*18:01:01, B*18:01:02, B*18:01:03, B*18:01:04, B*18:01:05, B*18:01:06, B*18:01:07, B*18:01:08, B*18:01:09, B*18:01:10, B*18:01:11, B*18:01:12, B*18:01:13, B*18:01:14, B*18:02, B*18:03, B*18:04, B*18:06, B*18:07:01, B*18:07:02, B*18:08, B*27:01, B*27:02:01, B*27:02:02, B*27:03, B*27:04:01, B*27:04:02, B*27:04:03, B*27:05:02, B*27:05:03, B*27:05:04, B*27:05:05, B*27:05:06, B*27:05:07, B*27:05:08, B*27:05:09, B*27:05:10, B*27:05:11, B*27:05:12, B*27:05:13, B*27:05:14, B*27:05:15, B*27:05:16, B*27:05:17, B*27:06, B*27:07, B*27:08, B*27:09, B*27:10, B*27:11, B*27:12, B*27:13, B*27:14, B*27:20, B*27:21, B*35:01:01:01, B*35:01:01:02, B*35:01:02, B*35:01:03, B*35:01:04, B*35:01:05, B*35:01:06, B*35:01:07, B*35:01:08, B*35:01:09, B*35:01:10, B*35:01:11, B*35:01:12, B*35:01:13, B*35:01:14, B*35:01:15, B*35:01:16, B*35:01:17, B*35:01:18, B*35:01:19, B*35:01:20, B*35:01:21, B*35:01:22, B*35:01:23, B*35:01:24, B*35:01:25, B*35:01:26, B*35:01:27, B*35:01:28, B*35:01:29, B*35:02:01, B*35:02:02, B*35:02:03, B*35:02:04, B*35:03:01, B*35:03:02, B*35:03:03, B*35:03:04, B*35:03:05, B*35:03:06, B*35:03:07, B*35:03:08, B*35:03:09, B*35:03:10, B*35:04:01, B*35:04:02, B*35:04:03, B*35:05:01, B*35:05:02, B*35:06, B*35:08:01, B*35:08:02, B*35:08:03, B*35:08:04, B*35:09:01, B*35:09:02, B*35:10, B*35:11:01, B*35:11:02, B*35:12:01, B*35:12:02, B*35:12:03, B*35:13, B*35:14:01, B*35:14:02, B*35:15, B*35:16, B*35:17, B*35:18, B*35:19, B*35:20:01, B*35:20:02, B*35:21, B*35:22, B*35:23, B*35:27, B*35:28, B*35:30, B*35:32, B*35:33, B*35:43:01, B*35:43:02, B*35:46, B*37:01:01, B*37:01:02, B*37:01:03, B*37:01:04, B*37:01:05, B*37:01:06, B*37:01:07, B*37:01:08, B*37:01:09, B*38:01:01, B*38:01:02, B*38:01:03, B*38:01:04, B*38:01:05, B*38:02:01, B*38:02:02, B*38:02:03, B*38:04, B*38:05, B*38:06, B*38:09, B*39:01:01:01, B*39:01:03, B*39:01:04, B*39:01:05, B*39:01:06, B*39:01:07, B*39:01:08, B*39:01:09, B*39:01:10, B*39:01:11, B*39:01:12, B*39:02:01, B*39:02:02, B*39:03, B*39:04, B*39:05:01, B*39:05:02, B*39:06:01, B*39:06:02, B*39:07, B*39:08, B*39:09, B*39:10:01, B*39:10:02, B*39:11, B*39:12, B*39:13:01, B*39:13:02, B*39:14, B*39:15, B*39:24:01, B*39:24:02, B*40:01:01, B*40:01:02, B*40:01:03, B*40:01:04, B*40:01:05, B*40:01:06, B*40:01:07, B*40:01:08, B*40:01:09, B*40:01:10, B*40:01:11, B*40:01:12, B*40:01:13, B*40:01:14, B*40:01:15, B*40:01:16, B*40:01:17, B*40:01:18, B*40:01:19, B*40:01:20, B*40:01:21, B*40:01:22, B*40:01:23, B*40:02:01, B*40:02:02, B*40:02:03, B*40:02:04, B*40:02:05, B*40:02:06, B*40:02:07, B*40:02:08, B*40:02:09, B*40:02:10, B*40:02:11, B*40:02:12, B*40:03, B*40:04, B*40:05, B*40:06:01:01, B*40:06:01:02, B*40:06:02, B*40:06:03, B*40:06:04, B*40:07, B*40:08, B*40:09, B*40:10:01, B*40:10:02, B*40:11:01, B*40:11:02, B*40:12, B*40:14:01, B*40:14:02, B*40:14:03, B*40:16, B*40:18, B*40:20, B*40:21, B*40:23, B*40:27:01, B*40:27:02, B*40:31, B*40:35, B*40:36, B*40:37, B*40:38, B*40:39, B*40:40, B*40:42, B*40:44, B*40:49, B*40:50, B*40:52, B*41:01, B*41:02:01, B*41:02:02, B*41:02:03, B*41:02:04, B*41:03:01, B*41:03:02, B*42:01:01, B*42:01:02, B*42:02, B*44:02:01:01, B*44:02:02, B*44:02:03, B*44:02:04, B*44:02:05, B*44:02:06, B*44:02:07, B*44:02:08, B*44:02:09, B*44:02:10, B*44:02:11, B*44:02:12, B*44:02:13, B*44:02:14, B*44:02:15, B*44:02:16, B*44:02:17, B*44:02:18, B*44:02:19, B*44:02:20, B*44:02:21, B*44:03:01, B*44:03:02, B*44:03:03, B*44:03:04, B*44:03:05, B*44:03:06, B*44:03:07, B*44:03:08, B*44:03:09, B*44:03:10, B*44:03:11, B*44:03:12, B*44:03:13, B*44:03:14, B*44:04, B*44:05:01, B*44:05:02, B*44:05:03, B*44:06, B*44:07, B*44:09, B*44:10, B*44:12, B*44:15, B*44:18, B*44:22, B*45:01, B*45:06, B*46:01:01, B*46:01:02, B*46:01:03, B*46:01:04, B*46:01:05, B*46:01:06, B*46:01:07, B*46:02, B*47:01:01:01, B*47:01:01:02, B*47:01:02, B*47:02, B*47:03, B*48:01:01, B*48:01:02, B*48:01:03, B*48:02:01, B*48:02:02, B*48:03:01, B*48:03:02, B*48:04, B*48:06, B*48:07, B*48:08, B*49:01:01, B*49:01:02, B*49:01:03, B*49:02, B*50:01:01, B*50:01:02, B*50:01:03, B*50:02, B*51:01:01, B*51:01:02, B*51:01:03, B*51:01:04, B*51:01:05, B*51:01:06, B*51:01:07, B*51:01:08, B*51:01:09, B*51:01:10, B*51:01:11, B*51:01:12, B*51:01:13, B*51:01:14, B*51:01:15, B*51:01:16, B*51:01:17, B*51:01:18, B*51:01:19, B*51:01:20, B*51:01:21, B*51:01:22, B*51:01:23, B*51:01:24, B*51:01:25, B*51:01:26, B*51:01:27, B*51:01:28, B*51:02:01, B*51:02:02, B*51:02:03, B*51:02:04, B*51:02:05, B*51:04, B*51:05, B*51:06:01, B*51:06:02, B*51:07:01, B*51:07:02, B*51:08, B*51:09:01, B*51:09:02, B*51:10, B*51:14, B*51:19, B*51:21, B*51:22, B*51:31, B*51:32, B*51:34, B*51:37, B*52:01:01:01, B*52:01:01:02, B*52:01:02, B*52:01:03, B*52:01:04, B*52:01:05, B*52:01:06, B*52:01:07, B*52:01:08, B*52:01:09, B*53:01:01, B*53:01:02, B*53:01:03, B*53:01:04, B*53:01:05, B*53:02, B*53:04, B*53:08:01, B*53:08:02, B*54:01:01, B*54:01:02, B*54:02, B*55:01:01, B*55:01:02, B*55:01:03, B*55:01:04, B*55:01:05, B*55:01:06, B*55:01:07, B*55:02:01, B*55:02:02, B*55:02:03, B*55:02:04, B*55:02:05, B*55:02:06, B*55:04, B*55:07, B*55:08, B*55:10, B*55:12, B*55:16, B*56:01:01, B*56:01:02, B*56:01:03, B*56:01:04, B*56:02, B*56:03, B*56:04, B*56:06, B*56:07, B*56:09, B*56:11, B*57:01:01, B*57:01:02, B*57:01:03, B*57:01:04, B*57:01:05, B*57:01:06, B*57:01:07, B*57:01:08, B*57:01:09, B*57:01:10, B*57:01:11, B*57:02:01, B*57:02:02, B*57:03:01, B*57:03:02, B*57:04, B*57:06, B*58:01:01, B*58:01:02, B*58:01:03, B*58:01:04, B*58:01:05, B*58:01:06, B*58:01:07, B*58:01:08, B*58:01:09, B*58:02, B*58:06, B*59:01:01:01, B*59:01:01:02, B*67:01:01, B*67:01:02, B*67:02, B*73:01, B*78:01:01, B*78:01:02, B*78:02:01, B*78:02:02, B*81:01, B*82:01, B*82:02, B*83:01, C*01:02:01, C*01:02:02, C*01:02:03, C*01:02:04, C*01:02:05, C*01:02:06, C*01:02:07, C*01:02:08, C*01:02:09, C*01:02:10, C*01:02:11, C*01:02:12, C*01:02:13, C*01:02:14, C*01:03, C*01:04, C*01:05, C*01:06, C*01:07, C*01:08, C*01:10, C*01:16, C*01:18, C*01:30, C*02:02:01, C*02:02:02, C*02:02:03, C*02:02:05, C*02:02:06, C*02:02:07, C*02:02:08, C*02:02:09, C*02:02:10, C*02:02:11, C*02:02:12, C*02:02:13, C*02:02:14, C*02:02:15, C*02:02:16, C*02:02:17, C*02:02:18, C*02:02:19, C*02:02:20, C*02:03, C*02:14, C*02:18, C*03:02:01, C*03:02:02:01, C*03:02:02:02, C*03:02:03, C*03:02:04, C*03:02:05, C*03:02:06, C*03:02:07, C*03:02:08, C*03:03:01, C*03:03:02, C*03:03:03, C*03:03:04, C*03:03:05, C*03:03:06, C*03:03:07, C*03:03:08, C*03:03:09, C*03:03:10, C*03:03:11, C*03:03:12, C*03:03:13, C*03:03:14, C*03:03:15, C*03:03:16, C*03:04:01:01, C*03:04:01:02, C*03:04:02, C*03:04:03, C*03:04:04, C*03:04:05, C*03:04:06, C*03:04:07, C*03:04:08, C*03:04:09, C*03:04:10, C*03:04:11, C*03:04:12, C*03:04:13, C*03:04:14, C*03:04:15, C*03:04:16, C*03:04:17, C*03:04:18, C*03:04:19, C*03:04:20, C*03:04:21, C*03:04:22, C*03:04:23, C*03:05, C*03:06, C*03:07, C*03:08, C*03:09, C*03:12, C*03:13, C*03:15, C*03:16, C*03:17, C*03:19, C*03:36, C*03:37, C*03:38:01, C*03:38:02, C*04:01:01:01, C*04:01:01:02, C*04:01:01:03, C*04:01:01:04, C*04:01:02, C*04:01:03, C*04:01:04, C*04:01:05, C*04:01:06, C*04:01:07, C*04:01:08, C*04:01:09, C*04:01:10, C*04:01:11, C*04:01:12, C*04:01:13, C*04:01:14, C*04:01:15, C*04:01:16, C*04:01:17, C*04:01:18, C*04:01:19, C*04:01:20, C*04:01:21, C*04:01:22, C*04:01:23, C*04:01:24, C*04:01:25, C*04:01:26, C*04:01:27, C*04:01:28, C*04:01:29, C*04:01:30, C*04:01:31, C*04:01:32, C*04:01:33, C*04:03, C*04:04:01, C*04:04:02, C*04:05, C*04:06, C*04:07, C*04:08, C*04:10, C*04:13, C*04:14, C*04:15:01, C*04:15:02, C*04:15:03, C*04:27, C*05:01:01:01, C*05:01:01:02, C*05:01:02, C*05:01:03, C*05:01:04, C*05:01:05, C*05:01:06, C*05:01:07, C*05:01:08, C*05:01:09, C*05:01:10, C*05:01:11, C*05:01:12, C*05:01:13, C*05:01:14, C*05:01:15, C*05:01:16, C*05:01:17, C*05:05, C*05:09, C*06:02:01:01, C*06:02:01:02, C*06:02:03, C*06:02:04, C*06:02:05, C*06:02:06, C*06:02:07, C*06:02:08, C*06:02:09, C*06:02:10, C*06:02:11, C*06:02:12, C*06:02:13, C*06:02:14, C*06:02:15, C*06:02:16, C*06:02:17, C*06:03, C*06:04, C*06:06, C*06:08, C*06:09, C*06:10, C*06:15, C*06:24, C*07:01:01, C*07:01:02, C*07:01:03, C*07:01:04, C*07:01:05, C*07:01:06, C*07:01:07, C*07:01:08, C*07:01:09, C*07:01:10, C*07:01:11, C*07:01:12, C*07:01:13, C*07:01:14, C*07:01:15, C*07:01:16, C*07:01:17, C*07:01:18, C*07:01:19, C*07:01:20, C*07:01:21, C*07:01:22, C*07:01:23, C*07:01:24, C*07:02:01:01, C*07:02:01:03, C*07:02:02, C*07:02:03, C*07:02:04, C*07:02:05, C*07:02:06, C*07:02:07, C*07:02:08, C*07:02:09, C*07:02:10, C*07:02:11, C*07:02:12, C*07:02:13, C*07:02:14, C*07:02:15, C*07:02:16, C*07:02:17, C*07:02:18, C*07:02:19, C*07:02:20, C*07:02:21, C*07:02:22, C*07:02:23, C*07:02:24, C*07:02:25, C*07:02:26, C*07:02:27, C*07:02:28, C*07:02:29, C*07:03, C*07:04:01, C*07:04:02, C*07:04:03, C*07:04:04, C*07:04:05, C*07:04:06, C*07:04:06, C*07:05, C*07:06, C*07:07, C*07:08, C*07:09, C*07:10, C*07:12, C*07:13, C*07:14, C*07:17, C*07:18, C*07:26, C*07:27:01, C*07:27:02, C*07:29, C*07:35, C*07:43, C*07:56:01, C*07:56:02, C*07:66, C*07:67, C*08:01:01, C*08:01:02, C*08:01:03, C*08:01:04, C*08:01:05, C*08:02:01, C*08:02:02, C*08:02:03, C*08:02:04, C*08:02:05, C*08:02:06, C*08:03:01, C*08:03:02, C*08:04, C*08:05, C*08:06, C*08:11, C*08:12, C*08:13, C*08:20, C*08:21, C*08:27, C*12:02:01, C*12:02:02, C*12:02:03, C*12:02:04, C*12:02:05, C*12:02:06, C*12:03:01:01, C*12:03:01:02, C*12:03:02, C*12:03:03, C*12:03:04, C*12:03:05, C*12:03:06, C*12:03:07, C*12:03:08, C*12:03:09, C*12:03:10, C*12:03:11, C*12:03:12, C*12:03:13, C*12:03:14, C*12:03:15, C*12:03:16, C*12:03:17, C*12:04:01, C*12:04:02, C*12:05, C*12:07, C*12:12, C*14:02:01, C*14:02:02, C*14:02:03, C*14:02:04, C*14:02:05, C*14:02:06, C*14:02:07, C*14:03, C*14:04, C*14:06, C*15:02:01, C*15:02:02, C*15:02:03, C*15:02:04, C*15:02:05, C*15:02:06, C*15:02:07, C*15:03, C*15:04, C*15:05:01, C*15:05:02, C*15:05:03, C*15:05:04, C*15:05:05, C*15:05:06, C*15:06:01, C*15:06:02, C*15:06:03, C*15:07, C*15:08, C*15:09, C*15:11, C*15:13, C*15:17, C*15:19, C*15:20, C*16:01:01, C*16:01:02, C*16:01:03, C*16:01:04, C*16:01:05, C*16:01:06, C*16:02:01, C*16:02:02, C*16:02:03, C*16:02:04, C*16:02:05, C*16:02:06, C*16:02:07, C*16:02:08, C*16:04:01, C*16:08, C*17:01:01:01, C*17:01:01:02, C*17:01:02, C*17:01:03, C*17:01:04, C*17:01:05, C*17:01:06, C*17:03, C*17:04, C*18:01, C*18:03, E*01:01:01:01, E*01:01:01:02, E*01:01:01:03, E*01:03:01:01, E*01:03:01:02, E*01:03:02:01, E*01:03:02:02, E*01:03:03, E*01:03:04, E*01:04, F*01:01:01:01, F*01:01:01:02, F*01:01:01:03, F*01:01:01:04, F*01:01:01:05, F*01:01:01:06, F*01:01:01:07, F*01:01:01:08, F*01:01:02:01, F*01:01:02:02, F*01:01:02:03, F*01:01:02:04, F*01:01:02:05, F*01:01:02:06, F*01:01:03:01, F*01:01:03:02, F*01:01:03:03, F*01:01:03:04, F*01:02, F*01:03:01:01, F*01:03:01:02, F*01:04, G*01:01:01:01, G*01:01:01:02, G*01:01:01:03, G*01:01:01:04, G*01:01:01:05, G*01:01:01:06, G*01:01:02:01, G*01:01:02:02, G*01:01:03:01, G*01:01:03:02, G*01:01:04, G*01:01:05, G*01:01:06, G*01:01:07, G*01:01:08, G*01:01:09, G*01:01:11, G*01:01:12, G*01:01:13, G*01:01:14, G*01:01:15, G*01:01:16, G*01:01:17, G*01:01:18, G*01:01:19, G*01:01:20, G*01:02, G*01:03:01:01, G*01:03:01:02, G*01:04:01, G*01:04:02, G*01:04:03, G*01:04:04, G*01:04:05, G*01:06, G*01:07, G*01:08, G*01:09, G*01:10, G*01:11, G*01:12, G*01:14, G*01:15, G*01:16, G*01:17, DPA1*01:03:01:01, DPA1*01:03:01:02, DPA1*01:03:01:03, DPA1*01:03:01:04, DPA1*01:03:01:05, DPA1*01:03:02, DPA1*01:03:03, DPA1*01:03:04, DPA1*01:04, DPA1*01:05, DPA1*01:06:01, DPA1*01:06:02, DPA1*01:07, DPA1*01:08, DPA1*01:09, DPA1*01:10, DPA1*02:01:01, DPA1*02:01:02, DPA1*02:01:03, DPA1*02:01:04, DPA1*02:01:05, DPA1*02:01:06, DPA1*02:01:07, DPA1*02:02:01, DPA1*02:02:02, DPA1*02:02:03, DPA1*02:03, DPA1*02:04, DPA1*03:01, DPA1*03:02, DPA1*03:03, DPA1*04:01, DPB1*01:01:01, DPB1*01:01:02, DPB1*01:01:03, DPB1*02:01:02, DPB1*02:01:03, DPB1*02:01:04, DPB1*02:01:05, DPB1*02:01:06, DPB1*02:01:07, DPB1*02:02, DPB1*03:01:01, DPB1*03:01:02, DPB1*04:01:01:01, DPB1*04:01:01:02, DPB1*04:01:02, DPB1*04:02:01:01, DPB1*04:02:01:02, DPB1*05:01:01, DPB1*05:01:02, DPB1*06:01:01, DPB1*08:01, DPB1*09:01, DPB1*100:01, DPB1*101:01, DPB1*102:01, DPB1*103:01, DPB1*104:01, DPB1*105:

01, DPB1*106:01, DPB1*107:01, DPB1*108:01, DPB1*109:01, DPB1*10:01, DPB1*110:01, DPB1*111:01, DPB1*112:01, DPB1*113:01, DPB1*114:01, DPB1*115:01, DPB1*116:01, DPB1*117:01, DPB1*118:01, DPB1*119:01, DPB1*11:01:01, DPB1*11:01:02, DPB1*121:01, DPB1*122:01, DPB1*123:01, DPB1*124:01, DPB1*125:01, DPB1*126:01, DPB1*127:01, DPB1*128:01, DPB1*129:01, DPB1*130:01, DPB1*131:01, DPB1*132:01, DPB1*133:01, DPB1*134:01, DPB1*13:01, DPB1*14:01, DPB1*15:01, DPB1*16:01, DPB1*17:01, DPB1*18:01, DPB1*19:01, DPB1*20:01:01, DPB1*20:01:02, DPB1*21:01, DPB1*22:01, DPB1*23:01, DPB1*24:01, DPB1*25:01, DPB1*26:01:01, DPB1*26:01:02, DPB1*27:01, DPB1*28:01, DPB1*29:01, DPB1*30:01, DPB1*31:01, DPB1*32:01, DPB1*33:01, DPB1*34:01, DPB1*35:01:01, DPB1*35:01:02, DPB1*36:01, DPB1*37:01, DPB1*38:01, DPB1*39:01, DPB1*40:01, DPB1*41:01:01, DPB1*41:01:02, DPB1*44:01, DPB1*45:01, DPB1*46:01, DPB1*47:01, DPB1*48:01, DPB1*49:01, DPB1*50:01, DPB1*51:01, DPB1*52:01, DPB1*53:01, DPB1*54:01, DPB1*55:01, DPB1*56:01, DPB1*57:01, DPB1*58:01, DPB1*59:01, DPB1*60:01, DPB1*62:01, DPB1*63:01, DPB1*65:01, DPB1*66:01, DPB1*67:01, DPB1*68:01, DPB1*69:01, DPB1*70:01, DPB1*71:01, DPB1*72:01, DPB1*73:01, DPB1*74:01, DPB1*75:01, DPB1*76:01, DPB1*77:01, DPB1*78:01, DPB1*79:01, DPB1*80:01, DPB1*81:01, DPB1*82:01, DPB1*83:01, DPB1*84:01, DPB1*85:01, DPB1*86:01, DPB1*87:01, DPB1*88:01, DPB1*89:01, DPB1*90:01, DPB1*91:01, DPB1*92:01, DPB1*93:01, DPB1*94:01, DPB1*95:01, DPB1*96:01, DPB1*97:01, DPB1*98:01, DPB1*99:01, DQA1*01:01:01, DQA1*01:01:02, DQA1*01:02:01:01, DQA1*01:02:01:02, DQA1*01:02:01:03, DQA1*01:02:01:04, DQA1*01:02:02, DQA1*01:02:03, DQA1*01:02:04, DQA1*01:03:01:01, DQA1*01:03:01:02, DQA1*01:04:01:01, DQA1*01:04:01:02, DQA1*01:04:02, DQA1*01:05, DQA1*01:06, DQA1*01:07, DQA1*02:01, DQA1*03:01:01, DQA1*03:02, DQA1*03:03, DQA1*04:01:01, DQA1*04:01:02, DQA1*04:02, DQA1*04:04, DQA1*05:01:01:01, DQA1*05:01:01:02, DQA1*05:01:02, DQA1*05:02, DQA1*05:03, DQA1*05:04, DQA1*05:05:01:01, DQA1*05:05:01:02, DQA1*05:05:01:03, DQA1*05:06, DQA1*05:07, DQA1*05:08, DQA1*05:09, DQA1*05:10, DQA1*05:11, DQA1*06:01:01, DQA1*06:01:02, DQB1*02:01:01, DQB1*02:01:02, DQB1*02:01:03, DQB1*02:01:04, DQB1*02:02, DQB1*02:03, DQB1*02:04, DQB1*02:05, DQB1*02:06, DQB1*03:01:01:01, DQB1*03:01:01:02, DQB1*03:01:01:03, DQB1*03:01:02, DQB1*03:01:03, DQB1*03:01:04, DQB1*03:01:05, DQB1*03:01:06, DQB1*03:02:01, DQB1*03:02:02, DQB1*03:02:03, DQB1*03:02:04, DQB1*03:02:05, DQB1*03:03:02:01, DQB1*03:03:02:02, DQB1*03:03:02:03, DQB1*03:03:03, DQB1*03:03:04, DQB1*03:04, DQB1*03:05:01, DQB1*03:05:02, DQB1*03:05:03, DQB1*03:05:04, DQB1*03:06, DQB1*03:07, DQB1*03:08, DQB1*03:09, DQB1*03:10, DQB1*03:11, DQB1*03:12, DQB1*03:13, DQB1*03:14, DQB1*03:15, DQB1*03:16, DQB1*03:17, DQB1*03:18, DQB1*03:19, DQB1*03:20, DQB1*03:21, DQB1*03:22, DQB1*03:23, DQB1*03:24, DQB1*03:25, DQB1*03:26, DQB1*03:27, DQB1*03:28, DQB1*03:29, DQB1*03:30, DQB1*03:31, DQB1*03:32, DQB1*03:33, DQB1*03:34, DQB1*03:35, DQB1*03:36, DQB1*03:37, DQB1*03:38, DQB1*04:01:01, DQB1*04:01:02, DQB1*04:02:01, DQB1*04:02:02, DQB1*04:03:01, DQB1*04:03:02, DQB1*04:04, DQB1*04:05, DQB1*04:06, DQB1*04:07, DQB1*04:08, DQB1*05:01:01:01, DQB1*05:01:01:02, DQB1*05:01:02, DQB1*05:01:03, DQB1*05:02:01, DQB1*05:02:02, DQB1*05:02:03, DQB1*05:03:01:01, DQB1*05:03:01:02, DQB1*05:03:02, DQB1*05:03:03, DQB1*05:03:04, DQB1*05:03:05, DQB1*05:04, DQB1*05:05, DQB1*05:06, DQB1*05:07, DQB1*05:08, DQB1*05:09, DQB1*05:10, DQB1*05:11, DQB1*05:12, DQB1*06:01:01, DQB1*06:01:02, DQB1*06:01:03, DQB1*06:01:04, DQB1*06:01:05, DQB1*06:01:06, DQB1*06:02:01, DQB1*06:02:02, DQB1*06:03:01, DQB1*06:03:02, DQB1*06:04:01, DQB1*06:04:02, DQB1*06:04:03, DQB1*06:05:01, DQB1*06:05:02, DQB1*06:06, DQB1*06:07:01, DQB1*06:07:02, DQB1*06:08:01, DQB1*06:08:02, DQB1*06:09, DQB1*06:10, DQB1*06:11:01, DQB1*06:11:02, DQB1*06:12, DQB1*06:13, DQB1*06:14:01, DQB1*06:14:02, DQB1*06:15, DQB1*06:16, DQB1*06:17, DQB1*06:18, DQB1*06:19, DQB1*06:20, DQB1*06:21, DQB1*06:22, DQB1*06:23, DQB1*06:24, DQB1*06:25, DQB1*06:27, DQB1*06:28, DQB1*06:29, DQB1*06:30, DQB1*06:31, DQB1*06:32, DQB1*06:33, DQB1*06:34, DQB1*06:35, DQB1*06:36, DQB1*06:37, DQB1*06:38, DQB1*06:39, DQB1*06:40, DQB1*06:41, DQB1*06:42, DQB1*06:43, DQB1*06:44, DRA*01:01:01:01, DRA*01:01:01:02, DRA*01:01:01:03, DRA*01:01:02, DRA*01:02:01, DRA*01:02:02, DRA*01:02:03, DRB1*01:01:01, DRB1*01:01:02, DRB1*01:01:03, DRB1*01:01:04, DRB1*01:01:05, DRB1*01:01:06, DRB1*01:01:07, DRB1*01:01:08, DRB1*01:01:09, DRB1*01:01:10, DRB1*01:01:11, DRB1*01:01:12, DRB1*01:01:13, DRB1*01:01:14, DRB1*01:01:15, DRB1*01:01:16, DRB1*01:01:17, DRB1*01:01:18, DRB1*01:01:19, DRB1*01:01:20, DRB1*01:02:01, DRB1*01:02:02, DRB1*01:02:03, DRB1*01:02:04, DRB1*01:02:05, DRB1*01:03, DRB1*01:04, DRB1*01:05, DRB1*01:06, DRB1*01:07, DRB1*01:08, DRB1*01:09, DRB1*01:10, DRB1*01:11, DRB1*01:12, DRB1*01:13, DRB1*01:14, DRB1*01:15, DRB1*01:16, DRB1*01:17, DRB1*01:18, DRB1*01:19, DRB1*01:20, DRB1*01:21, DRB1*01:22, DRB1*01:23, DRB1*01:24, DRB1*01:25, DRB1*01:26, DRB1*01:27, DRB1*01:28, DRB1*01:29, DRB1*01:30, DRB1*01:31, DRB1*01:32, DRB1*01:34, DRB1*01:35, DRB1*01:36, DRB1*01:37, DRB1*03:01:01:01, DRB1*03:01:01:02, DRB1*03:01:02, DRB1*03:01:03, DRB1*03:01:04, DRB1*03:01:05, DRB1*03:01:06, DRB1*03:01:07, DRB1*03:01:08, DRB1*03:01:09, DRB1*03:01:10, DRB1*03:01:11, DRB1*03:01:12, DRB1*03:01:13, DRB1*03:01:14, DRB1*03:02:01, DRB1*03:02:02, DRB1*03:03, DRB1*03:04:01, DRB1*03:04:02, DRB1*03:05:01, DRB1*03:05:02, DRB1*03:05:03, DRB1*03:06, DRB1*03:07, DRB1*03:08, DRB1*03:09, DRB1*03:10, DRB1*03:11:01, DRB1*03:11:02, DRB1*03:12, DRB1*03:13:01, DRB1*03:13:02, DRB1*03:14, DRB1*03:15, DRB1*03:16, DRB1*03:17, DRB1*03:18, DRB1*03:19, DRB1*03:20, DRB1*03:21, DRB1*03:22, DRB1*03:23, DRB1*03:24, DRB1*03:25, DRB1*03:26, DRB1*03:27, DRB1*03:28, DRB1*03:29, DRB1*03:30, DRB1*03:31, DRB1*03:32, DRB1*03:33, DRB1*03:34, DRB1*03:35, DRB1*03:36, DRB1*03:37, DRB1*03:38, DRB1*03:39, DRB1*03:40, DRB1*03:41, DRB1*03:42, DRB1*03:43, DRB1*03:44, DRB1*03:45, DRB1*03:46, DRB1*03:47, DRB1*03:48, DRB1*03:49, DRB1*03:50, DRB1*03:51, DRB1*03:52, DRB1*03:53, DRB1*03:54, DRB1*03:55, DRB1*03:56, DRB1*03:57, DRB1*03:58, DRB1*03:59, DRB1*03:60, DRB1*03:61, DRB1*03:62, DRB1*03:63, DRB1*03:64, DRB1*03:65, DRB1*04:01:01, DRB1*04:01:02, DRB1*04:01:03, DRB1*04:01:04, DRB1*04:01:05, DRB1*04:01:06, DRB1*04:01:07, DRB1*04:02:01,

DRB1*04:02:02, DRB1*04:02:03, DRB1*04:03:01, DRB1*04:03:02, DRB1*04:03:03, DRB1*04:03:04, DRB1*04:03:05, DRB1*04:03:06, DRB1*04:03:07, DRB1*04:04:01, DRB1*04:04:02, DRB1*04:04:03, DRB1*04:04:04, DRB1*04:04:05, DRB1*04:04:06, DRB1*04:05:01, DRB1*04:05:02, DRB1*04:05:03, DRB1*04:05:04, DRB1*04:05:05, DRB1*04:05:06, DRB1*04:05:07, DRB1*04:05:08, DRB1*04:05:09, DRB1*04:05:10, DRB1*04:05:11, DRB1*04:05:12, DRB1*04:06:01, DRB1*04:06:02, DRB1*04:06:03, DRB1*04:06:04, DRB1*04:07:01, DRB1*04:07:02, DRB1*04:07:03, DRB1*04:07:04, DRB1*04:08:01, DRB1*04:08:02, DRB1*04:09, DRB1*04:10, DRB1*04:100, DRB1*04:101, DRB1*04:102, DRB1*04:11, DRB1*04:12, DRB1*04:13, DRB1*04:14, DRB1*04:15, DRB1*04:16, DRB1*04:17:01, DRB1*04:17:02, DRB1*04:18, DRB1*04:19, DRB1*04:20, DRB1*04:21, DRB1*04:22, DRB1*04:23, DRB1*04:24, DRB1*04:25, DRB1*04:26, DRB1*04:27, DRB1*04:28, DRB1*04:29, DRB1*04:30, DRB1*04:31, DRB1*04:32, DRB1*04:33, DRB1*04:34, DRB1*04:35, DRB1*04:36, DRB1*04:37, DRB1*04:38, DRB1*04:39, DRB1*04:40, DRB1*04:41, DRB1*04:42, DRB1*04:43, DRB1*04:44, DRB1*04:45, DRB1*04:46, DRB1*04:47, DRB1*04:48, DRB1*04:49, DRB1*04:50, DRB1*04:51, DRB1*04:52, DRB1*04:53, DRB1*04:54, DRB1*04:55, DRB1*04:56, DRB1*04:57, DRB1*04:58, DRB1*04:59, DRB1*04:60, DRB1*04:61, DRB1*04:62, DRB1*04:63, DRB1*04:64, DRB1*04:65, DRB1*04:66, DRB1*04:67, DRB1*04:68, DRB1*04:69, DRB1*04:70, DRB1*04:71, DRB1*04:72:01, DRB1*04:72:02, DRB1*04:73, DRB1*04:74, DRB1*04:75, DRB1*04:76, DRB1*04:77, DRB1*04:78, DRB1*04:79, DRB1*04:80, DRB1*04:82, DRB1*04:83, DRB1*04:84, DRB1*04:85, DRB1*04:86, DRB1*04:87, DRB1*04:88, DRB1*04:89, DRB1*04:90, DRB1*04:91, DRB1*04:92, DRB1*04:93, DRB1*04:95, DRB1*04:96, DRB1*04:97, DRB1*04:98, DRB1*04:99, DRB1*07:01:01:01, DRB1*07:01:01:02, DRB1*07:01:02, DRB1*07:01:03, DRB1*07:01:04, DRB1*07:03, DRB1*07:04, DRB1*07:05, DRB1*07:06, DRB1*07:07, DRB1*07:08, DRB1*07:09, DRB1*07:11, DRB1*07:12, DRB1*07:13, DRB1*07:14, DRB1*07:15, DRB1*07:16, DRB1*07:17, DRB1*07:18, DRB1*07:19, DRB1*07:20, DRB1*07:21, DRB1*08:01:01, DRB1*08:01:02, DRB1*08:01:03, DRB1*08:01:04, DRB1*08:01:05, DRB1*08:02:01, DRB1*08:02:02, DRB1*08:02:03, DRB1*08:02:04, DRB1*08:03:02, DRB1*08:04:01, DRB1*08:04:02, DRB1*08:04:03, DRB1*08:04:04, DRB1*08:04:05, DRB1*08:04:06, DRB1*08:04:07, DRB1*08:05, DRB1*08:06, DRB1*08:07, DRB1*08:08, DRB1*08:09, DRB1*08:10, DRB1*08:11, DRB1*08:12, DRB1*08:13, DRB1*08:14, DRB1*08:15, DRB1*08:16, DRB1*08:17, DRB1*08:18, DRB1*08:19, DRB1*08:20, DRB1*08:21, DRB1*08:22, DRB1*08:23, DRB1*08:24, DRB1*08:25, DRB1*08:26, DRB1*08:27, DRB1*08:28, DRB1*08:29, DRB1*08:30:01, DRB1*08:30:02, DRB1*08:30:03, DRB1*08:31, DRB1*08:32, DRB1*08:33, DRB1*08:34, DRB1*08:35, DRB1*08:36, DRB1*08:37, DRB1*08:38, DRB1*08:39, DRB1*08:40, DRB1*08:41, DRB1*08:42, DRB1*08:43, DRB1*08:44, DRB1*08:45, DRB1*08:46, DRB1*08:47, DRB1*08:48, DRB1*09:01:02, DRB1*09:01:03, DRB1*09:01:04, DRB1*09:01:05, DRB1*09:01:06, DRB1*09:01:07, DRB1*09:02:01, DRB1*09:02:02, DRB1*09:03, DRB1*09:04, DRB1*09:05, DRB1*09:06, DRB1*09:07, DRB1*09:08, DRB1*09:09, DRB1*09:10, DRB1*09:11, DRB1*09:12, DRB1*09:13, DRB1*09:14, DRB1*09:15, DRB1*09:16, DRB1*10:01:01, DRB1*10:01:02, DRB1*10:01:03, DRB1*10:02, DRB1*10:03, DRB1*11:01:01, DRB1*11:01:02, DRB1*11:01:03, DRB1*11:01:04, DRB1*11:01:05, DRB1*11:01:06, DRB1*11:01:07, DRB1*11:01:08, DRB1*11:01:09, DRB1*11:01:10, DRB1*11:01:11, DRB1*11:01:12, DRB1*11:01:13, DRB1*11:01:14, DRB1*11:01:15, DRB1*11:02:01, DRB1*11:02:02, DRB1*11:03, DRB1*11:04:01, DRB1*11:04:02, DRB1*11:04:03, DRB1*11:04:04, DRB1*11:04:05, DRB1*11:04:06, DRB1*11:04:07, DRB1*11:04:08, DRB1*11:05, DRB1*11:06:01, DRB1*11:06:02, DRB1*11:07, DRB1*11:08:01, DRB1*11:08:02, DRB1*11:09, DRB1*11:100, DRB1*11:101, DRB1*11:102, DRB1*11:103, DRB1*11:104, DRB1*11:105, DRB1*11:106, DRB1*11:107, DRB1*11:108, DRB1*11:109, DRB1*11:10:01, DRB1*11:10:02, DRB1*11:110, DRB1*11:111, DRB1*11:112, DRB1*11:113, DRB1*11:11:01, DRB1*11:11:02, DRB1*11:12:01, DRB1*11:12:02, DRB1*11:13:01, DRB1*11:13:02, DRB1*11:14:01, DRB1*11:14:02, DRB1*11:15, DRB1*11:16, DRB1*11:17, DRB1*11:18, DRB1*11:19:01, DRB1*11:19:02, DRB1*11:19:03, DRB1*11:20, DRB1*11:21, DRB1*11:22, DRB1*11:23, DRB1*11:24, DRB1*11:25, DRB1*11:26, DRB1*11:27:01, DRB1*11:27:02, DRB1*11:27:03, DRB1*11:28:01, DRB1*11:28:02, DRB1*11:29, DRB1*11:30, DRB1*11:31, DRB1*11:32, DRB1*11:33, DRB1*11:34, DRB1*11:35, DRB1*11:36, DRB1*11:37, DRB1*11:38, DRB1*11:39, DRB1*11:40, DRB1*11:41, DRB1*11:42, DRB1*11:43, DRB1*11:44, DRB1*11:45, DRB1*11:46:01, DRB1*11:46:02, DRB1*11:47, DRB1*11:48, DRB1*11:49:01, DRB1*11:49:02, DRB1*11:50, DRB1*11:51, DRB1*11:52, DRB1*11:53, DRB1*11:54:01, DRB1*11:54:02, DRB1*11:55, DRB1*11:56, DRB1*11:57, DRB1*11:58:01, DRB1*11:58:02, DRB1*11:59, DRB1*11:60, DRB1*11:61, DRB1*11:62, DRB1*11:63, DRB1*11:64, DRB1*11:65:01, DRB1*11:65:02, DRB1*11:66, DRB1*11:67, DRB1*11:68, DRB1*11:69, DRB1*11:70, DRB1*11:72, DRB1*11:73, DRB1*11:74:01, DRB1*11:74:02, DRB1*11:75, DRB1*11:76, DRB1*11:77, DRB1*11:78, DRB1*11:79, DRB1*11:80, DRB1*11:81, DRB1*11:82, DRB1*11:83, DRB1*11:84, DRB1*11:85, DRB1*11:86, DRB1*11:87, DRB1*11:88, DRB1*11:89, DRB1*11:90, DRB1*11:91, DRB1*11:92, DRB1*11:93, DRB1*11:94, DRB1*11:95, DRB1*11:96, DRB1*11:97, DRB1*11:98, DRB1*11:99, DRB1*12:01:01, DRB1*12:01:02, DRB1*12:01:03, DRB1*12:01:04, DRB1*12:02:01, DRB1*12:02:02, DRB1*12:02:03, DRB1*12:02:04, DRB1*12:02:05, DRB1*12:03:02, DRB1*12:04, DRB1*12:05, DRB1*12:06, DRB1*12:07, DRB1*12:08, DRB1*12:09, DRB1*12:10, DRB1*12:11, DRB1*12:12, DRB1*12:13, DRB1*12:14, DRB1*12:15, DRB1*12:16, DRB1*12:17, DRB1*12:18, DRB1*12:19, DRB1*12:20, DRB1*12:21, DRB1*12:22, DRB1*12:23, DRB1*12:25, DRB1*12:26, DRB1*12:27, DRB1*12:28, DRB1*12:29, DRB1*12:30, DRB1*12:32, DRB1*12:33, DRB1*12:34, DRB1*13:01:01, DRB1*13:01:02, DRB1*13:01:03, DRB1*13:01:04, DRB1*13:01:05, DRB1*13:01:06, DRB1*13:01:07, DRB1*13:01:08, DRB1*13:01:09, DRB1*13:02:01, DRB1*13:02:02, DRB1*13:02:03, DRB1*13:02:04, DRB1*13:02:05, DRB1*13:03:01, DRB1*13:03:02, DRB1*13:03:03, DRB1*13:03:04, DRB1*13:03:05, DRB1*13:03:06, DRB1*13:04, DRB1*13:05:01, DRB1*13:05:02, DRB1*13:06, DRB1*13:07:01, DRB1*13:07:02, DRB1*13:08, DRB1*13:09, DRB1*13:10, DRB1*13:100, DRB1*13:101, DRB1*13:102, DRB1*13:103, DRB1*13:104, DRB1*13:105, DRB1*13:106, DRB1*13:107,

DRB1*13:108, DRB1*13:109, DRB1*13:110, DRB1*13:111, DRB1*13:112, DRB1*13:114, DRB1*13:115, DRB1*13:116, DRB1*13:117, DRB1*13:118, DRB1*13:119, DRB1*13:11:01, DRB1*13:11:02, DRB1*13:12:01, DRB1*13:12:02, DRB1*13:13, DRB1*13:14:01, DRB1*13:14:02, DRB1*13:14:03, DRB1*13:15, DRB1*13:16, DRB1*13:17, DRB1*13:18, DRB1*13:19, DRB1*13:20, DRB1*13:21:01, DRB1*13:21:02, DRB1*13:22, DRB1*13:23:01, DRB1*13:23:02, DRB1*13:24, DRB1*13:25, DRB1*13:26, DRB1*13:27, DRB1*13:28, DRB1*13:29, DRB1*13:30, DRB1*13:31, DRB1*13:32, DRB1*13:33:01, DRB1*13:33:02, DRB1*13:33:03, DRB1*13:34, DRB1*13:35, DRB1*13:36, DRB1*13:37, DRB1*13:38, DRB1*13:39, DRB1*13:40, DRB1*13:41, DRB1*13:42, DRB1*13:43, DRB1*13:44, DRB1*13:45, DRB1*13:46, DRB1*13:47, DRB1*13:48, DRB1*13:49, DRB1*13:50:01, DRB1*13:50:02, DRB1*13:51, DRB1*13:52, DRB1*13:53, DRB1*13:54, DRB1*13:55, DRB1*13:56, DRB1*13:57, DRB1*13:58, DRB1*13:59, DRB1*13:60, DRB1*13:61:01, DRB1*13:61:02, DRB1*13:62, DRB1*13:63, DRB1*13:64, DRB1*13:65, DRB1*13:66:01, DRB1*13:66:02, DRB1*13:67, DRB1*13:68, DRB1*13:69, DRB1*13:70, DRB1*13:71, DRB1*13:72, DRB1*13:73, DRB1*13:74, DRB1*13:75, DRB1*13:76, DRB1*13:77, DRB1*13:78, DRB1*13:79, DRB1*13:80, DRB1*13:81, DRB1*13:82, DRB1*13:83, DRB1*13:84, DRB1*13:85, DRB1*13:86, DRB1*13:87, DRB1*13:88, DRB1*13:89, DRB1*13:90, DRB1*13:91, DRB1*13:92, DRB1*13:93, DRB1*13:94, DRB1*13:95, DRB1*13:96:01, DRB1*13:96:02, DRB1*13:97, DRB1*13:98, DRB1*13:99, DRB1*14:01:01, DRB1*14:01:02, DRB1*14:01:03, DRB1*14:02, DRB1*14:03:01, DRB1*14:03:02, DRB1*14:04, DRB1*14:05:01, DRB1*14:05:02, DRB1*14:05:03, DRB1*14:06:01, DRB1*14:06:02, DRB1*14:07:01, DRB1*14:07:02, DRB1*14:08, DRB1*14:09, DRB1*14:10, DRB1*14:100, DRB1*14:101, DRB1*14:102, DRB1*14:103, DRB1*14:104, DRB1*14:105, DRB1*14:106, DRB1*14:107, DRB1*14:108, DRB1*14:109, DRB1*14:11, DRB1*14:110, DRB1*14:111, DRB1*14:112, DRB1*14:113, DRB1*14:114, DRB1*14:115, DRB1*14:116, DRB1*14:117, DRB1*14:12:01, DRB1*14:12:02, DRB1*14:13, DRB1*14:14, DRB1*14:15, DRB1*14:16, DRB1*14:17, DRB1*14:18, DRB1*14:19, DRB1*14:20, DRB1*14:21, DRB1*14:22, DRB1*14:23:01, DRB1*14:23:02, DRB1*14:23:03, DRB1*14:24, DRB1*14:25, DRB1*14:26, DRB1*14:27, DRB1*14:28, DRB1*14:29, DRB1*14:30, DRB1*14:31, DRB1*14:32:01, DRB1*14:32:02, DRB1*14:33, DRB1*14:34, DRB1*14:35, DRB1*14:36, DRB1*14:37, DRB1*14:38, DRB1*14:39, DRB1*14:40, DRB1*14:41, DRB1*14:42, DRB1*14:43, DRB1*14:44:01, DRB1*14:44:02, DRB1*14:45, DRB1*14:46, DRB1*14:47, DRB1*14:48, DRB1*14:49, DRB1*14:50, DRB1*14:51, DRB1*14:52, DRB1*14:53, DRB1*14:54, DRB1*14:55, DRB1*14:56, DRB1*14:57, DRB1*14:58, DRB1*14:59, DRB1*14:60, DRB1*14:61, DRB1*14:62, DRB1*14:63, DRB1*14:64, DRB1*14:65, DRB1*14:67, DRB1*14:68, DRB1*14:69, DRB1*14:70, DRB1*14:71, DRB1*14:72, DRB1*14:73, DRB1*14:74, DRB1*14:75, DRB1*14:76, DRB1*14:77, DRB1*14:78, DRB1*14:79, DRB1*14:80, DRB1*14:81, DRB1*14:82, DRB1*14:83, DRB1*14:84, DRB1*14:85, DRB1*14:86, DRB1*14:87, DRB1*14:88, DRB1*14:89, DRB1*14:90, DRB1*14:91, DRB1*14:93, DRB1*14:94, DRB1*14:95, DRB1*14:96, DRB1*14:97, DRB1*14:98, DRB1*14:99, DRB1*15:01:01:01, DRB1*15:01:01:02, DRB1*15:01:02, DRB1*15:01:03, DRB1*15:01:04, DRB1*15:01:05, DRB1*15:01:06, DRB1*15:01:07, DRB1*15:01:08, DRB1*15:01:09, DRB1*15:01:10, DRB1*15:01:11, DRB1*15:01:12, DRB1*15:01:13, DRB1*15:01:14, DRB1*15:01:15, DRB1*15:01:16, DRB1*15:01:17, DRB1*15:02:01, DRB1*15:02:02, DRB1*15:02:03, DRB1*15:02:04, DRB1*15:02:05, DRB1*15:02:06, DRB1*15:02:07, DRB1*15:02:08, DRB1*15:03:01:01, DRB1*15:03:01:02, DRB1*15:03:02, DRB1*15:04, DRB1*15:05, DRB1*15:06, DRB1*15:07, DRB1*15:08, DRB1*15:09, DRB1*15:10, DRB1*15:11, DRB1*15:12, DRB1*15:13, DRB1*15:14, DRB1*15:15, DRB1*15:16, DRB1*15:18, DRB1*15:19, DRB1*15:20, DRB1*15:21, DRB1*15:22, DRB1*15:23, DRB1*15:24, DRB1*15:25, DRB1*15:26, DRB1*15:27, DRB1*15:28, DRB1*15:29, DRB1*15:30, DRB1*15:31, DRB1*15:32, DRB1*15:33, DRB1*15:34, DRB1*15:35, DRB1*15:36, DRB1*15:37, DRB1*15:38, DRB1*15:39, DRB1*15:40, DRB1*15:41, DRB1*15:42, DRB1*15:43, DRB1*15:44, DRB1*15:45, DRB1*15:46, DRB1*15:47, DRB1*15:48, DRB1*15:49, DRB1*15:51, DRB1*15:52, DRB1*15:53, DRB1*15:54, DRB1*15:55, DRB1*15:56, DRB1*15:57, DRB1*15:58, DRB1*16:01:01, DRB1*16:01:02, DRB1*16:02:01, DRB1*16:02:02, DRB1*16:03, DRB1*16:04, DRB1*16:05:01, DRB1*16:05:02, DRB1*16:07, DRB1*16:08, DRB1*16:09, DRB1*16:10, DRB1*16:11, DRB1*16:12, DRB1*16:14, DRB1*16:15, DRB1*16:16, DRB1*16:17, DRB1*16:18, DRB3*01:01:02:01, DRB3*01:01:02:02, DRB3*01:01:03, DRB3*01:01:04, DRB3*01:01:05, DRB3*01:02, DRB3*01:03, DRB3*01:04, DRB3*01:05, DRB3*01:06, DRB3*01:07, DRB3*01:08, DRB3*01:09, DRB3*01:10, DRB3*01:11, DRB3*01:12, DRB3*01:13, DRB3*01:14, DRB3*01:15, DRB3*02:01, DRB3*02:02:01:01, DRB3*02:02:01:02, DRB3*02:02:02, DRB3*02:02:03, DRB3*02:02:04, DRB3*02:02:05, DRB3*02:03, DRB3*02:04, DRB3*02:05, DRB3*02:06, DRB3*02:07, DRB3*02:08, DRB3*02:09, DRB3*02:10, DRB3*02:11, DRB3*02:12, DRB3*02:13, DRB3*02:14, DRB3*02:15, DRB3*02:16, DRB3*02:17, DRB3*02:18, DRB3*02:19, DRB3*02:20, DRB3*02:21, DRB3*02:22, DRB3*02:23, DRB3*02:24, DRB3*02:25, DRB3*02:26, DRB3*02:27, DRB3*02:28, DRB3*03:01:01, DRB3*03:01:02, DRB3*03:01:03, DRB3*03:02, DRB3*03:03, DRB4*01:01:01:01, DRB4*01:02, DRB4*01:03:01:01, DRB4*01:03:01:03, DRB4*01:03:02, DRB4*01:03:03, DRB4*01:03:04, DRB4*01:04, DRB4*01:05, DRB4*01:06, DRB4*01:07, DRB4*01:08, DRB5*01:01:01, DRB5*01:01:02, DRB5*01:02, DRB5*01:03, DRB5*01:04, DRB5*01:05, DRB5*01:06, DRB5*01:07, DRB5*01:09, DRB5*01:11, DRB5*01:12, DRB5*01:13, DRB5*01:14, DRB5*02:02, DRB5*02:03, DRB5*02:04, DRB5*02:05, ABCEFG_negative_control, DRA_negative_control, DRB_negative_control, DQA_negative_control, DQB_negative_control, DPA_negative_control, and DPB_negative_control.

Within a specific embodiment, the oligonucleotide array comprises one or more of the negative control oligonucleotides having the nucleic acid sequences set forth in Table VI, below. The oligonucleotides in Table VI are negative control oligonucleotides for classical and non-classical HLA molecules. Within another specific embodiment, the oligonucleotide array comprises one or more of the negative control oligonucleotides having the nucleic acid sequences set forth in Table VII, below. The oligonucleotides in Table VII are negative control oligonucleotides for accessory molecules. Within yet another specific embodiment, the oligonucleotide array comprises one or more of the negative control oligonucleotides having the nucleic acid sequences set forth in Table VIII, below. The oligonucleotides in Table VIII are negative control oligonucleotides for KIR molecules. Within still another specific embodiment, the oligonucleotide array comprises one or more of the negative control oligonucleotides having the nucleic acid sequences set forth in Table IX, below. The oligonucleotides in Table IX are negative control oligonucleotides for blood group determining molecules. Within still another specific embodiment, the oligonucleotide array comprises one or more of the negative control oligonucleotides having the nucleic acid sequences set forth in Table X and denoted by "HNN" in Table X, below.

In Tables I-X, within each of the three columns of sequences, the leftmost column indicates the SEQ ID NO ("SIN"), the middle column indicates the name of the sequence (e.g., "N001087" in Table 1) (or in certain Tables, e.g., Tables III-IX, the oligonucleotides' names are just numbers), and the rightmost column indicates the nucleic acid sequences (containing A, C, G, and T). In Tables I and II, the letter "E" at the beginning of an oligonucleotide name indicates that the oligo is "extended" and "N" indicates "normal" (i.e., not extended). In Table X, oligo names begin with "HNN," "HPN," "HPE," or "HPT." As discussed above, "HNN" indicates that the oligo is a negative control oligonucleotide, "HPN" indicates a "normal" (unchanged) oligo, "HPT" indicates a "truncated" oligo, and "HPE" indicates an "extended" oligo. The "HPT" and "HPE" modifications were made to ensure proper melting temperature.

Lengthy table referenced here

US08969254-20150303-T00001

Please refer to the end of the specification for access instructions.

Lengthy table referenced here

US08969254-20150303-T00002

Please refer to the end of the specification for access instructions.

Lengthy table referenced here

US08969254-20150303-T00003

Please refer to the end of the specification for access instructions.

Lengthy table referenced here

US08969254-20150303-T00004

Please refer to the end of the specification for access instructions.

Lengthy table referenced here

US08969254-20150303-T00005

Please refer to the end of the specification for access instructions.

Lengthy table referenced here

US08969254-20150303-T00006

Please refer to the end of the specification for access instructions.

Lengthy table referenced here

US08969254-20150303-T00007

Please refer to the end of the specification for access instructions.

Lengthy table referenced here

US08969254-20150303-T00008

Please refer to the end of the specification for access instructions.

Lengthy table referenced here

US08969254-20150303-T00009

Please refer to the end of the specification for access instructions.

Lengthy table referenced here

US08969254-20150303-T00010

Please refer to the end of the specification for access instructions.

It is to be understood that an oligonucleotide array as described herein can comprise the capture oligonucleotides set forth in any one or more of Tables I-X, above. Further, an oligonucleotide array preferably comprises all of the oligonucleotide sequences set forth in at least one of Tables I-V and the non-negative controls in Table X (oligos with names starting with "HPN", "HPE" or "HPT", but not "HNN"), but within certain embodiments can include fewer oligonucleotides, such as, e.g., 5%, 10%, 20%, 30%, 40%, 50%, 60%, 70%, 80, 90%, 95% or 98% of the sequences set forth in any of Tables I-V. In other embodiments, an oligonucleotide array can comprise nearly all or all (e.g., 70%, 75%, 80%, 85%, 90%, 95%, 98%, 99%, or 100%) of the sequences set forth in one of Tables I-V and fewer than all or nearly all of the sequences set forth in one of the other of Tables I-IX, e.g., 0%, 1%, 5%, 10%, 15%, 20%, 25%, 30%, 35%, 40%, 45%, 50%, 55%, 60%, 65%, 70%, 75%, 80%, 85%, 90%, 95%, 98% or 99% of the oligonucleotides set forth in one or more other of Tables I-IX. By way of example, and without limitation, an oligonucleotide array can comprise all of the capture oligonucleotides set forth in Table I, 50% of the capture oligonucleotides set forth in Table II, and 10% of the capture oligonucleotides set forth in Table III, and optionally, one or more of the oligonucleotides having a sequence set forth in any one or more of Tables VI-IX or the oligos with names starting with "HNN" in Table X.

Solution or Solid Phase Methods for Oligonucleotide Synthesis

Detailed descriptions of the procedures for solution and solid phase synthesis of nucleic acids by phosphite-triester, phosphotriester, and H-phosphonate chemistries are widely available. For example, the solid phase phosphoramidite triester method of Beaticage and Carruthers using an automated synthesizer is described in, e.g., Itakura, U.S. Pat. No. 4,401, 796; Carruthers, U.S. Pat. Nos. 4,458,066 and 4,500,707. See also Needham-VanDevanter, Nucleic Acids Res. 12:6159-6168 (1984); Beigelman Nucleic Acids Res 23:3989-3994 (1995); Oligonucleotide Synthesis: A Practical Approach, Gait (ed.), IRL Press, Washington D.C. (1984), see Jones, chapt 2, Atkinson, chapter 3, and Sproat, chapert 4; Froehler, Tetrahedron Lett. 27:469-472 (1986); Froehler, Nucleic Acids Res. 14:5399-5407 (1986). Methods to purify oligonucleotides include native acrylamide gel electrophoresis, anion-exchange HPLC, as described in Pearson J. Chrom. 255:137-149 (1983). The sequence of the synthetic oligonucleotide can be verified using any chemical degradation method, e.g., see Maxam (1980) Methods in Enzymology 65:499-560, Xiao Antisense Nucleic Acid Drug Dev 6:247-258 (1996), or for solid-phase chemical degradation procedures, Rosenthal, Nucleic Acids Symp. Ser. 18:249-252 (1987).

Solid-Support Based Oligonucleotide Synthesis

An array of capture oligonucleotides at known locations on a single substrate surface can be formed using a variety of techniques known to those skilled in the art of polymer synthesis on solid supports. For example, "light directed" methods (which are one technique in a family of methods known as VLSIPS™ methods) are described in U.S. Pat. No. 5,143, 854. The light directed methods discussed in the '854 patent involve activating predefined regions of a substrate or solid support and then contacting the substrate with a preselected monomer solution. The predefined regions can be activated with a light source shown through a mask (much in the manner of photolithography techniques used in integrated circuit fabrication). Other regions of the substrate remain inactive because they are blocked by the mask from illumination and remain chemically protected. Thus, a light pattern defines which regions of the substrate react with a given monomer. By repeatedly activating different sets of predefined regions and contacting different monomer solutions with the substrate, a diverse array of polymers is produced on the substrate. Of course, other steps such as washing unreacted monomer solution from the substrate can be used as necessary.

Other useful techniques include mechanical techniques (e.g., flow channel, spotting or pin-based methods). In each of the "flow channel" or "spotting" methods, certain activated regions of the substrate are mechanically separated from other regions when the monomer solutions are delivered to the various reaction sites.

A typical "flow channel" method applied to the compounds and libraries of the present invention can generally be described as follows. Diverse probe sequences are synthesized at selected regions of a substrate or solid support by forming flow channels on a surface of the substrate through which appropriate reagents flow or in which appropriate reagents are placed. For example, assume a monomer "A" is to be bound to the substrate in a first group of selected regions. If necessary, all or part of the surface of the substrate in all or a part of the selected regions is activated for binding by, for example, flowing appropriate reagents through all or some of the channels, or by washing the entire substrate with appropriate reagents. After placement of a channel block on the surface of the substrate, a reagent having the monomer A flows through or is placed in all or some of the channel(s). The channels provide fluid contact to the first selected regions, thereby binding the monomer A on the substrate directly or indirectly (via a spacer) in the first selected regions.

Thereafter, a monomer B is coupled to second selected regions, some of which may be included among the first selected regions. The second selected regions will be in fluid contact with a second flow channel(s) through translation, rotation, or replacement of the channel block on the surface of the substrate; through opening or closing a selected valve; or through deposition of a layer of chemical or photoresist. If necessary, a step is performed for activating at least the second regions. Thereafter, the monomer B is flowed through or placed in the second flow channel(s), binding monomer B at the second selected locations. In this particular example, the resulting sequences bound to the substrate at this stage of processing will be, for example, A, B, and AB. The process is repeated to form an array of sequences of desired length at known locations on the substrate.

After the substrate is activated, monomer A can be flowed through some of the channels, monomer B can be flowed through other channels, a monomer C can be flowed through still other channels, etc. In this manner, many or all of the reaction regions are reacted with a monomer before the channel block must be moved or the substrate must be washed and/or reactivated. By making use of many or all of the available reaction regions simultaneously, the number of washing and activation steps can be minimized.

One of skill in the art will recognize that there are alternative methods of forming channels or otherwise protecting a portion of the surface of the substrate. For example, according to some embodiments, a protective coating such as a hydrophilic or hydrophobic coating (depending upon the nature of the solvent) is utilized over portions of the substrate to be protected, sometimes in combination with materials that facilitate wetting by the reactant solution in other regions. In this manner, the flowing solutions are further prevented from passing outside of their designated flow paths.

The "spotting" methods of preparing compounds and libraries of the present invention can be implemented in much the same manner as the flow channel methods. For example, a monomer A can be delivered to and coupled with a first group of reaction regions which have been appropriately activated. Thereafter, a monomer B can be delivered to and reacted with a second group of activated reaction regions. Unlike the flow channel embodiments described above, reactants are delivered by directly depositing (rather than flowing) relatively small quantities of them in selected regions. In some steps, of course, the entire substrate surface can be sprayed or otherwise coated with a solution. In preferred embodiments, a dispenser moves from region to region, depositing only as much monomer as necessary at each stop. Typical dispensers include a micropipette to deliver the monomer solution to the substrate and a robotic system to control the position of the micropipette with respect to the substrate. In other embodiments, the dispenser includes a series of tubes, a manifold, an array of pipettes, or the like so that various reagents can be delivered to the reaction regions simultaneously.

Another method which is useful for the preparation of an array of diverse oligonucleotides on a single substrate involves "pin based synthesis." This method is described in detail in U.S. Pat. No. 5,288,514. The method utilizes a substrate having a plurality of pins or other extensions. The pins are each inserted simultaneously into individual reagent containers in a tray. In a common embodiment, an array of 96 pins/containers is utilized.

Each tray is filled with a particular reagent for coupling in a particular chemical reaction on an individual pin. Accordingly, the trays will often contain different reagents. Since the chemistry used is such that relatively similar reaction conditions may be utilized to perform each of the reactions, multiple chemical coupling steps can be conducted simultaneously. In the first step of the process, a substrate on which the chemical coupling steps are conducted is provided. The substrate is optionally provided with a spacer (e.g., 15-mer of poly-dT) having active sites on which the capture oligonucleotides are attached or constructed.

Methods for HLA Tissue Typing Using Oligonucleotide Arrays

Within one embodiment, a method for human leukocyte antigen (HLA) tissue typing is provided, wherein said method comprises: (a) contacting a cDNA- or cRNA-containing sample under hybridization conditions with a plurality of capture oligonucleotides specific for HLA polypeptides, wherein said hybridization conditions facilitate hybridization of a subset of the capture oligonucleotides to complementary sequences present in the cDNA or cRNA; (b) detecting a hybridization pattern for said cDNA or cRNA; and (c) assigning to the sample, based on the hybridization pattern, an HLA tissue type; wherein the capture oligonucleotides are from about 17 to about 60 nucleotides in length and each capture oligonucleotide with respect to its exact complement has a melting temperature of about 64 degrees Celsius; wherein said capture oligonucleotides comprise subsets of oligonucleotides that collectively target classical HLA polypeptide-encoding nucleic acids ("classical HLA oligo subsets"), each classical HLA oligo subset targeting a different classical HLA polypeptide-encoding nucleic acid; and wherein each of said classical HLA oligo subsets comprises a set of overlapping oligonucleotides that cover every single nucleotide position in the mRNA sequences coding for the classical HLA polypeptides from 5' to 3' and are sequentially shifted by 1-5 nucleotides from the 5' end of the preceding overlapping oligonucleotide. In a specific embodiment, the capture oligonucleotides comprise subsets of oligonucleotides that collectively target all known classical HLA polypeptide-encoding nucleic acids. In one embodiment, the capture oligonucleotides are immobilized on a substrate (e.g, a microarray).

In another embodiment, a method for human leukocyte antigen (HLA) tissue typing is provided, wherein said method comprises: (a) contacting a cDNA- or cRNA-containing sample under hybridization conditions with a plurality of capture oligonucleotides specific for HLA polypeptides, wherein said hybridization conditions facilitate hybridization of a subset of the capture oligonucleotides to complementary sequences present in the cDNA or cRNA; (b) detecting a hybridization pattern for said cDNA or cRNA; and (c) assigning to the sample, based on the hybridization pattern, an HLA tissue type; wherein the capture oligonucleotides are from about 17 to about 60 nucleotides in length and each capture oligonucleotide with respect to its exact complement has a melting temperature of about 64 degrees Celsius; wherein said capture oligonucleotides comprise subsets of oligonucleotides that collectively target a panel of reference classical HLA polypeptide-encoding nucleic acids, wherein the panel comprises nucleic acids encoding all reference classical HLA polypeptides to which it is desired to test the HLA cDNA or cRNA in the sample for hybridization potential ("classical HLA oligo subsets"), each classical HLA oligo subset targeting a different classical HLA polypeptide-encoding nucleic acid; and wherein each of said classical HLA oligo subsets comprises a set of overlapping oligonucleotides that cover every single nucleotide position in the mRNA sequences coding for the classical HLA polypeptides from 5' to 3' and are sequentially shifted by 1-5 nucleotides from the 5' end of the preceding overlapping oligonucleotide.

Within certain embodiments of the above-describe method for HLA tissue typing, in the step (a), the cDNA or cRNA was detectably labeled during the making, and the detecting step (c) comprises detecting the detectably labeled cDNA or cRNA. Within other embodiments, the detecting step (b) comprises the use of labeled detection probes.

Within another embodiment, the capture oligonucleotides in the above-described method for HLA tissue typing further comprise a plurality of oligonucleotide subsets that collectively targets non-classical HLA polypeptide-encoding nucleic acids ("non-classical HLA oligo subsets"), each non-classical HLA oligo subset targeting a different non-classical HLA polypeptide-encoding nucleic acid; wherein each of said non-classical HLA oligo subsets comprises a set of overlapping oligonucleotides that cover every single nucleotide position in the mRNA sequences coding for the non-classical HLA polypeptides from 5' to 3' and are sequentially shifted by 1-5 nucleotides from the 5' end of the preceding overlapping oligonucleotide. In a specific embodiment, the plurality of oligonucleotide subsets that collectively targets non-classical HLA polypeptide-encoding nucleic acids collectively target all known non-classical HLA polypeptide-encoding nucleic acids. In one embodiment, the capture oligonucleotides are immobilized on a substrate (e.g, a microarray). In another embodiment, said capture oligonucleotides comprise subsets of oligonucleotides that collectively target a panel of reference non-classical HLA polypeptide-encoding nucleic acids, wherein the panel comprises nucleic acids encoding all reference non-classical HLA polypeptides to which it is desired to test the HLA cDNA or cRNA in the sample for hybridization potential ("non-classical HLA oligo subsets"), each classical HLA oligo subset targeting a different non-classical HLA polypeptide-encoding nucleic acid.

Within another embodiment, the capture oligonucleotides in the above-described method for HLA tissue typing further comprise a plurality of oligonucleotide subsets that collectively targets nucleic acids encoding accessory molecules ("accessory molecule oligo subsets"), and said method further comprises the step of assigning to the cell, based on the hybridization pattern, an accessory molecule phenotype; wherein each of said accessory molecule oligo subsets comprises a set of overlapping oligonucleotides that cover every single nucleotide position in the mRNA sequences coding for the accessory molecules from 5' to 3' and are sequentially shifted by 1-5 nucleotides from the 5' end of the preceding overlapping oligonucleotide.

Within still another embodiment, the capture oligonucleotides in the above-described method for HLA tissue typing further comprise a plurality of oligonucleotide subsets targeting killer-cell immunoglobulin-like receptor (KIR) polypeptide-encoding nucleic acids ("KIR oligo subsets"), and said method further comprises the step of assigning to the cell, based on the hybridization pattern, a KIR polypeptide phenotype; wherein each of said KIR oligo subsets comprises a set of overlapping oligonucleotides that cover every single nucleotide position in the mRNA sequences coding for the KIR polypeptides from 5' to 3' and are sequentially shifted by 1-5 nucleotides from the 5' end of the preceding overlapping oligonucleotide.

Within yet another embodiment, the capture oligonucleotides in the above-described method for HLA tissue typing further comprise a plurality of oligonucleotide subsets targeting blood group-determining polypeptide encoding nucleic acids ("blood group determining oligo subsets"), and said method further comprises the step of assigning to the cell, based on the hybridization pattern, a blood group phenotype; wherein each of said blood group determining oligo subsets comprises a set of overlapping oligonucleotides that cover every single nucleotide position in the mRNA sequences coding for the blood group-determining polypeptides from 5' to 3' and are sequentially shifted by 1-5 nucleotides from the 5' end of the preceding overlapping oligonucleotide.

In any of the above-described embodiments, the array can further comprise negative control oligonucleotides, such as, e.g., one or more of those having the nucleic acid sequences set forth in Tables VI-IX, or the oligos with names starting with "HNN" in Table X, above.

In any of the above-described embodiments, cDNA or cRNA can be made from an mRNA-containing sample according to any suitable method in the art (e.g., PCR). Further, the sample can be obtained from any suitable source, such as, e.g., a cell or cells. A cell or cells can be obtained from any suitable source of cells, such as, e.g., cells from a tissue from e.g., a subject (e.g., a donor or recipient or patient), cells obtained from blood or other bodily fluid, or cell line.

Within certain embodiments, the microarray can comprise any suitable substrate, e.g., solid support, such as those described herein. The fidelity of the hybridization assay is governed by the stability differences between perfectly matched and mismatched duplexes. Preferably, a single set of hybridization conditions that can provide a clear discrimination between matches and mismatches for all polymorphisms in each target gene (e.g., HLA polypeptide-encoding gene) should be used.

Within one embodiment, the cDNA samples were hybridized to custom oligonucleotide slides at 64° C. for 16 h, however, other hybridization conditions are also possible, can be determined by one of ordinary skill in the art.

The detecting step (b) in the above method can be carried out according to any suitable methods. For example, in one embodiment, the cDNA or cRNA hay have been directly labeled (e.g., with fluorescent dye). In another embodiment, labeled detection probes (e.g., fluorescent detection probes) can be used. For example, in a certain embodiments, when the capture oligonucleotides are immobilized on a solid support, such as, not limited to a microarray, the labeled detection probes can be hybridized to the microarray according to suitable methods known in the art. Such detection probes are designed with specific nucleic acids sequences to target the nucleic acids hybridized to the capture oligonucleotides attached to the array substrate (e.g., slide). Method for designing such detection probes are known in the art. Briefly, the probe sequences are assembled computationally based upon nucleotide sequence databases of the target loci. The detection probes are labeled and are detected using a suitable detector (e.g., in the case of fluorescent dyes, a fluorescent scanner may be used to detect and quantify the intensity of the signal.

Those of skill in the art will understand that the above-described detection probe sequences are exemplary, and that other probes having other nucleic acid sequences can also be used, alternatively, or in addition, to detect the microarray targets described herein. Further, the sequences of such detection probes can be determined according to routine methods known in the art.

In the above methods, the probe signal (of either the directly labeled cDNA or cRNA sample or of the detection probes) can be analyzed using pattern recognition software. A specific approach for analyzing the probe signal (and hybridization pattern) is described in detail in Example 2, below.

Based on the analysis of the microarray data, the HLA tissue type is assigned based on the specific combination of HLA alleles present in the sample.

Diagnostic Methods Using Oligonucleotide Arrays

Within a specific embodiment, methods for deriving donor/recipient compatibility in tissue transplants are provided. Tissue transplants can include, e.g., both solid organs and cells (e.g., bone marrow). In order to determine donor/recipient compatibility in tissue transplants, the practitioner should compare the HLA tissue type of both the potential donor and the recipient. The HLA tissue type of each is assigned according to the methods described above.

Once the HLA tissue types of the patient and potential donor are determined, donor/recipient compatibility is derived according to the following criteria: donor and recipient are considered fully matched when their HLA are phenotypically identical across HLA-A, HLA-B, HLA-C, HLA-DRA, HLADRB1, HLA-DRB1,4,5, HLA-DQA1, HLA-DQB1, HLA-DPA1, HLA-DPB1. In the case that a matched donor cannot be found, a mismatch must be accepted at the discretion of the physician conducting the donor search.

Within other embodiments, methods for diagnosing or predicting the likelihood of an HLA-linked genetic defect, disease, inadequate or undesirable response to a vaccine, biologic treatment (recombinant protein, biosimilar or equivalent), or infectious organism or condition in said subject, wherein the step is based on one or more assigned tissue types or phenotypes selected from the group consisting of: a classical HLA tissue type, a non-classical HLA tissue type, an accessory molecule phenotype, a KIR polypeptide phenotype, and a blood group phenotype. HLA associated diseases include, for example, and without limitation, type 1 diabetes mellitus (see, Larsen, C. E. & Alper, C. A. Current Opinion in Immunology 16, 660-667 (2004)); rheumatoid arthritis (see, Khan et al. (1983), Tissue Antigens, 22: 182-185), and ankylosing spondylitis (Gonzalez-Roces, S., et al. Tissue Antigens, 49: 116-123).

Within other embodiments, methods for diagnosing or predicting the likelihood of an HLA-linked genetic defect, disease, inadequate or undesirable response to a vaccine, biologic treatment (recombinant protein, biosimilar or equivalent), or infectious organism or condition in said subject, wherein the step is based on one or more assigned HLA tissue types or phenotypes selected from the group consisting of: a classical HLA tissue type, a non-classical HLA tissue type, an accessory molecule phenotype, a KIR polypeptide phenotype, and a blood group phenotype.

Within still other embodiments, methods for determining the likely response of a subject to a particular treatment regimen are provided, wherein the treatment regimen is selected from the group consisting of: bone marrow transplantation, immunosuppressive regimen, antiviral drug regimen, antiviral drug resistance, antiretroviral drug regimen, and autoimmunity drug regimen, and wherein the method is based on determining according to the method described herein one or more assigned HLA tissue types or phenotypes selected from the group consisting of: a classical HLA tissue type, a non-classical HLA tissue type, an accessory molecule phenotype, a KIR polypeptide phenotype, and a blood group phenotype.

Within yet other embodiments, methods for determining whether a subject is likely to develop antiretroviral drug resistance or cancer drug regimen resistance are provided, wherein the method is based on determining according to the method described herein one or more assigned HLA tissue types or phenotypes selected from the group consisting of: a classical HLA tissue type, a non-classical HLA tissue type, an accessory molecule phenotype, a KIR polypeptide phenotype, and a blood group phenotype.

The following examples are meant to illustrate, not limit, the invention.

EXAMPLES

Example 1

Design of Oligonucleotide Microarray

This Example demonstrates the design of a microarray for rapid and economical identification of HLA profiles of individuals and characterization of the HLA genotypes and polymorphisms in antigen processing and presentation machinery. The set of HLA capture oligonucleotide spotted on the array comprised 3821 classical HLA-I class I sequences (1193 HLA-A, 1799 HLA-B and 829 HLA-C), 1249 HLA-II class II sequences (901 HLA-DR, 169 HLA-DP, 147 HLA-DQ, 11 HLA-DM, 21 HLA-DO), and 188 other HLA region sequences (i.e., non-classical HLA) (9 HLA-E, 21-F, 46-G, 101 MIC, and 11 TAP), 504 KIR and 68 antigen presentation and processing genes (accessory molecules), a total of 5830 coding sequences. The array also contained 65 negative control sequences for all probes for all coding sequences. The total number of probes covering the complete set of HLA loci and accessory molecules on each array was 178,857 providing a dense tiling coverage (the overlapping probes are sequentially shifted by 1-2 nucleotides (i.e., step 1 or step 2 shifts) of all HLA polypeptides. The flow chart shown in FIG. 1 describes the processing steps in HLA typing using microarray. Each of the steps is described in detail, below.

Capture Oligonucleotide Design

The primary data necessary to design the capture oligonucleotides consists of gene and allele identifiers and the associated nucleotide sequences. The sequences are organized into sequence groups of sufficient homology to produce an accurate alignment. Sequence groups can consist of all alleles of a locus, or of multiple loci when they are highly homologous. Sequence groups include: HLA class I (HLA-A, -B, -C, -E, -F, and -G), HLA-DRB (DRB1, DRB3, DRB4, and DRB5), HLA-DRA, HLA-DQA, HLA-DQB, HLA-DPA, HLA-DPB, HLA-DMA, HLA-DMB, HLA-DOA, HLA-DOB, TAP1, TAP2, MICA, MICB, KIR, endoplasmic reticulum genes (B2M, tapasin, CANX, CALR, PDIA2, PDIA3, ERAP1), aminopeptidase genes (TPP2, BLMH, LAP3), proteasome (PSMA1, PSMA2, PSMA3, PSMA4, PSMA5, PSMA6, PSMA7, PSMA8, PSMB1, PSMB2, PSMB3, PSMB4, PSMB5, PSMB6, PSMB7, PSMB8, PSMB9, PSMB10, PSMB11, PSMC1, PSMC2, PSMC3, PSMC4, PSMC5, PSMC6, PSMD1, PSMD2, PSMD3, PSMD4, PSMD5, PSMD6, PSMD7, PSMD8, PSMD9, PSMD10, PSMD11, PSMD12, PSMD13, and PSMD14). Specific parameters of this method are selected to produce the best results for the sets of genes and alleles that are targeted for typing. These parameters include the tiling interval (step size, e.g., sequential shifting by 1 or 2 nucleotides), target melting temperature (each capture oligonucleotide is designed to have the closest possible melting temperature to the target melting temperature); and negative control replacement interval (this is the interval at which replacements are made in a consensus sequence of a sequence group to create capture oligonucleotides that do not occur in the target genes and alleles).

Negative Control

For each sequence group, an artificial negative control sequence is generated. The sequences in this group are aligned and a consensus sequence is determined. Alternate nucleotides are chosen at specific intervals (10 nt) within the consensus sequence and replaced by nucleotides not represented in the sequence alignment at the given position. If the nucleotide at a selected position is not fully conserved, the nearest fully conserved residue is selected for nucleotide replacement.

To preserve target melting temperature the following replacements can be done: A to T, T to A, C to G, and G to C. The nucleotide on the left (e.g., the A in "A to T") represents a conserved one from the sequences, and the nucleotide on the right (e.g., the T in "A to T") represents those present in the negative control probes. See, FIG. 2, which demonstrates a set of probes (P1 to P13) covering A*02:01:01:01 sequence and their corresponding negative control probes (P1N to P 13N) generated based on the consensus sequence of HLA class I sequence group.

Sequence Alignments

A sequence alignment is generated containing all the sequences from within a sequence group as well as the corresponding negative control sequence for that group. The aligned sequences are used in the remaining steps.

Tiling

Capture oligonucleotide sequences are subsequences of the alignment generated by stepping through each sequence at a specific interval called the step size. The step size will determine whether a capture oligonucleotide is created for each position (e.g. step size=1) or a subset of positions (e.g. step size=2, for every second position). The following capture oligonucleotide selection process is applied for each position:

A capture oligonucleotide sequence is a subsequence in the alignment determined by a start position and an end position.

For a given start position, the end position giving the closest melting temperature to a target melting temperature is identified.

Length restrictions: capture oligonucleotides shorter than 20 nucleotides are extended to 20 by appending thymines to the sequence. Capture oligonucleotides longer than 60 nucleotides are truncated to 60.

The capture oligonucleotide sequence becomes part of the final set of capture oligonucleotides under the condition that the sequence is not already represented in the final set of capture oligonucleotides.

FIG. 3 shows a set of tiling capture oligonucleotides (P1 to P13) covering A*02:01:01:01 sequence.

Computational Capture Oligonucleotide Generation

Determination of Optimal Target Melting Temperature

Figure 4:
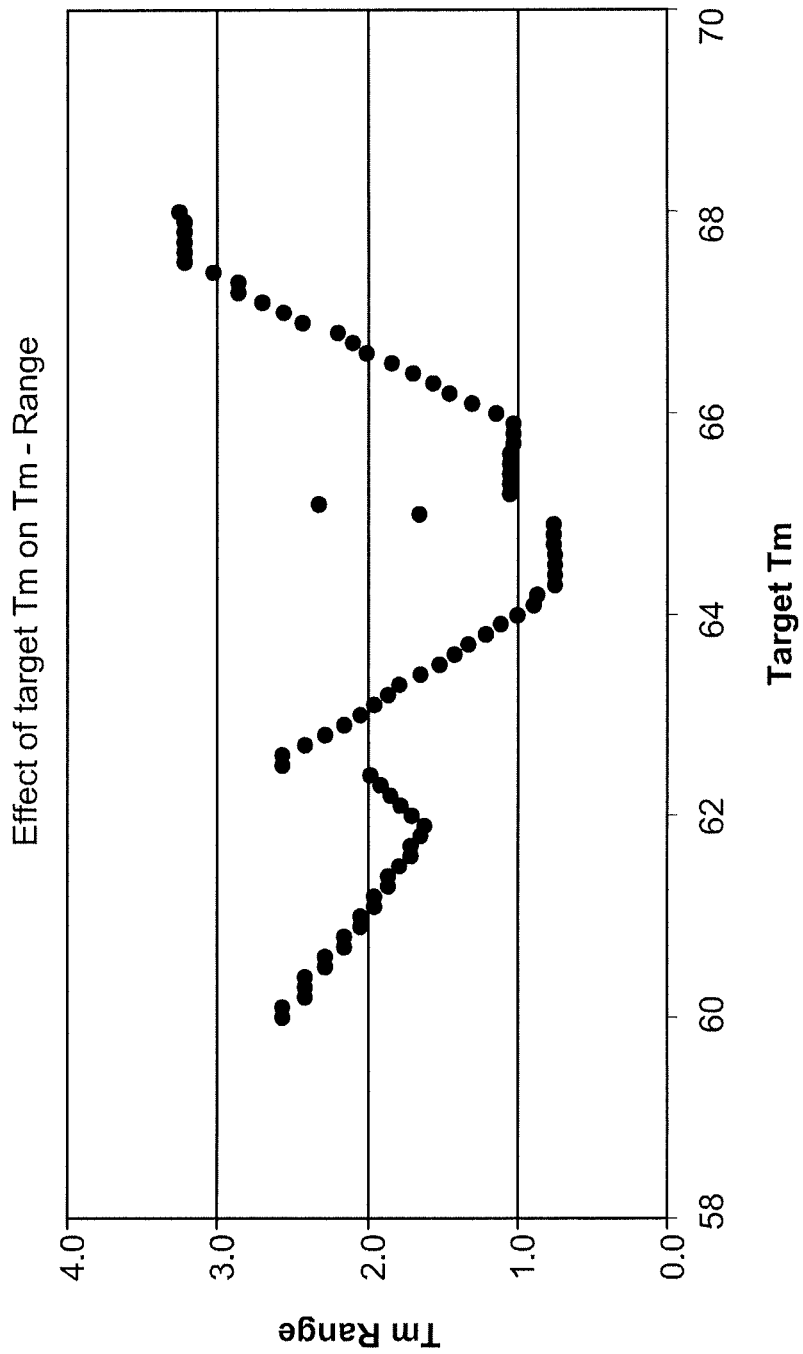
FIG. 4. is a graph demonstrating the relationship between target melting temperature and the capture oligonucleotide melting temperature range.

The optimal melting temperature was defined using a systematic analysis. This analysis identified that the targeted melting temperature is 64.3° C. providing the minimal deviation from the target temperature of all capture oligonucleotides. See FIG. 4, which demonstrates the relationship between target melting temperature and the capture oligonucleotide melting temperature range.

The steps listed above were executed to create a tiled microarray of a given target melting temperature. The actual melting temperatures of capture oligonucleotides (with respect to their exact complements) in the array will span a range specific to that chip. In general, an optimal target melting temperature is chosen which will minimize the range of the melting temperatures of the generated capture oligonucleotides. This is done computationally by performing the steps of the previous section iteratively over a range of target melting temperatures. The final capture oligonucleotides are those generated using the optimal target melting temperature giving the narrowest melting temperature range.

Melting Temperature

Melting temperature was calculated for the nucleotide sequences according to the following formula: $Tm=64.9+41*(N_G+N_c-16.4)/(N_A+N_T+N_G+N_C)$, where $N_A$, $N_T$, $N_G$, and $N_C$ are the number of the bases A,T,G,C in the sequence, respectively.

Figure 5A:
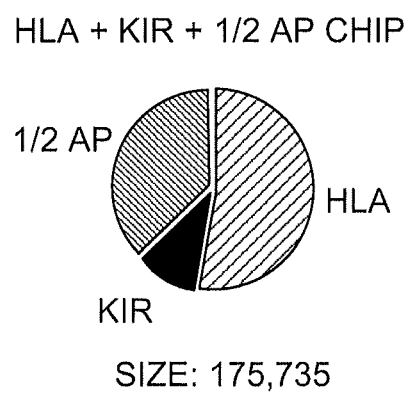
FIG. 5 contains pie graphs demonstrating the portioning of capture oligonucleotides with regard to (A) typing targets and (B) negative control oligonucleotides.
Figure 5B:
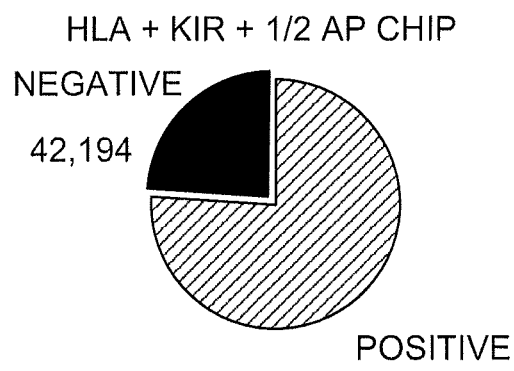
Figure 6A:
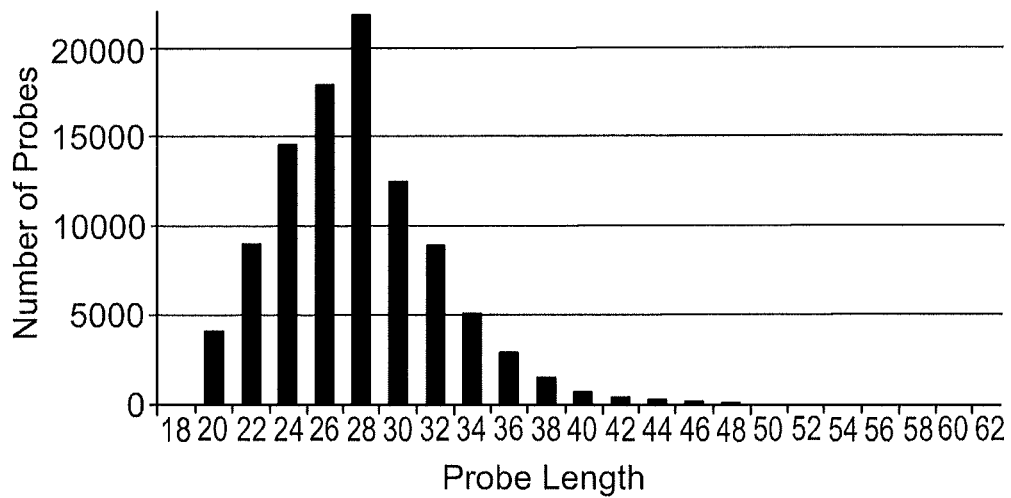
FIG. 6 shows histograms of capture oligonucleotide distribution according to (A) capture oligonucleotide length and (B) melting temperature.
Figure 6B:
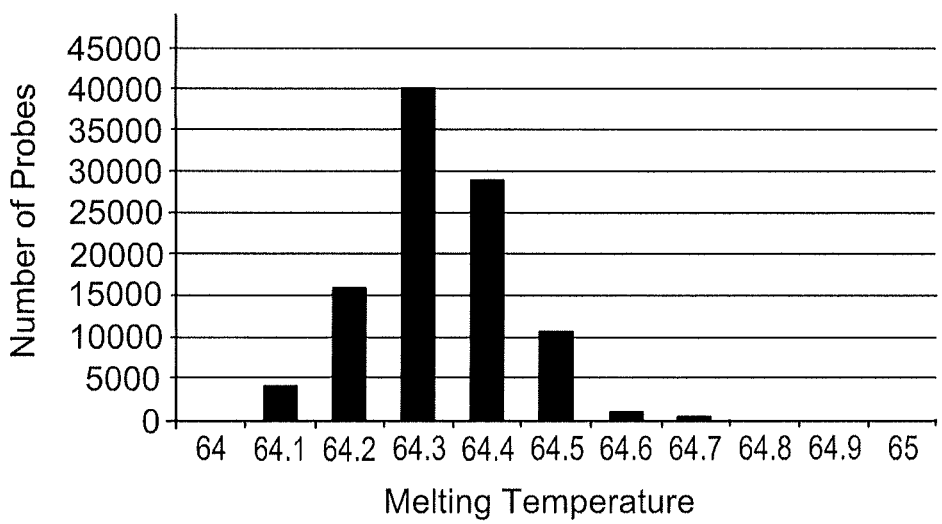

The method of capture oligonucleotide generation outlined above was applied to the HLA, KIR, and accessory molecules (antigen presentation) systems with the intent of generating no more than 180,000 probes. This can be achieved by using a step size of 2 for the set of accessory molecules. The pie charts in FIG. 5A and FIG. 5B demonstrate that this method results in the majority of capture oligonucleotide detecting (i.e., targeting nucleic acids encoding) HLA alleles, followed by accessory molecules and KIR molecules. The strategy of targeting the optimal melting temperature results in a wide range of probe lengths (FIG. 6A), but a minimal range of probe melting temperatures (FIG. 6B).

Example 2

Microarray Experiment—Handling of Samples and Extraction of Probe Signals

The microarray and hybridization experiment was performed using Agilent custom-made 4×180K arrays with four identical arrays printed on each slide. Capture oligonucleotides were designed using eArray<earray.chem.agilent.com/earray> software—input data were the working set of capture oligonucleotides. Arrays were printed using Agilent's SurePrint technology and included Agilent's control probes.

Peripheral blood samples were collected from six donors and from five HLA typed EBV transformed reference B cell lines. Standard HLA typing was performed by an external clinical HLA typing laboratory. Donor RNA from frozen PBMC and cell lines were isolated using Total RNA Isolation Mini Kit (RNeasy) from Qiagen. RNA quality was determined using The RNA 6000 Nano Chip kit from Agilent Technologies. Fluorescent cRNA sample for hybridization to the capture oligonucleotides immobilized on the array were synthesized from total RNA using the Agilent single color direct labeling kit. The labeled sample cRNA was hybridized to custom slides at 64° C. for 16 h, based on the reference capture oligonucleotide melting temperature of 64.3° C. and advice from the microarray producer. The slides were scanned using an Agilent Microarray scanner. After the slides were scanned using an Agilent Microarray scanner, Agilent Feature Extraction program was used to convert the fluorescence intensity into signal files.

Samples were hybridized to an HLA chip array. Standard Agilent hybridization protocol was followed at a temperature of 64° C. The chips were scanned using an Agilent Microarray scanner and they hybridization pattern (signals of bound, labeled cRNA) was detected using Agilent Feature Extraction program.

Probe Signal Preprocessing

Global scaling of signals was performed, so that all arrays had the same minimum, maximum, and average signal. Normalization that mapped signals to a scale of 1-20,000 was performed where minimum was set to 1, maximum to 20,000, and the array-wide average to 1,000. The detailed steps involved in signal preparation is shown below:

Signal Preparation
1. Signal extraction
   a. If a capture oligonucleotide is found on the chip multiple times, then only one instance is considered.
2. Scaling
   a. 4,000 probes with minimum=1
   b. Maximum=20,000
   c. Mean=1,000
3. Elimination of bad (incorrect) signals
   a. Remove from further analysis probes with global high signals (the probe signals are equal to or larger than 10000 for every array)
   b. The elimination is applied to all variants of algorithms This transformation produced comparable signals for all microarrays. The data from 32 array experiments showed high reproducibility of array-wide signals. The correlation coefficients were always r>0.97 for samples from the same individual, while for samples from different individuals were 0.8<r<0.96. These values of r were sufficient to identify when the same sample has been used in different arrays.

Statistical analysis was performed for probe signals at each alignment position. The maximum, minimum, mean, median, and geometric mean of the probe signals at each alignment poistion were calculated as shown for an exemplary alignment position in FIG. 7.

Data cleaning programs were made for outlier detection. Problematic probes, such as probes with constant global high signal of 20,000 on most of the 32 arrays, were identified. The signals of these probes were marked as not trustworthy.

Signal Analysis and Prediction of HLA Profiles

Figure 8:
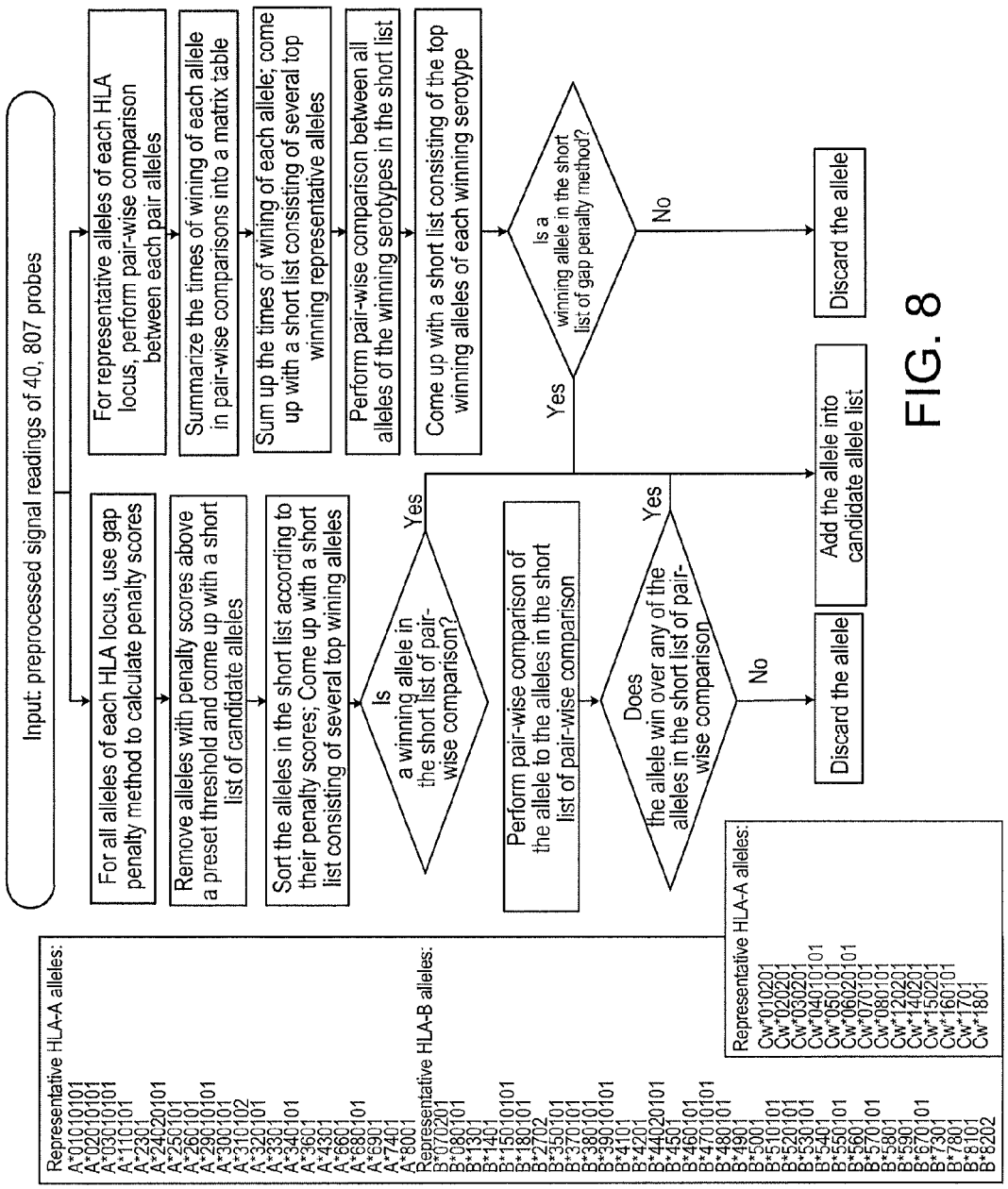
FIG. 8 is flow diagram showing the approach for combining gap penalty method and pair-wise comparison method for identification of sample HLA alleles.

Two complimentary methods, gap penalty method and pairwise comparison methods, were applied for the prediction of sample HLA profiles. FIG. 8 shows the process of combining these two methods for accurate prediction of candidate HLA alleles. Each of the methods will be introduced in details.

Gap Penalty Method

Figure 9A:
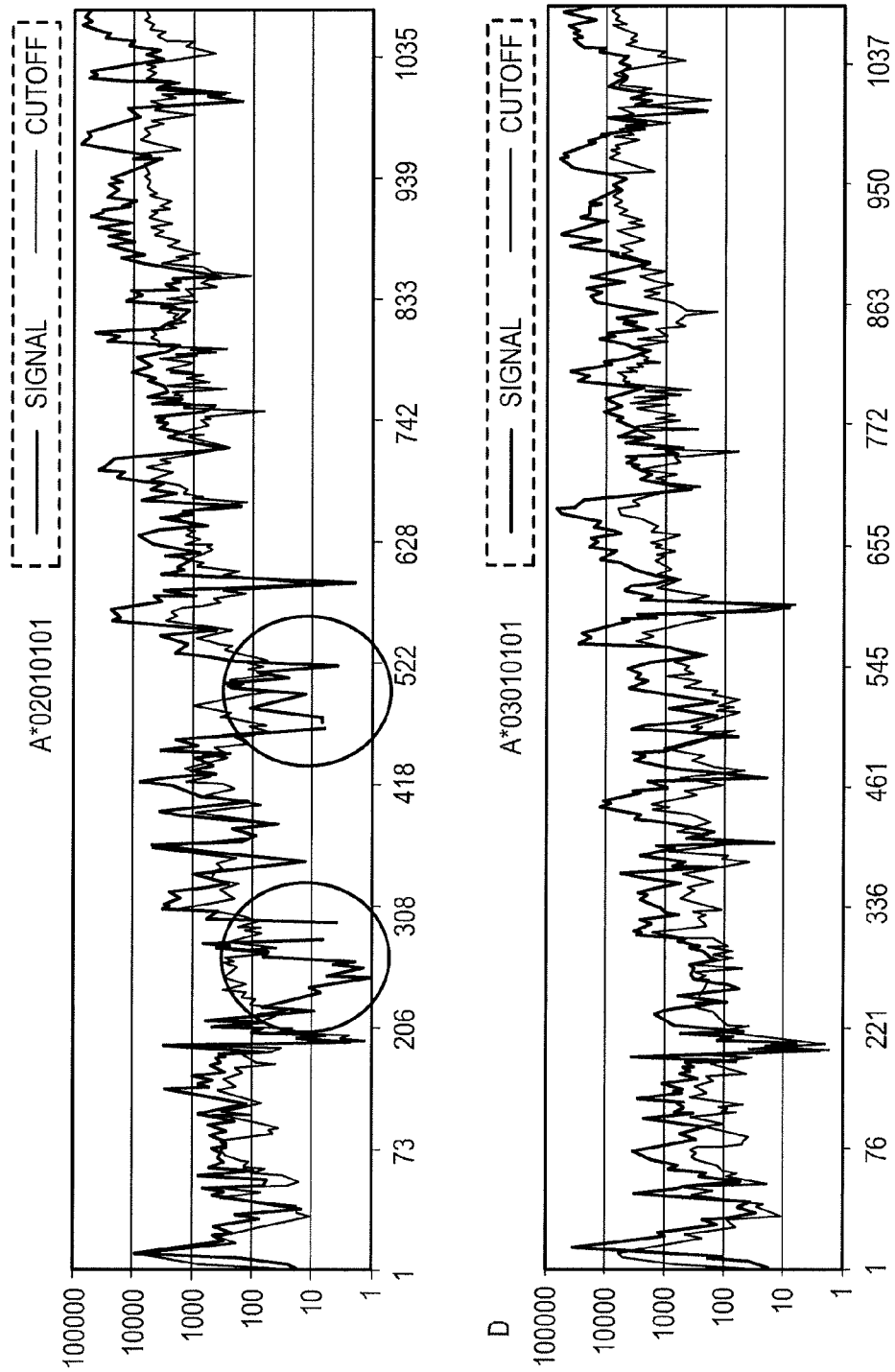
FIG. 9 contains graphs showing A*02010101 and A*03010101 probe signals of (A) sample D and (B) sample E. The thick, darker lines plot probe signals at each alignment position and the thinner, lighter-colored lines plots thresholds (cutoffs) at each position. The threshold used here is the 10% of the maximum signal at each position.
Figure 9B:
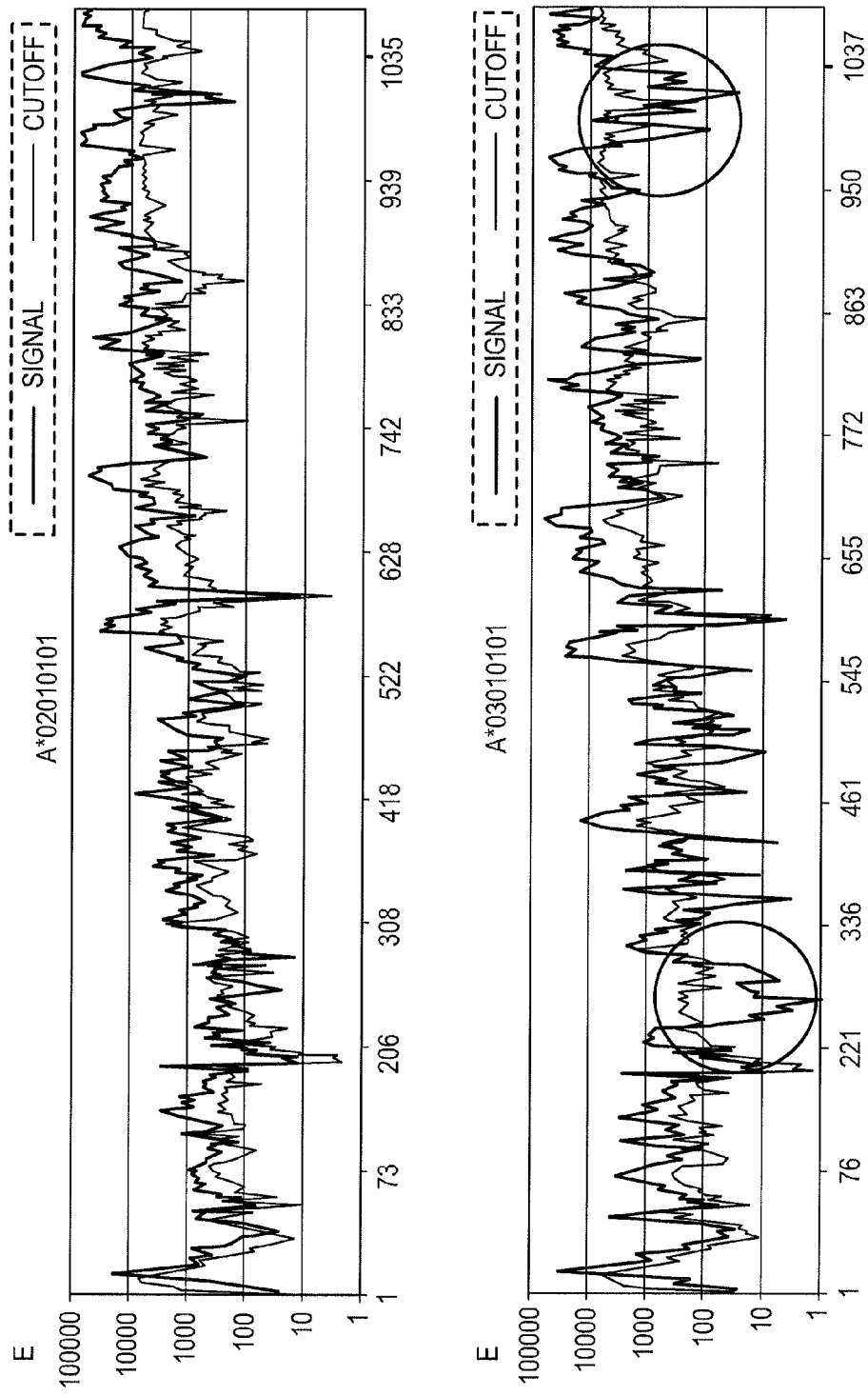

If an allele is present in a sample, the majority of the probe signals of that allele should be reasonably high. If an allele has a long region of continuous probes with very low signals, it is highly likely that the allele is not present in the sample. As marked out by circles in FIG. 9A, there are two regions with continuous low signal probes for A*02010101. It suggests that A*02010101 is not presented in sample D. Similarly, in FIG. 9B, there are two regions with continuous low signal probes for A*03010101. It suggests that A*03010101 is not presented in sample D. Using this rational, the gap penalty method was developed.

The detail steps involved in gap penalty method are described in detail, below:

Gap Penalty
1. For each allele, three scores are generated and used with cutoffs to eliminate obviously negative alleles: gap penalty, maximum gap length, and the average signal of an allele;
2. Cutoff for low probe signals (default value: 10% of the maximum signal at a position):
   a. This parameter defines gaps as a percentage of maximum signal;

b. Gap is a signal having less than the cutoff percent of maximum signal;
3. Gap penalty threshold:
   a. Contiguous gap positions contribute to this score exponentially;
   b. Noncontiguous gaps are simply added together;
   c. Penalty of an allele=$\Sigma G_i \times G_i$, where $G_i$ is the length of ith gap in the sequence;
   d. High potential as a ranking method;
4. Maximum gap length threshold (default value: 11):
   a. Gap length is the number of contiguous positions below the low probe signal percentage (see point 2);
5. Average signal threshold (Default value: 2.5):
   a. The allele must have a score, 10/average signal, less than this cutoff;
   b. The average signal is inverted in order to make this score inversely proportional to the allele's probability of being present (to fit with the other gap length and gap penalty).

Pairwise Comparison Method

Figure 10A:
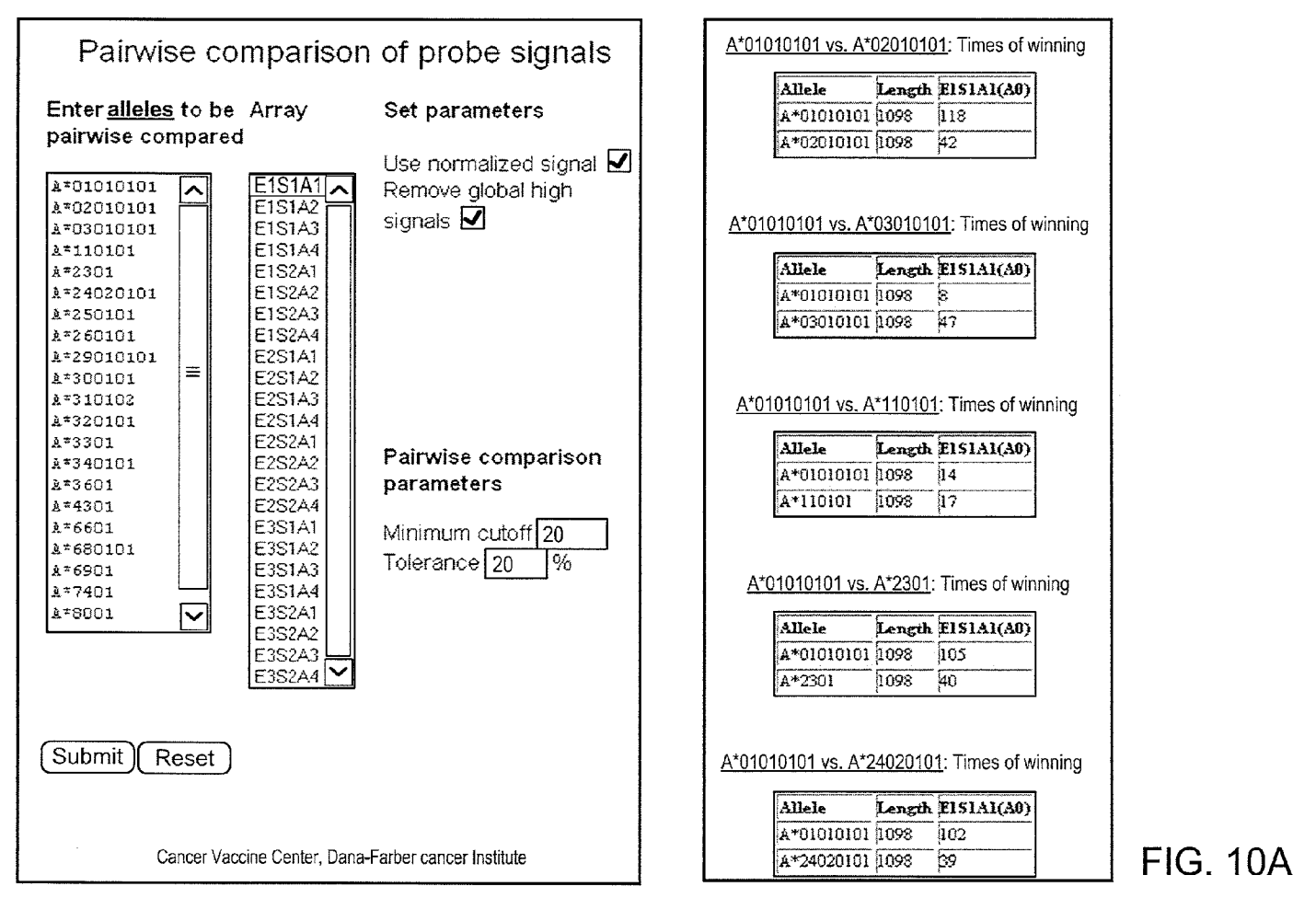

Given two alleles present in a multiple sequence alignment, the pairwise comparison method identifies the capture oligonucleotides containing sequence variations between the two alleles, compares the signals of each capture oligonucleotide pair, and votes on winning based on the signals. The detailed steps involved in the gap penalty method are shown below and in FIGS. 10A-C:

Pairwise Comparison
1. This is a triple layer method:
   a. Probes (oligonucleotides) from a pair of alleles are compared and voting is performed;
   b. The winner of the two alleles is accessed;
   c. The winner of all the alleles over all the comparisons is assessed;
2. Rules for ignoring a position when comparing two alleles:
   a. Low signal—if both signals <20;
   b. Similar—signal difference <30% of higher signal;
   c. Unique probe—winning probe is only present in 1 allele;
   d. Uninformative—winner is in a pre-defined set probes that are similar across all arrays;
   e. Masking—if the following three criteria are fulfilled;
      i. Loser signal<median signal for this position;
      ii. Winning probe's HLA coverage>twice that of losing probe;
      iii. Winning probe's HLA coverage>100 (class I); 20 (class II);
3. Elimination strategy—after all pairs have been compared, an allele will be eliminated from the list of candidates if:
   a. The winning allele is not a partial sequence; and
      i. The loosing allele has 1 or less votes and the difference in votes >=4; or
      ii. the losing votes are >1 and the difference >=20;
4. Ranking strategy (alternative to elimination):
   a. Difference in votes is calculated for each allele pair;
   b. The average of all difference for an allele is calculated.

* * *

Patents, patent applications, publications, product descriptions, and protocols are cited throughout this application, the disclosures of which are incorporated herein by reference in their entireties for all purposes.

A number of embodiments of the invention have been described. Nevertheless, it will be understood that various modifications may be made without departing from the spirit and scope of the invention. It is further to be understood that all values are approximate, and are provided for description. Accordingly, other embodiments are within the scope of the following claims.

LENGTHY TABLES

The patent contains a lengthy table section. A copy of the table is available in electronic form from the USPTO web site (http://seqdata.uspto.gov/?pageRequest=docDetail&DocID=US08969254B2). An electronic copy of the table will also be available from the USPTO upon request and payment of the fee set forth in 37 CFR 1.19(b)(3).

SEQUENCE LISTING (428860 sequences)

SEQ ID NO: 1 - DNA, 23 bp, Artificial Sequence
  Description of Artificial Sequence: Synthetic oligonucleotide
atggccgtcatggcgccccgaac

SEQ ID NO: 2 - DNA, 22 bp, Artificial Sequence
  Description of Artificial Sequence: Synthetic oligonucleotide
tggccgtcatggcgccccgaac

SEQ ID NO: 3 - DNA, 21 bp, Artificial Sequence
  Description of Artificial Sequence: Synthetic oligonucleotide
ggccgtcatggcgccccgaac

SEQ ID NO: 4 - DNA, 23 bp, Artificial Sequence
  Description of Artificial Sequence: Synthetic oligonucleotide
atggccgtcatggcgccccgaac

SEQ ID NO: 5 - DNA, 22 bp, Artificial Sequence
  Description of Artificial Sequence: Synthetic oligonucleotide
tggccgtcatggcgccccgaac

SEQ ID NO: 6 - DNA, 21 bp, Artificial Sequence
  Description of Artificial Sequence: Synthetic oligonucleotide
ggccgtcatggcgccccgaac

SEQ ID NO: 7 - DNA, 21 bp, Artificial Sequence
  Description of Artificial Sequence: Synthetic oligonucleotide
gccgtcatggcgccccgaacc

SEQ ID NO: 8 - DNA, 22 bp, Artificial Sequence
  Description of Artificial Sequence: Synthetic oligonucleotide
ccgtcatggcgccccgaaccct

SEQ ID NO: 9 - DNA, 22 bp, Artificial Sequence
  Description of Artificial Sequence: Synthetic oligonucleotide
cgtcatggcgccccgaaccctc

SEQ ID NO: 10 - DNA, 23 bp, Artificial Sequence
  Description of Artificial Sequence: Synthetic oligonucleotide
gtcatggcgccccgaaccctcct

SEQ ID NO: 11 - DNA, 23 bp, Artificial Sequence
  Description of Artificial Sequence: Synthetic oligonucleotide
tcatggcgccccgaaccctcctc

SEQ ID NO: 12 - DNA, 22 bp, Artificial Sequence
  Description of Artificial Sequence: Synthetic oligonucleotide
catggcgccccgaaccctcctc

SEQ ID NO: 13 - DNA, 23 bp, Artificial Sequence
  Description of Artificial Sequence: Synthetic oligonucleotide
atggcgccccgaaccctcctcct

SEQ ID NO: 14 - DNA, 22 bp, Artificial Sequence
  Description of Artificial Sequence: Synthetic oligonucleotide
tggcgccccgaaccctcctcct

SEQ ID NO: 15 - DNA, 21 bp, Artificial Sequence
  Description of Artificial Sequence: Synthetic oligonucleotide
ggcgccccgaaccctcctcct

SEQ ID NO: 16 - DNA, 21 bp, Artificial Sequence
  Description of Artificial Sequence: Synthetic oligonucleotide
gcgccccgaaccctcctcctg

SEQ ID NO: 17 - DNA, 23 bp, Artificial Sequence
  Description of Artificial Sequence: Synthetic oligonucleotide
cgccccgaaccctcctcctgcta

SEQ ID NO: 18 - DNA, 24 bp, Artificial Sequence
  Description of Artificial Sequence: Synthetic oligonucleotide
gccccgaaccctcctcctgctact

SEQ ID NO: 19 - DNA, 25 bp, Artificial Sequence
  Description of Artificial Sequence: Synthetic oligonucleotide
ccccgaaccctcctcctgctactct

SEQ ID NO: 20 - DNA, 25 bp, Artificial Sequence
  Description of Artificial Sequence: Synthetic oligonucleotide
cccgaaccctcctcctgctactctc

SEQ ID NO: 21 - DNA, 25 bp, Artificial Sequence
  Description of Artificial Sequence: Synthetic oligonucleotide
ccgaaccctcctcctgctactctcg

SEQ ID NO: 22 - DNA, 25 bp, Artificial Sequence
  Description of Artificial Sequence: Synthetic oligonucleotide
cgaaccctcctcctgctactctcgg

SEQ ID NO: 23 - DNA, 25 bp, Artificial Sequence
  Description of Artificial Sequence: Synthetic oligonucleotide
gaaccctcctcctgctactctcggg

SEQ ID NO: 24 - DNA, 25 bp, Artificial Sequence
  Description of Artificial Sequence: Synthetic oligonucleotide
aaccctcctcctgctactctcgggg

SEQ ID NO: 25 - DNA, 24 bp, Artificial Sequence
  Description of Artificial Sequence: Synthetic oligonucleotide
accctcctcctgctactctcgggg

SEQ ID NO: 26 - DNA, 23 bp, Artificial Sequence
  Description of Artificial Sequence: Synthetic oligonucleotide
ccctcctcctgctactctcgggg

SEQ ID NO: 27 - DNA, 23 bp, Artificial Sequence
  Description of Artificial Sequence: Synthetic oligonucleotide
cctcctcctgctactctcggggg

SEQ ID NO: 28 - DNA, 23 bp, Artificial Sequence
  Description of Artificial Sequence: Synthetic oligonucleotide
ctcctcctgctactctcgggggc

SEQ ID NO: 29 - DNA, 23 bp, Artificial Sequence
  Description of Artificial Sequence: Synthetic oligonucleotide
tcctcctgctactctcgggggcc

SEQ ID NO: 30 - DNA, 22 bp, Artificial Sequence
  Description of Artificial Sequence: Synthetic oligonucleotide
cctcctgctactctcgggggcc

SEQ ID NO: 31 - DNA, 23 bp, Artificial Sequence
  Description of Artificial Sequence: Synthetic oligonucleotide
ctcctgctactctcgggggccct

SEQ ID NO: 32 - DNA, 23 bp, Artificial Sequence
  Description of Artificial Sequence: Synthetic oligonucleotide
tcctgctactctcgggggccctg

SEQ ID NO: 33 - DNA, 22 bp, Artificial Sequence
  Description of Artificial Sequence: Synthetic oligonucleotide
cctgctactctcgggggccctg

SEQ ID NO: 34 - DNA, 22 bp, Artificial Sequence
  Description of Artificial Sequence: Synthetic oligonucleotide
ctgctactctcgggggccctgg

SEQ ID NO: 35 - DNA, 22 bp, Artificial Sequence
  Description of Artificial Sequence: Synthetic oligonucleotide
tgctactctcgggggccctggc

SEQ ID NO: 36 - DNA, 21 bp, Artificial Sequence
  Description of Artificial Sequence: Synthetic oligonucleotide
gctactctcgggggccctggc

SEQ ID NO: 37 - DNA, 21 bp, Artificial Sequence
  Description of Artificial Sequence: Synthetic oligonucleotide
ctactctcgggggccctggcc

SEQ ID NO: 38 - DNA, 22 bp, Artificial Sequence
  Description of Artificial Sequence: Synthetic oligonucleotide
tactctcgggggccctggccct

SEQ ID NO: 39 - DNA, 21 bp, Artificial Sequence
  Description of Artificial Sequence: Synthetic oligonucleotide
actctcgggggccctggccct

SEQ ID NO: 40 - DNA, 20 bp, Artificial Sequence
  Description of Artificial Sequence: Synthetic oligonucleotide
ctctcgggggccctggccct

SEQ ID NO: 41 - DNA, 21 bp, Artificial Sequence
  Description of Artificial Sequence: Synthetic oligonucleotide
tctcgggggccctggccctga

SEQ ID NO: 42 - DNA, 20 bp, Artificial Sequence
  Description of Artificial Sequence: Synthetic oligonucleotide
ctcgggggccctggccctga

SEQ ID NO: 43 - DNA, 20 bp, Artificial Sequence
  Description of Artificial Sequence: Synthetic oligonucleotide
tcgggggccctggccctgac

SEQ ID NO: 44 - DNA, 20 bp, Artificial Sequence
  Description of Artificial Sequence: Synthetic oligonucleotide
cgggggccctggccctgact

SEQ ID NO: 45 - DNA, 20 bp, Artificial Sequence
  Description of Artificial Sequence: Synthetic oligonucleotide
gggggccctggccctgacct

SEQ ID NO: 46 - DNA, 20 bp, Artificial Sequence
  Description of Artificial Sequence: Synthetic oligonucleotide
ggggccctggccctgaccca

SEQ ID NO: 47 - DNA, 21 bp, Artificial Sequence
  Description of Artificial Sequence: Synthetic oligonucleotide
gggccctggccctgacccaga

SEQ ID NO: 48 - DNA, 21 bp, Artificial Sequence
  Description of Artificial Sequence: Synthetic oligonucleotide
ggccctggccctgacccagac

SEQ ID NO: 49 - DNA, 22 bp, Artificial Sequence
  Description of Artificial Sequence: Synthetic oligonucleotide
gccctggccctgacccagacct

SEQ ID NO: 50 - DNA, 22 bp, Artificial Sequence
  Description of Artificial Sequence: Synthetic oligonucleotide
ccctggccctgacccagacctg

SEQ ID NO: 51 - DNA, 22 bp, Artificial Sequence
  Description of Artificial Sequence: Synthetic oligonucleotide
cctggccctgacccagacctgg

SEQ ID NO: 52 - DNA, 22 bp, Artificial Sequence
  Description of Artificial Sequence: Synthetic oligonucleotide
ctggccctgacccagacctggg

SEQ ID NO: 53 - DNA, 22 bp, Artificial Sequence
  Description of Artificial Sequence: Synthetic oligonucleotide
tggccctgacccagacctgggc

SEQ ID NO: 54 - DNA, 21 bp, Artificial Sequence
  Description of Artificial Sequence: Synthetic oligonucleotide
ggccctgacccagacctgggc

SEQ ID NO: 55 - DNA, 21 bp, Artificial Sequence
  Description of Artificial Sequence: Synthetic oligonucleotide
gccctgacccagacctgggcg

SEQ ID NO: 56 - DNA, 21 bp, Artificial Sequence
  Description of Artificial Sequence: Synthetic oligonucleotide
ccctgacccagacctgggcgg

SEQ ID NO: 57 - DNA, 21 bp, Artificial Sequence
  Description of Artificial Sequence: Synthetic oligonucleotide
cctgacccagacctgggcggg

SEQ ID NO: 58 - DNA, 22 bp, Artificial Sequence
  Description of Artificial Sequence: Synthetic oligonucleotide
ctgacccagacctgggcgggct

SEQ ID NO: 59 - DNA, 22 bp, Artificial Sequence
  Description of Artificial Sequence: Synthetic oligonucleotide
tgacccagacctgggcgggctc

SEQ ID NO: 60 - DNA, 21 bp, Artificial Sequence
  Description of Artificial Sequence: Synthetic oligonucleotide
gacccagacctgggcgggctc

SEQ ID NO: 61 - DNA, 21 bp, Artificial Sequence
  Description of Artificial Sequence: Synthetic oligonucleotide
acccagacctgggcgggctcc

SEQ ID NO: 62 - DNA, 20 bp, Artificial Sequence
  Description of Artificial Sequence: Synthetic oligonucleotide
cccagacctgggcgggctcc

SEQ ID NO: 63 - DNA, 21 bp, Artificial Sequence
  Description of Artificial Sequence: Synthetic oligonucleotide
ccagacctgggcgggctccca

SEQ ID NO: 64 - DNA, 22 bp, Artificial Sequence
  Description of Artificial Sequence: Synthetic oligonucleotide
cagacctgggcgggctcccact

SEQ ID NO: 65 - DNA, 22 bp, Artificial Sequence
  Description of Artificial Sequence: Synthetic oligonucleotide
agacctgggcgggctcccactc

SEQ ID NO: 66 - DNA, 21 bp, Artificial Sequence
  Description of Artificial Sequence: Synthetic oligonucleotide
gacctgggcgggctcccactc

SEQ ID NO: 67 - DNA, 23 bp, Artificial Sequence
  Description of Artificial Sequence: Synthetic oligonucleotide
acctgggcgggctcccactccat

SEQ ID NO: 68 - DNA, 22 bp, Artificial Sequence
  Description of Artificial Sequence: Synthetic oligonucleotide
cctgggcgggctcccactccat

SEQ ID NO: 69 - DNA, 23 bp, Artificial Sequence
  Description of Artificial Sequence: Synthetic oligonucleotide
ctgggcgggctcccactccatga

SEQ ID NO: 70 - DNA, 23 bp, Artificial Sequence
  Description of Artificial Sequence: Synthetic oligonucleotide
tgggcgggctcccactccatgag

SEQ ID NO: 71 - DNA, 22 bp, Artificial Sequence
  Description of Artificial Sequence: Synthetic oligonucleotide
gggcgggctcccactccatgag

SEQ ID NO: 72 - DNA, 27 bp, Artificial Sequence
  Description of Artificial Sequence: Synthetic oligonucleotide
ggcgggctcccactccatgaggtattt

SEQ ID NO: 73 - DNA, 27 bp, Artificial Sequence
  Description of Artificial Sequence: Synthetic oligonucleotide
gcgggctcccactccatgaggtatttc

SEQ ID NO: 74 - DNA, 29 bp, Artificial Sequence
  Description of Artificial Sequence: Synthetic oligonucleotide
cgggctcccactccatgaggtatttcttc

SEQ ID NO: 75 - DNA, 30 bp, Artificial Sequence
  Description of Artificial Sequence: Synthetic oligonucleotide
gggctcccactccatgaggtatttcttcac

SEQ ID NO: 76 - DNA, 32 bp, Artificial Sequence
  Description of Artificial Sequence: Synthetic oligonucleotide
ggctcccactccatgaggtatttcttcacatc

SEQ ID NO: 77 - DNA, 32 bp, Artificial Sequence
  Description of Artificial Sequence: Synthetic oligonucleotide
gctcccactccatgaggtatttcttcacatcc

SEQ ID NO: 78 - DNA, 32 bp, Artificial Sequence
  Description of Artificial Sequence: Synthetic oligonucleotide
ctcccactccatgaggtatttcttcacatccg

SEQ ID NO: 79 - DNA, 33 bp, Artificial Sequence
  Description of Artificial Sequence: Synthetic oligonucleotide
tcccactccatgaggtatttcttcacatccgtg

SEQ ID NO: 80 - DNA, 32 bp, Artificial Sequence
  Description of Artificial Sequence: Synthetic oligonucleotide
cccactccatgaggtatttcttcacatccgtg

SEQ ID NO: 81 - DNA, 33 bp, Artificial Sequence
  Description of Artificial Sequence: Synthetic oligonucleotide
ccactccatgaggtatttcttcacatccgtgtc

SEQ ID NO: 82 - DNA, 33 bp, Artificial Sequence
  Description of Artificial Sequence: Synthetic oligonucleotide
cactccatgaggtatttcttcacatccgtgtcc

SEQ ID NO: 83 - DNA, 33 bp, Artificial Sequence
  Description of Artificial Sequence: Synthetic oligonucleotide
actccatgaggtatttcttcacatccgtgtccc

SEQ ID NO: 84 - DNA, 32 bp, Artificial Sequence
  Description of Artificial Sequence: Synthetic oligonucleotide
ctccatgaggtatttcttcacatccgtgtccc

SEQ ID NO: 85 - DNA, 32 bp, Artificial Sequence
  Description of Artificial Sequence: Synthetic oligonucleotide
tccatgaggtatttcttcacatccgtgtcccg

SEQ ID NO: 86 - DNA, 31 bp, Artificial Sequence
  Description of Artificial Sequence: Synthetic oligonucleotide
ccatgaggtatttcttcacatccgtgtcccg

SEQ ID NO: 87 - DNA, 31 bp, Artificial Sequence
  Description of Artificial Sequence: Synthetic oligonucleotide
catgaggtatttcttcacatccgtgtcccgg

SEQ ID NO: 88 - DNA, 31 bp, Artificial Sequence
  Description of Artificial Sequence: Synthetic oligonucleotide
atgaggtatttcttcacatccgtgtcccggc

SEQ ID NO: 89 - DNA, 30 bp, Artificial Sequence
  Description of Artificial Sequence: Synthetic oligonucleotide
tgaggtatttcttcacatccgtgtcccggc

SEQ ID NO: 90 - DNA, 29 bp, Artificial Sequence
  Description of Artificial Sequence: Synthetic oligonucleotide
gaggtatttcttcacatccgtgtcccggc

SEQ ID NO: 91 - DNA, 29 bp, Artificial Sequence
  Description of Artificial Sequence: Synthetic oligonucleotide
aggtatttcttcacatccgtgtcccggcc

SEQ ID NO: 92 - DNA, 28 bp, Artificial Sequence
  Description of Artificial Sequence: Synthetic oligonucleotide
ggtatttcttcacatccgtgtcccggcc

SEQ ID NO: 93 - DNA, 28 bp, Artificial Sequence
  Description of Artificial Sequence: Synthetic oligonucleotide
gtatttcttcacatccgtgtcccggccc

SEQ ID NO: 94 - DNA, 28 bp, Artificial Sequence
  Description of Artificial Sequence: Synthetic oligonucleotide
tatttcttcacatccgtgtcccggcccg

SEQ ID NO: 95 - DNA, 27 bp, Artificial Sequence
  Description of Artificial Sequence: Synthetic oligonucleotide
atttcttcacatccgtgtcccggcccg

SEQ ID NO: 96 - DNA, 26 bp, Artificial Sequence
  Description of Artificial Sequence: Synthetic oligonucleotide
tttcttcacatccgtgtcccggcccg

SEQ ID NO: 97 - DNA, 25 bp, Artificial Sequence
  Description of Artificial Sequence: Synthetic oligonucleotide
ttcttcacatccgtgtcccggcccg

SEQ ID NO: 98 - DNA, 24 bp, Artificial Sequence
  Description of Artificial Sequence: Synthetic oligonucleotide
tcttcacatccgtgtcccggcccg

SEQ ID NO: 99 - DNA, 23 bp, Artificial Sequence
  Description of Artificial Sequence: Synthetic oligonucleotide
cttcacatccgtgtcccggcccg

SEQ ID NO: 100 - DNA, 23 bp, Artificial Sequence
  Description of Artificial Sequence: Synthetic oligonucleotide
ttcacatccgtgtcccggcccgg

SEQ ID NO: 101 - DNA, 22 bp, Artificial Sequence
  Description of Artificial Sequence: Synthetic oligonucleotide
tcacatccgtgtcccggcccgg

SEQ ID NO: 102 - DNA, 21 bp, Artificial Sequence
  Description of Artificial Sequence: Synthetic oligonucleotide
cacatccgtgtcccggcccgg

SEQ ID NO: 103 - DNA, 21 bp, Artificial Sequence
  Description of Artificial Sequence: Synthetic oligonucleotide
acatccgtgtcccggcccggc

SEQ ID NO: 104 - DNA, 20 bp, Artificial Sequence
  Description of Artificial Sequence: Synthetic oligonucleotide
catccgtgtcccggcccggc

SEQ ID NO: 105 - DNA, 20 bp, Artificial Sequence
  Description of Artificial Sequence: Synthetic oligonucleotide
atccgtgtcccggcccggcc

SEQ ID NO: 106 - DNA, 20 bp, Artificial Sequence
  Description of Artificial Sequence: Synthetic oligonucleotide
tccgtgtcccggcccggcct

SEQ ID NO: 107 - DNA, 20 bp, Artificial Sequence
  Description of Artificial Sequence: Synthetic oligonucleotide
ccgtgtcccggcccggcctt

SEQ ID NO: 108 - DNA, 20 bp, Artificial Sequence
  Description of Artificial Sequence: Synthetic oligonucleotide
cgtgtcccggcccggccgtt

SEQ ID NO: 109 - DNA, 20 bp, Artificial Sequence
  Description of Artificial Sequence: Synthetic oligonucleotide
gtgtcccggcccggccgctt

SEQ ID NO: 110 - DNA, 20 bp, Artificial Sequence
  Description of Artificial Sequence: Synthetic oligonucleotide
tgtcccggcccggccgcgtt

SEQ ID NO: 111 - DNA, 20 bp, Artificial Sequence
  Description of Artificial Sequence: Synthetic oligonucleotide
gtcccggcccggccgcgttt

SEQ ID NO: 112 - DNA, 20 bp, Artificial Sequence
  Description of Artificial Sequence: Synthetic oligonucleotide
tcccggcccggccgcggttt

SEQ ID NO: 113 - DNA, 20 bp, Artificial Sequence
  Description of Artificial Sequence: Synthetic oligonucleotide
cccggcccggccgcggtttt

SEQ ID NO: 114 - DNA, 20 bp, Artificial Sequence
  Description of Artificial Sequence: Synthetic oligonucleotide
ccggcccggccgcgggtttt

SEQ ID NO: 115 - DNA, 20 bp, Artificial Sequence
  Description of Artificial Sequence: Synthetic oligonucleotide
cggcccggccgcggggattt

SEQ ID NO: 116 - DNA, 20 bp, Artificial Sequence
  Description of Artificial Sequence: Synthetic oligonucleotide
ggcccggccgcggggagttt

SEQ ID NO: 117 - DNA, 20 bp, Artificial Sequence
  Description of Artificial Sequence: Synthetic oligonucleotide
gcccggccgcggggagcttt

SEQ ID NO: 118 - DNA, 20 bp, Artificial Sequence
  Description of Artificial Sequence: Synthetic oligonucleotide
cccggccgcggggagccttt

SEQ ID NO: 119 - DNA, 20 bp, Artificial Sequence
  Description of Artificial Sequence: Synthetic oligonucleotide
ccggccgcggggagcccttt

SEQ ID NO: 120 - DNA, 20 bp, Artificial Sequence
  Description of Artificial Sequence: Synthetic oligonucleotide
cggccgcggggagccccttt

SEQ ID NO: 121 - DNA, 20 bp, Artificial Sequence
  Description of Artificial Sequence: Synthetic oligonucleotide
ggccgcggggagccccgttt

SEQ ID NO: 122 - DNA, 20 bp, Artificial Sequence
  Description of Artificial Sequence: Synthetic oligonucleotide
gccgcggggagccccgcttt

SEQ ID NO: 123 - DNA, 21 bp, Artificial Sequence
  Description of Artificial Sequence: Synthetic oligonucleotide
ccgcggggagccccgcttcat

SEQ ID NO: 124 - DNA, 21 bp, Artificial Sequence
  Description of Artificial Sequence: Synthetic oligonucleotide
cgcggggagccccgcttcatc

SEQ ID NO: 125 - DNA, 21 bp, Artificial Sequence
  Description of Artificial Sequence: Synthetic oligonucleotide
gcggggagccccgcttcatcg

SEQ ID NO: 126 - DNA, 21 bp, Artificial Sequence
  Description of Artificial Sequence: Synthetic oligonucleotide
cggggagccccgcttcatcgc

SEQ ID NO: 127 - DNA, 21 bp, Artificial Sequence
  Description of Artificial Sequence: Synthetic oligonucleotide
ggggagccccgcttcatcgcc

SEQ ID NO: 128 - DNA, 22 bp, Artificial Sequence
  Description of Artificial Sequence: Synthetic oligonucleotide
gggagccccgcttcatcgccgt

SEQ ID NO: 129 - DNA, 22 bp, Artificial Sequence
  Description of Artificial Sequence: Synthetic oligonucleotide
ggagccccgcttcatcgccgtg

SEQ ID NO: 130 - DNA, 22 bp, Artificial Sequence
  Description of Artificial Sequence: Synthetic oligonucleotide
gagccccgcttcatcgccgtgg

SEQ ID NO: 131 - DNA, 22 bp, Artificial Sequence
  Description of Artificial Sequence: Synthetic oligonucleotide
agccccgcttcatcgccgtggg

SEQ ID NO: 132 - DNA, 21 bp, Artificial Sequence
  Description of Artificial Sequence: Synthetic oligonucleotide
gccccgcttcatcgccgtggg

SEQ ID NO: 133 - DNA, 23 bp, Artificial Sequence
  Description of Artificial Sequence: Synthetic oligonucleotide
ccccgcttcatcgccgtgggcta

SEQ ID NO: 134 - DNA, 23 bp, Artificial Sequence
  Description of Artificial Sequence: Synthetic oligonucleotide
cccgcttcatcgccgtgggctac

SEQ ID NO: 135 - DNA, 24 bp, Artificial Sequence
  Description of Artificial Sequence: Synthetic oligonucleotide
ccgcttcatcgccgtgggctacgt

SEQ ID NO: 136 - DNA, 24 bp, Artificial Sequence
  Description of Artificial Sequence: Synthetic oligonucleotide
cgcttcatcgccgtgggctacgtg

SEQ ID NO: 137 - DNA, 25 bp, Artificial Sequence
  Description of Artificial Sequence: Synthetic oligonucleotide
gcttcatcgccgtgggctacgtgga

SEQ ID NO: 138 - DNA, 25 bp, Artificial Sequence
  Description of Artificial Sequence: Synthetic oligonucleotide
cttcatcgccgtgggctacgtggac

SEQ ID NO: 139 - DNA, 26 bp, Artificial Sequence
  Description of Artificial Sequence: Synthetic oligonucleotide
ttcatcgccgtgggctacgtggacga

SEQ ID NO: 140 - DNA, 25 bp, Artificial Sequence
  Description of Artificial Sequence: Synthetic oligonucleotide
tcatcgccgtgggctacgtggacga

SEQ ID NO: 141 - DNA, 24 bp, Artificial Sequence
  Description of Artificial Sequence: Synthetic oligonucleotide
catcgccgtgggctacgtggacga

SEQ ID NO: 142 - DNA, 25 bp, Artificial Sequence
  Description of Artificial Sequence: Synthetic oligonucleotide
atcgccgtgggctacgtggacgaca

SEQ ID NO: 143 - DNA, 24 bp, Artificial Sequence
  Description of Artificial Sequence: Synthetic oligonucleotide
tcgccgtgggctacgtggacgaca

SEQ ID NO: 144 - DNA, 23 bp, Artificial Sequence
  Description of Artificial Sequence: Synthetic oligonucleotide
cgccgtgggctacgtggacgaca

SEQ ID NO: 145 - DNA, 23 bp, Artificial Sequence
  Description of Artificial Sequence: Synthetic oligonucleotide
gccgtgggctacgtggacgacac

SEQ ID NO: 146 - DNA, 23 bp, Artificial Sequence
  Description of Artificial Sequence: Synthetic oligonucleotide
ccgtgggctacgtggacgacacg

SEQ ID NO: 147 - DNA, 24 bp, Artificial Sequence
  Description of Artificial Sequence: Synthetic oligonucleotide
cgtgggctacgtggacgacacgca

SEQ ID NO: 148 - DNA, 26 bp, Artificial Sequence
  Description of Artificial Sequence: Synthetic oligonucleotide
gtgggctacgtggacgacacgcagtt

SEQ ID NO: 149 - DNA, 26 bp, Artificial Sequence
  Description of Artificial Sequence: Synthetic oligonucleotide
tgggctacgtggacgacacgcagttc

SEQ ID NO: 150 - DNA, 25 bp, Artificial Sequence
  Description of Artificial Sequence: Synthetic oligonucleotide
gggctacgtggacgacacgcagttc

SEQ ID NO: 151 - DNA, 26 bp, Artificial Sequence
  Description of Artificial Sequence: Synthetic oligonucleotide
ggctacgtggacgacacgcagttcgt

SEQ ID NO: 152 - DNA, 26 bp, Artificial Sequence
  Description of Artificial Sequence: Synthetic oligonucleotide
gctacgtggacgacacgcagttcgtg

SEQ ID NO: 153 - DNA, 26 bp, Artificial Sequence
  Description of Artificial Sequence: Synthetic oligonucleotide
ctacgtggacgacacgcagttcgtgc

SEQ ID NO: 154 - DNA, 26 bp, Artificial Sequence
  Description of Artificial Sequence: Synthetic oligonucleotide
tacgtggacgacacgcagttcgtgcg

SEQ ID NO: 155 - DNA, 25 bp, Artificial Sequence
  Description of Artificial Sequence: Synthetic oligonucleotide
acgtggacgacacgcagttcgtgcg

SEQ ID NO: 156 - DNA, 24 bp, Artificial Sequence
  Description of Artificial Sequence: Synthetic oligonucleotide
cgtggacgacacgcagttcgtgcg

SEQ ID NO: 157 - DNA, 26 bp, Artificial Sequence
  Description of Artificial Sequence: Synthetic oligonucleotide
gtggacgacacgcagttcgtgcggtt

SEQ ID NO: 158 - DNA, 26 bp, Artificial Sequence
  Description of Artificial Sequence: Synthetic oligonucleotide
tggacgacacgcagttcgtgcggttc

SEQ ID NO: 159 - DNA, 25 bp, Artificial Sequence
  Description of Artificial Sequence: Synthetic oligonucleotide
ggacgacacgcagttcgtgcggttc

SEQ ID NO: 160 - DNA, 26 bp, Artificial Sequence
  Description of Artificial Sequence: Synthetic oligonucleotide
gacgacacgcagttcgtgcggttcga

SEQ ID NO: 161 - DNA, 27 bp, Artificial Sequence
  Description of Artificial Sequence: Synthetic oligonucleotide
acgacacgcagttcgtgcggttcgaca

SEQ ID NO: 162 - DNA, 26 bp, Artificial Sequence
  Description of Artificial Sequence: Synthetic oligonucleotide
cgacacgcagttcgtgcggttcgaca

SEQ ID NO: 163 - DNA, 26 bp, Artificial Sequence
  Description of Artificial Sequence: Synthetic oligonucleotide
gacacgcagttcgtgcggttcgacag

SEQ ID NO: 164 - DNA, 26 bp, Artificial Sequence
  Description of Artificial Sequence: Synthetic oligonucleotide
acacgcagttcgtgcggttcgacagc

SEQ ID NO: 165 - DNA, 25 bp, Artificial Sequence
  Description of Artificial Sequence: Synthetic oligonucleotide
cacgcagttcgtgcggttcgacagc

SEQ ID NO: 166 - DNA, 26 bp, Artificial Sequence
  Description of Artificial Sequence: Synthetic oligonucleotide
acgcagttcgtgcggttcgacagcga

SEQ ID NO: 167 - DNA, 25 bp, Artificial Sequence
  Description of Artificial Sequence: Synthetic oligonucleotide
cgcagttcgtgcggttcgacagcga

SEQ ID NO: 168 - DNA, 25 bp, Artificial Sequence
  Description of Artificial Sequence: Synthetic oligonucleotide
gcagttcgtgcggttcgacagcgac

SEQ ID NO: 169 - DNA, 25 bp, Artificial Sequence
  Description of Artificial Sequence: Synthetic oligonucleotide
cagttcgtgcggttcgacagcgacg

SEQ ID NO: 170 - DNA, 25 bp, Artificial Sequence
  Description of Artificial Sequence: Synthetic oligonucleotide
agttcgtgcggttcgacagcgacgc

SEQ ID NO: 171 - DNA, 24 bp, Artificial Sequence
  Description of Artificial Sequence: Synthetic oligonucleotide
gttcgtgcggttcgacagcgacgc

SEQ ID NO: 172 - DNA, 24 bp, Artificial Sequence
  Description of Artificial Sequence: Synthetic oligonucleotide
ttcgtgcggttcgacagcgacgcc

SEQ ID NO: 173 - DNA, 23 bp, Artificial Sequence
  Description of Artificial Sequence: Synthetic oligonucleotide
tcgtgcggttcgacagcgacgcc

SEQ ID NO: 174 - DNA, 22 bp, Artificial Sequence
  Description of Artificial Sequence: Synthetic oligonucleotide
cgtgcggttcgacagcgacgcc

SEQ ID NO: 175 - DNA, 22 bp, Artificial Sequence
  Description of Artificial Sequence: Synthetic oligonucleotide
gtgcggttcgacagcgacgccg

SEQ ID NO: 176 - DNA, 22 bp, Artificial Sequence
  Description of Artificial Sequence: Synthetic oligonucleotide
tgcggttcgacagcgacgccgc

SEQ ID NO: 177 - DNA, 21 bp, Artificial Sequence
  Description of Artificial Sequence: Synthetic oligonucleotide
gcggttcgacagcgacgccgc

SEQ ID NO: 178 - DNA, 22 bp, Artificial Sequence
  Description of Artificial Sequence: Synthetic oligonucleotide
cggttcgacagcgacgccgcga

SEQ ID NO: 179 - DNA, 22 bp, Artificial Sequence
  Description of Artificial Sequence: Synthetic oligonucleotide
ggttcgacagcgacgccgcgag

SEQ ID NO: 180 - DNA, 22 bp, Artificial Sequence
  Description of Artificial Sequence: Synthetic oligonucleotide
gttcgacagcgacgccgcgagc

SEQ ID NO: 181 - DNA, 23 bp, Artificial Sequence
  Description of Artificial Sequence: Synthetic oligonucleotide
ttcgacagcgacgccgcgagcca

SEQ ID NO: 182 - DNA, 22 bp, Artificial Sequence
  Description of Artificial Sequence: Synthetic oligonucleotide
tcgacagcgacgccgcgagcca

SEQ ID NO: 183 - DNA, 21 bp, Artificial Sequence
  Description of Artificial Sequence: Synthetic oligonucleotide
cgacagcgacgccgcgagcca

SEQ ID NO: 184 - DNA, 23 bp, Artificial Sequence
  Description of Artificial Sequence: Synthetic oligonucleotide
gacagcgacgccgcgagccagaa

SEQ ID NO: 185 - DNA, 25 bp, Artificial Sequence
  Description of Artificial Sequence: Synthetic oligonucleotide
acagcgacgccgcgagccagaagat

SEQ ID NO: 186 - DNA, 24 bp, Artificial Sequence
  Description of Artificial Sequence: Synthetic oligonucleotide
cagcgacgccgcgagccagaagat

SEQ ID NO: 187 - DNA, 24 bp, Artificial Sequence
  Description of Artificial Sequence: Synthetic oligonucleotide
agcgacgccgcgagccagaagatg

SEQ ID NO: 188 - DNA, 23 bp, Artificial Sequence
  Description of Artificial Sequence: Synthetic oligonucleotide
gcgacgccgcgagccagaagatg

SEQ ID NO: 189 - DNA, 24 bp, Artificial Sequence
  Description of Artificial Sequence: Synthetic oligonucleotide
cgacgccgcgagccagaagatgga

SEQ ID NO: 190 - DNA, 24 bp, Artificial Sequence
  Description of Artificial Sequence: Synthetic oligonucleotide
gacgccgcgagccagaagatggag

SEQ ID NO: 191 - DNA, 24 bp, Artificial Sequence
  Description of Artificial Sequence: Synthetic oligonucleotide
acgccgcgagccagaagatggagc

SEQ ID NO: 192 - DNA, 23 bp, Artificial Sequence
  Description of Artificial Sequence: Synthetic oligonucleotide
cgccgcgagccagaagatggagc

SEQ ID NO: 193 - DNA, 23 bp, Artificial Sequence
  Description of Artificial Sequence: Synthetic oligonucleotide
gccgcgagccagaagatggagcc

SEQ ID NO: 194 - DNA, 23 bp, Artificial Sequence
  Description of Artificial Sequence: Synthetic oligonucleotide
ccgcgagccagaagatggagccg

SEQ ID NO: 195 - DNA, 23 bp, Artificial Sequence
  Description of Artificial Sequence: Synthetic oligonucleotide
cgcgagccagaagatggagccgc

SEQ ID NO: 196 - DNA, 23 bp, Artificial Sequence
  Description of Artificial Sequence: Synthetic oligonucleotide
gcgagccagaagatggagccgcg

SEQ ID NO: 197 - DNA, 23 bp, Artificial Sequence
  Description of Artificial Sequence: Synthetic oligonucleotide
cgagccagaagatggagccgcgg

SEQ ID NO: 198 - DNA, 23 bp, Artificial Sequence
  Description of Artificial Sequence: Synthetic oligonucleotide
gagccagaagatggagccgcggg

SEQ ID NO: 199 - DNA, 23 bp, Artificial Sequence
  Description of Artificial Sequence: Synthetic oligonucleotide
agccagaagatggagccgcgggc

SEQ ID NO: 200 - DNA, 22 bp, Artificial Sequence
  Description of Artificial Sequence: Synthetic oligonucleotide
gccagaagatggagccgcgggc

SEQ ID NO: 201 - DNA, 22 bp, Artificial Sequence
  Description of Artificial Sequence: Synthetic oligonucleotide
ccagaagatggagccgcgggcg

SEQ ID NO: 202 - DNA, 22 bp, Artificial Sequence
  Description of Artificial Sequence: Synthetic oligonucleotide
cagaagatggagccgcgggcgc

SEQ ID NO: 203 - DNA, 22 bp, Artificial Sequence
  Description of Artificial Sequence: Synthetic oligonucleotide
agaagatggagccgcgggcgcc

SEQ ID NO: 204 - DNA, 21 bp, Artificial Sequence
  Description of Artificial Sequence: Synthetic oligonucleotide
gaagatggagccgcgggcgcc

SEQ ID NO: 205 - DNA, 22 bp, Artificial Sequence
  Description of Artificial Sequence: Synthetic oligonucleotide
aagatggagccgcgggcgccgt

SEQ ID NO: 206 - DNA, 21 bp, Artificial Sequence
  Description of Artificial Sequence: Synthetic oligonucleotide
agatggagccgcgggcgccgt

SEQ ID NO: 207 - DNA, 20 bp, Artificial Sequence
  Description of Artificial Sequence: Synthetic oligonucleotide
gatggagccgcgggcgccgt

SEQ ID NO: 208 - DNA, 20 bp, Artificial Sequence
  Description of Artificial Sequence: Synthetic oligonucleotide
atggagccgcgggcgccgtg

SEQ ID NO: 209 - DNA, 20 bp, Artificial Sequence
  Description of Artificial Sequence: Synthetic oligonucleotide
tggagccgcgggcgccgtgt

SEQ ID NO: 210 - DNA, 20 bp, Artificial Sequence
  Description of Artificial Sequence: Synthetic oligonucleotide
ggagccgcgggcgccgtgtt

SEQ ID NO: 211 - DNA, 21 bp, Artificial Sequence
  Description of Artificial Sequence: Synthetic oligonucleotide
gagccgcgggcgccgtggata

SEQ ID NO: 212 - DNA, 22 bp, Artificial Sequence
  Description of Artificial Sequence: Synthetic oligonucleotide
agccgcgggcgccgtggataga

SEQ ID NO: 213 - DNA, 21 bp, Artificial Sequence
  Description of Artificial Sequence: Synthetic oligonucleotide
gccgcgggcgccgtggataga

SEQ ID NO: 214 - DNA, 21 bp, Artificial Sequence
  Description of Artificial Sequence: Synthetic oligonucleotide
ccgcgggcgccgtggatagag

SEQ ID NO: 215 - DNA, 22 bp, Artificial Sequence
  Description of Artificial Sequence: Synthetic oligonucleotide
cgcgggcgccgtggatagagca

SEQ ID NO: 216 - DNA, 22 bp, Artificial Sequence
  Description of Artificial Sequence: Synthetic oligonucleotide
gcgggcgccgtggatagagcag

SEQ ID NO: 217 - DNA, 23 bp, Artificial Sequence
  Description of Artificial Sequence: Synthetic oligonucleotide
cgggcgccgtggatagagcagga

SEQ ID NO: 218 - DNA, 23 bp, Artificial Sequence
  Description of Artificial Sequence: Synthetic oligonucleotide
gggcgccgtggatagagcaggag

SEQ ID NO: 219 - DNA, 23 bp, Artificial Sequence
  Description of Artificial Sequence: Synthetic oligonucleotide
ggcgccgtggatagagcaggagg

SEQ ID NO: 220 - DNA, 23 bp, Artificial Sequence
  Description of Artificial Sequence: Synthetic oligonucleotide
gcgccgtggatagagcaggaggg

SEQ ID NO: 221 - DNA, 23 bp, Artificial Sequence
  Description of Artificial Sequence: Synthetic oligonucleotide
cgccgtggatagagcaggagggg

SEQ ID NO: 222 - DNA, 23 bp, Artificial Sequence
  Description of Artificial Sequence: Synthetic oligonucleotide
gccgtggatagagcaggaggggc

SEQ ID NO: 223 - DNA, 23 bp, Artificial Sequence
  Description of Artificial Sequence: Synthetic oligonucleotide
ccgtggatagagcaggaggggcc

SEQ ID NO: 224 - DNA, 23 bp, Artificial Sequence
  Description of Artificial Sequence: Synthetic oligonucleotide
cgtggatagagcaggaggggccg

SEQ ID NO: 225 - DNA, 24 bp, Artificial Sequence
  Description of Artificial Sequence: Synthetic oligonucleotide
gtggatagagcaggaggggccgga

SEQ ID NO: 226 - DNA, 27 bp, Artificial Sequence
  Description of Artificial Sequence: Synthetic oligonucleotide
tggatagagcaggaggggccggagtat

SEQ ID NO: 227 - DNA, 27 bp, Artificial Sequence
  Description of Artificial Sequence: Synthetic oligonucleotide
ggatagagcaggaggggccggagtatt

SEQ ID NO: 228 - DNA, 27 bp, Artificial Sequence
  Description of Artificial Sequence: Synthetic oligonucleotide
gatagagcaggaggggccggagtattg

SEQ ID NO: 229 - DNA, 27 bp, Artificial Sequence
  Description of Artificial Sequence: Synthetic oligonucleotide
atagagcaggaggggccggagtattgg

SEQ ID NO: 230 - DNA, 26 bp, Artificial Sequence
  Description of Artificial Sequence: Synthetic oligonucleotide
tagagcaggaggggccggagtattgg

SEQ ID NO: 231 - DNA, 25 bp, Artificial Sequence
  Description of Artificial Sequence: Synthetic oligonucleotide
agagcaggaggggccggagtattgg

SEQ ID NO: 232 - DNA, 24 bp, Artificial Sequence
  Description of Artificial Sequence: Synthetic oligonucleotide
gagcaggaggggccggagtattgg

SEQ ID NO: 233 - DNA, 25 bp, Artificial Sequence
  Description of Artificial Sequence: Synthetic oligonucleotide
agcaggaggggccggagtattggga

SEQ ID NO: 234 - DNA, 24 bp, Artificial Sequence
  Description of Artificial Sequence: Synthetic oligonucleotide
gcaggaggggccggagtattggga

SEQ ID NO: 235 - DNA, 24 bp, Artificial Sequence
  Description of Artificial Sequence: Synthetic oligonucleotide
caggaggggccggagtattgggac

SEQ ID NO: 236 - DNA, 25 bp, Artificial Sequence
  Description of Artificial Sequence: Synthetic oligonucleotide
aggaggggccggagtattgggacca

SEQ ID NO: 237 - DNA, 24 bp, Artificial Sequence
  Description of Artificial Sequence: Synthetic oligonucleotide
ggaggggccggagtattgggacca

SEQ ID NO: 238 - DNA, 24 bp, Artificial Sequence
  Description of Artificial Sequence: Synthetic oligonucleotide
gaggggccggagtattgggaccag

SEQ ID NO: 239 - DNA, 25 bp, Artificial Sequence
  Description of Artificial Sequence: Synthetic oligonucleotide
aggggccggagtattgggaccagga

SEQ ID NO: 240 - DNA, 24 bp, Artificial Sequence
  Description of Artificial Sequence: Synthetic oligonucleotide
ggggccggagtattgggaccagga

SEQ ID NO: 241 - DNA, 25 bp, Artificial Sequence
  Description of Artificial Sequence: Synthetic oligonucleotide
gggccggagtattgggaccaggaga

SEQ ID NO: 242 - DNA, 26 bp, Artificial Sequence
  Description of Artificial Sequence: Synthetic oligonucleotide
ggccggagtattgggaccaggagaca

SEQ ID NO: 243 - DNA, 26 bp, Artificial Sequence
  Description of Artificial Sequence: Synthetic oligonucleotide
gccggagtattgggaccaggagacac

SEQ ID NO: 244 - DNA, 26 bp, Artificial Sequence
  Description of Artificial Sequence: Synthetic oligonucleotide
ccggagtattgggaccaggagacacg

SEQ ID NO: 245 - DNA, 27 bp, Artificial Sequence
  Description of Artificial Sequence: Synthetic oligonucleotide
cggagtattgggaccaggagacacgga

SEQ ID NO: 246 - DNA, 31 bp, Artificial Sequence
  Description of Artificial Sequence: Synthetic oligonucleotide
ggagtattgggaccaggagacacggaatatg

SEQ ID NO: 247 - DNA, 33 bp, Artificial Sequence
  Description of Artificial Sequence: Synthetic oligonucleotide
gagtattgggaccaggagacacggaatatgaag

SEQ ID NO: 248 - DNA, 33 bp, Artificial Sequence
  Description of Artificial Sequence: Synthetic oligonucleotide
agtattgggaccaggagacacggaatatgaagg

SEQ ID NO: 249 - DNA, 32 bp, Artificial Sequence
  Description of Artificial Sequence: Synthetic oligonucleotide
gtattgggaccaggagacacggaatatgaagg

SEQ ID NO: 250 - DNA, 32 bp, Artificial Sequence
  Description of Artificial Sequence: Synthetic oligonucleotide
tattgggaccaggagacacggaatatgaaggc

SEQ ID NO: 251 - DNA, 31 bp, Artificial Sequence
  Description of Artificial Sequence: Synthetic oligonucleotide
attgggaccaggagacacggaatatgaaggc

SEQ ID NO: 252 - DNA, 30 bp, Artificial Sequence
  Description of Artificial Sequence: Synthetic oligonucleotide
ttgggaccaggagacacggaatatgaaggc

SEQ ID NO: 253 - DNA, 29 bp, Artificial Sequence
  Description of Artificial Sequence: Synthetic oligonucleotide
tgggaccaggagacacggaatatgaaggc

SEQ ID NO: 254 - DNA, 28 bp, Artificial Sequence
  Description of Artificial Sequence: Synthetic oligonucleotide
gggaccaggagacacggaatatgaaggc

SEQ ID NO: 255 - DNA, 28 bp, Artificial Sequence
  Description of Artificial Sequence: Synthetic oligonucleotide
ggaccaggagacacggaatatgaaggcc

SEQ ID NO: 256 - DNA, 28 bp, Artificial Sequence
  Description of Artificial Sequence: Synthetic oligonucleotide
gaccaggagacacggaatatgaaggccc

SEQ ID NO: 257 - DNA, 29 bp, Artificial Sequence
  Description of Artificial Sequence: Synthetic oligonucleotide
accaggagacacggaatatgaaggcccac

SEQ ID NO: 258 - DNA, 28 bp, Artificial Sequence
  Description of Artificial Sequence: Synthetic oligonucleotide
ccaggagacacggaatatgaaggcccac

SEQ ID NO: 259 - DNA, 29 bp, Artificial Sequence
  Description of Artificial Sequence: Synthetic oligonucleotide
caggagacacggaatatgaaggcccactc

SEQ ID NO: 260 - DNA, 30 bp, Artificial Sequence
  Description of Artificial Sequence: Synthetic oligonucleotide
aggagacacggaatatgaaggcccactcac

SEQ ID NO: 261 - DNA, 29 bp, Artificial Sequence
  Description of Artificial Sequence: Synthetic oligonucleotide
ggagacacggaatatgaaggcccactcac

SEQ ID NO: 262 - DNA, 30 bp, Artificial Sequence
  Description of Artificial Sequence: Synthetic oligonucleotide
gagacacggaatatgaaggcccactcacag

SEQ ID NO: 263 - DNA, 31 bp, Artificial Sequence
  Description of Artificial Sequence: Synthetic oligonucleotide
agacacggaatatgaaggcccactcacagac

SEQ ID NO: 264 - DNA, 30 bp, Artificial Sequence
  Description of Artificial Sequence: Synthetic oligonucleotide
gacacggaatatgaaggcccactcacagac

SEQ ID NO: 265 - DNA, 31 bp, Artificial Sequence
  Description of Artificial Sequence: Synthetic oligonucleotide
acacggaatatgaaggcccactcacagactg

SEQ ID NO: 266 - DNA, 30 bp, Artificial Sequence
  Description of Artificial Sequence: Synthetic oligonucleotide
cacggaatatgaaggcccactcacagactg

SEQ ID NO: 267 - DNA, 31 bp, Artificial Sequence
  Description of Artificial Sequence: Synthetic oligonucleotide
acggaatatgaaggcccactcacagactgac

SEQ ID NO: 268 - DNA, 30 bp, Artificial Sequence
  Description of Artificial Sequence: Synthetic oligonucleotide
cggaatatgaaggcccactcacagactgac

SEQ ID NO: 269 - DNA, 30 bp, Artificial Sequence
  Description of Artificial Sequence: Synthetic oligonucleotide
ggaatatgaaggcccactcacagactgacc

SEQ ID NO: 270 - DNA, 30 bp, Artificial Sequence
  Description of Artificial Sequence: Synthetic oligonucleotide
gaatatgaaggcccactcacagactgaccg

SEQ ID NO: 271 - DNA, 31 bp, Artificial Sequence
  Description of Artificial Sequence: Synthetic oligonucleotide
aatatgaaggcccactcacagactgaccgag

SEQ ID NO: 272 - DNA, 30 bp, Artificial Sequence
  Description of Artificial Sequence: Synthetic oligonucleotide
atatgaaggcccactcacagactgaccgag

SEQ ID NO: 273 - DNA, 29 bp, Artificial Sequence
  Description of Artificial Sequence: Synthetic oligonucleotide
tatgaaggcccactcacagactgaccgag

SEQ ID NO: 274 - DNA, 28 bp, Artificial Sequence
  Description of Artificial Sequence: Synthetic oligonucleotide
atgaaggcccactcacagactgaccgag

SEQ ID NO: 275 - DNA, 27 bp, Artificial Sequence
  Description of Artificial Sequence: Synthetic oligonucleotide
tgaaggcccactcacagactgaccgag

SEQ ID NO: 276 - DNA, 26 bp, Artificial Sequence
  Description of Artificial Sequence: Synthetic oligonucleotide
gaaggcccactcacagactgaccgag

SEQ ID NO: 277 - DNA, 26 bp, Artificial Sequence
  Description of Artificial Sequence: Synthetic oligonucleotide
aaggcccactcacagactgaccgagc

SEQ ID NO: 278 - DNA, 25 bp, Artificial Sequence
  Description of Artificial Sequence: Synthetic oligonucleotide
aggcccactcacagactgaccgagc

SEQ ID NO: 279 - DNA, 24 bp, Artificial Sequence
  Description of Artificial Sequence: Synthetic oligonucleotide
ggcccactcacagactgaccgagc

SEQ ID NO: 280 - DNA, 26 bp, Artificial Sequence
  Description of Artificial Sequence: Synthetic oligonucleotide
gcccactcacagactgaccgagcgaa

SEQ ID NO: 281 - DNA, 26 bp, Artificial Sequence
  Description of Artificial Sequence: Synthetic oligonucleotide
cccactcacagactgaccgagcgaac

SEQ ID NO: 282 - DNA, 27 bp, Artificial Sequence
  Description of Artificial Sequence: Synthetic oligonucleotide
ccactcacagactgaccgagcgaacct

SEQ ID NO: 283 - DNA, 27 bp, Artificial Sequence
  Description of Artificial Sequence: Synthetic oligonucleotide
cactcacagactgaccgagcgaacctg

SEQ ID NO: 284 - DNA, 27 bp, Artificial Sequence
  Description of Artificial Sequence: Synthetic oligonucleotide
actcacagactgaccgagcgaacctgg

SEQ ID NO: 285 - DNA, 26 bp, Artificial Sequence
  Description of Artificial Sequence: Synthetic oligonucleotide
ctcacagactgaccgagcgaacctgg

SEQ ID NO: 286 - DNA, 26 bp, Artificial Sequence
  Description of Artificial Sequence: Synthetic oligonucleotide
tcacagactgaccgagcgaacctggg

SEQ ID NO: 287 - DNA, 25 bp, Artificial Sequence
  Description of Artificial Sequence: Synthetic oligonucleotide
cacagactgaccgagcgaacctggg

SEQ ID NO: 288 - DNA, 26 bp, Artificial Sequence
  Description of Artificial Sequence: Synthetic oligonucleotide
acagactgaccgagcgaacctgggga

SEQ ID NO: 289 - DNA, 25 bp, Artificial Sequence
  Description of Artificial Sequence: Synthetic oligonucleotide
cagactgaccgagcgaacctgggga

SEQ ID NO: 290 - DNA, 25 bp, Artificial Sequence
  Description of Artificial Sequence: Synthetic oligonucleotide
agactgaccgagcgaacctggggac

SEQ ID NO: 291 - DNA, 24 bp, Artificial Sequence
  Description of Artificial Sequence: Synthetic oligonucleotide
gactgaccgagcgaacctggggac

SEQ ID NO: 292 - DNA, 24 bp, Artificial Sequence
  Description of Artificial Sequence: Synthetic oligonucleotide
actgaccgagcgaacctggggacc

SEQ ID NO: 293 - DNA, 23 bp, Artificial Sequence
  Description of Artificial Sequence: Synthetic oligonucleotide
ctgaccgagcgaacctggggacc

SEQ ID NO: 294 - DNA, 24 bp, Artificial Sequence
  Description of Artificial Sequence: Synthetic oligonucleotide
tgaccgagcgaacctggggaccct

SEQ ID NO: 295 - DNA, 23 bp, Artificial Sequence
  Description of Artificial Sequence: Synthetic oligonucleotide
gaccgagcgaacctggggaccct

SEQ ID NO: 296 - DNA, 23 bp, Artificial Sequence
  Description of Artificial Sequence: Synthetic oligonucleotide
accgagcgaacctggggaccctg

SEQ ID NO: 297 - DNA, 22 bp, Artificial Sequence
  Description of Artificial Sequence: Synthetic oligonucleotide
ccgagcgaacctggggaccctg

SEQ ID NO: 298 - DNA, 22 bp, Artificial Sequence
  Description of Artificial Sequence: Synthetic oligonucleotide
cgagcgaacctggggaccctgc

SEQ ID NO: 299 - DNA, 22 bp, Artificial Sequence
  Description of Artificial Sequence: Synthetic oligonucleotide
gagcgaacctggggaccctgcg

SEQ ID NO: 300 - DNA, 22 bp, Artificial Sequence
  Description of Artificial Sequence: Synthetic oligonucleotide
agcgaacctggggaccctgcgc

SEQ ID NO: 301 - DNA, 21 bp, Artificial Sequence
  Description of Artificial Sequence: Synthetic oligonucleotide
gcgaacctggggaccctgcgc

SEQ ID NO: 302 - DNA, 21 bp, Artificial Sequence
  Description of Artificial Sequence: Synthetic oligonucleotide
cgaacctggggaccctgcgcg

SEQ ID NO: 303 - DNA, 21 bp, Artificial Sequence
  Description of Artificial Sequence: Synthetic oligonucleotide
gaacctggggaccctgcgcgg

SEQ ID NO: 304 - DNA, 23 bp, Artificial Sequence
  Description of Artificial Sequence: Synthetic oligonucleotide
aacctggggaccctgcgcggcta

SEQ ID NO: 305 - DNA, 22 bp, Artificial Sequence
  Description of Artificial Sequence: Synthetic oligonucleotide
acctggggaccctgcgcggcta

SEQ ID NO: 306 - DNA, 21 bp, Artificial Sequence
  Description of Artificial Sequence: Synthetic oligonucleotide
cctggggaccctgcgcggcta

SEQ ID NO: 307 - DNA, 23 bp, Artificial Sequence
  Description of Artificial Sequence: Synthetic oligonucleotide
ctggggaccctgcgcggctacta

SEQ ID NO: 308 - DNA, 25 bp, Artificial Sequence
  Description of Artificial Sequence: Synthetic oligonucleotide
tggggaccctgcgcggctactacaa

SEQ ID NO: 309 - DNA, 24 bp, Artificial Sequence
  Description of Artificial Sequence: Synthetic oligonucleotide
ggggaccctgcgcggctactacaa

SEQ ID NO: 310 - DNA, 24 bp, Artificial Sequence
  Description of Artificial Sequence: Synthetic oligonucleotide
gggaccctgcgcggctactacaac

SEQ ID NO: 311 - DNA, 25 bp, Artificial Sequence
  Description of Artificial Sequence: Synthetic oligonucleotide
ggaccctgcgcggctactacaacca

SEQ ID NO: 312 - DNA, 26 bp, Artificial Sequence
  Description of Artificial Sequence: Synthetic oligonucleotide
gaccctgcgcggctactacaaccaga

SEQ ID NO: 313 - DNA, 26 bp, Artificial Sequence
  Description of Artificial Sequence: Synthetic oligonucleotide
accctgcgcggctactacaaccagag

SEQ ID NO: 314 - DNA, 25 bp, Artificial Sequence
  Description of Artificial Sequence: Synthetic oligonucleotide
ccctgcgcggctactacaaccagag

SEQ ID NO: 315 - DNA, 25 bp, Artificial Sequence
  Description of Artificial Sequence: Synthetic oligonucleotide
cctgcgcggctactacaaccagagc

SEQ ID NO: 316 - DNA, 26 bp, Artificial Sequence
  Description of Artificial Sequence: Synthetic oligonucleotide
ctgcgcggctactacaaccagagcga

SEQ ID NO: 317 - DNA, 26 bp, Artificial Sequence
  Description of Artificial Sequence: Synthetic oligonucleotide
tgcgcggctactacaaccagagcgag

SEQ ID NO: 318 - DNA, 25 bp, Artificial Sequence
  Description of Artificial Sequence: Synthetic oligonucleotide
gcgcggctactacaaccagagcgag

SEQ ID NO: 319 - DNA, 26 bp, Artificial Sequence
  Description of Artificial Sequence: Synthetic oligonucleotide
cgcggctactacaaccagagcgagga

SEQ ID NO: 320 - DNA, 26 bp, Artificial Sequence
  Description of Artificial Sequence: Synthetic oligonucleotide
gcggctactacaaccagagcgaggac

SEQ ID NO: 321 - DNA, 26 bp, Artificial Sequence
  Description of Artificial Sequence: Synthetic oligonucleotide
cggctactacaaccagagcgaggacg

SEQ ID NO: 322 - DNA, 27 bp, Artificial Sequence
  Description of Artificial Sequence: Synthetic oligonucleotide
ggctactacaaccagagcgaggacggt

SEQ ID NO: 323 - DNA, 28 bp, Artificial Sequence
  Description of Artificial Sequence: Synthetic oligonucleotide
gctactacaaccagagcgaggacggttc

SEQ ID NO: 324 - DNA, 29 bp, Artificial Sequence
  Description of Artificial Sequence: Synthetic oligonucleotide
ctactacaaccagagcgaggacggttctc

SEQ ID NO: 325 - DNA, 30 bp, Artificial Sequence
  Description of Artificial Sequence: Synthetic oligonucleotide
tactacaaccagagcgaggacggttctcac

SEQ ID NO: 326 - DNA, 29 bp, Artificial Sequence
  Description of Artificial Sequence: Synthetic oligonucleotide
actacaaccagagcgaggacggttctcac

SEQ ID NO: 327 - DNA, 28 bp, Artificial Sequence
  Description of Artificial Sequence: Synthetic oligonucleotide
ctacaaccagagcgaggacggttctcac

SEQ ID NO: 328 - DNA, 29 bp, Artificial Sequence
  Description of Artificial Sequence: Synthetic oligonucleotide
tacaaccagagcgaggacggttctcacac

SEQ ID NO: 329 - DNA, 28 bp, Artificial Sequence
  Description of Artificial Sequence: Synthetic oligonucleotide
acaaccagagcgaggacggttctcacac

SEQ ID NO: 330 - DNA, 27 bp, Artificial Sequence
  Description of Artificial Sequence: Synthetic oligonucleotide
caaccagagcgaggacggttctcacac

SEQ ID NO: 331 - DNA, 27 bp, Artificial Sequence
  Description of Artificial Sequence: Synthetic oligonucleotide
aaccagagcgaggacggttctcacacc

SEQ ID NO: 332 - DNA, 27 bp, Artificial Sequence
  Description of Artificial Sequence: Synthetic oligonucleotide
accagagcgaggacggttctcacacca

SEQ ID NO: 333 - DNA, 27 bp, Artificial Sequence
  Description of Artificial Sequence: Synthetic oligonucleotide
ccagagcgaggacggttctcacaccat

SEQ ID NO: 334 - DNA, 27 bp, Artificial Sequence
  Description of Artificial Sequence: Synthetic oligonucleotide
cagagcgaggacggttctcacaccatc

SEQ ID NO: 335 - DNA, 27 bp, Artificial Sequence
  Description of Artificial Sequence: Synthetic oligonucleotide
agagcgaggacggttctcacaccatcc

SEQ ID NO: 336 - DNA, 27 bp, Artificial Sequence
  Description of Artificial Sequence: Synthetic oligonucleotide
gagcgaggacggttctcacaccatcca

SEQ ID NO: 337 - DNA, 27 bp, Artificial Sequence
  Description of Artificial Sequence: Synthetic oligonucleotide
agcgaggacggttctcacaccatccag

SEQ ID NO: 338 - DNA, 27 bp, Artificial Sequence
  Description of Artificial Sequence: Synthetic oligonucleotide
gcgaggacggttctcacaccatccaga

SEQ ID NO: 339 - DNA, 31 bp, Artificial Sequence
  Description of Artificial Sequence: Synthetic oligonucleotide
cgaggacggttctcacaccatccagataatg

SEQ ID NO: 340 - DNA, 34 bp, Artificial Sequence
  Description of Artificial Sequence: Synthetic oligonucleotide
gaggacggttctcacaccatccagataatgtatg

SEQ ID NO: 341 - DNA, 34 bp, Artificial Sequence
  Description of Artificial Sequence: Synthetic oligonucleotide
aggacggttctcacaccatccagataatgtatgg

SEQ ID NO: 342 - DNA, 33 bp, Artificial Sequence
  Description of Artificial Sequence: Synthetic oligonucleotide
ggacggttctcacaccatccagataatgtatgg

SEQ ID NO: 343 - DNA, 33 bp, Artificial Sequence
  Description of Artificial Sequence: Synthetic oligonucleotide
gacggttctcacaccatccagataatgtatggc

SEQ ID NO: 344 - DNA, 34 bp, Artificial Sequence
  Description of Artificial Sequence: Synthetic oligonucleotide
acggttctcacaccatccagataatgtatggctg

SEQ ID NO: 345 - DNA, 33 bp, Artificial Sequence
  Description of Artificial Sequence: Synthetic oligonucleotide
cggttctcacaccatccagataatgtatggctg

SEQ ID NO: 346 - DNA, 33 bp, Artificial Sequence
  Description of Artificial Sequence: Synthetic oligonucleotide
ggttctcacaccatccagataatgtatggctgc

SEQ ID NO: 347 - DNA, 33 bp, Artificial Sequence
  Description of Artificial Sequence: Synthetic oligonucleotide
gttctcacaccatccagataatgtatggctgcg

SEQ ID NO: 348 - DNA, 34 bp, Artificial Sequence
  Description of Artificial Sequence: Synthetic oligonucleotide
ttctcacaccatccagataatgtatggctgcgac

SEQ ID NO: 349 - DNA, 33 bp, Artificial Sequence
  Description of Artificial Sequence: Synthetic oligonucleotide
tctcacaccatccagataatgtatggctgcgac

SEQ ID NO: 350 - DNA, 32 bp, Artificial Sequence
  Description of Artificial Sequence: Synthetic oligonucleotide
ctcacaccatccagataatgtatggctgcgac

SEQ ID NO: 351 - DNA, 32 bp, Artificial Sequence
  Description of Artificial Sequence: Synthetic oligonucleotide
tcacaccatccagataatgtatggctgcgacg

SEQ ID NO: 352 - DNA, 31 bp, Artificial Sequence
  Description of Artificial Sequence: Synthetic oligonucleotide
cacaccatccagataatgtatggctgcgacg

SEQ ID NO: 353 - DNA, 32 bp, Artificial Sequence
  Description of Artificial Sequence: Synthetic oligonucleotide
acaccatccagataatgtatggctgcgacgtg

SEQ ID NO: 354 - DNA, 31 bp, Artificial Sequence
  Description of Artificial Sequence: Synthetic oligonucleotide
caccatccagataatgtatggctgcgacgtg

SEQ ID NO: 355 - DNA, 31 bp, Artificial Sequence
  Description of Artificial Sequence: Synthetic oligonucleotide
accatccagataatgtatggctgcgacgtgg

SEQ ID NO: 356 - DNA, 30 bp, Artificial Sequence
  Description of Artificial Sequence: Synthetic oligonucleotide
ccatccagataatgtatggctgcgacgtgg

SEQ ID NO: 357 - DNA, 30 bp, Artificial Sequence
  Description of Artificial Sequence: Synthetic oligonucleotide
catccagataatgtatggctgcgacgtggg

SEQ ID NO: 358 - DNA, 30 bp, Artificial Sequence
  Description of Artificial Sequence: Synthetic oligonucleotide
atccagataatgtatggctgcgacgtgggg

SEQ ID NO: 359 - DNA, 29 bp, Artificial Sequence
  Description of Artificial Sequence: Synthetic oligonucleotide
tccagataatgtatggctgcgacgtgggg

SEQ ID NO: 360 - DNA, 28 bp, Artificial Sequence
  Description of Artificial Sequence: Synthetic oligonucleotide
ccagataatgtatggctgcgacgtgggg

SEQ ID NO: 361 - DNA, 28 bp, Artificial Sequence
  Description of Artificial Sequence: Synthetic oligonucleotide
cagataatgtatggctgcgacgtggggc

SEQ ID NO: 362 - DNA, 28 bp, Artificial Sequence
  Description of Artificial Sequence: Synthetic oligonucleotide
agataatgtatggctgcgacgtggggcc

SEQ ID NO: 363 - DNA, 27 bp, Artificial Sequence
  Description of Artificial Sequence: Synthetic oligonucleotide
gataatgtatggctgcgacgtggggcc

SEQ ID NO: 364 - DNA, 27 bp, Artificial Sequence
  Description of Artificial Sequence: Synthetic oligonucleotide
ataatgtatggctgcgacgtggggccg

SEQ ID NO: 365 - DNA, 26 bp, Artificial Sequence
  Description of Artificial Sequence: Synthetic oligonucleotide
taatgtatggctgcgacgtggggccg

SEQ ID NO: 366 - DNA, 25 bp, Artificial Sequence
  Description of Artificial Sequence: Synthetic oligonucleotide
aatgtatggctgcgacgtggggccg

SEQ ID NO: 367 - DNA, 24 bp, Artificial Sequence
  Description of Artificial Sequence: Synthetic oligonucleotide
atgtatggctgcgacgtggggccg

SEQ ID NO: 368 - DNA, 23 bp, Artificial Sequence
  Description of Artificial Sequence: Synthetic oligonucleotide
tgtatggctgcgacgtggggccg

SEQ ID NO: 369 - DNA, 22 bp, Artificial Sequence
  Description of Artificial Sequence: Synthetic oligonucleotide
gtatggctgcgacgtggggccg

SEQ ID NO: 370 - DNA, 23 bp, Artificial Sequence
  Description of Artificial Sequence: Synthetic oligonucleotide
tatggctgcgacgtggggccgga

SEQ ID NO: 371 - DNA, 22 bp, Artificial Sequence
  Description of Artificial Sequence: Synthetic oligonucleotide
atggctgcgacgtggggccgga

SEQ ID NO: 372 - DNA, 21 bp, Artificial Sequence
  Description of Artificial Sequence: Synthetic oligonucleotide
tggctgcgacgtggggccgga

SEQ ID NO: 373 - DNA, 20 bp, Artificial Sequence
  Description of Artificial Sequence: Synthetic oligonucleotide
ggctgcgacgtggggccgga

SEQ ID NO: 374 - DNA, 20 bp, Artificial Sequence
  Description of Artificial Sequence: Synthetic oligonucleotide
gctgcgacgtggggccggac

SEQ ID NO: 375 - DNA, 20 bp, Artificial Sequence
  Description of Artificial Sequence: Synthetic oligonucleotide
ctgcgacgtggggccggacg

SEQ ID NO: 376 - DNA, 20 bp, Artificial Sequence
  Description of Artificial Sequence: Synthetic oligonucleotide
tgcgacgtggggccggacgg

SEQ ID NO: 377 - DNA, 20 bp, Artificial Sequence
  Description of Artificial Sequence: Synthetic oligonucleotide
gcgacgtggggccggacggt

SEQ ID NO: 378 - DNA, 20 bp, Artificial Sequence
  Description of Artificial Sequence: Synthetic oligonucleotide
cgacgtggggccggacgggt

SEQ ID NO: 379 - DNA, 20 bp, Artificial Sequence
  Description of Artificial Sequence: Synthetic oligonucleotide
gacgtggggccggacgggct

SEQ ID NO: 380 - DNA, 20 bp, Artificial Sequence
  Description of Artificial Sequence: Synthetic oligonucleotide
acgtggggccggacgggcgt

SEQ ID NO: 381 - DNA, 20 bp, Artificial Sequence
  Description of Artificial Sequence: Synthetic oligonucleotide
cgtggggccggacgggcgtt

SEQ ID NO: 382 - DNA, 20 bp, Artificial Sequence
  Description of Artificial Sequence: Synthetic oligonucleotide
gtggggccggacgggcgctt

SEQ ID NO: 383 - DNA, 20 bp, Artificial Sequence
  Description of Artificial Sequence: Synthetic oligonucleotide
tggggccggacgggcgcttc

SEQ ID NO: 384 - DNA, 20 bp, Artificial Sequence
  Description of Artificial Sequence: Synthetic oligonucleotide
ggggccggacgggcgcttct

SEQ ID NO: 385 - DNA, 20 bp, Artificial Sequence
  Description of Artificial Sequence: Synthetic oligonucleotide
gggccggacgggcgcttcct

SEQ ID NO: 386 - DNA, 20 bp, Artificial Sequence
  Description of Artificial Sequence: Synthetic oligonucleotide
ggccggacgggcgcttcctc

SEQ ID NO: 387 - DNA, 20 bp, Artificial Sequence
  Description of Artificial Sequence: Synthetic oligonucleotide
gccggacgggcgcttcctcc

SEQ ID NO: 388 - DNA, 20 bp, Artificial Sequence
  Description of Artificial Sequence: Synthetic oligonucleotide
ccggacgggcgcttcctccg

SEQ ID NO: 389 - DNA, 20 bp, Artificial Sequence
  Description of Artificial Sequence: Synthetic oligonucleotide
cggacgggcgcttcctccgc

SEQ ID NO: 390 - DNA, 20 bp, Artificial Sequence
  Description of Artificial Sequence: Synthetic oligonucleotide
ggacgggcgcttcctccgcg

SEQ ID NO: 391 - DNA, 20 bp, Artificial Sequence
  Description of Artificial Sequence: Synthetic oligonucleotide
gacgggcgcttcctccgcgg

SEQ ID NO: 392 - DNA, 22 bp, Artificial Sequence
  Description of Artificial Sequence: Synthetic oligonucleotide
acgggcgcttcctccgcgggta

SEQ ID NO: 393 - DNA, 21 bp, Artificial Sequence
  Description of Artificial Sequence: Synthetic oligonucleotide
cgggcgcttcctccgcgggta

SEQ ID NO: 394 - DNA, 21 bp, Artificial Sequence
  Description of Artificial Sequence: Synthetic oligonucleotide
gggcgcttcctccgcgggtac

SEQ ID NO: 395 - DNA, 21 bp, Artificial Sequence
  Description of Artificial Sequence: Synthetic oligonucleotide
ggcgcttcctccgcgggtacc

SEQ ID NO: 396 - DNA, 21 bp, Artificial Sequence
  Description of Artificial Sequence: Synthetic oligonucleotide
gcgcttcctccgcgggtaccg

SEQ ID NO: 397 - DNA, 21 bp, Artificial Sequence
  Description of Artificial Sequence: Synthetic oligonucleotide
cgcttcctccgcgggtaccgg

SEQ ID NO: 398 - DNA, 22 bp, Artificial Sequence
  Description of Artificial Sequence: Synthetic oligonucleotide
gcttcctccgcgggtaccggca

SEQ ID NO: 399 - DNA, 22 bp, Artificial Sequence
  Description of Artificial Sequence: Synthetic oligonucleotide
cttcctccgcgggtaccggcag

SEQ ID NO: 400 - DNA, 23 bp, Artificial Sequence
  Description of Artificial Sequence: Synthetic oligonucleotide
ttcctccgcgggtaccggcagga

SEQ ID NO: 401 - DNA, 22 bp, Artificial Sequence
  Description of Artificial Sequence: Synthetic oligonucleotide
tcctccgcgggtaccggcagga

SEQ ID NO: 402 - DNA, 21 bp, Artificial Sequence
  Description of Artificial Sequence: Synthetic oligonucleotide
cctccgcgggtaccggcagga

SEQ ID NO: 403 - DNA, 21 bp, Artificial Sequence
  Description of Artificial Sequence: Synthetic oligonucleotide
ctccgcgggtaccggcaggac

SEQ ID NO: 404 - DNA, 21 bp, Artificial Sequence
  Description of Artificial Sequence: Synthetic oligonucleotide
tccgcgggtaccggcaggacg

SEQ ID NO: 405 - DNA, 20 bp, Artificial Sequence
  Description of Artificial Sequence: Synthetic oligonucleotide
ccgcgggtaccggcaggacg

SEQ ID NO: 406 - DNA, 20 bp, Artificial Sequence
  Description of Artificial Sequence: Synthetic oligonucleotide
cgcgggtaccggcaggacgc

SEQ ID NO: 407 - DNA, 22 bp, Artificial Sequence
  Description of Artificial Sequence: Synthetic oligonucleotide
gcgggtaccggcaggacgccta

SEQ ID NO: 408 - DNA, 22 bp, Artificial Sequence
  Description of Artificial Sequence: Synthetic oligonucleotide
cgggtaccggcaggacgcctac

SEQ ID NO: 409 - DNA, 23 bp, Artificial Sequence
  Description of Artificial Sequence: Synthetic oligonucleotide
gggtaccggcaggacgcctacga

SEQ ID NO: 410 - DNA, 23 bp, Artificial Sequence
  Description of Artificial Sequence: Synthetic oligonucleotide
ggtaccggcaggacgcctacgac

SEQ ID NO: 411 - DNA, 23 bp, Artificial Sequence
  Description of Artificial Sequence: Synthetic oligonucleotide
gtaccggcaggacgcctacgacg

SEQ ID NO: 412 - DNA, 23 bp, Artificial Sequence
  Description of Artificial Sequence: Synthetic oligonucleotide
taccggcaggacgcctacgacgg

SEQ ID NO: 413 - DNA, 22 bp, Artificial Sequence
  Description of Artificial Sequence: Synthetic oligonucleotide
accggcaggacgcctacgacgg

SEQ ID NO: 414 - DNA, 21 bp, Artificial Sequence
  Description of Artificial Sequence: Synthetic oligonucleotide
ccggcaggacgcctacgacgg

SEQ ID NO: 415 - DNA, 23 bp, Artificial Sequence
  Description of Artificial Sequence: Synthetic oligonucleotide
cggcaggacgcctacgacggcaa

SEQ ID NO: 416 - DNA, 23 bp, Artificial Sequence
  Description of Artificial Sequence: Synthetic oligonucleotide
ggcaggacgcctacgacggcaag

SEQ ID NO: 417 - DNA, 27 bp, Artificial Sequence
  Description of Artificial Sequence: Synthetic oligonucleotide
gcaggacgcctacgacggcaaggatta

SEQ ID NO: 418 - DNA, 27 bp, Artificial Sequence
  Description of Artificial Sequence: Synthetic oligonucleotide
caggacgcctacgacggcaaggattac

SEQ ID NO: 419 - DNA, 29 bp, Artificial Sequence
  Description of Artificial Sequence: Synthetic oligonucleotide
aggacgcctacgacggcaaggattacatc

SEQ ID NO: 420 - DNA, 28 bp, Artificial Sequence
  Description of Artificial Sequence: Synthetic oligonucleotide
ggacgcctacgacggcaaggattacatc

SEQ ID NO: 421 - DNA, 28 bp, Artificial Sequence
  Description of Artificial Sequence: Synthetic oligonucleotide
gacgcctacgacggcaaggattacatcg

SEQ ID NO: 422 - DNA, 28 bp, Artificial Sequence
  Description of Artificial Sequence: Synthetic oligonucleotide
acgcctacgacggcaaggattacatcgc

SEQ ID NO: 423 - DNA, 27 bp, Artificial Sequence
  Description of Artificial Sequence: Synthetic oligonucleotide
cgcctacgacggcaaggattacatcgc

SEQ ID NO: 424 - DNA, 27 bp, Artificial Sequence
  Description of Artificial Sequence: Synthetic oligonucleotide
gcctacgacggcaaggattacatcgcc

SEQ ID NO: 425 - DNA, 27 bp, Artificial Sequence
  Description of Artificial Sequence: Synthetic oligonucleotide
cctacgacggcaaggattacatcgccc

SEQ ID NO: 426 - DNA, 28 bp, Artificial Sequence
  Description of Artificial Sequence: Synthetic oligonucleotide
ctacgacggcaaggattacatcgccctg

SEQ ID NO: 427 - DNA, 30 bp, Artificial Sequence
  Description of Artificial Sequence: Synthetic oligonucleotide
tacgacggcaaggattacatcgccctgaac

SEQ ID NO: 428 - DNA, 29 bp, Artificial Sequence
  Description of Artificial Sequence: Synthetic oligonucleotide
acgacggcaaggattacatcgccctgaac

SEQ ID NO: 429 - DNA, 28 bp, Artificial Sequence
  Description of Artificial Sequence: Synthetic oligonucleotide
cgacggcaaggattacatcgccctgaac

SEQ ID NO: 430 - DNA, 28 bp, Artificial Sequence
  Description of Artificial Sequence: Synthetic oligonucleotide
gacggcaaggattacatcgccctgaacg

SEQ ID NO: 431 - DNA, 29 bp, Artificial Sequence
  Description of Artificial Sequence: Synthetic oligonucleotide
acggcaaggattacatcgccctgaacgag

SEQ ID NO: 432 - DNA, 28 bp, Artificial Sequence
  Description of Artificial Sequence: Synthetic oligonucleotide
cggcaaggattacatcgccctgaacgag

SEQ ID NO: 433 - DNA, 28 bp, Artificial Sequence
  Description of Artificial Sequence: Synthetic oligonucleotide
ggcaaggattacatcgccctgaacgagg

SEQ ID NO: 434 - DNA, 29 bp, Artificial Sequence
  Description of Artificial Sequence: Synthetic oligonucleotide
gcaaggattacatcgccctgaacgaggac

SEQ ID NO: 435 - DNA, 29 bp, Artificial Sequence
  Description of Artificial Sequence: Synthetic oligonucleotide
caaggattacatcgccctgaacgaggacc

SEQ ID NO: 436 - DNA, 30 bp, Artificial Sequence
  Description of Artificial Sequence: Synthetic oligonucleotide
aaggattacatcgccctgaacgaggacctg

SEQ ID NO: 437 - DNA, 29 bp, Artificial Sequence
  Description of Artificial Sequence: Synthetic oligonucleotide
aggattacatcgccctgaacgaggacctg

SEQ ID NO: 438 - DNA, 28 bp, Artificial Sequence
  Description of Artificial Sequence: Synthetic oligonucleotide
ggattacatcgccctgaacgaggacctg

SEQ ID NO: 439 - DNA, 28 bp, Artificial Sequence
  Description of Artificial Sequence: Synthetic oligonucleotide
gattacatcgccctgaacgaggacctgc

SEQ ID NO: 440 - DNA, 28 bp, Artificial Sequence
  Description of Artificial Sequence: Synthetic oligonucleotide
attacatcgccctgaacgaggacctgcg

SEQ ID NO: 441 - DNA, 27 bp, Artificial Sequence
  Description of Artificial Sequence: Synthetic oligonucleotide
ttacatcgccctgaacgaggacctgcg

SEQ ID NO: 442 - DNA, 26 bp, Artificial Sequence
  Description of Artificial Sequence: Synthetic oligonucleotide
tacatcgccctgaacgaggacctgcg

SEQ ID NO: 443 - DNA, 25 bp, Artificial Sequence
  Description of Artificial Sequence: Synthetic oligonucleotide
acatcgccctgaacgaggacctgcg

SEQ ID NO: 444 - DNA, 24 bp, Artificial Sequence
  Description of Artificial Sequence: Synthetic oligonucleotide
catcgccctgaacgaggacctgcg

SEQ ID NO: 445 - DNA, 25 bp, Artificial Sequence
  Description of Artificial Sequence: Synthetic oligonucleotide
atcgccctgaacgaggacctgcgct

SEQ ID NO: 446 - DNA, 24 bp, Artificial Sequence
  Description of Artificial Sequence: Synthetic oligonucleotide
tcgccctgaacgaggacctgcgct

SEQ ID NO: 447 - DNA, 23 bp, Artificial Sequence
  Description of Artificial Sequence: Synthetic oligonucleotide
cgccctgaacgaggacctgcgct

SEQ ID NO: 448 - DNA, 25 bp, Artificial Sequence
  Description of Artificial Sequence: Synthetic oligonucleotide
gccctgaacgaggacctgcgctctt

SEQ ID NO: 449 - DNA, 25 bp, Artificial Sequence
  Description of Artificial Sequence: Synthetic oligonucleotide
ccctgaacgaggacctgcgctcttg

SEQ ID NO: 450 - DNA, 26 bp, Artificial Sequence
  Description of Artificial Sequence: Synthetic oligonucleotide
cctgaacgaggacctgcgctcttgga

SEQ ID NO: 451 - DNA, 26 bp, Artificial Sequence
  Description of Artificial Sequence: Synthetic oligonucleotide
ctgaacgaggacctgcgctcttggac

SEQ ID NO: 452 - DNA, 26 bp, Artificial Sequence
  Description of Artificial Sequence: Synthetic oligonucleotide
tgaacgaggacctgcgctcttggacc

SEQ ID NO: 453 - DNA, 25 bp, Artificial Sequence
  Description of Artificial Sequence: Synthetic oligonucleotide
gaacgaggacctgcgctcttggacc

SEQ ID NO: 454 - DNA, 25 bp, Artificial Sequence
  Description of Artificial Sequence: Synthetic oligonucleotide
aacgaggacctgcgctcttggaccg

SEQ ID NO: 455 - DNA, 24 bp, Artificial Sequence
  Description of Artificial Sequence: Synthetic oligonucleotide
acgaggacctgcgctcttggaccg

SEQ ID NO: 456 - DNA, 23 bp, Artificial Sequence
  Description of Artificial Sequence: Synthetic oligonucleotide
cgaggacctgcgctcttggaccg

SEQ ID NO: 457 - DNA, 23 bp, Artificial Sequence
  Description of Artificial Sequence: Synthetic oligonucleotide
gaggacctgcgctcttggaccgc

SEQ ID NO: 458 - DNA, 23 bp, Artificial Sequence
  Description of Artificial Sequence: Synthetic oligonucleotide
aggacctgcgctcttggaccgcg

SEQ ID NO: 459 - DNA, 22 bp, Artificial Sequence
  Description of Artificial Sequence: Synthetic oligonucleotide
ggacctgcgctcttggaccgcg

SEQ ID NO: 460 - DNA, 22 bp, Artificial Sequence
  Description of Artificial Sequence: Synthetic oligonucleotide
gacctgcgctcttggaccgcgg

SEQ ID NO: 461 - DNA, 22 bp, Artificial Sequence
  Description of Artificial Sequence: Synthetic oligonucleotide
acctgcgctcttggaccgcggc

SEQ ID NO: 462 - DNA, 21 bp, Artificial Sequence
  Description of Artificial Sequence: Synthetic oligonucleotide
cctgcgctcttggaccgcggc

SEQ ID NO: 463 - DNA, 21 bp, Artificial Sequence
  Description of Artificial Sequence: Synthetic oligonucleotide
ctgcgctcttggaccgcggcg

SEQ ID NO: 464 - DNA, 22 bp, Artificial Sequence
  Description of Artificial Sequence: Synthetic oligonucleotide
tgcgctcttggaccgcggcgga

SEQ ID NO: 465 - DNA, 21 bp, Artificial Sequence
  Description of Artificial Sequence: Synthetic oligonucleotide
gcgctcttggaccgcggcgga

SEQ ID NO: 466 - DNA, 23 bp, Artificial Sequence
  Description of Artificial Sequence: Synthetic oligonucleotide
cgctcttggaccgcggcggacat

SEQ ID NO: 467 - DNA, 23 bp, Artificial Sequence
  Description of Artificial Sequence: Synthetic oligonucleotide
gctcttggaccgcggcggacatg

SEQ ID NO: 468 - DNA, 23 bp, Artificial Sequence
  Description of Artificial Sequence: Synthetic oligonucleotide
ctcttggaccgcggcggacatgg

SEQ ID NO: 469 - DNA, 24 bp, Artificial Sequence
  Description of Artificial Sequence: Synthetic oligonucleotide
tcttggaccgcggcggacatggca

SEQ ID NO: 470 - DNA, 23 bp, Artificial Sequence
  Description of Artificial Sequence: Synthetic oligonucleotide
cttggaccgcggcggacatggca

SEQ ID NO: 471 - DNA, 23 bp, Artificial Sequence
  Description of Artificial Sequence: Synthetic oligonucleotide
ttggaccgcggcggacatggcag

SEQ ID NO: 472 - DNA, 22 bp, Artificial Sequence
  Description of Artificial Sequence: Synthetic oligonucleotide
tggaccgcggcggacatggcag

SEQ ID NO: 473 - DNA, 21 bp, Artificial Sequence
  Description of Artificial Sequence: Synthetic oligonucleotide
ggaccgcggcggacatggcag

SEQ ID NO: 474 - DNA, 22 bp, Artificial Sequence
  Description of Artificial Sequence: Synthetic oligonucleotide
gaccgcggcggacatggcagct

SEQ ID NO: 475 - DNA, 23 bp, Artificial Sequence
  Description of Artificial Sequence: Synthetic oligonucleotide
accgcggcggacatggcagctca

SEQ ID NO: 476 - DNA, 22 bp, Artificial Sequence
  Description of Artificial Sequence: Synthetic oligonucleotide
ccgcggcggacatggcagctca

SEQ ID NO: 477 - DNA, 24 bp, Artificial Sequence
  Description of Artificial Sequence: Synthetic oligonucleotide
cgcggcggacatggcagctcagat

SEQ ID NO: 478 - DNA, 25 bp, Artificial Sequence
  Description of Artificial Sequence: Synthetic oligonucleotide
gcggcggacatggcagctcagatca

SEQ ID NO: 479 - DNA, 25 bp, Artificial Sequence
  Description of Artificial Sequence: Synthetic oligonucleotide
cggcggacatggcagctcagatcac

SEQ ID NO: 480 - DNA, 27 bp, Artificial Sequence
  Description of Artificial Sequence: Synthetic oligonucleotide
ggcggacatggcagctcagatcaccaa

SEQ ID NO: 481 - DNA, 27 bp, Artificial Sequence
  Description of Artificial Sequence: Synthetic oligonucleotide
gcggacatggcagctcagatcaccaag

SEQ ID NO: 482 - DNA, 27 bp, Artificial Sequence
  Description of Artificial Sequence: Synthetic oligonucleotide
cggacatggcagctcagatcaccaagc

SEQ ID NO: 483 - DNA, 27 bp, Artificial Sequence
  Description of Artificial Sequence: Synthetic oligonucleotide
ggacatggcagctcagatcaccaagcg

SEQ ID NO: 484 - DNA, 27 bp, Artificial Sequence
  Description of Artificial Sequence: Synthetic oligonucleotide
gacatggcagctcagatcaccaagcgc

SEQ ID NO: 485 - DNA, 29 bp, Artificial Sequence
  Description of Artificial Sequence: Synthetic oligonucleotide
acatggcagctcagatcaccaagcgcaag

SEQ ID NO: 486 - DNA, 28 bp, Artificial Sequence
  Description of Artificial Sequence: Synthetic oligonucleotide
catggcagctcagatcaccaagcgcaag

SEQ ID NO: 487 - DNA, 29 bp, Artificial Sequence
  Description of Artificial Sequence: Synthetic oligonucleotide
atggcagctcagatcaccaagcgcaagtg

SEQ ID NO: 488 - DNA, 28 bp, Artificial Sequence
  Description of Artificial Sequence: Synthetic oligonucleotide
tggcagctcagatcaccaagcgcaagtg

SEQ ID NO: 489 - DNA, 27 bp, Artificial Sequence
  Description of Artificial Sequence: Synthetic oligonucleotide
ggcagctcagatcaccaagcgcaagtg

SEQ ID NO: 490 - DNA, 27 bp, Artificial Sequence
  Description of Artificial Sequence: Synthetic oligonucleotide
gcagctcagatcaccaagcgcaagtgg

SEQ ID NO: 491 - DNA, 27 bp, Artificial Sequence
  Description of Artificial Sequence: Synthetic oligonucleotide
cagctcagatcaccaagcgcaagtggg

SEQ ID NO: 492 - DNA, 28 bp, Artificial Sequence
  Description of Artificial Sequence: Synthetic oligonucleotide
agctcagatcaccaagcgcaagtgggag

SEQ ID NO: 493 - DNA, 27 bp, Artificial Sequence
  Description of Artificial Sequence: Synthetic oligonucleotide
gctcagatcaccaagcgcaagtgggag

SEQ ID NO: 494 - DNA, 27 bp, Artificial Sequence
  Description of Artificial Sequence: Synthetic oligonucleotide
ctcagatcaccaagcgcaagtgggagg

SEQ ID NO: 495 - DNA, 27 bp, Artificial Sequence
  Description of Artificial Sequence: Synthetic oligonucleotide
tcagatcaccaagcgcaagtgggaggc

SEQ ID NO: 496 - DNA, 26 bp, Artificial Sequence
  Description of Artificial Sequence: Synthetic oligonucleotide
cagatcaccaagcgcaagtgggaggc

SEQ ID NO: 497 - DNA, 26 bp, Artificial Sequence
  Description of Artificial Sequence: Synthetic oligonucleotide
agatcaccaagcgcaagtgggaggcg

SEQ ID NO: 498 - DNA, 25 bp, Artificial Sequence
  Description of Artificial Sequence: Synthetic oligonucleotide
gatcaccaagcgcaagtgggaggcg

SEQ ID NO: 499 - DNA, 26 bp, Artificial Sequence
  Description of Artificial Sequence: Synthetic oligonucleotide
atcaccaagcgcaagtgggaggcggt

SEQ ID NO: 500 - DNA, 25 bp, Artificial Sequence
  Description of Artificial Sequence: Synthetic oligonucleotide
tcaccaagcgcaagtgggaggcggt

SEQ ID NO: 501 - DNA, 24 bp, Artificial Sequence
  Description of Artificial Sequence: Synthetic oligonucleotide
caccaagcgcaagtgggaggcggt

SEQ ID NO: 502 - DNA, 24 bp, Artificial Sequence
  Description of Artificial Sequence: Synthetic oligonucleotide
accaagcgcaagtgggaggcggtc

SEQ ID NO: 503 - DNA, 23 bp, Artificial Sequence
  Description of Artificial Sequence: Synthetic oligonucleotide
ccaagcgcaagtgggaggcggtc

SEQ ID NO: 504 - DNA, 25 bp, Artificial Sequence
  Description of Artificial Sequence: Synthetic oligonucleotide
caagcgcaagtgggaggcggtccat

SEQ ID NO: 505 - DNA, 25 bp, Artificial Sequence
  Description of Artificial Sequence: Synthetic oligonucleotide
aagcgcaagtgggaggcggtccatg

SEQ ID NO: 506 - DNA, 24 bp, Artificial Sequence
  Description of Artificial Sequence: Synthetic oligonucleotide
agcgcaagtgggaggcggtccatg

SEQ ID NO: 507 - DNA, 23 bp, Artificial Sequence
  Description of Artificial Sequence: Synthetic oligonucleotide
gcgcaagtgggaggcggtccatg

SEQ ID NO: 508 - DNA, 23 bp, Artificial Sequence
  Description of Artificial Sequence: Synthetic oligonucleotide
cgcaagtgggaggcggtccatgc

SEQ ID NO: 509 - DNA, 23 bp, Artificial Sequence
  Description of Artificial Sequence: Synthetic oligonucleotide
gcaagtgggaggcggtccatgcg

SEQ ID NO: 510 - DNA, 23 bp, Artificial Sequence
  Description of Artificial Sequence: Synthetic oligonucleotide
caagtgggaggcggtccatgcgg

SEQ ID NO: 511 - DNA, 23 bp, Artificial Sequence
  Description of Artificial Sequence: Synthetic oligonucleotide
aagtgggaggcggtccatgcggc

SEQ ID NO: 512 - DNA, 22 bp, Artificial Sequence
  Description of Artificial Sequence: Synthetic oligonucleotide
agtgggaggcggtccatgcggc

SEQ ID NO: 513 - DNA, 21 bp, Artificial Sequence
  Description of Artificial Sequence: Synthetic oligonucleotide
gtgggaggcggtccatgcggc

SEQ ID NO: 514 - DNA, 21 bp, Artificial Sequence
  Description of Artificial Sequence: Synthetic oligonucleotide
tgggaggcggtccatgcggcg

SEQ ID NO: 515 - DNA, 20 bp, Artificial Sequence
  Description of Artificial Sequence: Synthetic oligonucleotide
gggaggcggtccatgcggcg

SEQ ID NO: 516 - DNA, 21 bp, Artificial Sequence
  Description of Artificial Sequence: Synthetic oligonucleotide
ggaggcggtccatgcggcgga

SEQ ID NO: 517 - DNA, 21 bp, Artificial Sequence
  Description of Artificial Sequence: Synthetic oligonucleotide
gaggcggtccatgcggcggag

SEQ ID NO: 518 - DNA, 22 bp, Artificial Sequence
  Description of Artificial Sequence: Synthetic oligonucleotide
aggcggtccatgcggcggagca

SEQ ID NO: 519 - DNA, 21 bp, Artificial Sequence
  Description of Artificial Sequence: Synthetic oligonucleotide
ggcggtccatgcggcggagca

SEQ ID NO: 520 - DNA, 21 bp, Artificial Sequence
  Description of Artificial Sequence: Synthetic oligonucleotide
gcggtccatgcggcggagcag

SEQ ID NO: 521 - DNA, 21 bp, Artificial Sequence
  Description of Artificial Sequence: Synthetic oligonucleotide
cggtccatgcggcggagcagc

SEQ ID NO: 522 - DNA, 21 bp, Artificial Sequence
  Description of Artificial Sequence: Synthetic oligonucleotide
ggtccatgcggcggagcagcg

SEQ ID NO: 523 - DNA, 22 bp, Artificial Sequence
  Description of Artificial Sequence: Synthetic oligonucleotide
gtccatgcggcggagcagcgga

SEQ ID NO: 524 - DNA, 23 bp, Artificial Sequence
  Description of Artificial Sequence: Synthetic oligonucleotide
tccatgcggcggagcagcggaga

SEQ ID NO: 525 - DNA, 22 bp, Artificial Sequence
  Description of Artificial Sequence: Synthetic oligonucleotide
ccatgcggcggagcagcggaga

SEQ ID NO: 526 - DNA, 23 bp, Artificial Sequence
  Description of Artificial Sequence: Synthetic oligonucleotide
catgcggcggagcagcggagagt

SEQ ID NO: 527 - DNA, 25 bp, Artificial Sequence
  Description of Artificial Sequence: Synthetic oligonucleotide
atgcggcggagcagcggagagtcta

SEQ ID NO: 528 - DNA, 24 bp, Artificial Sequence
  Description of Artificial Sequence: Synthetic oligonucleotide
tgcggcggagcagcggagagtcta

SEQ ID NO: 529 - DNA, 23 bp, Artificial Sequence
  Description of Artificial Sequence: Synthetic oligonucleotide
gcggcggagcagcggagagtcta

SEQ ID NO: 530 - DNA, 23 bp, Artificial Sequence
  Description of Artificial Sequence: Synthetic oligonucleotide
cggcggagcagcggagagtctac

SEQ ID NO: 531 - DNA, 24 bp, Artificial Sequence
  Description of Artificial Sequence: Synthetic oligonucleotide
ggcggagcagcggagagtctacct

SEQ ID NO: 532 - DNA, 24 bp, Artificial Sequence
  Description of Artificial Sequence: Synthetic oligonucleotide
gcggagcagcggagagtctacctg

SEQ ID NO: 533 - DNA, 25 bp, Artificial Sequence
  Description of Artificial Sequence: Synthetic oligonucleotide
cggagcagcggagagtctacctgga

SEQ ID NO: 534 - DNA, 25 bp, Artificial Sequence
  Description of Artificial Sequence: Synthetic oligonucleotide
ggagcagcggagagtctacctggag

SEQ ID NO: 535 - DNA, 25 bp, Artificial Sequence
  Description of Artificial Sequence: Synthetic oligonucleotide
gagcagcggagagtctacctggagg

SEQ ID NO: 536 - DNA, 25 bp, Artificial Sequence
  Description of Artificial Sequence: Synthetic oligonucleotide
agcagcggagagtctacctggaggg

SEQ ID NO: 537 - DNA, 24 bp, Artificial Sequence
  Description of Artificial Sequence: Synthetic oligonucleotide
gcagcggagagtctacctggaggg

SEQ ID NO: 538 - DNA, 24 bp, Artificial Sequence
  Description of Artificial Sequence: Synthetic oligonucleotide
cagcggagagtctacctggagggc

SEQ ID NO: 539 - DNA, 24 bp, Artificial Sequence
  Description of Artificial Sequence: Synthetic oligonucleotide
agcggagagtctacctggagggcc

SEQ ID NO: 540 - DNA, 23 bp, Artificial Sequence
  Description of Artificial Sequence: Synthetic oligonucleotide
gcggagagtctacctggagggcc

SEQ ID NO: 541 - DNA, 23 bp, Artificial Sequence
  Description of Artificial Sequence: Synthetic oligonucleotide
cggagagtctacctggagggccg

SEQ ID NO: 542 - DNA, 24 bp, Artificial Sequence
  Description of Artificial Sequence: Synthetic oligonucleotide
ggagagtctacctggagggccggt

SEQ ID NO: 543 - DNA, 24 bp, Artificial Sequence
  Description of Artificial Sequence: Synthetic oligonucleotide
gagagtctacctggagggccggtg

SEQ ID NO: 544 - DNA, 24 bp, Artificial Sequence
  Description of Artificial Sequence: Synthetic oligonucleotide
agagtctacctggagggccggtgc

SEQ ID NO: 545 - DNA, 23 bp, Artificial Sequence
  Description of Artificial Sequence: Synthetic oligonucleotide
gagtctacctggagggccggtgc

SEQ ID NO: 546 - DNA, 24 bp, Artificial Sequence
  Description of Artificial Sequence: Synthetic oligonucleotide
agtctacctggagggccggtgcgt

SEQ ID NO: 547 - DNA, 23 bp, Artificial Sequence
  Description of Artificial Sequence: Synthetic oligonucleotide
gtctacctggagggccggtgcgt

SEQ ID NO: 548 - DNA, 23 bp, Artificial Sequence
  Description of Artificial Sequence: Synthetic oligonucleotide
tctacctggagggccggtgcgtg

SEQ ID NO: 549 - DNA, 22 bp, Artificial Sequence
  Description of Artificial Sequence: Synthetic oligonucleotide
ctacctggagggccggtgcgtg

SEQ ID NO: 550 - DNA, 23 bp, Artificial Sequence
  Description of Artificial Sequence: Synthetic oligonucleotide
tacctggagggccggtgcgtgga

SEQ ID NO: 551 - DNA, 22 bp, Artificial Sequence
  Description of Artificial Sequence: Synthetic oligonucleotide
acctggagggccggtgcgtgga

SEQ ID NO: 552 - DNA, 21 bp, Artificial Sequence
  Description of Artificial Sequence: Synthetic oligonucleotide
cctggagggccggtgcgtgga

SEQ ID NO: 553 - DNA, 21 bp, Artificial Sequence
  Description of Artificial Sequence: Synthetic oligonucleotide
ctggagggccggtgcgtggac

SEQ ID NO: 554 - DNA, 21 bp, Artificial Sequence
  Description of Artificial Sequence: Synthetic oligonucleotide
tggagggccggtgcgtggacg

SEQ ID NO: 555 - DNA, 20 bp, Artificial Sequence
  Description of Artificial Sequence: Synthetic oligonucleotide
ggagggccggtgcgtggacg

SEQ ID NO: 556 - DNA, 20 bp, Artificial Sequence
  Description of Artificial Sequence: Synthetic oligonucleotide
gagggccggtgcgtggacgg

SEQ ID NO: 557 - DNA, 20 bp, Artificial Sequence
  Description of Artificial Sequence: Synthetic oligonucleotide
agggccggtgcgtggacggg

SEQ ID NO: 558 - DNA, 20 bp, Artificial Sequence
  Description of Artificial Sequence: Synthetic oligonucleotide
gggccggtgcgtggacgggt

SEQ ID NO: 559 - DNA, 20 bp, Artificial Sequence
  Description of Artificial Sequence: Synthetic oligonucleotide
ggccggtgcgtggacgggct

SEQ ID NO: 560 - DNA, 20 bp, Artificial Sequence
  Description of Artificial Sequence: Synthetic oligonucleotide
gccggtgcgtggacgggctc

SEQ ID NO: 561 - DNA, 20 bp, Artificial Sequence
  Description of Artificial Sequence: Synthetic oligonucleotide
ccggtgcgtggacgggctcc

SEQ ID NO: 562 - DNA, 20 bp, Artificial Sequence
  Description of Artificial Sequence: Synthetic oligonucleotide
cggtgcgtggacgggctccg

SEQ ID NO: 563 - DNA, 21 bp, Artificial Sequence
  Description of Artificial Sequence: Synthetic oligonucleotide
ggtgcgtggacgggctccgca

SEQ ID NO: 564 - DNA, 24 bp, Artificial Sequence
  Description of Artificial Sequence: Synthetic oligonucleotide
gtgcgtggacgggctccgcagata

SEQ ID NO: 565 - DNA, 24 bp, Artificial Sequence
  Description of Artificial Sequence: Synthetic oligonucleotide
tgcgtggacgggctccgcagatac

SEQ ID NO: 566 - DNA, 23 bp, Artificial Sequence
  Description of Artificial Sequence: Synthetic oligonucleotide
gcgtggacgggctccgcagatac

SEQ ID NO: 567 - DNA, 24 bp, Artificial Sequence
  Description of Artificial Sequence: Synthetic oligonucleotide
cgtggacgggctccgcagatacct

SEQ ID NO: 568 - DNA, 24 bp, Artificial Sequence
  Description of Artificial Sequence: Synthetic oligonucleotide
gtggacgggctccgcagatacctg

SEQ ID NO: 569 - DNA, 25 bp, Artificial Sequence
  Description of Artificial Sequence: Synthetic oligonucleotide
tggacgggctccgcagatacctgga

SEQ ID NO: 570 - DNA, 24 bp, Artificial Sequence
  Description of Artificial Sequence: Synthetic oligonucleotide
ggacgggctccgcagatacctgga

SEQ ID NO: 571 - DNA, 26 bp, Artificial Sequence
  Description of Artificial Sequence: Synthetic oligonucleotide
gacgggctccgcagatacctggagaa

SEQ ID NO: 572 - DNA, 26 bp, Artificial Sequence
  Description of Artificial Sequence: Synthetic oligonucleotide
acgggctccgcagatacctggagaac

SEQ ID NO: 573 - DNA, 25 bp, Artificial Sequence
  Description of Artificial Sequence: Synthetic oligonucleotide
cgggctccgcagatacctggagaac

SEQ ID NO: 574 - DNA, 25 bp, Artificial Sequence
  Description of Artificial Sequence: Synthetic oligonucleotide
gggctccgcagatacctggagaacg

SEQ ID NO: 575 - DNA, 25 bp, Artificial Sequence
  Description of Artificial Sequence: Synthetic oligonucleotide
ggctccgcagatacctggagaacgg

SEQ ID NO: 576 - DNA, 27 bp, Artificial Sequence
  Description of Artificial Sequence: Synthetic oligonucleotide
gctccgcagatacctggagaacgggaa

SEQ ID NO: 577 - DNA, 27 bp, Artificial Sequence
  Description of Artificial Sequence: Synthetic oligonucleotide
ctccgcagatacctggagaacgggaag

SEQ ID NO: 578 - DNA, 27 bp, Artificial Sequence
  Description of Artificial Sequence: Synthetic oligonucleotide
tccgcagatacctggagaacgggaagg

SEQ ID NO: 579 - DNA, 27 bp, Artificial Sequence
  Description of Artificial Sequence: Synthetic oligonucleotide
ccgcagatacctggagaacgggaagga

SEQ ID NO: 580 - DNA, 27 bp, Artificial Sequence
  Description of Artificial Sequence: Synthetic oligonucleotide
cgcagatacctggagaacgggaaggag

SEQ ID NO: 581 - DNA, 28 bp, Artificial Sequence
  Description of Artificial Sequence: Synthetic oligonucleotide
gcagatacctggagaacgggaaggagac

SEQ ID NO: 582 - DNA, 28 bp, Artificial Sequence
  Description of Artificial Sequence: Synthetic oligonucleotide
cagatacctggagaacgggaaggagacg

SEQ ID NO: 583 - DNA, 28 bp, Artificial Sequence
  Description of Artificial Sequence: Synthetic oligonucleotide
agatacctggagaacgggaaggagacgc

SEQ ID NO: 584 - DNA, 27 bp, Artificial Sequence
  Description of Artificial Sequence: Synthetic oligonucleotide
gatacctggagaacgggaaggagacgc

SEQ ID NO: 585 - DNA, 28 bp, Artificial Sequence
  Description of Artificial Sequence: Synthetic oligonucleotide
atacctggagaacgggaaggagacgctg

SEQ ID NO: 586 - DNA, 27 bp, Artificial Sequence
  Description of Artificial Sequence: Synthetic oligonucleotide
tacctggagaacgggaaggagacgctg

SEQ ID NO: 587 - DNA, 26 bp, Artificial Sequence
  Description of Artificial Sequence: Synthetic oligonucleotide
acctggagaacgggaaggagacgctg

SEQ ID NO: 588 - DNA, 25 bp, Artificial Sequence
  Description of Artificial Sequence: Synthetic oligonucleotide
cctggagaacgggaaggagacgctg

SEQ ID NO: 589 - DNA, 26 bp, Artificial Sequence
  Description of Artificial Sequence: Synthetic oligonucleotide
ctggagaacgggaaggagacgctgca

SEQ ID NO: 590 - DNA, 26 bp, Artificial Sequence
  Description of Artificial Sequence: Synthetic oligonucleotide
tggagaacgggaaggagacgctgcag

SEQ ID NO: 591 - DNA, 25 bp, Artificial Sequence
  Description of Artificial Sequence: Synthetic oligonucleotide
ggagaacgggaaggagacgctgcag

SEQ ID NO: 592 - DNA, 25 bp, Artificial Sequence
  Description of Artificial Sequence: Synthetic oligonucleotide
gagaacgggaaggagacgctgcagc

SEQ ID NO: 593 - DNA, 25 bp, Artificial Sequence
  Description of Artificial Sequence: Synthetic oligonucleotide
agaacgggaaggagacgctgcagcg

SEQ ID NO: 594 - DNA, 24 bp, Artificial Sequence
  Description of Artificial Sequence: Synthetic oligonucleotide
gaacgggaaggagacgctgcagcg

SEQ ID NO: 595 - DNA, 25 bp, Artificial Sequence
  Description of Artificial Sequence: Synthetic oligonucleotide
aacgggaaggagacgctgcagcgca

SEQ ID NO: 596 - DNA, 24 bp, Artificial Sequence
  Description of Artificial Sequence: Synthetic oligonucleotide
acgggaaggagacgctgcagcgca

SEQ ID NO: 597 - DNA, 23 bp, Artificial Sequence
  Description of Artificial Sequence: Synthetic oligonucleotide
cgggaaggagacgctgcagcgca

SEQ ID NO: 598 - DNA, 23 bp, Artificial Sequence
  Description of Artificial Sequence: Synthetic oligonucleotide
gggaaggagacgctgcagcgcac

SEQ ID NO: 599 - DNA, 23 bp, Artificial Sequence
  Description of Artificial Sequence: Synthetic oligonucleotide
ggaaggagacgctgcagcgcacg

SEQ ID NO: 600 - DNA, 24 bp, Artificial Sequence
  Description of Artificial Sequence: Synthetic oligonucleotide
gaaggagacgctgcagcgcacgga

SEQ ID NO: 601 - DNA, 24 bp, Artificial Sequence
  Description of Artificial Sequence: Synthetic oligonucleotide
aaggagacgctgcagcgcacggac

SEQ ID NO: 602 - DNA, 23 bp, Artificial Sequence
  Description of Artificial Sequence: Synthetic oligonucleotide
aggagacgctgcagcgcacggac

SEQ ID NO: 603 - DNA, 22 bp, Artificial Sequence
  Description of Artificial Sequence: Synthetic oligonucleotide
ggagacgctgcagcgcacggac

SEQ ID NO: 604 - DNA, 22 bp, Artificial Sequence
  Description of Artificial Sequence: Synthetic oligonucleotide
gagacgctgcagcgcacggacc

SEQ ID NO: 605 - DNA, 22 bp, Artificial Sequence
  Description of Artificial Sequence: Synthetic oligonucleotide
agacgctgcagcgcacggaccc

SEQ ID NO: 606 - DNA, 21 bp, Artificial Sequence
  Description of Artificial Sequence: Synthetic oligonucleotide
gacgctgcagcgcacggaccc

SEQ ID NO: 607 - DNA, 21 bp, Artificial Sequence
  Description of Artificial Sequence: Synthetic oligonucleotide
acgctgcagcgcacggacccc

SEQ ID NO: 608 - DNA, 20 bp, Artificial Sequence
  Description of Artificial Sequence: Synthetic oligonucleotide
cgctgcagcgcacggacccc

SEQ ID NO: 609 - DNA, 20 bp, Artificial Sequence
  Description of Artificial Sequence: Synthetic oligonucleotide
gctgcagcgcacggaccccc

SEQ ID NO: 610 - DNA, 20 bp, Artificial Sequence
  Description of Artificial Sequence: Synthetic oligonucleotide
ctgcagcgcacggacccccc

SEQ ID NO: 611 - DNA, 22 bp, Artificial Sequence
  Description of Artificial Sequence: Synthetic oligonucleotide
tgcagcgcacggacccccccaa

SEQ ID NO: 612 - DNA, 21 bp, Artificial Sequence
  Description of Artificial Sequence: Synthetic oligonucleotide
gcagcgcacggacccccccaa

SEQ ID NO: 613 - DNA, 22 bp, Artificial Sequence
  Description of Artificial Sequence: Synthetic oligonucleotide
cagcgcacggacccccccaaga

SEQ ID NO: 614 - DNA, 23 bp, Artificial Sequence
  Description of Artificial Sequence: Synthetic oligonucleotide
agcgcacggacccccccaagaca

SEQ ID NO: 615 - DNA, 22 bp, Artificial Sequence
  Description of Artificial Sequence: Synthetic oligonucleotide
gcgcacggacccccccaagaca

SEQ ID NO: 616 - DNA, 26 bp, Artificial Sequence
  Description of Artificial Sequence: Synthetic oligonucleotide
cgcacggacccccccaagacacatat

SEQ ID NO: 617 - DNA, 27 bp, Artificial Sequence
  Description of Artificial Sequence: Synthetic oligonucleotide
gcacggacccccccaagacacatatga

SEQ ID NO: 618 - DNA, 27 bp, Artificial Sequence
  Description of Artificial Sequence: Synthetic oligonucleotide
cacggacccccccaagacacatatgac

SEQ ID NO: 619 - DNA, 27 bp, Artificial Sequence
  Description of Artificial Sequence: Synthetic oligonucleotide
acggacccccccaagacacatatgacc

SEQ ID NO: 620 - DNA, 26 bp, Artificial Sequence
  Description of Artificial Sequence: Synthetic oligonucleotide
cggacccccccaagacacatatgacc

SEQ ID NO: 621 - DNA, 27 bp, Artificial Sequence
  Description of Artificial Sequence: Synthetic oligonucleotide
ggacccccccaagacacatatgaccca

SEQ ID NO: 622 - DNA, 27 bp, Artificial Sequence
  Description of Artificial Sequence: Synthetic oligonucleotide
gacccccccaagacacatatgacccac

SEQ ID NO: 623 - DNA, 27 bp, Artificial Sequence
  Description of Artificial Sequence: Synthetic oligonucleotide
acccccccaagacacatatgacccacc

SEQ ID NO: 624 - DNA, 27 bp, Artificial Sequence
  Description of Artificial Sequence: Synthetic oligonucleotide
cccccccaagacacatatgacccacca

SEQ ID NO: 625 - DNA, 27 bp, Artificial Sequence
  Description of Artificial Sequence: Synthetic oligonucleotide
ccccccaagacacatatgacccaccac

SEQ ID NO: 626 - DNA, 27 bp, Artificial Sequence
  Description of Artificial Sequence: Synthetic oligonucleotide
cccccaagacacatatgacccaccacc

SEQ ID NO: 627 - DNA, 27 bp, Artificial Sequence
  Description of Artificial Sequence: Synthetic oligonucleotide
ccccaagacacatatgacccaccaccc

SEQ ID NO: 628 - DNA, 27 bp, Artificial Sequence
  Description of Artificial Sequence: Synthetic oligonucleotide
cccaagacacatatgacccaccacccc

SEQ ID NO: 629 - DNA, 29 bp, Artificial Sequence
  Description of Artificial Sequence: Synthetic oligonucleotide
ccaagacacatatgacccaccaccccatc

SEQ ID NO: 630 - DNA, 30 bp, Artificial Sequence
  Description of Artificial Sequence: Synthetic oligonucleotide
caagacacatatgacccaccaccccatctc

SEQ ID NO: 631 - DNA, 31 bp, Artificial Sequence
  Description of Artificial Sequence: Synthetic oligonucleotide
aagacacatatgacccaccaccccatctctg

SEQ ID NO: 632 - DNA, 30 bp, Artificial Sequence
  Description of Artificial Sequence: Synthetic oligonucleotide
agacacatatgacccaccaccccatctctg

SEQ ID NO: 633 - DNA, 29 bp, Artificial Sequence
  Description of Artificial Sequence: Synthetic oligonucleotide
gacacatatgacccaccaccccatctctg

SEQ ID NO: 634 - DNA, 30 bp, Artificial Sequence
  Description of Artificial Sequence: Synthetic oligonucleotide
acacatatgacccaccaccccatctctgac

SEQ ID NO: 635 - DNA, 29 bp, Artificial Sequence
  Description of Artificial Sequence: Synthetic oligonucleotide
cacatatgacccaccaccccatctctgac

SEQ ID NO: 636 - DNA, 29 bp, Artificial Sequence
  Description of Artificial Sequence: Synthetic oligonucleotide
acatatgacccaccaccccatctctgacc

SEQ ID NO: 637 - DNA, 28 bp, Artificial Sequence
  Description of Artificial Sequence: Synthetic oligonucleotide
catatgacccaccaccccatctctgacc

SEQ ID NO: 638 - DNA, 30 bp, Artificial Sequence
  Description of Artificial Sequence: Synthetic oligonucleotide
atatgacccaccaccccatctctgaccatg

SEQ ID NO: 639 - DNA, 29 bp, Artificial Sequence
  Description of Artificial Sequence: Synthetic oligonucleotide
tatgacccaccaccccatctctgaccatg

SEQ ID NO: 640 - DNA, 28 bp, Artificial Sequence
  Description of Artificial Sequence: Synthetic oligonucleotide
atgacccaccaccccatctctgaccatg

SEQ ID NO: 641 - DNA, 27 bp, Artificial Sequence
  Description of Artificial Sequence: Synthetic oligonucleotide
tgacccaccaccccatctctgaccatg

SEQ ID NO: 642 - DNA, 27 bp, Artificial Sequence
  Description of Artificial Sequence: Synthetic oligonucleotide
gacccaccaccccatctctgaccatga

SEQ ID NO: 643 - DNA, 27 bp, Artificial Sequence
  Description of Artificial Sequence: Synthetic oligonucleotide
acccaccaccccatctctgaccatgag

SEQ ID NO: 644 - DNA, 26 bp, Artificial Sequence
  Description of Artificial Sequence: Synthetic oligonucleotide
cccaccaccccatctctgaccatgag

SEQ ID NO: 645 - DNA, 26 bp, Artificial Sequence
  Description of Artificial Sequence: Synthetic oligonucleotide
ccaccaccccatctctgaccatgagg

SEQ ID NO: 646 - DNA, 26 bp, Artificial Sequence
  Description of Artificial Sequence: Synthetic oligonucleotide
caccaccccatctctgaccatgaggc

SEQ ID NO: 647 - DNA, 27 bp, Artificial Sequence
  Description of Artificial Sequence: Synthetic oligonucleotide
accaccccatctctgaccatgaggcca

SEQ ID NO: 648 - DNA, 26 bp, Artificial Sequence
  Description of Artificial Sequence: Synthetic oligonucleotide
ccaccccatctctgaccatgaggcca

SEQ ID NO: 649 - DNA, 26 bp, Artificial Sequence
  Description of Artificial Sequence: Synthetic oligonucleotide
caccccatctctgaccatgaggccac

SEQ ID NO: 650 - DNA, 26 bp, Artificial Sequence
  Description of Artificial Sequence: Synthetic oligonucleotide
accccatctctgaccatgaggccacc

SEQ ID NO: 651 - DNA, 25 bp, Artificial Sequence
  Description of Artificial Sequence: Synthetic oligonucleotide
ccccatctctgaccatgaggccacc

SEQ ID NO: 652 - DNA, 26 bp, Artificial Sequence
  Description of Artificial Sequence: Synthetic oligonucleotide
cccatctctgaccatgaggccaccct

SEQ ID NO: 653 - DNA, 27 bp, Artificial Sequence
  Description of Artificial Sequence: Synthetic oligonucleotide
ccatctctgaccatgaggccaccctga

SEQ ID NO: 654 - DNA, 27 bp, Artificial Sequence
  Description of Artificial Sequence: Synthetic oligonucleotide
catctctgaccatgaggccaccctgag

SEQ ID NO: 655 - DNA, 27 bp, Artificial Sequence
  Description of Artificial Sequence: Synthetic oligonucleotide
atctctgaccatgaggccaccctgagg

SEQ ID NO: 656 - DNA, 27 bp, Artificial Sequence
  Description of Artificial Sequence: Synthetic oligonucleotide
tctctgaccatgaggccaccctgaggt

SEQ ID NO: 657 - DNA, 26 bp, Artificial Sequence
  Description of Artificial Sequence: Synthetic oligonucleotide
ctctgaccatgaggccaccctgaggt

SEQ ID NO: 658 - DNA, 26 bp, Artificial Sequence
  Description of Artificial Sequence: Synthetic oligonucleotide
tctgaccatgaggccaccctgaggtg

SEQ ID NO: 659 - DNA, 25 bp, Artificial Sequence
  Description of Artificial Sequence: Synthetic oligonucleotide
ctgaccatgaggccaccctgaggtg

SEQ ID NO: 660 - DNA, 26 bp, Artificial Sequence
  Description of Artificial Sequence: Synthetic oligonucleotide
tgaccatgaggccaccctgaggtgct

SEQ ID NO: 661 - DNA, 25 bp, Artificial Sequence
  Description of Artificial Sequence: Synthetic oligonucleotide
gaccatgaggccaccctgaggtgct

SEQ ID NO: 662 - DNA, 25 bp, Artificial Sequence
  Description of Artificial Sequence: Synthetic oligonucleotide
accatgaggccaccctgaggtgctg

SEQ ID NO: 663 - DNA, 24 bp, Artificial Sequence
  Description of Artificial Sequence: Synthetic oligonucleotide
ccatgaggccaccctgaggtgctg

SEQ ID NO: 664 - DNA, 24 bp, Artificial Sequence
  Description of Artificial Sequence: Synthetic oligonucleotide
catgaggccaccctgaggtgctgg

SEQ ID NO: 665 - DNA, 24 bp, Artificial Sequence
  Description of Artificial Sequence: Synthetic oligonucleotide
atgaggccaccctgaggtgctggg

SEQ ID NO: 666 - DNA, 23 bp, Artificial Sequence
  Description of Artificial Sequence: Synthetic oligonucleotide
tgaggccaccctgaggtgctggg

SEQ ID NO: 667 - DNA, 22 bp, Artificial Sequence
  Description of Artificial Sequence: Synthetic oligonucleotide
gaggccaccctgaggtgctggg

SEQ ID NO: 668 - DNA, 22 bp, Artificial Sequence
  Description of Artificial Sequence: Synthetic oligonucleotide
aggccaccctgaggtgctgggc

SEQ ID NO: 669 - DNA, 21 bp, Artificial Sequence
  Description of Artificial Sequence: Synthetic oligonucleotide
ggccaccctgaggtgctgggc

SEQ ID NO: 670 - DNA, 21 bp, Artificial Sequence
  Description of Artificial Sequence: Synthetic oligonucleotide
gccaccctgaggtgctgggcc

SEQ ID NO: 671 - DNA, 22 bp, Artificial Sequence
  Description of Artificial Sequence: Synthetic oligonucleotide
ccaccctgaggtgctgggccct

SEQ ID NO: 672 - DNA, 22 bp, Artificial Sequence
  Description of Artificial Sequence: Synthetic oligonucleotide
caccctgaggtgctgggccctg

SEQ ID NO: 673 - DNA, 22 bp, Artificial Sequence
  Description of Artificial Sequence: Synthetic oligonucleotide
accctgaggtgctgggccctgg

SEQ ID NO: 674 - DNA, 21 bp, Artificial Sequence
  Description of Artificial Sequence: Synthetic oligonucleotide
ccctgaggtgctgggccctgg

SEQ ID NO: 675 - DNA, 21 bp, Artificial Sequence
  Description of Artificial Sequence: Synthetic oligonucleotide
cctgaggtgctgggccctggg

SEQ ID NO: 676 - DNA, 23 bp, Artificial Sequence
  Description of Artificial Sequence: Synthetic oligonucleotide
ctgaggtgctgggccctgggctt

SEQ ID NO: 677 - DNA, 25 bp, Artificial Sequence
  Description of Artificial Sequence: Synthetic oligonucleotide
tgaggtgctgggccctgggcttcta

SEQ ID NO: 678 - DNA, 24 bp, Artificial Sequence
  Description of Artificial Sequence: Synthetic oligonucleotide
gaggtgctgggccctgggcttcta

SEQ ID NO: 679 - DNA, 24 bp, Artificial Sequence
  Description of Artificial Sequence: Synthetic oligonucleotide
aggtgctgggccctgggcttctac

SEQ ID NO: 680 - DNA, 23 bp, Artificial Sequence
  Description of Artificial Sequence: Synthetic oligonucleotide
ggtgctgggccctgggcttctac

SEQ ID NO: 681 - DNA, 23 bp, Artificial Sequence
  Description of Artificial Sequence: Synthetic oligonucleotide
gtgctgggccctgggcttctacc

SEQ ID NO: 682 - DNA, 24 bp, Artificial Sequence
  Description of Artificial Sequence: Synthetic oligonucleotide
tgctgggccctgggcttctaccct

SEQ ID NO: 683 - DNA, 23 bp, Artificial Sequence
  Description of Artificial Sequence: Synthetic oligonucleotide
gctgggccctgggcttctaccct

SEQ ID NO: 684 - DNA, 23 bp, Artificial Sequence
  Description of Artificial Sequence: Synthetic oligonucleotide
ctgggccctgggcttctaccctg

SEQ ID NO: 685 - DNA, 23 bp, Artificial Sequence
  Description of Artificial Sequence: Synthetic oligonucleotide
tgggccctgggcttctaccctgc

SEQ ID NO: 686 - DNA, 22 bp, Artificial Sequence
  Description of Artificial Sequence: Synthetic oligonucleotide
gggccctgggcttctaccctgc

SEQ ID NO: 687 - DNA, 22 bp, Artificial Sequence
  Description of Artificial Sequence: Synthetic oligonucleotide
ggccctgggcttctaccctgcg

SEQ ID NO: 688 - DNA, 23 bp, Artificial Sequence
  Description of Artificial Sequence: Synthetic oligonucleotide
gccctgggcttctaccctgcgga

SEQ ID NO: 689 - DNA, 25 bp, Artificial Sequence
  Description of Artificial Sequence: Synthetic oligonucleotide
ccctgggcttctaccctgcggagat

SEQ ID NO: 690 - DNA, 26 bp, Artificial Sequence
  Description of Artificial Sequence: Synthetic oligonucleotide
cctgggcttctaccctgcggagatca

SEQ ID NO: 691 - DNA, 27 bp, Artificial Sequence
  Description of Artificial Sequence: Synthetic oligonucleotide
ctgggcttctaccctgcggagatcaca

SEQ ID NO: 692 - DNA, 27 bp, Artificial Sequence
  Description of Artificial Sequence: Synthetic oligonucleotide
tgggcttctaccctgcggagatcacac

SEQ ID NO: 693 - DNA, 27 bp, Artificial Sequence
  Description of Artificial Sequence: Synthetic oligonucleotide
gggcttctaccctgcggagatcacact

SEQ ID NO: 694 - DNA, 27 bp, Artificial Sequence
  Description of Artificial Sequence: Synthetic oligonucleotide
ggcttctaccctgcggagatcacactg

SEQ ID NO: 695 - DNA, 28 bp, Artificial Sequence
  Description of Artificial Sequence: Synthetic oligonucleotide
gcttctaccctgcggagatcacactgac

SEQ ID NO: 696 - DNA, 28 bp, Artificial Sequence
  Description of Artificial Sequence: Synthetic oligonucleotide
cttctaccctgcggagatcacactgacc

SEQ ID NO: 697 - DNA, 29 bp, Artificial Sequence
  Description of Artificial Sequence: Synthetic oligonucleotide
ttctaccctgcggagatcacactgacctg

SEQ ID NO: 698 - DNA, 28 bp, Artificial Sequence
  Description of Artificial Sequence: Synthetic oligonucleotide
tctaccctgcggagatcacactgacctg

SEQ ID NO: 699 - DNA, 27 bp, Artificial Sequence
  Description of Artificial Sequence: Synthetic oligonucleotide
ctaccctgcggagatcacactgacctg

SEQ ID NO: 700 - DNA, 27 bp, Artificial Sequence
  Description of Artificial Sequence: Synthetic oligonucleotide
taccctgcggagatcacactgacctgg

SEQ ID NO: 701 - DNA, 26 bp, Artificial Sequence
  Description of Artificial Sequence: Synthetic oligonucleotide
accctgcggagatcacactgacctgg

SEQ ID NO: 702 - DNA, 25 bp, Artificial Sequence
  Description of Artificial Sequence: Synthetic oligonucleotide
ccctgcggagatcacactgacctgg

SEQ ID NO: 703 - DNA, 26 bp, Artificial Sequence
  Description of Artificial Sequence: Synthetic oligonucleotide
cctgcggagatcacactgacctggca

SEQ ID NO: 704 - DNA, 26 bp, Artificial Sequence
  Description of Artificial Sequence: Synthetic oligonucleotide
ctgcggagatcacactgacctggcag

SEQ ID NO: 705 - DNA, 26 bp, Artificial Sequence
  Description of Artificial Sequence: Synthetic oligonucleotide
tgcggagatcacactgacctggcagc

SEQ ID NO: 706 - DNA, 25 bp, Artificial Sequence
  Description of Artificial Sequence: Synthetic oligonucleotide
gcggagatcacactgacctggcagc

SEQ ID NO: 707 - DNA, 25 bp, Artificial Sequence
  Description of Artificial Sequence: Synthetic oligonucleotide
cggagatcacactgacctggcagcg

SEQ ID NO: 708 - DNA, 25 bp, Artificial Sequence
  Description of Artificial Sequence: Synthetic oligonucleotide
ggagatcacactgacctggcagcgg

SEQ ID NO: 709 - DNA, 27 bp, Artificial Sequence
  Description of Artificial Sequence: Synthetic oligonucleotide
gagatcacactgacctggcagcgggat

SEQ ID NO: 710 - DNA, 27 bp, Artificial Sequence
  Description of Artificial Sequence: Synthetic oligonucleotide
agatcacactgacctggcagcgggatg

SEQ ID NO: 711 - DNA, 26 bp, Artificial Sequence
  Description of Artificial Sequence: Synthetic oligonucleotide
gatcacactgacctggcagcgggatg

SEQ ID NO: 712 - DNA, 26 bp, Artificial Sequence
  Description of Artificial Sequence: Synthetic oligonucleotide
atcacactgacctggcagcgggatgg

SEQ ID NO: 713 - DNA, 25 bp, Artificial Sequence
  Description of Artificial Sequence: Synthetic oligonucleotide
tcacactgacctggcagcgggatgg

SEQ ID NO: 714 - DNA, 24 bp, Artificial Sequence
  Description of Artificial Sequence: Synthetic oligonucleotide
cacactgacctggcagcgggatgg

SEQ ID NO: 715 - DNA, 24 bp, Artificial Sequence
  Description of Artificial Sequence: Synthetic oligonucleotide
acactgacctggcagcgggatggg

SEQ ID NO: 716 - DNA, 23 bp, Artificial Sequence
  Description of Artificial Sequence: Synthetic oligonucleotide
cactgacctggcagcgggatggg

SEQ ID NO: 717 - DNA, 24 bp, Artificial Sequence
  Description of Artificial Sequence: Synthetic oligonucleotide
actgacctggcagcgggatgggga

SEQ ID NO: 718 - DNA, 23 bp, Artificial Sequence
  Description of Artificial Sequence: Synthetic oligonucleotide
ctgacctggcagcgggatgggga

SEQ ID NO: 719 - DNA, 23 bp, Artificial Sequence
  Description of Artificial Sequence: Synthetic oligonucleotide
tgacctggcagcgggatggggag

SEQ ID NO: 720 - DNA, 22 bp, Artificial Sequence
  Description of Artificial Sequence: Synthetic oligonucleotide
gacctggcagcgggatggggag

SEQ ID NO: 721 - DNA, 23 bp, Artificial Sequence
  Description of Artificial Sequence: Synthetic oligonucleotide
acctggcagcgggatggggagga

SEQ ID NO: 722 - DNA, 22 bp, Artificial Sequence
  Description of Artificial Sequence: Synthetic oligonucleotide
cctggcagcgggatggggagga

SEQ ID NO: 723 - DNA, 22 bp, Artificial Sequence
  Description of Artificial Sequence: Synthetic oligonucleotide
ctggcagcgggatggggaggac

SEQ ID NO: 724 - DNA, 23 bp, Artificial Sequence
  Description of Artificial Sequence: Synthetic oligonucleotide
tggcagcgggatggggaggacca

SEQ ID NO: 725 - DNA, 22 bp, Artificial Sequence
  Description of Artificial Sequence: Synthetic oligonucleotide
ggcagcgggatggggaggacca

SEQ ID NO: 726 - DNA, 23 bp, Artificial Sequence
  Description of Artificial Sequence: Synthetic oligonucleotide
gcagcgggatggggaggaccaga

SEQ ID NO: 727 - DNA, 23 bp, Artificial Sequence
  Description of Artificial Sequence: Synthetic oligonucleotide
cagcgggatggggaggaccagac

SEQ ID NO: 728 - DNA, 23 bp, Artificial Sequence
  Description of Artificial Sequence: Synthetic oligonucleotide
agcgggatggggaggaccagacc

SEQ ID NO: 729 - DNA, 22 bp, Artificial Sequence
  Description of Artificial Sequence: Synthetic oligonucleotide
gcgggatggggaggaccagacc

SEQ ID NO: 730 - DNA, 23 bp, Artificial Sequence
  Description of Artificial Sequence: Synthetic oligonucleotide
cgggatggggaggaccagaccca

SEQ ID NO: 731 - DNA, 23 bp, Artificial Sequence
  Description of Artificial Sequence: Synthetic oligonucleotide
gggatggggaggaccagacccag

SEQ ID NO: 732 - DNA, 24 bp, Artificial Sequence
  Description of Artificial Sequence: Synthetic oligonucleotide
ggatggggaggaccagacccagga

SEQ ID NO: 733 - DNA, 25 bp, Artificial Sequence
  Description of Artificial Sequence: Synthetic oligonucleotide
gatggggaggaccagacccaggaca

SEQ ID NO: 734 - DNA, 25 bp, Artificial Sequence
  Description of Artificial Sequence: Synthetic oligonucleotide
atggggaggaccagacccaggacac

SEQ ID NO: 735 - DNA, 24 bp, Artificial Sequence
  Description of Artificial Sequence: Synthetic oligonucleotide
tggggaggaccagacccaggacac

SEQ ID NO: 736 - DNA, 23 bp, Artificial Sequence
  Description of Artificial Sequence: Synthetic oligonucleotide
ggggaggaccagacccaggacac

SEQ ID NO: 737 - DNA, 23 bp, Artificial Sequence
  Description of Artificial Sequence: Synthetic oligonucleotide
gggaggaccagacccaggacacg

SEQ ID NO: 738 - DNA, 24 bp, Artificial Sequence
  Description of Artificial Sequence: Synthetic oligonucleotide
ggaggaccagacccaggacacgga

SEQ ID NO: 739 - DNA, 24 bp, Artificial Sequence
  Description of Artificial Sequence: Synthetic oligonucleotide
gaggaccagacccaggacacggag

SEQ ID NO: 740 - DNA, 25 bp, Artificial Sequence
  Description of Artificial Sequence: Synthetic oligonucleotide
aggaccagacccaggacacggagct

SEQ ID NO: 741 - DNA, 24 bp, Artificial Sequence
  Description of Artificial Sequence: Synthetic oligonucleotide
ggaccagacccaggacacggagct

SEQ ID NO: 742 - DNA, 24 bp, Artificial Sequence
  Description of Artificial Sequence: Synthetic oligonucleotide
gaccagacccaggacacggagctc

SEQ ID NO: 743 - DNA, 25 bp, Artificial Sequence
  Description of Artificial Sequence: Synthetic oligonucleotide
accagacccaggacacggagctcgt

SEQ ID NO: 744 - DNA, 24 bp, Artificial Sequence
  Description of Artificial Sequence: Synthetic oligonucleotide
ccagacccaggacacggagctcgt

SEQ ID NO: 745 - DNA, 24 bp, Artificial Sequence
  Description of Artificial Sequence: Synthetic oligonucleotide
cagacccaggacacggagctcgtg

SEQ ID NO: 746 - DNA, 25 bp, Artificial Sequence
  Description of Artificial Sequence: Synthetic oligonucleotide
agacccaggacacggagctcgtgga

SEQ ID NO: 747 - DNA, 24 bp, Artificial Sequence
  Description of Artificial Sequence: Synthetic oligonucleotide
gacccaggacacggagctcgtgga

SEQ ID NO: 748 - DNA, 25 bp, Artificial Sequence
  Description of Artificial Sequence: Synthetic oligonucleotide
acccaggacacggagctcgtggaga

SEQ ID NO: 749 - DNA, 24 bp, Artificial Sequence
  Description of Artificial Sequence: Synthetic oligonucleotide
cccaggacacggagctcgtggaga

SEQ ID NO: 750 - DNA, 24 bp, Artificial Sequence
  Description of Artificial Sequence: Synthetic oligonucleotide
ccaggacacggagctcgtggagac

SEQ ID NO: 751 - DNA, 25 bp, Artificial Sequence
  Description of Artificial Sequence: Synthetic oligonucleotide
caggacacggagctcgtggagacca

SEQ ID NO: 752 - DNA, 25 bp, Artificial Sequence
  Description of Artificial Sequence: Synthetic oligonucleotide
aggacacggagctcgtggagaccag

SEQ ID NO: 753 - DNA, 24 bp, Artificial Sequence
  Description of Artificial Sequence: Synthetic oligonucleotide
ggacacggagctcgtggagaccag

SEQ ID NO: 754 - DNA, 24 bp, Artificial Sequence
  Description of Artificial Sequence: Synthetic oligonucleotide
gacacggagctcgtggagaccagg

SEQ ID NO: 755 - DNA, 24 bp, Artificial Sequence
  Description of Artificial Sequence: Synthetic oligonucleotide
acacggagctcgtggagaccaggc

SEQ ID NO: 756 - DNA, 23 bp, Artificial Sequence
  Description of Artificial Sequence: Synthetic oligonucleotide
cacggagctcgtggagaccaggc

SEQ ID NO: 757 - DNA, 24 bp, Artificial Sequence
  Description of Artificial Sequence: Synthetic oligonucleotide
acggagctcgtggagaccaggcct

SEQ ID NO: 758 - DNA, 23 bp, Artificial Sequence
  Description of Artificial Sequence: Synthetic oligonucleotide
cggagctcgtggagaccaggcct

SEQ ID NO: 759 - DNA, 23 bp, Artificial Sequence
  Description of Artificial Sequence: Synthetic oligonucleotide
ggagctcgtggagaccaggcctg

SEQ ID NO: 760 - DNA, 24 bp, Artificial Sequence
  Description of Artificial Sequence: Synthetic oligonucleotide
gagctcgtggagaccaggcctgca

SEQ ID NO: 761 - DNA, 24 bp, Artificial Sequence
  Description of Artificial Sequence: Synthetic oligonucleotide
agctcgtggagaccaggcctgcag

SEQ ID NO: 762 - DNA, 23 bp, Artificial Sequence
  Description of Artificial Sequence: Synthetic oligonucleotide
gctcgtggagaccaggcctgcag

SEQ ID NO: 763 - DNA, 23 bp, Artificial Sequence
  Description of Artificial Sequence: Synthetic oligonucleotide
ctcgtggagaccaggcctgcagg

SEQ ID NO: 764 - DNA, 23 bp, Artificial Sequence
  Description of Artificial Sequence: Synthetic oligonucleotide
tcgtggagaccaggcctgcaggg

SEQ ID NO: 765 - DNA, 22 bp, Artificial Sequence
  Description of Artificial Sequence: Synthetic oligonucleotide
cgtggagaccaggcctgcaggg

SEQ ID NO: 766 - DNA, 24 bp, Artificial Sequence
  Description of Artificial Sequence: Synthetic oligonucleotide
gtggagaccaggcctgcaggggat

SEQ ID NO: 767 - DNA, 24 bp, Artificial Sequence
  Description of Artificial Sequence: Synthetic oligonucleotide
tggagaccaggcctgcaggggatg

SEQ ID NO: 768 - DNA, 23 bp, Artificial Sequence
  Description of Artificial Sequence: Synthetic oligonucleotide
ggagaccaggcctgcaggggatg

SEQ ID NO: 769 - DNA, 25 bp, Artificial Sequence
  Description of Artificial Sequence: Synthetic oligonucleotide
gagaccaggcctgcaggggatggaa

SEQ ID NO: 770 - DNA, 25 bp, Artificial Sequence
  Description of Artificial Sequence: Synthetic oligonucleotide
agaccaggcctgcaggggatggaac

SEQ ID NO: 771 - DNA, 24 bp, Artificial Sequence
  Description of Artificial Sequence: Synthetic oligonucleotide
gaccaggcctgcaggggatggaac

SEQ ID NO: 772 - DNA, 26 bp, Artificial Sequence
  Description of Artificial Sequence: Synthetic oligonucleotide
accaggcctgcaggggatggaacctt

SEQ ID NO: 773 - DNA, 25 bp, Artificial Sequence
  Description of Artificial Sequence: Synthetic oligonucleotide
ccaggcctgcaggggatggaacctt

SEQ ID NO: 774 - DNA, 25 bp, Artificial Sequence
  Description of Artificial Sequence: Synthetic oligonucleotide
caggcctgcaggggatggaaccttc

SEQ ID NO: 775 - DNA, 26 bp, Artificial Sequence
  Description of Artificial Sequence: Synthetic oligonucleotide
aggcctgcaggggatggaaccttcca

SEQ ID NO: 776 - DNA, 25 bp, Artificial Sequence
  Description of Artificial Sequence: Synthetic oligonucleotide
ggcctgcaggggatggaaccttcca

SEQ ID NO: 777 - DNA, 27 bp, Artificial Sequence
  Description of Artificial Sequence: Synthetic oligonucleotide
gcctgcaggggatggaaccttccagaa

SEQ ID NO: 778 - DNA, 27 bp, Artificial Sequence
  Description of Artificial Sequence: Synthetic oligonucleotide
cctgcaggggatggaaccttccagaag

SEQ ID NO: 779 - DNA, 28 bp, Artificial Sequence
  Description of Artificial Sequence: Synthetic oligonucleotide
ctgcaggggatggaaccttccagaagtg

SEQ ID NO: 780 - DNA, 28 bp, Artificial Sequence
  Description of Artificial Sequence: Synthetic oligonucleotide
tgcaggggatggaaccttccagaagtgg

SEQ ID NO: 781 - DNA, 27 bp, Artificial Sequence
  Description of Artificial Sequence: Synthetic oligonucleotide
gcaggggatggaaccttccagaagtgg

SEQ ID NO: 782 - DNA, 27 bp, Artificial Sequence
  Description of Artificial Sequence: Synthetic oligonucleotide
caggggatggaaccttccagaagtggg

SEQ ID NO: 783 - DNA, 27 bp, Artificial Sequence
  Description of Artificial Sequence: Synthetic oligonucleotide
aggggatggaaccttccagaagtgggc

SEQ ID NO: 784 - DNA, 26 bp, Artificial Sequence
  Description of Artificial Sequence: Synthetic oligonucleotide
ggggatggaaccttccagaagtgggc

SEQ ID NO: 785 - DNA, 26 bp, Artificial Sequence
  Description of Artificial Sequence: Synthetic oligonucleotide
gggatggaaccttccagaagtgggcg

SEQ ID NO: 786 - DNA, 26 bp, Artificial Sequence
  Description of Artificial Sequence: Synthetic oligonucleotide
ggatggaaccttccagaagtgggcgg

SEQ ID NO: 787 - DNA, 27 bp, Artificial Sequence
  Description of Artificial Sequence: Synthetic oligonucleotide
gatggaaccttccagaagtgggcggct

SEQ ID NO: 788 - DNA, 27 bp, Artificial Sequence
  Description of Artificial Sequence: Synthetic oligonucleotide
atggaaccttccagaagtgggcggctg

SEQ ID NO: 789 - DNA, 27 bp, Artificial Sequence
  Description of Artificial Sequence: Synthetic oligonucleotide
tggaaccttccagaagtgggcggctgt

SEQ ID NO: 790 - DNA, 26 bp, Artificial Sequence
  Description of Artificial Sequence: Synthetic oligonucleotide
ggaaccttccagaagtgggcggctgt

SEQ ID NO: 791 - DNA, 26 bp, Artificial Sequence
  Description of Artificial Sequence: Synthetic oligonucleotide
gaaccttccagaagtgggcggctgtg

SEQ ID NO: 792 - DNA, 27 bp, Artificial Sequence
  Description of Artificial Sequence: Synthetic oligonucleotide
aaccttccagaagtgggcggctgtggt

SEQ ID NO: 793 - DNA, 26 bp, Artificial Sequence
  Description of Artificial Sequence: Synthetic oligonucleotide
accttccagaagtgggcggctgtggt

SEQ ID NO: 794 - DNA, 25 bp, Artificial Sequence
  Description of Artificial Sequence: Synthetic oligonucleotide
ccttccagaagtgggcggctgtggt

SEQ ID NO: 795 - DNA, 25 bp, Artificial Sequence
  Description of Artificial Sequence: Synthetic oligonucleotide
cttccagaagtgggcggctgtggtg

SEQ ID NO: 796 - DNA, 26 bp, Artificial Sequence
  Description of Artificial Sequence: Synthetic oligonucleotide
ttccagaagtgggcggctgtggtggt

SEQ ID NO: 797 - DNA, 25 bp, Artificial Sequence
  Description of Artificial Sequence: Synthetic oligonucleotide
tccagaagtgggcggctgtggtggt

SEQ ID NO: 798 - DNA, 24 bp, Artificial Sequence
  Description of Artificial Sequence: Synthetic oligonucleotide
ccagaagtgggcggctgtggtggt

SEQ ID NO: 799 - DNA, 24 bp, Artificial Sequence
  Description of Artificial Sequence: Synthetic oligonucleotide
cagaagtgggcggctgtggtggtg

SEQ ID NO: 800 - DNA, 24 bp, Artificial Sequence
  Description of Artificial Sequence: Synthetic oligonucleotide
agaagtgggcggctgtggtggtgc

SEQ ID NO: 801 - DNA, 23 bp, Artificial Sequence
  Description of Artificial Sequence: Synthetic oligonucleotide
gaagtgggcggctgtggtggtgc

SEQ ID NO: 802 - DNA, 25 bp, Artificial Sequence
  Description of Artificial Sequence: Synthetic oligonucleotide
aagtgggcggctgtggtggtgcctt

SEQ ID NO: 803 - DNA, 24 bp, Artificial Sequence
  Description of Artificial Sequence: Synthetic oligonucleotide
agtgggcggctgtggtggtgcctt

SEQ ID NO: 804 - DNA, 23 bp, Artificial Sequence
  Description of Artificial Sequence: Synthetic oligonucleotide
gtgggcggctgtggtggtgcctt

SEQ ID NO: 805 - DNA, 24 bp, Artificial Sequence
  Description of Artificial Sequence: Synthetic oligonucleotide
tgggcggctgtggtggtgccttct

SEQ ID NO: 806 - DNA, 23 bp, Artificial Sequence
  Description of Artificial Sequence: Synthetic oligonucleotide
gggcggctgtggtggtgccttct

SEQ ID NO: 807 - DNA, 23 bp, Artificial Sequence
  Description of Artificial Sequence: Synthetic oligonucleotide
ggcggctgtggtggtgccttctg

SEQ ID NO: 808 - DNA, 24 bp, Artificial Sequence
  Description of Artificial Sequence: Synthetic oligonucleotide
gcggctgtggtggtgccttctgga

SEQ ID NO: 809 - DNA, 25 bp, Artificial Sequence
  Description of Artificial Sequence: Synthetic oligonucleotide
cggctgtggtggtgccttctggaga

SEQ ID NO: 810 - DNA, 25 bp, Artificial Sequence
  Description of Artificial Sequence: Synthetic oligonucleotide
ggctgtggtggtgccttctggagag

SEQ ID NO: 811 - DNA, 26 bp, Artificial Sequence
  Description of Artificial Sequence: Synthetic oligonucleotide
gctgtggtggtgccttctggagagga

SEQ ID NO: 812 - DNA, 26 bp, Artificial Sequence
  Description of Artificial Sequence: Synthetic oligonucleotide
ctgtggtggtgccttctggagaggag

SEQ ID NO: 813 - DNA, 27 bp, Artificial Sequence
  Description of Artificial Sequence: Synthetic oligonucleotide
tgtggtggtgccttctggagaggagca

SEQ ID NO: 814 - DNA, 26 bp, Artificial Sequence
  Description of Artificial Sequence: Synthetic oligonucleotide
gtggtggtgccttctggagaggagca

SEQ ID NO: 815 - DNA, 27 bp, Artificial Sequence
  Description of Artificial Sequence: Synthetic oligonucleotide
tggtggtgccttctggagaggagcaga

SEQ ID NO: 816 - DNA, 26 bp, Artificial Sequence
  Description of Artificial Sequence: Synthetic oligonucleotide
ggtggtgccttctggagaggagcaga

SEQ ID NO: 817 - DNA, 27 bp, Artificial Sequence
  Description of Artificial Sequence: Synthetic oligonucleotide
gtggtgccttctggagaggagcagaga

SEQ ID NO: 818 - DNA, 29 bp, Artificial Sequence
  Description of Artificial Sequence: Synthetic oligonucleotide
tggtgccttctggagaggagcagagatac

SEQ ID NO: 819 - DNA, 28 bp, Artificial Sequence
  Description of Artificial Sequence: Synthetic oligonucleotide
ggtgccttctggagaggagcagagatac

SEQ ID NO: 820 - DNA, 29 bp, Artificial Sequence
  Description of Artificial Sequence: Synthetic oligonucleotide
gtgccttctggagaggagcagagatacac

SEQ ID NO: 821 - DNA, 29 bp, Artificial Sequence
  Description of Artificial Sequence: Synthetic oligonucleotide
tgccttctggagaggagcagagatacacc

SEQ ID NO: 822 - DNA, 28 bp, Artificial Sequence
  Description of Artificial Sequence: Synthetic oligonucleotide
gccttctggagaggagcagagatacacc

SEQ ID NO: 823 - DNA, 29 bp, Artificial Sequence
  Description of Artificial Sequence: Synthetic oligonucleotide
ccttctggagaggagcagagatacacctg

SEQ ID NO: 824 - DNA, 29 bp, Artificial Sequence
  Description of Artificial Sequence: Synthetic oligonucleotide
cttctggagaggagcagagatacacctgc

SEQ ID NO: 825 - DNA, 29 bp, Artificial Sequence
  Description of Artificial Sequence: Synthetic oligonucleotide
ttctggagaggagcagagatacacctgcc

SEQ ID NO: 826 - DNA, 28 bp, Artificial Sequence
  Description of Artificial Sequence: Synthetic oligonucleotide
tctggagaggagcagagatacacctgcc

SEQ ID NO: 827 - DNA, 27 bp, Artificial Sequence
  Description of Artificial Sequence: Synthetic oligonucleotide
ctggagaggagcagagatacacctgcc

SEQ ID NO: 828 - DNA, 29 bp, Artificial Sequence
  Description of Artificial Sequence: Synthetic oligonucleotide
tggagaggagcagagatacacctgccatg

SEQ ID NO: 829 - DNA, 28 bp, Artificial Sequence
  Description of Artificial Sequence: Synthetic oligonucleotide
ggagaggagcagagatacacctgccatg

SEQ ID NO: 830 - DNA, 29 bp, Artificial Sequence
  Description of Artificial Sequence: Synthetic oligonucleotide
gagaggagcagagatacacctgccatgtg

SEQ ID NO: 831 - DNA, 29 bp, Artificial Sequence
  Description of Artificial Sequence: Synthetic oligonucleotide
agaggagcagagatacacctgccatgtgc

SEQ ID NO: 832 - DNA, 28 bp, Artificial Sequence
  Description of Artificial Sequence: Synthetic oligonucleotide
gaggagcagagatacacctgccatgtgc

SEQ ID NO: 833 - DNA, 29 bp, Artificial Sequence
  Description of Artificial Sequence: Synthetic oligonucleotide
aggagcagagatacacctgccatgtgcag

SEQ ID NO: 834 - DNA, 28 bp, Artificial Sequence
  Description of Artificial Sequence: Synthetic oligonucleotide
ggagcagagatacacctgccatgtgcag

SEQ ID NO: 835 - DNA, 28 bp, Artificial Sequence
  Description of Artificial Sequence: Synthetic oligonucleotide
gagcagagatacacctgccatgtgcagc

SEQ ID NO: 836 - DNA, 30 bp, Artificial Sequence
  Description of Artificial Sequence: Synthetic oligonucleotide
agcagagatacacctgccatgtgcagcatg

SEQ ID NO: 837 - DNA, 29 bp, Artificial Sequence
  Description of Artificial Sequence: Synthetic oligonucleotide
gcagagatacacctgccatgtgcagcatg

SEQ ID NO: 838 - DNA, 30 bp, Artificial Sequence
  Description of Artificial Sequence: Synthetic oligonucleotide
cagagatacacctgccatgtgcagcatgag

SEQ ID NO: 839 - DNA, 30 bp, Artificial Sequence
  Description of Artificial Sequence: Synthetic oligonucleotide
agagatacacctgccatgtgcagcatgagg

SEQ ID NO: 840 - DNA, 29 bp, Artificial Sequence
  Description of Artificial Sequence: Synthetic oligonucleotide
gagatacacctgccatgtgcagcatgagg

SEQ ID NO: 841 - DNA, 29 bp, Artificial Sequence
  Description of Artificial Sequence: Synthetic oligonucleotide
agatacacctgccatgtgcagcatgaggg

SEQ ID NO: 842 - DNA, 28 bp, Artificial Sequence
  Description of Artificial Sequence: Synthetic oligonucleotide
gatacacctgccatgtgcagcatgaggg

SEQ ID NO: 843 - DNA, 29 bp, Artificial Sequence
  Description of Artificial Sequence: Synthetic oligonucleotide
atacacctgccatgtgcagcatgagggtc

SEQ ID NO: 844 - DNA, 28 bp, Artificial Sequence
  Description of Artificial Sequence: Synthetic oligonucleotide
tacacctgccatgtgcagcatgagggtc

SEQ ID NO: 845 - DNA, 27 bp, Artificial Sequence
  Description of Artificial Sequence: Synthetic oligonucleotide
acacctgccatgtgcagcatgagggtc

SEQ ID NO: 846 - DNA, 27 bp, Artificial Sequence
  Description of Artificial Sequence: Synthetic oligonucleotide
cacctgccatgtgcagcatgagggtct

SEQ ID NO: 847 - DNA, 27 bp, Artificial Sequence
  Description of Artificial Sequence: Synthetic oligonucleotide
acctgccatgtgcagcatgagggtctg

SEQ ID NO: 848 - DNA, 26 bp, Artificial Sequence
  Description of Artificial Sequence: Synthetic oligonucleotide
cctgccatgtgcagcatgagggtctg

SEQ ID NO: 849 - DNA, 26 bp, Artificial Sequence
  Description of Artificial Sequence: Synthetic oligonucleotide
ctgccatgtgcagcatgagggtctgc

SEQ ID NO: 850 - DNA, 26 bp, Artificial Sequence
  Description of Artificial Sequence: Synthetic oligonucleotide
tgccatgtgcagcatgagggtctgcc

SEQ ID NO: 851 - DNA, 25 bp, Artificial Sequence
  Description of Artificial Sequence: Synthetic oligonucleotide
gccatgtgcagcatgagggtctgcc

SEQ ID NO: 852 - DNA, 27 bp, Artificial Sequence
  Description of Artificial Sequence: Synthetic oligonucleotide
ccatgtgcagcatgagggtctgcccaa

SEQ ID NO: 853 - DNA, 27 bp, Artificial Sequence
  Description of Artificial Sequence: Synthetic oligonucleotide
catgtgcagcatgagggtctgcccaag

SEQ ID NO: 854 - DNA, 27 bp, Artificial Sequence
  Description of Artificial Sequence: Synthetic oligonucleotide
atgtgcagcatgagggtctgcccaagc

SEQ ID NO: 855 - DNA, 26 bp, Artificial Sequence
  Description of Artificial Sequence: Synthetic oligonucleotide
tgtgcagcatgagggtctgcccaagc

SEQ ID NO: 856 - DNA, 25 bp, Artificial Sequence
  Description of Artificial Sequence: Synthetic oligonucleotide
gtgcagcatgagggtctgcccaagc

SEQ ID NO: 857 - DNA, 25 bp, Artificial Sequence
  Description of Artificial Sequence: Synthetic oligonucleotide
tgcagcatgagggtctgcccaagcc

SEQ ID NO: 858 - DNA, 24 bp, Artificial Sequence
  Description of Artificial Sequence: Synthetic oligonucleotide
gcagcatgagggtctgcccaagcc

SEQ ID NO: 859 - DNA, 24 bp, Artificial Sequence
  Description of Artificial Sequence: Synthetic oligonucleotide
cagcatgagggtctgcccaagccc

SEQ ID NO: 860 - DNA, 25 bp, Artificial Sequence
  Description of Artificial Sequence: Synthetic oligonucleotide
agcatgagggtctgcccaagcccct

SEQ ID NO: 861 - DNA, 24 bp, Artificial Sequence
  Description of Artificial Sequence: Synthetic oligonucleotide
gcatgagggtctgcccaagcccct

SEQ ID NO: 862 - DNA, 25 bp, Artificial Sequence
  Description of Artificial Sequence: Synthetic oligonucleotide
catgagggtctgcccaagcccctca

SEQ ID NO: 863 - DNA, 25 bp, Artificial Sequence
  Description of Artificial Sequence: Synthetic oligonucleotide
atgagggtctgcccaagcccctcac

SEQ ID NO: 864 - DNA, 24 bp, Artificial Sequence
  Description of Artificial Sequence: Synthetic oligonucleotide
tgagggtctgcccaagcccctcac

SEQ ID NO: 865 - DNA, 23 bp, Artificial Sequence
  Description of Artificial Sequence: Synthetic oligonucleotide
gagggtctgcccaagcccctcac

SEQ ID NO: 866 - DNA, 23 bp, Artificial Sequence
  Description of Artificial Sequence: Synthetic oligonucleotide
agggtctgcccaagcccctcacc

SEQ ID NO: 867 - DNA, 22 bp, Artificial Sequence
  Description of Artificial Sequence: Synthetic oligonucleotide
gggtctgcccaagcccctcacc

SEQ ID NO: 868 - DNA, 23 bp, Artificial Sequence
  Description of Artificial Sequence: Synthetic oligonucleotide
ggtctgcccaagcccctcaccct

SEQ ID NO: 869 - DNA, 24 bp, Artificial Sequence
  Description of Artificial Sequence: Synthetic oligonucleotide
gtctgcccaagcccctcaccctga

SEQ ID NO: 870 - DNA, 26 bp, Artificial Sequence
  Description of Artificial Sequence: Synthetic oligonucleotide
tctgcccaagcccctcaccctgagat

SEQ ID NO: 871 - DNA, 25 bp, Artificial Sequence
  Description of Artificial Sequence: Synthetic oligonucleotide
ctgcccaagcccctcaccctgagat

SEQ ID NO: 872 - DNA, 25 bp, Artificial Sequence
  Description of Artificial Sequence: Synthetic oligonucleotide
tgcccaagcccctcaccctgagatg

SEQ ID NO: 873 - DNA, 24 bp, Artificial Sequence
  Description of Artificial Sequence: Synthetic oligonucleotide
gcccaagcccctcaccctgagatg

SEQ ID NO: 874 - DNA, 24 bp, Artificial Sequence
  Description of Artificial Sequence: Synthetic oligonucleotide
cccaagcccctcaccctgagatgg

SEQ ID NO: 875 - DNA, 25 bp, Artificial Sequence
  Description of Artificial Sequence: Synthetic oligonucleotide
ccaagcccctcaccctgagatggga

SEQ ID NO: 876 - DNA, 25 bp, Artificial Sequence
  Description of Artificial Sequence: Synthetic oligonucleotide
caagcccctcaccctgagatgggag

SEQ ID NO: 877 - DNA, 26 bp, Artificial Sequence
  Description of Artificial Sequence: Synthetic oligonucleotide
aagcccctcaccctgagatgggagct

SEQ ID NO: 878 - DNA, 25 bp, Artificial Sequence
  Description of Artificial Sequence: Synthetic oligonucleotide
agcccctcaccctgagatgggagct

SEQ ID NO: 879 - DNA, 24 bp, Artificial Sequence
  Description of Artificial Sequence: Synthetic oligonucleotide
gcccctcaccctgagatgggagct

SEQ ID NO: 880 - DNA, 25 bp, Artificial Sequence
  Description of Artificial Sequence: Synthetic oligonucleotide
cccctcaccctgagatgggagctgt

SEQ ID NO: 881 - DNA, 27 bp, Artificial Sequence
  Description of Artificial Sequence: Synthetic oligonucleotide
ccctcaccctgagatgggagctgtctt

SEQ ID NO: 882 - DNA, 27 bp, Artificial Sequence
  Description of Artificial Sequence: Synthetic oligonucleotide
cctcaccctgagatgggagctgtcttc

SEQ ID NO: 883 - DNA, 27 bp, Artificial Sequence
  Description of Artificial Sequence: Synthetic oligonucleotide
ctcaccctgagatgggagctgtcttcc

SEQ ID NO: 884 - DNA, 27 bp, Artificial Sequence
  Description of Artificial Sequence: Synthetic oligonucleotide
tcaccctgagatgggagctgtcttccc

SEQ ID NO: 885 - DNA, 27 bp, Artificial Sequence
  Description of Artificial Sequence: Synthetic oligonucleotide
caccctgagatgggagctgtcttccca

SEQ ID NO: 886 - DNA, 27 bp, Artificial Sequence
  Description of Artificial Sequence: Synthetic oligonucleotide
accctgagatgggagctgtcttcccag

SEQ ID NO: 887 - DNA, 26 bp, Artificial Sequence
  Description of Artificial Sequence: Synthetic oligonucleotide
ccctgagatgggagctgtcttcccag

SEQ ID NO: 888 - DNA, 26 bp, Artificial Sequence
  Description of Artificial Sequence: Synthetic oligonucleotide
cctgagatgggagctgtcttcccagc

SEQ ID NO: 889 - DNA, 26 bp, Artificial Sequence
  Description of Artificial Sequence: Synthetic oligonucleotide
ctgagatgggagctgtcttcccagcc

SEQ ID NO: 890 - DNA, 27 bp, Artificial Sequence
  Description of Artificial Sequence: Synthetic oligonucleotide
tgagatgggagctgtcttcccagccca

SEQ ID NO: 891 - DNA, 26 bp, Artificial Sequence
  Description of Artificial Sequence: Synthetic oligonucleotide
gagatgggagctgtcttcccagccca

SEQ ID NO: 892 - DNA, 26 bp, Artificial Sequence
  Description of Artificial Sequence: Synthetic oligonucleotide
agatgggagctgtcttcccagcccac

SEQ ID NO: 893 - DNA, 25 bp, Artificial Sequence
  Description of Artificial Sequence: Synthetic oligonucleotide
gatgggagctgtcttcccagcccac

SEQ ID NO: 894 - DNA, 27 bp, Artificial Sequence
  Description of Artificial Sequence: Synthetic oligonucleotide
atgggagctgtcttcccagcccaccat

SEQ ID NO: 895 - DNA, 26 bp, Artificial Sequence
  Description of Artificial Sequence: Synthetic oligonucleotide
tgggagctgtcttcccagcccaccat

SEQ ID NO: 896 - DNA, 25 bp, Artificial Sequence
  Description of Artificial Sequence: Synthetic oligonucleotide
gggagctgtcttcccagcccaccat

SEQ ID NO: 897 - DNA, 25 bp, Artificial Sequence
  Description of Artificial Sequence: Synthetic oligonucleotide
ggagctgtcttcccagcccaccatc

SEQ ID NO: 898 - DNA, 25 bp, Artificial Sequence
  Description of Artificial Sequence: Synthetic oligonucleotide
gagctgtcttcccagcccaccatcc

SEQ ID NO: 899 - DNA, 25 bp, Artificial Sequence
  Description of Artificial Sequence: Synthetic oligonucleotide
agctgtcttcccagcccaccatccc

SEQ ID NO: 900 - DNA, 24 bp, Artificial Sequence
  Description of Artificial Sequence: Synthetic oligonucleotide
gctgtcttcccagcccaccatccc

SEQ ID NO: 901 - DNA, 26 bp, Artificial Sequence
  Description of Artificial Sequence: Synthetic oligonucleotide
ctgtcttcccagcccaccatccccat

SEQ ID NO: 902 - DNA, 26 bp, Artificial Sequence
  Description of Artificial Sequence: Synthetic oligonucleotide
tgtcttcccagcccaccatccccatc

SEQ ID NO: 903 - DNA, 25 bp, Artificial Sequence
  Description of Artificial Sequence: Synthetic oligonucleotide
gtcttcccagcccaccatccccatc

SEQ ID NO: 904 - DNA, 26 bp, Artificial Sequence
  Description of Artificial Sequence: Synthetic oligonucleotide
tcttcccagcccaccatccccatcgt

SEQ ID NO: 905 - DNA, 25 bp, Artificial Sequence
  Description of Artificial Sequence: Synthetic oligonucleotide
cttcccagcccaccatccccatcgt

SEQ ID NO: 906 - DNA, 25 bp, Artificial Sequence
  Description of Artificial Sequence: Synthetic oligonucleotide
ttcccagcccaccatccccatcgtg

SEQ ID NO: 907 - DNA, 24 bp, Artificial Sequence
  Description of Artificial Sequence: Synthetic oligonucleotide
tcccagcccaccatccccatcgtg

SEQ ID NO: 908 - DNA, 23 bp, Artificial Sequence
  Description of Artificial Sequence: Synthetic oligonucleotide
cccagcccaccatccccatcgtg

SEQ ID NO: 909 - DNA, 23 bp, Artificial Sequence
  Description of Artificial Sequence: Synthetic oligonucleotide
ccagcccaccatccccatcgtgg

SEQ ID NO: 910 - DNA, 23 bp, Artificial Sequence
  Description of Artificial Sequence: Synthetic oligonucleotide
cagcccaccatccccatcgtggg

SEQ ID NO: 911 - DNA, 25 bp, Artificial Sequence
  Description of Artificial Sequence: Synthetic oligonucleotide
agcccaccatccccatcgtgggcat

SEQ ID NO: 912 - DNA, 24 bp, Artificial Sequence
  Description of Artificial Sequence: Synthetic oligonucleotide
gcccaccatccccatcgtgggcat

SEQ ID NO: 913 - DNA, 27 bp, Artificial Sequence
  Description of Artificial Sequence: Synthetic oligonucleotide
cccaccatccccatcgtgggcatcatt

SEQ ID NO: 914 - DNA, 27 bp, Artificial Sequence
  Description of Artificial Sequence: Synthetic oligonucleotide
ccaccatccccatcgtgggcatcattg

SEQ ID NO: 915 - DNA, 27 bp, Artificial Sequence
  Description of Artificial Sequence: Synthetic oligonucleotide
caccatccccatcgtgggcatcattgc

SEQ ID NO: 916 - DNA, 28 bp, Artificial Sequence
  Description of Artificial Sequence: Synthetic oligonucleotide
accatccccatcgtgggcatcattgctg

SEQ ID NO: 917 - DNA, 27 bp, Artificial Sequence
  Description of Artificial Sequence: Synthetic oligonucleotide
ccatccccatcgtgggcatcattgctg

SEQ ID NO: 918 - DNA, 27 bp, Artificial Sequence
  Description of Artificial Sequence: Synthetic oligonucleotide
catccccatcgtgggcatcattgctgg

SEQ ID NO: 919 - DNA, 27 bp, Artificial Sequence
  Description of Artificial Sequence: Synthetic oligonucleotide
atccccatcgtgggcatcattgctggc

SEQ ID NO: 920 - DNA, 26 bp, Artificial Sequence
  Description of Artificial Sequence: Synthetic oligonucleotide
tccccatcgtgggcatcattgctggc

SEQ ID NO: 921 - DNA, 25 bp, Artificial Sequence
  Description of Artificial Sequence: Synthetic oligonucleotide
ccccatcgtgggcatcattgctggc

SEQ ID NO: 922 - DNA, 26 bp, Artificial Sequence
  Description of Artificial Sequence: Synthetic oligonucleotide
cccatcgtgggcatcattgctggcct

SEQ ID NO: 923 - DNA, 26 bp, Artificial Sequence
  Description of Artificial Sequence: Synthetic oligonucleotide
ccatcgtgggcatcattgctggcctg

SEQ ID NO: 924 - DNA, 27 bp, Artificial Sequence
  Description of Artificial Sequence: Synthetic oligonucleotide
catcgtgggcatcattgctggcctggt

SEQ ID NO: 925 - DNA, 28 bp, Artificial Sequence
  Description of Artificial Sequence: Synthetic oligonucleotide
atcgtgggcatcattgctggcctggttc

SEQ ID NO: 926 - DNA, 27 bp, Artificial Sequence
  Description of Artificial Sequence: Synthetic oligonucleotide
tcgtgggcatcattgctggcctggttc

SEQ ID NO: 927 - DNA, 27 bp, Artificial Sequence
  Description of Artificial Sequence: Synthetic oligonucleotide
cgtgggcatcattgctggcctggttct

SEQ ID NO: 928 - DNA, 27 bp, Artificial Sequence
  Description of Artificial Sequence: Synthetic oligonucleotide
gtgggcatcattgctggcctggttctc

SEQ ID NO: 929 - DNA, 27 bp, Artificial Sequence
  Description of Artificial Sequence: Synthetic oligonucleotide
tgggcatcattgctggcctggttctcc

SEQ ID NO: 930 - DNA, 27 bp, Artificial Sequence
  Description of Artificial Sequence: Synthetic oligonucleotide
gggcatcattgctggcctggttctcct

SEQ ID NO: 931 - DNA, 28 bp, Artificial Sequence
  Description of Artificial Sequence: Synthetic oligonucleotide
ggcatcattgctggcctggttctccttg

SEQ ID NO: 932 - DNA, 28 bp, Artificial Sequence
  Description of Artificial Sequence: Synthetic oligonucleotide
gcatcattgctggcctggttctccttgg

SEQ ID NO: 933 - DNA, 29 bp, Artificial Sequence
  Description of Artificial Sequence: Synthetic oligonucleotide
catcattgctggcctggttctccttggag

SEQ ID NO: 934 - DNA, 29 bp, Artificial Sequence
  Description of Artificial Sequence: Synthetic oligonucleotide
atcattgctggcctggttctccttggagc

SEQ ID NO: 935 - DNA, 28 bp, Artificial Sequence
  Description of Artificial Sequence: Synthetic oligonucleotide
tcattgctggcctggttctccttggagc

SEQ ID NO: 936 - DNA, 27 bp, Artificial Sequence
  Description of Artificial Sequence: Synthetic oligonucleotide
cattgctggcctggttctccttggagc

SEQ ID NO: 937 - DNA, 28 bp, Artificial Sequence
  Description of Artificial Sequence: Synthetic oligonucleotide
attgctggcctggttctccttggagctg

SEQ ID NO: 938 - DNA, 27 bp, Artificial Sequence
  Description of Artificial Sequence: Synthetic oligonucleotide
ttgctggcctggttctccttggagctg

SEQ ID NO: 939 - DNA, 27 bp, Artificial Sequence
  Description of Artificial Sequence: Synthetic oligonucleotide
tgctggcctggttctccttggagctgt

SEQ ID NO: 940 - DNA, 26 bp, Artificial Sequence
  Description of Artificial Sequence: Synthetic oligonucleotide
gctggcctggttctccttggagctgt

SEQ ID NO: 941 - DNA, 27 bp, Artificial Sequence
  Description of Artificial Sequence: Synthetic oligonucleotide
ctggcctggttctccttggagctgtga

SEQ ID NO: 942 - DNA, 28 bp, Artificial Sequence
  Description of Artificial Sequence: Synthetic oligonucleotide
tggcctggttctccttggagctgtgatc

SEQ ID NO: 943 - DNA, 27 bp, Artificial Sequence
  Description of Artificial Sequence: Synthetic oligonucleotide
ggcctggttctccttggagctgtgatc

SEQ ID NO: 944 - DNA, 28 bp, Artificial Sequence
  Description of Artificial Sequence: Synthetic oligonucleotide
gcctggttctccttggagctgtgatcac

SEQ ID NO: 945 - DNA, 29 bp, Artificial Sequence
  Description of Artificial Sequence: Synthetic oligonucleotide
cctggttctccttggagctgtgatcactg

SEQ ID NO: 946 - DNA, 29 bp, Artificial Sequence
  Description of Artificial Sequence: Synthetic oligonucleotide
ctggttctccttggagctgtgatcactgg

SEQ ID NO: 947 - DNA, 30 bp, Artificial Sequence
  Description of Artificial Sequence: Synthetic oligonucleotide
tggttctccttggagctgtgatcactggag

SEQ ID NO: 948 - DNA, 29 bp, Artificial Sequence
  Description of Artificial Sequence: Synthetic oligonucleotide
ggttctccttggagctgtgatcactggag

SEQ ID NO: 949 - DNA, 29 bp, Artificial Sequence
  Description of Artificial Sequence: Synthetic oligonucleotide
gttctccttggagctgtgatcactggagc

SEQ ID NO: 950 - DNA, 30 bp, Artificial Sequence
  Description of Artificial Sequence: Synthetic oligonucleotide
ttctccttggagctgtgatcactggagctg

SEQ ID NO: 951 - DNA, 29 bp, Artificial Sequence
  Description of Artificial Sequence: Synthetic oligonucleotide
tctccttggagctgtgatcactggagctg

SEQ ID NO: 952 - DNA, 28 bp, Artificial Sequence
  Description of Artificial Sequence: Synthetic oligonucleotide
ctccttggagctgtgatcactggagctg

SEQ ID NO: 953 - DNA, 29 bp, Artificial Sequence
  Description of Artificial Sequence: Synthetic oligonucleotide
tccttggagctgtgatcactggagctgtg

SEQ ID NO: 954 - DNA, 28 bp, Artificial Sequence
  Description of Artificial Sequence: Synthetic oligonucleotide
ccttggagctgtgatcactggagctgtg

SEQ ID NO: 955 - DNA, 28 bp, Artificial Sequence
  Description of Artificial Sequence: Synthetic oligonucleotide
cttggagctgtgatcactggagctgtgg

SEQ ID NO: 956 - DNA, 29 bp, Artificial Sequence
  Description of Artificial Sequence: Synthetic oligonucleotide
ttggagctgtgatcactggagctgtggtc

SEQ ID NO: 957 - DNA, 28 bp, Artificial Sequence
  Description of Artificial Sequence: Synthetic oligonucleotide
tggagctgtgatcactggagctgtggtc

SEQ ID NO: 958 - DNA, 27 bp, Artificial Sequence
  Description of Artificial Sequence: Synthetic oligonucleotide
ggagctgtgatcactggagctgtggtc

SEQ ID NO: 959 - DNA, 27 bp, Artificial Sequence
  Description of Artificial Sequence: Synthetic oligonucleotide
gagctgtgatcactggagctgtggtcg

SEQ ID NO: 960 - DNA, 27 bp, Artificial Sequence
  Description of Artificial Sequence: Synthetic oligonucleotide
agctgtgatcactggagctgtggtcgc

SEQ ID NO: 961 - DNA, 27 bp, Artificial Sequence
  Description of Artificial Sequence: Synthetic oligonucleotide
gctgtgatcactggagctgtggtcgct

SEQ ID NO: 962 - DNA, 27 bp, Artificial Sequence
  Description of Artificial Sequence: Synthetic oligonucleotide
ctgtgatcactggagctgtggtcgctg

SEQ ID NO: 963 - DNA, 27 bp, Artificial Sequence
  Description of Artificial Sequence: Synthetic oligonucleotide
tgtgatcactggagctgtggtcgctgc

SEQ ID NO: 964 - DNA, 26 bp, Artificial Sequence
  Description of Artificial Sequence: Synthetic oligonucleotide
gtgatcactggagctgtggtcgctgc

SEQ ID NO: 965 - DNA, 26 bp, Artificial Sequence
  Description of Artificial Sequence: Synthetic oligonucleotide
tgatcactggagctgtggtcgctgcc

SEQ ID NO: 966 - DNA, 25 bp, Artificial Sequence
  Description of Artificial Sequence: Synthetic oligonucleotide
gatcactggagctgtggtcgctgcc

SEQ ID NO: 967 - DNA, 26 bp, Artificial Sequence
  Description of Artificial Sequence: Synthetic oligonucleotide
atcactggagctgtggtcgctgccgt

SEQ ID NO: 968 - DNA, 25 bp, Artificial Sequence
  Description of Artificial Sequence: Synthetic oligonucleotide
tcactggagctgtggtcgctgccgt

SEQ ID NO: 969 - DNA, 24 bp, Artificial Sequence
  Description of Artificial Sequence: Synthetic oligonucleotide
cactggagctgtggtcgctgccgt

SEQ ID NO: 970 - DNA, 26 bp, Artificial Sequence
  Description of Artificial Sequence: Synthetic oligonucleotide
actggagctgtggtcgctgccgtgat

SEQ ID NO: 971 - DNA, 25 bp, Artificial Sequence
  Description of Artificial Sequence: Synthetic oligonucleotide
ctggagctgtggtcgctgccgtgat

SEQ ID NO: 972 - DNA, 26 bp, Artificial Sequence
  Description of Artificial Sequence: Synthetic oligonucleotide
tggagctgtggtcgctgccgtgatgt

SEQ ID NO: 973 - DNA, 25 bp, Artificial Sequence
  Description of Artificial Sequence: Synthetic oligonucleotide
ggagctgtggtcgctgccgtgatgt

SEQ ID NO: 974 - DNA, 25 bp, Artificial Sequence
  Description of Artificial Sequence: Synthetic oligonucleotide
gagctgtggtcgctgccgtgatgtg

SEQ ID NO: 975 - DNA, 26 bp, Artificial Sequence
  Description of Artificial Sequence: Synthetic oligonucleotide
agctgtggtcgctgccgtgatgtgga

SEQ ID NO: 976 - DNA, 25 bp, Artificial Sequence
  Description of Artificial Sequence: Synthetic oligonucleotide
gctgtggtcgctgccgtgatgtgga

SEQ ID NO: 977 - DNA, 25 bp, Artificial Sequence
  Description of Artificial Sequence: Synthetic oligonucleotide
ctgtggtcgctgccgtgatgtggag

SEQ ID NO: 978 - DNA, 26 bp, Artificial Sequence
  Description of Artificial Sequence: Synthetic oligonucleotide
tgtggtcgctgccgtgatgtggagga

SEQ ID NO: 979 - DNA, 25 bp, Artificial Sequence
  Description of Artificial Sequence: Synthetic oligonucleotide
gtggtcgctgccgtgatgtggagga

SEQ ID NO: 980 - DNA, 25 bp, Artificial Sequence
  Description of Artificial Sequence: Synthetic oligonucleotide
tggtcgctgccgtgatgtggaggag

SEQ ID NO: 981 - DNA, 24 bp, Artificial Sequence
  Description of Artificial Sequence: Synthetic oligonucleotide
ggtcgctgccgtgatgtggaggag

SEQ ID NO: 982 - DNA, 26 bp, Artificial Sequence
  Description of Artificial Sequence: Synthetic oligonucleotide
gtcgctgccgtgatgtggaggaggaa

SEQ ID NO: 983 - DNA, 27 bp, Artificial Sequence
  Description of Artificial Sequence: Synthetic oligonucleotide
tcgctgccgtgatgtggaggaggaaga

SEQ ID NO: 984 - DNA, 26 bp, Artificial Sequence
  Description of Artificial Sequence: Synthetic oligonucleotide
cgctgccgtgatgtggaggaggaaga

SEQ ID NO: 985 - DNA, 26 bp, Artificial Sequence
  Description of Artificial Sequence: Synthetic oligonucleotide
gctgccgtgatgtggaggaggaagag

SEQ ID NO: 986 - DNA, 27 bp, Artificial Sequence
  Description of Artificial Sequence: Synthetic oligonucleotide
ctgccgtgatgtggaggaggaagagct

SEQ ID NO: 987 - DNA, 27 bp, Artificial Sequence
  Description of Artificial Sequence: Synthetic oligonucleotide
tgccgtgatgtggaggaggaagagctc

SEQ ID NO: 988 - DNA, 27 bp, Artificial Sequence
  Description of Artificial Sequence: Synthetic oligonucleotide
gccgtgatgtggaggaggaagagctca

SEQ ID NO: 989 - DNA, 27 bp, Artificial Sequence
  Description of Artificial Sequence: Synthetic oligonucleotide
ccgtgatgtggaggaggaagagctcag

SEQ ID NO: 990 - DNA, 30 bp, Artificial Sequence
  Description of Artificial Sequence: Synthetic oligonucleotide
cgtgatgtggaggaggaagagctcagatag

SEQ ID NO: 991 - DNA, 34 bp, Artificial Sequence
  Description of Artificial Sequence: Synthetic oligonucleotide
gtgatgtggaggaggaagagctcagatagaaaag

SEQ ID NO: 992 - DNA, 34 bp, Artificial Sequence
  Description of Artificial Sequence: Synthetic oligonucleotide
tgatgtggaggaggaagagctcagatagaaaagg

SEQ ID NO: 993 - DNA, 33 bp, Artificial Sequence
  Description of Artificial Sequence: Synthetic oligonucleotide
gatgtggaggaggaagagctcagatagaaaagg

SEQ ID NO: 994 - DNA, 34 bp, Artificial Sequence
  Description of Artificial Sequence: Synthetic oligonucleotide
atgtggaggaggaagagctcagatagaaaaggag

SEQ ID NO: 995 - DNA, 33 bp, Artificial Sequence
  Description of Artificial Sequence: Synthetic oligonucleotide
tgtggaggaggaagagctcagatagaaaaggag

SEQ ID NO: 996 - DNA, 32 bp, Artificial Sequence
  Description of Artificial Sequence: Synthetic oligonucleotide
gtggaggaggaagagctcagatagaaaaggag

SEQ ID NO: 997 - DNA, 32 bp, Artificial Sequence
  Description of Artificial Sequence: Synthetic oligonucleotide
tggaggaggaagagctcagatagaaaaggagg

SEQ ID NO: 998 - DNA, 31 bp, Artificial Sequence
  Description of Artificial Sequence: Synthetic oligonucleotide
ggaggaggaagagctcagatagaaaaggagg

SEQ ID NO: 999 - DNA, 31 bp, Artificial Sequence
  Description of Artificial Sequence: Synthetic oligonucleotide
gaggaggaagagctcagatagaaaaggaggg

SEQ ID NO: 1000 - DNA, 32 bp, Artificial Sequence
  Description of Artificial Sequence: Synthetic oligonucleotide
aggaggaagagctcagatagaaaaggagggag

SEQ ID NO: 1001 - DNA, 31 bp, Artificial Sequence
  Description of Artificial Sequence: Synthetic oligonucleotide
ggaggaagagctcagatagaaaaggagggag

SEQ ID NO: 1002 - DNA, 34 bp, Artificial Sequence
  Description of Artificial Sequence: Synthetic oligonucleotide
gaggaagagctcagatagaaaaggagggagttac

SEQ ID NO: 1003 - DNA, 35 bp, Artificial Sequence
  Description of Artificial Sequence: Synthetic oligonucleotide
aggaagagctcagatagaaaaggagggagttacac

SEQ ID NO: 1004 - DNA, 34 bp, Artificial Sequence
  Description of Artificial Sequence: Synthetic oligonucleotide
ggaagagctcagatagaaaaggagggagttacac

SEQ ID NO: 1005 - DNA, 35 bp, Artificial Sequence
  Description of Artificial Sequence: Synthetic oligonucleotide
gaagagctcagatagaaaaggagggagttacactc

SEQ ID NO: 1006 - DNA, 36 bp, Artificial Sequence
  Description of Artificial Sequence: Synthetic oligonucleotide
aagagctcagatagaaaaggagggagttacactcag

SEQ ID NO: 1007 - DNA, 35 bp, Artificial Sequence
  Description of Artificial Sequence: Synthetic oligonucleotide
agagctcagatagaaaaggagggagttacactcag

SEQ ID NO: 1008 - DNA, 34 bp, Artificial Sequence
  Description of Artificial Sequence: Synthetic oligonucleotide
gagctcagatagaaaaggagggagttacactcag

SEQ ID NO: 1009 - DNA, 34 bp, Artificial Sequence
  Description of Artificial Sequence: Synthetic oligonucleotide
agctcagatagaaaaggagggagttacactcagg

SEQ ID NO: 1010 - DNA, 33 bp, Artificial Sequence
  Description of Artificial Sequence: Synthetic oligonucleotide
gctcagatagaaaaggagggagttacactcagg

SEQ ID NO: 1011 - DNA, 33 bp, Artificial Sequence
  Description of Artificial Sequence: Synthetic oligonucleotide
ctcagatagaaaaggagggagttacactcaggc

SEQ ID NO: 1012 - DNA, 34 bp, Artificial Sequence
  Description of Artificial Sequence: Synthetic oligonucleotide
tcagatagaaaaggagggagttacactcaggctg

SEQ ID NO: 1013 - DNA, 33 bp, Artificial Sequence
  Description of Artificial Sequence: Synthetic oligonucleotide
cagatagaaaaggagggagttacactcaggctg

SEQ ID NO: 1014 - DNA, 33 bp, Artificial Sequence
  Description of Artificial Sequence: Synthetic oligonucleotide
agatagaaaaggagggagttacactcaggctgc

SEQ ID NO: 1015 - DNA, 32 bp, Artificial Sequence
  Description of Artificial Sequence: Synthetic oligonucleotide
gatagaaaaggagggagttacactcaggctgc

SEQ ID NO: 1016 - DNA, 34 bp, Artificial Sequence
  Description of Artificial Sequence: Synthetic oligonucleotide
atagaaaaggagggagttacactcaggctgcaag

SEQ ID NO: 1017 - DNA, 33 bp, Artificial Sequence
  Description of Artificial Sequence: Synthetic oligonucleotide
tagaaaaggagggagttacactcaggctgcaag

SEQ ID NO: 1018 - DNA, 32 bp, Artificial Sequence
  Description of Artificial Sequence: Synthetic oligonucleotide
agaaaaggagggagttacactcaggctgcaag

SEQ ID NO: 1019 - DNA, 31 bp, Artificial Sequence
  Description of Artificial Sequence: Synthetic oligonucleotide
gaaaaggagggagttacactcaggctgcaag

SEQ ID NO: 1020 - DNA, 31 bp, Artificial Sequence
  Description of Artificial Sequence: Synthetic oligonucleotide
aaaaggagggagttacactcaggctgcaagc

SEQ ID NO: 1021 - DNA, 30 bp, Artificial Sequence
  Description of Artificial Sequence: Synthetic oligonucleotide
aaaggagggagttacactcaggctgcaagc

SEQ ID NO: 1022 - DNA, 29 bp, Artificial Sequence
  Description of Artificial Sequence: Synthetic oligonucleotide
aaggagggagttacactcaggctgcaagc

SEQ ID NO: 1023 - DNA, 28 bp, Artificial Sequence
  Description of Artificial Sequence: Synthetic oligonucleotide
aggagggagttacactcaggctgcaagc

SEQ ID NO: 1024 - DNA, 27 bp, Artificial Sequence
  Description of Artificial Sequence: Synthetic oligonucleotide
ggagggagttacactcaggctgcaagc

SEQ ID NO: 1025 - DNA, 28 bp, Artificial Sequence
  Description of Artificial Sequence: Synthetic oligonucleotide
gagggagttacactcaggctgcaagcag

SEQ ID NO: 1026 - DNA, 29 bp, Artificial Sequence
  Description of Artificial Sequence: Synthetic oligonucleotide
agggagttacactcaggctgcaagcagtg

SEQ ID NO: 1027 - DNA, 28 bp, Artificial Sequence
  Description of Artificial Sequence: Synthetic oligonucleotide
gggagttacactcaggctgcaagcagtg

SEQ ID NO: 1028 - DNA, 29 bp, Artificial Sequence
  Description of Artificial Sequence: Synthetic oligonucleotide
ggagttacactcaggctgcaagcagtgac

SEQ ID NO: 1029 - DNA, 30 bp, Artificial Sequence
  Description of Artificial Sequence: Synthetic oligonucleotide
gagttacactcaggctgcaagcagtgacag

SEQ ID NO: 1030 - DNA, 31 bp, Artificial Sequence
  Description of Artificial Sequence: Synthetic oligonucleotide
agttacactcaggctgcaagcagtgacagtg

SEQ ID NO: 1031 - DNA, 30 bp, Artificial Sequence
  Description of Artificial Sequence: Synthetic oligonucleotide
gttacactcaggctgcaagcagtgacagtg

SEQ ID NO: 1032 - DNA, 30 bp, Artificial Sequence
  Description of Artificial Sequence: Synthetic oligonucleotide
ttacactcaggctgcaagcagtgacagtgc

SEQ ID NO: 1033 - DNA, 29 bp, Artificial Sequence
  Description of Artificial Sequence: Synthetic oligonucleotide
tacactcaggctgcaagcagtgacagtgc

SEQ ID NO: 1034 - DNA, 28 bp, Artificial Sequence
  Description of Artificial Sequence: Synthetic oligonucleotide
acactcaggctgcaagcagtgacagtgc

SEQ ID NO: 1035 - DNA, 27 bp, Artificial Sequence
  Description of Artificial Sequence: Synthetic oligonucleotide
cactcaggctgcaagcagtgacagtgc

SEQ ID NO: 1036 - DNA, 27 bp, Artificial Sequence
  Description of Artificial Sequence: Synthetic oligonucleotide
actcaggctgcaagcagtgacagtgcc

SEQ ID NO: 1037 - DNA, 26 bp, Artificial Sequence
  Description of Artificial Sequence: Synthetic oligonucleotide
ctcaggctgcaagcagtgacagtgcc

SEQ ID NO: 1038 - DNA, 27 bp, Artificial Sequence
  Description of Artificial Sequence: Synthetic oligonucleotide
tcaggctgcaagcagtgacagtgccca

SEQ ID NO: 1039 - DNA, 26 bp, Artificial Sequence
  Description of Artificial Sequence: Synthetic oligonucleotide
caggctgcaagcagtgacagtgccca

SEQ ID NO: 1040 - DNA, 26 bp, Artificial Sequence
  Description of Artificial Sequence: Synthetic oligonucleotide
aggctgcaagcagtgacagtgcccag

SEQ ID NO: 1041 - DNA, 25 bp, Artificial Sequence
  Description of Artificial Sequence: Synthetic oligonucleotide
ggctgcaagcagtgacagtgcccag

SEQ ID NO: 1042 - DNA, 25 bp, Artificial Sequence
  Description of Artificial Sequence: Synthetic oligonucleotide
gctgcaagcagtgacagtgcccagg

SEQ ID NO: 1043 - DNA, 25 bp, Artificial Sequence
  Description of Artificial Sequence: Synthetic oligonucleotide
ctgcaagcagtgacagtgcccaggg

SEQ ID NO: 1044 - DNA, 26 bp, Artificial Sequence
  Description of Artificial Sequence: Synthetic oligonucleotide
tgcaagcagtgacagtgcccagggct

SEQ ID NO: 1045 - DNA, 25 bp, Artificial Sequence
  Description of Artificial Sequence: Synthetic oligonucleotide
gcaagcagtgacagtgcccagggct

SEQ ID NO: 1046 - DNA, 26 bp, Artificial Sequence
  Description of Artificial Sequence: Synthetic oligonucleotide
caagcagtgacagtgcccagggctct

SEQ ID NO: 1047 - DNA, 27 bp, Artificial Sequence
  Description of Artificial Sequence: Synthetic oligonucleotide
aagcagtgacagtgcccagggctctga

SEQ ID NO: 1048 - DNA, 27 bp, Artificial Sequence
  Description of Artificial Sequence: Synthetic oligonucleotide
agcagtgacagtgcccagggctctgat

SEQ ID NO: 1049 - DNA, 26 bp, Artificial Sequence
  Description of Artificial Sequence: Synthetic oligonucleotide
gcagtgacagtgcccagggctctgat

SEQ ID NO: 1050 - DNA, 27 bp, Artificial Sequence
  Description of Artificial Sequence: Synthetic oligonucleotide
cagtgacagtgcccagggctctgatgt

SEQ ID NO: 1051 - DNA, 27 bp, Artificial Sequence
  Description of Artificial Sequence: Synthetic oligonucleotide
agtgacagtgcccagggctctgatgtg

SEQ ID NO: 1052 - DNA, 27 bp, Artificial Sequence
  Description of Artificial Sequence: Synthetic oligonucleotide
gtgacagtgcccagggctctgatgtgt

SEQ ID NO: 1053 - DNA, 27 bp, Artificial Sequence
  Description of Artificial Sequence: Synthetic oligonucleotide
tgacagtgcccagggctctgatgtgtc

SEQ ID NO: 1054 - DNA, 27 bp, Artificial Sequence
  Description of Artificial Sequence: Synthetic oligonucleotide
gacagtgcccagggctctgatgtgtct

SEQ ID NO: 1055 - DNA, 27 bp, Artificial Sequence
  Description of Artificial Sequence: Synthetic oligonucleotide
acagtgcccagggctctgatgtgtctc

SEQ ID NO: 1056 - DNA, 27 bp, Artificial Sequence
  Description of Artificial Sequence: Synthetic oligonucleotide
cagtgcccagggctctgatgtgtctct

SEQ ID NO: 1057 - DNA, 27 bp, Artificial Sequence
  Description of Artificial Sequence: Synthetic oligonucleotide
agtgcccagggctctgatgtgtctctc

SEQ ID NO: 1058 - DNA, 27 bp, Artificial Sequence
  Description of Artificial Sequence: Synthetic oligonucleotide
gtgcccagggctctgatgtgtctctca

SEQ ID NO: 1059 - DNA, 27 bp, Artificial Sequence
  Description of Artificial Sequence: Synthetic oligonucleotide
tgcccagggctctgatgtgtctctcac

SEQ ID NO: 1060 - DNA, 27 bp, Artificial Sequence
  Description of Artificial Sequence: Synthetic oligonucleotide
gcccagggctctgatgtgtctctcaca

SEQ ID NO: 1061 - DNA, 27 bp, Artificial Sequence
  Description of Artificial Sequence: Synthetic oligonucleotide
cccagggctctgatgtgtctctcacag

SEQ ID NO: 1062 - DNA, 27 bp, Artificial Sequence
  Description of Artificial Sequence: Synthetic oligonucleotide
ccagggctctgatgtgtctctcacagc

SEQ ID NO: 1063 - DNA, 29 bp, Artificial Sequence
  Description of Artificial Sequence: Synthetic oligonucleotide
cagggctctgatgtgtctctcacagcttg

SEQ ID NO: 1064 - DNA, 33 bp, Artificial Sequence
  Description of Artificial Sequence: Synthetic oligonucleotide
agggctctgatgtgtctctcacagcttgtaaag

SEQ ID NO: 1065 - DNA, 32 bp, Artificial Sequence
  Description of Artificial Sequence: Synthetic oligonucleotide
gggctctgatgtgtctctcacagcttgtaaag

SEQ ID NO: 1066 - DNA, 33 bp, Artificial Sequence
  Description of Artificial Sequence: Synthetic oligonucleotide
ggctctgatgtgtctctcacagcttgtaaagtg

SEQ ID NO: 1067 - DNA, 34 bp, Artificial Sequence
  Description of Artificial Sequence: Synthetic oligonucleotide
gctctgatgtgtctctcacagcttgtaaagtgtg

SEQ ID NO: 1068 - DNA, 26 bp, Artificial Sequence
  Description of Artificial Sequence: Synthetic oligonucleotide
cgcggcggacatggcagctcagatta

SEQ ID NO: 1069 - DNA, 26 bp, Artificial Sequence
  Description of Artificial Sequence: Synthetic oligonucleotide
gcggcggacatggcagctcagattac

SEQ ID NO: 1070 - DNA, 27 bp, Artificial Sequence
  Description of Artificial Sequence: Synthetic oligonucleotide
cggcggacatggcagctcagattacca

SEQ ID NO: 1071 - DNA, 28 bp, Artificial Sequence
  Description of Artificial Sequence: Synthetic oligonucleotide
ggcggacatggcagctcagattaccaag

SEQ ID NO: 1072 - DNA, 28 bp, Artificial Sequence
  Description of Artificial Sequence: Synthetic oligonucleotide
gcggacatggcagctcagattaccaagc

SEQ ID NO: 1073 - DNA, 28 bp, Artificial Sequence
  Description of Artificial Sequence: Synthetic oligonucleotide
cggacatggcagctcagattaccaagcg

SEQ ID NO: 1074 - DNA, 28 bp, Artificial Sequence
  Description of Artificial Sequence: Synthetic oligonucleotide
ggacatggcagctcagattaccaagcgc

SEQ ID NO: 1075 - DNA, 30 bp, Artificial Sequence
  Description of Artificial Sequence: Synthetic oligonucleotide
gacatggcagctcagattaccaagcgcaag

SEQ ID NO: 1076 - DNA, 31 bp, Artificial Sequence
  Description of Artificial Sequence: Synthetic oligonucleotide
acatggcagctcagattaccaagcgcaagtg

SEQ ID NO: 1077 - DNA, 30 bp, Artificial Sequence
  Description of Artificial Sequence: Synthetic oligonucleotide
catggcagctcagattaccaagcgcaagtg

SEQ ID NO: 1078 - DNA, 30 bp, Artificial Sequence
  Description of Artificial Sequence: Synthetic oligonucleotide
atggcagctcagattaccaagcgcaagtgg

SEQ ID NO: 1079 - DNA, 29 bp, Artificial Sequence
  Description of Artificial Sequence: Synthetic oligonucleotide
tggcagctcagattaccaagcgcaagtgg

SEQ ID NO: 1080 - DNA, 28 bp, Artificial Sequence
  Description of Artificial Sequence: Synthetic oligonucleotide
ggcagctcagattaccaagcgcaagtgg

SEQ ID NO: 1081 - DNA, 28 bp, Artificial Sequence
  Description of Artificial Sequence: Synthetic oligonucleotide
gcagctcagattaccaagcgcaagtggg

SEQ ID NO: 1082 - DNA, 29 bp, Artificial Sequence
  Description of Artificial Sequence: Synthetic oligonucleotide
cagctcagattaccaagcgcaagtgggag

SEQ ID NO: 1083 - DNA, 29 bp, Artificial Sequence
  Description of Artificial Sequence: Synthetic oligonucleotide
agctcagattaccaagcgcaagtgggagg

SEQ ID NO: 1084 - DNA, 28 bp, Artificial Sequence
  Description of Artificial Sequence: Synthetic oligonucleotide
gctcagattaccaagcgcaagtgggagg

SEQ ID NO: 1085 - DNA, 28 bp, Artificial Sequence
  Description of Artificial Sequence: Synthetic oligonucleotide
ctcagattaccaagcgcaagtgggaggc

SEQ ID NO: 1086 - DNA, 28 bp, Artificial Sequence
  Description of Artificial Sequence: Synthetic oligonucleotide
tcagattaccaagcgcaagtgggaggcg

SEQ ID NO: 1087 - DNA, 27 bp, Artificial Sequence
  Description of Artificial Sequence: Synthetic oligonucleotide
cagattaccaagcgcaagtgggaggcg

SEQ ID NO: 1088 - DNA, 27 bp, Artificial Sequence
  Description of Artificial Sequence: Synthetic oligonucleotide
agattaccaagcgcaagtgggaggcgg

SEQ ID NO: 1089 - DNA, 27 bp, Artificial Sequence
  Description of Artificial Sequence: Synthetic oligonucleotide
gattaccaagcgcaagtgggaggcggt

SEQ ID NO: 1090 - DNA, 27 bp, Artificial Sequence
  Description of Artificial Sequence: Synthetic oligonucleotide
attaccaagcgcaagtgggaggcggtc

SEQ ID NO: 1091 - DNA, 26 bp, Artificial Sequence
  Description of Artificial Sequence: Synthetic oligonucleotide
ttaccaagcgcaagtgggaggcggtc

SEQ ID NO: 1092 - DNA, 25 bp, Artificial Sequence
  Description of Artificial Sequence: Synthetic oligonucleotide
taccaagcgcaagtgggaggcggtc

SEQ ID NO: 1093 - DNA, 23 bp, Artificial Sequence
  Description of Artificial Sequence: Synthetic oligonucleotide
gaaggagacgctgcagcgcacgg

SEQ ID NO: 1094 - DNA, 24 bp, Artificial Sequence
  Description of Artificial Sequence: Synthetic oligonucleotide
gggaaggagacgctgcagcgcact

SEQ ID NO: 1095 - DNA, 25 bp, Artificial Sequence
  Description of Artificial Sequence: Synthetic oligonucleotide
ggaaggagacgctgcagcgcactga

SEQ ID NO: 1096 - DNA, 25 bp, Artificial Sequence
  Description of Artificial Sequence: Synthetic oligonucleotide
gaaggagacgctgcagcgcactgac

SEQ ID NO: 1097 - DNA, 25 bp, Artificial Sequence
  Description of Artificial Sequence: Synthetic oligonucleotide
aaggagacgctgcagcgcactgacc

SEQ ID NO: 1098 - DNA, 24 bp, Artificial Sequence
  Description of Artificial Sequence: Synthetic oligonucleotide
aggagacgctgcagcgcactgacc

SEQ ID NO: 1099 - DNA, 23 bp, Artificial Sequence
  Description of Artificial Sequence: Synthetic oligonucleotide
ggagacgctgcagcgcactgacc

SEQ ID NO: 1100 - DNA, 23 bp, Artificial Sequence
  Description of Artificial Sequence: Synthetic oligonucleotide
gagacgctgcagcgcactgaccc

SEQ ID NO: 1101 - DNA, 23 bp, Artificial Sequence
  Description of Artificial Sequence: Synthetic oligonucleotide
agacgctgcagcgcactgacccc

SEQ ID NO: 1102 - DNA, 22 bp, Artificial Sequence
  Description of Artificial Sequence: Synthetic oligonucleotide
gacgctgcagcgcactgacccc

SEQ ID NO: 1103 - DNA, 22 bp, Artificial Sequence
  Description of Artificial Sequence: Synthetic oligonucleotide
acgctgcagcgcactgaccccc

SEQ ID NO: 1104 - DNA, 21 bp, Artificial Sequence
  Description of Artificial Sequence: Synthetic oligonucleotide
cgctgcagcgcactgaccccc

SEQ ID NO: 1105 - DNA, 21 bp, Artificial Sequence
  Description of Artificial Sequence: Synthetic oligonucleotide
gctgcagcgcactgacccccc

SEQ ID NO: 1106 - DNA, 23 bp, Artificial Sequence
  Description of Artificial Sequence: Synthetic oligonucleotide
ctgcagcgcactgacccccccaa

SEQ ID NO: 1107 - DNA, 24 bp, Artificial Sequence
  Description of Artificial Sequence: Synthetic oligonucleotide
tgcagcgcactgacccccccaaga

SEQ ID NO: 1108 - DNA, 23 bp, Artificial Sequence
  Description of Artificial Sequence: Synthetic oligonucleotide
gcagcgcactgacccccccaaga

SEQ ID NO: 1109 - DNA, 24 bp, Artificial Sequence
  Description of Artificial Sequence: Synthetic oligonucleotide
cagcgcactgacccccccaagaca

SEQ ID NO: 1110 - DNA, 27 bp, Artificial Sequence
  Description of Artificial Sequence: Synthetic oligonucleotide
agcgcactgacccccccaagacacata

SEQ ID NO: 1111 - DNA, 27 bp, Artificial Sequence
  Description of Artificial Sequence: Synthetic oligonucleotide
gcgcactgacccccccaagacacatat

SEQ ID NO: 1112 - DNA, 27 bp, Artificial Sequence
  Description of Artificial Sequence: Synthetic oligonucleotide
cgcactgacccccccaagacacatatg

SEQ ID NO: 1113 - DNA, 28 bp, Artificial Sequence
  Description of Artificial Sequence: Synthetic oligonucleotide
gcactgacccccccaagacacatatgac

SEQ ID NO: 1114 - DNA, 28 bp, Artificial Sequence
  Description of Artificial Sequence: Synthetic oligonucleotide
cactgacccccccaagacacatatgacc

SEQ ID NO: 1115 - DNA, 28 bp, Artificial Sequence
  Description of Artificial Sequence: Synthetic oligonucleotide
actgacccccccaagacacatatgaccc

SEQ ID NO: 1116 - DNA, 27 bp, Artificial Sequence
  Description of Artificial Sequence: Synthetic oligonucleotide
ctgacccccccaagacacatatgaccc

SEQ ID NO: 1117 - DNA, 28 bp, Artificial Sequence
  Description of Artificial Sequence: Synthetic oligonucleotide
tgacccccccaagacacatatgacccac

SEQ ID NO: 1118 - DNA, 24 bp, Artificial Sequence
  Description of Artificial Sequence: Synthetic oligonucleotide
ccaagcccctcaccctgagatggg

SEQ ID NO: 1119 - DNA, 27 bp, Artificial Sequence
  Description of Artificial Sequence: Synthetic oligonucleotide
gcccactcacagactgaccgagcgaat

SEQ ID NO: 1120 - DNA, 27 bp, Artificial Sequence
  Description of Artificial Sequence: Synthetic oligonucleotide
cccactcacagactgaccgagcgaatc

SEQ ID NO: 1121 - DNA, 28 bp, Artificial Sequence
  Description of Artificial Sequence: Synthetic oligonucleotide
ccactcacagactgaccgagcgaatctg

SEQ ID NO: 1122 - DNA, 28 bp, Artificial Sequence
  Description of Artificial Sequence: Synthetic oligonucleotide
cactcacagactgaccgagcgaatctgg

SEQ ID NO: 1123 - DNA, 28 bp, Artificial Sequence
  Description of Artificial Sequence: Synthetic oligonucleotide
actcacagactgaccgagcgaatctggg

SEQ ID NO: 1124 - DNA, 27 bp, Artificial Sequence
  Description of Artificial Sequence: Synthetic oligonucleotide
ctcacagactgaccgagcgaatctggg

SEQ ID NO: 1125 - DNA, 27 bp, Artificial Sequence
  Description of Artificial Sequence: Synthetic oligonucleotide
tcacagactgaccgagcgaatctgggg

SEQ ID NO: 1126 - DNA, 27 bp, Artificial Sequence
  Description of Artificial Sequence: Synthetic oligonucleotide
cacagactgaccgagcgaatctgggga

SEQ ID NO: 1127 - DNA, 27 bp, Artificial Sequence
  Description of Artificial Sequence: Synthetic oligonucleotide
acagactgaccgagcgaatctggggac

SEQ ID NO: 1128 - DNA, 26 bp, Artificial Sequence
  Description of Artificial Sequence: Synthetic oligonucleotide
cagactgaccgagcgaatctggggac

SEQ ID NO: 1129 - DNA, 26 bp, Artificial Sequence
  Description of Artificial Sequence: Synthetic oligonucleotide
agactgaccgagcgaatctggggacc

SEQ ID NO: 1130 - DNA, 25 bp, Artificial Sequence
  Description of Artificial Sequence: Synthetic oligonucleotide
gactgaccgagcgaatctggggacc

SEQ ID NO: 1131 - DNA, 26 bp, Artificial Sequence
  Description of Artificial Sequence: Synthetic oligonucleotide
actgaccgagcgaatctggggaccct

SEQ ID NO: 1132 - DNA, 25 bp, Artificial Sequence
  Description of Artificial Sequence: Synthetic oligonucleotide
ctgaccgagcgaatctggggaccct

SEQ ID NO: 1133 - DNA, 25 bp, Artificial Sequence
  Description of Artificial Sequence: Synthetic oligonucleotide
tgaccgagcgaatctggggaccctg

SEQ ID NO: 1134 - DNA, 24 bp, Artificial Sequence
  Description of Artificial Sequence: Synthetic oligonucleotide
gaccgagcgaatctggggaccctg

SEQ ID NO: 1135 - DNA, 24 bp, Artificial Sequence
  Description of Artificial Sequence: Synthetic oligonucleotide
accgagcgaatctggggaccctgc

SEQ ID NO: 1136 - DNA, 23 bp, Artificial Sequence
  Description of Artificial Sequence: Synthetic oligonucleotide
ccgagcgaatctggggaccctgc

SEQ ID NO: 1137 - DNA, 23 bp, Artificial Sequence
  Description of Artificial Sequence: Synthetic oligonucleotide
cgagcgaatctggggaccctgcg

SEQ ID NO: 1138 - DNA, 23 bp, Artificial Sequence
  Description of Artificial Sequence: Synthetic oligonucleotide
gagcgaatctggggaccctgcgc

SEQ ID NO: 1139 - DNA, 23 bp, Artificial Sequence
  Description of Artificial Sequence: Synthetic oligonucleotide
agcgaatctggggaccctgcgcg

SEQ ID NO: 1140 - DNA, 22 bp, Artificial Sequence
  Description of Artificial Sequence: Synthetic oligonucleotide
gcgaatctggggaccctgcgcg

SEQ ID NO: 1141 - DNA, 22 bp, Artificial Sequence
  Description of Artificial Sequence: Synthetic oligonucleotide
cgaatctggggaccctgcgcgg

SEQ ID NO: 1142 - DNA, 24 bp, Artificial Sequence
  Description of Artificial Sequence: Synthetic oligonucleotide
gaatctggggaccctgcgcggcta

SEQ ID NO: 1143 - DNA, 26 bp, Artificial Sequence
  Description of Artificial Sequence: Synthetic oligonucleotide
aatctggggaccctgcgcggctacta

SEQ ID NO: 1144 - DNA, 25 bp, Artificial Sequence
  Description of Artificial Sequence: Synthetic oligonucleotide
atctggggaccctgcgcggctacta

SEQ ID NO: 1145 - DNA, 24 bp, Artificial Sequence
  Description of Artificial Sequence: Synthetic oligonucleotide
tctggggaccctgcgcggctacta

SEQ ID NO: 1146 - DNA, 21 bp, Artificial Sequence
  Description of Artificial Sequence: Synthetic oligonucleotide
ggggagccccgcttcatcgcg

SEQ ID NO: 1147 - DNA, 22 bp, Artificial Sequence
  Description of Artificial Sequence: Synthetic oligonucleotide
gggagccccgcttcatcgcggt

SEQ ID NO: 1148 - DNA, 22 bp, Artificial Sequence
  Description of Artificial Sequence: Synthetic oligonucleotide
ggagccccgcttcatcgcggtg

SEQ ID NO: 1149 - DNA, 22 bp, Artificial Sequence
  Description of Artificial Sequence: Synthetic oligonucleotide
gagccccgcttcatcgcggtgg

SEQ ID NO: 1150 - DNA, 22 bp, Artificial Sequence
  Description of Artificial Sequence: Synthetic oligonucleotide
agccccgcttcatcgcggtggg

SEQ ID NO: 1151 - DNA, 21 bp, Artificial Sequence
  Description of Artificial Sequence: Synthetic oligonucleotide
gccccgcttcatcgcggtggg

SEQ ID NO: 1152 - DNA, 23 bp, Artificial Sequence
  Description of Artificial Sequence: Synthetic oligonucleotide
ccccgcttcatcgcggtgggcta

SEQ ID NO: 1153 - DNA, 23 bp, Artificial Sequence
  Description of Artificial Sequence: Synthetic oligonucleotide
cccgcttcatcgcggtgggctac

SEQ ID NO: 1154 - DNA, 24 bp, Artificial Sequence
  Description of Artificial Sequence: Synthetic oligonucleotide
ccgcttcatcgcggtgggctacgt

SEQ ID NO: 1155 - DNA, 24 bp, Artificial Sequence
  Description of Artificial Sequence: Synthetic oligonucleotide
cgcttcatcgcggtgggctacgtg

SEQ ID NO: 1156 - DNA, 25 bp, Artificial Sequence
  Description of Artificial Sequence: Synthetic oligonucleotide
gcttcatcgcggtgggctacgtgga

SEQ ID NO: 1157 - DNA, 25 bp, Artificial Sequence
  Description of Artificial Sequence: Synthetic oligonucleotide
cttcatcgcggtgggctacgtggac

SEQ ID NO: 1158 - DNA, 26 bp, Artificial Sequence
  Description of Artificial Sequence: Synthetic oligonucleotide
ttcatcgcggtgggctacgtggacga

SEQ ID NO: 1159 - DNA, 25 bp, Artificial Sequence
  Description of Artificial Sequence: Synthetic oligonucleotide
tcatcgcggtgggctacgtggacga

SEQ ID NO: 1160 - DNA, 24 bp, Artificial Sequence
  Description of Artificial Sequence: Synthetic oligonucleotide
catcgcggtgggctacgtggacga

SEQ ID NO: 1161 - DNA, 25 bp, Artificial Sequence
  Description of Artificial Sequence: Synthetic oligonucleotide
atcgcggtgggctacgtggacgaca

SEQ ID NO: 1162 - DNA, 24 bp, Artificial Sequence
  Description of Artificial Sequence: Synthetic oligonucleotide
tcgcggtgggctacgtggacgaca

SEQ ID NO: 1163 - DNA, 23 bp, Artificial Sequence
  Description of Artificial Sequence: Synthetic oligonucleotide
cgcggtgggctacgtggacgaca

SEQ ID NO: 1164 - DNA, 23 bp, Artificial Sequence
  Description of Artificial Sequence: Synthetic oligonucleotide
gcggtgggctacgtggacgacac

SEQ ID NO: 1165 - DNA, 23 bp, Artificial Sequence
  Description of Artificial Sequence: Synthetic oligonucleotide
cggtgggctacgtggacgacacg

SEQ ID NO: 1166 - DNA, 24 bp, Artificial Sequence
  Description of Artificial Sequence: Synthetic oligonucleotide
ggtgggctacgtggacgacacgca

SEQ ID NO: 1167 - DNA, 31 bp, Artificial Sequence
  Description of Artificial Sequence: Synthetic oligonucleotide
tacgacggcaaggattacatcgccctgaatg

SEQ ID NO: 1168 - DNA, 30 bp, Artificial Sequence
  Description of Artificial Sequence: Synthetic oligonucleotide
acgacggcaaggattacatcgccctgaatg

SEQ ID NO: 1169 - DNA, 29 bp, Artificial Sequence
  Description of Artificial Sequence: Synthetic oligonucleotide
cgacggcaaggattacatcgccctgaatg

SEQ ID NO: 1170 - DNA, 30 bp, Artificial Sequence
  Description of Artificial Sequence: Synthetic oligonucleotide
gacggcaaggattacatcgccctgaatgag

SEQ ID NO: 1171 - DNA, 30 bp, Artificial Sequence
  Description of Artificial Sequence: Synthetic oligonucleotide
acggcaaggattacatcgccctgaatgagg

SEQ ID NO: 1172 - DNA, 29 bp, Artificial Sequence
  Description of Artificial Sequence: Synthetic oligonucleotide
cggcaaggattacatcgccctgaatgagg

SEQ ID NO: 1173 - DNA, 30 bp, Artificial Sequence
  Description of Artificial Sequence: Synthetic oligonucleotide
ggcaaggattacatcgccctgaatgaggac

SEQ ID NO: 1174 - DNA, 30 bp, Artificial Sequence
  Description of Artificial Sequence: Synthetic oligonucleotide
gcaaggattacatcgccctgaatgaggacc

SEQ ID NO: 1175 - DNA, 31 bp, Artificial Sequence
  Description of Artificial Sequence: Synthetic oligonucleotide
caaggattacatcgccctgaatgaggacctg

SEQ ID NO: 1176 - DNA, 31 bp, Artificial Sequence
  Description of Artificial Sequence: Synthetic oligonucleotide
aaggattacatcgccctgaatgaggacctgc

SEQ ID NO: 1177 - DNA, 30 bp, Artificial Sequence
  Description of Artificial Sequence: Synthetic oligonucleotide
aggattacatcgccctgaatgaggacctgc

SEQ ID NO: 1178 - DNA, 29 bp, Artificial Sequence
  Description of Artificial Sequence: Synthetic oligonucleotide
ggattacatcgccctgaatgaggacctgc

SEQ ID NO: 1179 - DNA, 29 bp, Artificial Sequence
  Description of Artificial Sequence: Synthetic oligonucleotide
gattacatcgccctgaatgaggacctgcg

SEQ ID NO: 1180 - DNA, 29 bp, Artificial Sequence
  Description of Artificial Sequence: Synthetic oligonucleotide
attacatcgccctgaatgaggacctgcgc

SEQ ID NO: 1181 - DNA, 28 bp, Artificial Sequence
  Description of Artificial Sequence: Synthetic oligonucleotide
ttacatcgccctgaatgaggacctgcgc

SEQ ID NO: 1182 - DNA, 27 bp, Artificial Sequence
  Description of Artificial Sequence: Synthetic oligonucleotide
tacatcgccctgaatgaggacctgcgc

SEQ ID NO: 1183 - DNA, 27 bp, Artificial Sequence
  Description of Artificial Sequence: Synthetic oligonucleotide
acatcgccctgaatgaggacctgcgct

SEQ ID NO: 1184 - DNA, 26 bp, Artificial Sequence
  Description of Artificial Sequence: Synthetic oligonucleotide
catcgccctgaatgaggacctgcgct

SEQ ID NO: 1185 - DNA, 27 bp, Artificial Sequence
  Description of Artificial Sequence: Synthetic oligonucleotide
atcgccctgaatgaggacctgcgctct

SEQ ID NO: 1186 - DNA, 27 bp, Artificial Sequence
  Description of Artificial Sequence: Synthetic oligonucleotide
tcgccctgaatgaggacctgcgctctt

SEQ ID NO: 1187 - DNA, 26 bp, Artificial Sequence
  Description of Artificial Sequence: Synthetic oligonucleotide
cgccctgaatgaggacctgcgctctt

SEQ ID NO: 1188 - DNA, 26 bp, Artificial Sequence
  Description of Artificial Sequence: Synthetic oligonucleotide
gccctgaatgaggacctgcgctcttg

SEQ ID NO: 1189 - DNA, 27 bp, Artificial Sequence
  Description of Artificial Sequence: Synthetic oligonucleotide
ccctgaatgaggacctgcgctcttgga

SEQ ID NO: 1190 - DNA, 27 bp, Artificial Sequence
  Description of Artificial Sequence: Synthetic oligonucleotide
cctgaatgaggacctgcgctcttggac

SEQ ID NO: 1191 - DNA, 27 bp, Artificial Sequence
  Description of Artificial Sequence: Synthetic oligonucleotide
ctgaatgaggacctgcgctcttggacc

SEQ ID NO: 1192 - DNA, 27 bp, Artificial Sequence
  Description of Artificial Sequence: Synthetic oligonucleotide
tgaatgaggacctgcgctcttggaccg

SEQ ID NO: 1193 - DNA, 26 bp, Artificial Sequence
  Description of Artificial Sequence: Synthetic oligonucleotide
gaatgaggacctgcgctcttggaccg

SEQ ID NO: 1194 - DNA, 26 bp, Artificial Sequence
  Description of Artificial Sequence: Synthetic oligonucleotide
aatgaggacctgcgctcttggaccgc

SEQ ID NO: 1195 - DNA, 25 bp, Artificial Sequence
  Description of Artificial Sequence: Synthetic oligonucleotide
atgaggacctgcgctcttggaccgc

SEQ ID NO: 1196 - DNA, 24 bp, Artificial Sequence
  Description of Artificial Sequence: Synthetic oligonucleotide
tgaggacctgcgctcttggaccgc

SEQ ID NO: 1197 - DNA, 27 bp, Artificial Sequence
  Description of Artificial Sequence: Synthetic oligonucleotide
gtggatagagcaggaggggccggaata

SEQ ID NO: 1198 - DNA, 29 bp, Artificial Sequence
  Description of Artificial Sequence: Synthetic oligonucleotide
tggatagagcaggaggggccggaatattg

SEQ ID NO: 1199 - DNA, 28 bp, Artificial Sequence
  Description of Artificial Sequence: Synthetic oligonucleotide
ggatagagcaggaggggccggaatattg

SEQ ID NO: 1200 - DNA, 28 bp, Artificial Sequence
  Description of Artificial Sequence: Synthetic oligonucleotide
gatagagcaggaggggccggaatattgg

SEQ ID NO: 1201 - DNA, 28 bp, Artificial Sequence
  Description of Artificial Sequence: Synthetic oligonucleotide
atagagcaggaggggccggaatattggg

SEQ ID NO: 1202 - DNA, 27 bp, Artificial Sequence
  Description of Artificial Sequence: Synthetic oligonucleotide
tagagcaggaggggccggaatattggg

SEQ ID NO: 1203 - DNA, 27 bp, Artificial Sequence
  Description of Artificial Sequence: Synthetic oligonucleotide
agagcaggaggggccggaatattggga

SEQ ID NO: 1204 - DNA, 26 bp, Artificial Sequence
  Description of Artificial Sequence: Synthetic oligonucleotide
gagcaggaggggccggaatattggga

SEQ ID NO: 1205 - DNA, 26 bp, Artificial Sequence
  Description of Artificial Sequence: Synthetic oligonucleotide
agcaggaggggccggaatattgggac

SEQ ID NO: 1206 - DNA, 25 bp, Artificial Sequence
  Description of Artificial Sequence: Synthetic oligonucleotide
gcaggaggggccggaatattgggac

SEQ ID NO: 1207 - DNA, 26 bp, Artificial Sequence
  Description of Artificial Sequence: Synthetic oligonucleotide
caggaggggccggaatattgggacca

SEQ ID NO: 1208 - DNA, 26 bp, Artificial Sequence
  Description of Artificial Sequence: Synthetic oligonucleotide
aggaggggccggaatattgggaccag

SEQ ID NO: 1209 - DNA, 25 bp, Artificial Sequence
  Description of Artificial Sequence: Synthetic oligonucleotide
ggaggggccggaatattgggaccag

SEQ ID NO: 1210 - DNA, 26 bp, Artificial Sequence
  Description of Artificial Sequence: Synthetic oligonucleotide
gaggggccggaatattgggaccagga

SEQ ID NO: 1211 - DNA, 27 bp, Artificial Sequence
  Description of Artificial Sequence: Synthetic oligonucleotide
aggggccggaatattgggaccaggaga

SEQ ID NO: 1212 - DNA, 26 bp, Artificial Sequence
  Description of Artificial Sequence: Synthetic oligonucleotide
ggggccggaatattgggaccaggaga

SEQ ID NO: 1213 - DNA, 27 bp, Artificial Sequence
  Description of Artificial Sequence: Synthetic oligonucleotide
gggccggaatattgggaccaggagaca

SEQ ID NO: 1214 - DNA, 27 bp, Artificial Sequence
  Description of Artificial Sequence: Synthetic oligonucleotide
ggccggaatattgggaccaggagacac

SEQ ID NO: 1215 - DNA, 27 bp, Artificial Sequence
  Description of Artificial Sequence: Synthetic oligonucleotide
gccggaatattgggaccaggagacacg

SEQ ID NO: 1216 - DNA, 27 bp, Artificial Sequence
  Description of Artificial Sequence: Synthetic oligonucleotide
ccggaatattgggaccaggagacacgg

SEQ ID NO: 1217 - DNA, 32 bp, Artificial Sequence
  Description of Artificial Sequence: Synthetic oligonucleotide
cggaatattgggaccaggagacacggaatatg

SEQ ID NO: 1218 - DNA, 34 bp, Artificial Sequence
  Description of Artificial Sequence: Synthetic oligonucleotide
ggaatattgggaccaggagacacggaatatgaag

SEQ ID NO: 1219 - DNA, 34 bp, Artificial Sequence
  Description of Artificial Sequence: Synthetic oligonucleotide
gaatattgggaccaggagacacggaatatgaagg

SEQ ID NO: 1220 - DNA, 34 bp, Artificial Sequence
  Description of Artificial Sequence: Synthetic oligonucleotide
aatattgggaccaggagacacggaatatgaaggc

SEQ ID NO: 1221 - DNA, 33 bp, Artificial Sequence
  Description of Artificial Sequence: Synthetic oligonucleotide
atattgggaccaggagacacggaatatgaaggc

SEQ ID NO: 1222 - DNA, 26 bp, Artificial Sequence
  Description of Artificial Sequence: Synthetic oligonucleotide
tgcgtggacgggctccgcagatactt

SEQ ID NO: 1223 - DNA, 25 bp, Artificial Sequence
  Description of Artificial Sequence: Synthetic oligonucleotide
gcgtggacgggctccgcagatactt

SEQ ID NO: 1224 - DNA, 25 bp, Artificial Sequence
  Description of Artificial Sequence: Synthetic oligonucleotide
cgtggacgggctccgcagatacttg

SEQ ID NO: 1225 - DNA, 26 bp, Artificial Sequence
  Description of Artificial Sequence: Synthetic oligonucleotide
gtggacgggctccgcagatacttgga

SEQ ID NO: 1226 - DNA, 27 bp, Artificial Sequence
  Description of Artificial Sequence: Synthetic oligonucleotide
tggacgggctccgcagatacttggaga

SEQ ID NO: 1227 - DNA, 27 bp, Artificial Sequence
  Description of Artificial Sequence: Synthetic oligonucleotide
ggacgggctccgcagatacttggagaa

SEQ ID NO: 1228 - DNA, 27 bp, Artificial Sequence
  Description of Artificial Sequence: Synthetic oligonucleotide
gacgggctccgcagatacttggagaac

SEQ ID NO: 1229 - DNA, 27 bp, Artificial Sequence
  Description of Artificial Sequence: Synthetic oligonucleotide
acgggctccgcagatacttggagaacg

SEQ ID NO: 1230 - DNA, 26 bp, Artificial Sequence
  Description of Artificial Sequence: Synthetic oligonucleotide
cgggctccgcagatacttggagaacg

SEQ ID NO: 1231 - DNA, 26 bp, Artificial Sequence
  Description of Artificial Sequence: Synthetic oligonucleotide
gggctccgcagatacttggagaacgg

SEQ ID NO: 1232 - DNA, 27 bp, Artificial Sequence
  Description of Artificial Sequence: Synthetic oligonucleotide
ggctccgcagatacttggagaacggga

SEQ ID NO: 1233 - DNA, 28 bp, Artificial Sequence
  Description of Artificial Sequence: Synthetic oligonucleotide
gctccgcagatacttggagaacgggaag

SEQ ID NO: 1234 - DNA, 28 bp, Artificial Sequence
  Description of Artificial Sequence: Synthetic oligonucleotide
ctccgcagatacttggagaacgggaagg

SEQ ID NO: 1235 - DNA, 29 bp, Artificial Sequence
  Description of Artificial Sequence: Synthetic oligonucleotide
tccgcagatacttggagaacgggaaggag

SEQ ID NO: 1236 - DNA, 28 bp, Artificial Sequence
  Description of Artificial Sequence: Synthetic oligonucleotide
ccgcagatacttggagaacgggaaggag

SEQ ID NO: 1237 - DNA, 29 bp, Artificial Sequence
  Description of Artificial Sequence: Synthetic oligonucleotide
cgcagatacttggagaacgggaaggagac

SEQ ID NO: 1238 - DNA, 29 bp, Artificial Sequence
  Description of Artificial Sequence: Synthetic oligonucleotide
gcagatacttggagaacgggaaggagacg

SEQ ID NO: 1239 - DNA, 29 bp, Artificial Sequence
  Description of Artificial Sequence: Synthetic oligonucleotide
cagatacttggagaacgggaaggagacgc

SEQ ID NO: 1240 - DNA, 30 bp, Artificial Sequence
  Description of Artificial Sequence: Synthetic oligonucleotide
agatacttggagaacgggaaggagacgctg

SEQ ID NO: 1241 - DNA, 29 bp, Artificial Sequence
  Description of Artificial Sequence: Synthetic oligonucleotide
gatacttggagaacgggaaggagacgctg

SEQ ID NO: 1242 - DNA, 29 bp, Artificial Sequence
  Description of Artificial Sequence: Synthetic oligonucleotide
atacttggagaacgggaaggagacgctgc

SEQ ID NO: 1243 - DNA, 28 bp, Artificial Sequence
  Description of Artificial Sequence: Synthetic oligonucleotide
tacttggagaacgggaaggagacgctgc

SEQ ID NO: 1244 - DNA, 27 bp, Artificial Sequence
  Description of Artificial Sequence: Synthetic oligonucleotide
acttggagaacgggaaggagacgctgc

SEQ ID NO: 1245 - DNA, 27 bp, Artificial Sequence
  Description of Artificial Sequence: Synthetic oligonucleotide
cttggagaacgggaaggagacgctgca

SEQ ID NO: 1246 - DNA, 27 bp, Artificial Sequence
  Description of Artificial Sequence: Synthetic oligonucleotide
ttggagaacgggaaggagacgctgcag

SEQ ID NO: 1247 - DNA, 21 bp, Artificial Sequence
  Description of Artificial Sequence: Synthetic oligonucleotide
acatccgtgtcccggcccggg

SEQ ID NO: 1248 - DNA, 20 bp, Artificial Sequence
  Description of Artificial Sequence: Synthetic oligonucleotide
catccgtgtcccggcccggg

SEQ ID NO: 1249 - DNA, 20 bp, Artificial Sequence
  Description of Artificial Sequence: Synthetic oligonucleotide
atccgtgtcccggcccgggc

SEQ ID NO: 1250 - DNA, 20 bp, Artificial Sequence
  Description of Artificial Sequence: Synthetic oligonucleotide
tccgtgtcccggcccgggct

SEQ ID NO: 1251 - DNA, 20 bp, Artificial Sequence
  Description of Artificial Sequence: Synthetic oligonucleotide
ccgtgtcccggcccgggctt

SEQ ID NO: 1252 - DNA, 20 bp, Artificial Sequence
  Description of Artificial Sequence: Synthetic oligonucleotide
cgtgtcccggcccgggcgtt

SEQ ID NO: 1253 - DNA, 20 bp, Artificial Sequence
  Description of Artificial Sequence: Synthetic oligonucleotide
gtgtcccggcccgggcgctt

SEQ ID NO: 1254 - DNA, 20 bp, Artificial Sequence
  Description of Artificial Sequence: Synthetic oligonucleotide
tgtcccggcccgggcgcgtt

SEQ ID NO: 1255 - DNA, 20 bp, Artificial Sequence
  Description of Artificial Sequence: Synthetic oligonucleotide
gtcccggcccgggcgcgttt

SEQ ID NO: 1256 - DNA, 20 bp, Artificial Sequence
  Description of Artificial Sequence: Synthetic oligonucleotide
tcccggcccgggcgcggttt

SEQ ID NO: 1257 - DNA, 20 bp, Artificial Sequence
  Description of Artificial Sequence: Synthetic oligonucleotide
cccggcccgggcgcggtttt

SEQ ID NO: 1258 - DNA, 20 bp, Artificial Sequence
  Description of Artificial Sequence: Synthetic oligonucleotide
ccggcccgggcgcgggtttt

SEQ ID NO: 1259 - DNA, 20 bp, Artificial Sequence
  Description of Artificial Sequence: Synthetic oligonucleotide
cggcccgggcgcggggattt

SEQ ID NO: 1260 - DNA, 20 bp, Artificial Sequence
  Description of Artificial Sequence: Synthetic oligonucleotide
ggcccgggcgcggggagttt

SEQ ID NO: 1261 - DNA, 20 bp, Artificial Sequence
  Description of Artificial Sequence: Synthetic oligonucleotide
gcccgggcgcggggagcttt

SEQ ID NO: 1262 - DNA, 20 bp, Artificial Sequence
  Description of Artificial Sequence: Synthetic oligonucleotide
cccgggcgcggggagccttt

SEQ ID NO: 1263 - DNA, 20 bp, Artificial Sequence
  Description of Artificial Sequence: Synthetic oligonucleotide
ccgggcgcggggagcccttt

SEQ ID NO: 1264 - DNA, 20 bp, Artificial Sequence
  Description of Artificial Sequence: Synthetic oligonucleotide
cgggcgcggggagccccttt

SEQ ID NO: 1265 - DNA, 20 bp, Artificial Sequence
  Description of Artificial Sequence: Synthetic oligonucleotide
gggcgcggggagccccgttt

SEQ ID NO: 1266 - DNA, 20 bp, Artificial Sequence
  Description of Artificial Sequence: Synthetic oligonucleotide
ggcgcggggagccccgcttt

SEQ ID NO: 1267 - DNA, 21 bp, Artificial Sequence
  Description of Artificial Sequence: Synthetic oligonucleotide
gcgcggggagccccgcttcat

SEQ ID NO: 1268 - DNA, 24 bp, Artificial Sequence
  Description of Artificial Sequence: Synthetic oligonucleotide
gaggacctgcgctcttggaccgca

SEQ ID NO: 1269 - DNA, 24 bp, Artificial Sequence
  Description of Artificial Sequence: Synthetic oligonucleotide
aggacctgcgctcttggaccgcag

SEQ ID NO: 1270 - DNA, 23 bp, Artificial Sequence
  Description of Artificial Sequence: Synthetic oligonucleotide
ggacctgcgctcttggaccgcag

SEQ ID NO: 1271 - DNA, 23 bp, Artificial Sequence
  Description of Artificial Sequence: Synthetic oligonucleotide
gacctgcgctcttggaccgcagc

SEQ ID NO: 1272 - DNA, 23 bp, Artificial Sequence
  Description of Artificial Sequence: Synthetic oligonucleotide
acctgcgctcttggaccgcagcg

SEQ ID NO: 1273 - DNA, 22 bp, Artificial Sequence
  Description of Artificial Sequence: Synthetic oligonucleotide
cctgcgctcttggaccgcagcg

SEQ ID NO: 1274 - DNA, 23 bp, Artificial Sequence
  Description of Artificial Sequence: Synthetic oligonucleotide
ctgcgctcttggaccgcagcgga

SEQ ID NO: 1275 - DNA, 25 bp, Artificial Sequence
  Description of Artificial Sequence: Synthetic oligonucleotide
tgcgctcttggaccgcagcggacat

SEQ ID NO: 1276 - DNA, 24 bp, Artificial Sequence
  Description of Artificial Sequence: Synthetic oligonucleotide
gcgctcttggaccgcagcggacat

SEQ ID NO: 1277 - DNA, 24 bp, Artificial Sequence
  Description of Artificial Sequence: Synthetic oligonucleotide
cgctcttggaccgcagcggacatg

SEQ ID NO: 1278 - DNA, 24 bp, Artificial Sequence
  Description of Artificial Sequence: Synthetic oligonucleotide
gctcttggaccgcagcggacatgg

SEQ ID NO: 1279 - DNA, 25 bp, Artificial Sequence
  Description of Artificial Sequence: Synthetic oligonucleotide
ctcttggaccgcagcggacatggca

SEQ ID NO: 1280 - DNA, 25 bp, Artificial Sequence
  Description of Artificial Sequence: Synthetic oligonucleotide
tcttggaccgcagcggacatggcag

SEQ ID NO: 1281 - DNA, 24 bp, Artificial Sequence
  Description of Artificial Sequence: Synthetic oligonucleotide
cttggaccgcagcggacatggcag

SEQ ID NO: 1282 - DNA, 25 bp, Artificial Sequence
  Description of Artificial Sequence: Synthetic oligonucleotide
ttggaccgcagcggacatggcagct

SEQ ID NO: 1283 - DNA, 24 bp, Artificial Sequence
  Description of Artificial Sequence: Synthetic oligonucleotide
tggaccgcagcggacatggcagct

SEQ ID NO: 1284 - DNA, 23 bp, Artificial Sequence
  Description of Artificial Sequence: Synthetic oligonucleotide
ggaccgcagcggacatggcagct

SEQ ID NO: 1285 - DNA, 24 bp, Artificial Sequence
  Description of Artificial Sequence: Synthetic oligonucleotide
gaccgcagcggacatggcagctca

SEQ ID NO: 1286 - DNA, 26 bp, Artificial Sequence
  Description of Artificial Sequence: Synthetic oligonucleotide
accgcagcggacatggcagctcagat

SEQ ID NO: 1287 - DNA, 25 bp, Artificial Sequence
  Description of Artificial Sequence: Synthetic oligonucleotide
ccgcagcggacatggcagctcagat

SEQ ID NO: 1288 - DNA, 26 bp, Artificial Sequence
  Description of Artificial Sequence: Synthetic oligonucleotide
cgcagcggacatggcagctcagatca

SEQ ID NO: 1289 - DNA, 26 bp, Artificial Sequence
  Description of Artificial Sequence: Synthetic oligonucleotide
gcagcggacatggcagctcagatcac

SEQ ID NO: 1290 - DNA, 27 bp, Artificial Sequence
  Description of Artificial Sequence: Synthetic oligonucleotide
cagcggacatggcagctcagatcacca

SEQ ID NO: 1291 - DNA, 28 bp, Artificial Sequence
  Description of Artificial Sequence: Synthetic oligonucleotide
agcggacatggcagctcagatcaccaag

SEQ ID NO: 1292 - DNA, 22 bp, Artificial Sequence
  Description of Artificial Sequence: Synthetic oligonucleotide
cggttcgacagcgacgccgcca

SEQ ID NO: 1293 - DNA, 22 bp, Artificial Sequence
  Description of Artificial Sequence: Synthetic oligonucleotide
ggttcgacagcgacgccgccag

SEQ ID NO: 1294 - DNA, 22 bp, Artificial Sequence
  Description of Artificial Sequence: Synthetic oligonucleotide
gttcgacagcgacgccgccagc

SEQ ID NO: 1295 - DNA, 23 bp, Artificial Sequence
  Description of Artificial Sequence: Synthetic oligonucleotide
ttcgacagcgacgccgccagcca

SEQ ID NO: 1296 - DNA, 22 bp, Artificial Sequence
  Description of Artificial Sequence: Synthetic oligonucleotide
tcgacagcgacgccgccagcca

SEQ ID NO: 1297 - DNA, 21 bp, Artificial Sequence
  Description of Artificial Sequence: Synthetic oligonucleotide
cgacagcgacgccgccagcca

SEQ ID NO: 1298 - DNA, 23 bp, Artificial Sequence
  Description of Artificial Sequence: Synthetic oligonucleotide
gacagcgacgccgccagccagaa

SEQ ID NO: 1299 - DNA, 25 bp, Artificial Sequence
  Description of Artificial Sequence: Synthetic oligonucleotide
acagcgacgccgccagccagaagat

SEQ ID NO: 1300 - DNA, 24 bp, Artificial Sequence
  Description of Artificial Sequence: Synthetic oligonucleotide
cagcgacgccgccagccagaagat

SEQ ID NO: 1301 - DNA, 24 bp, Artificial Sequence
  Description of Artificial Sequence: Synthetic oligonucleotide
agcgacgccgccagccagaagatg

SEQ ID NO: 1302 - DNA, 23 bp, Artificial Sequence
  Description of Artificial Sequence: Synthetic oligonucleotide
gcgacgccgccagccagaagatg

SEQ ID NO: 1303 - DNA, 24 bp, Artificial Sequence
  Description of Artificial Sequence: Synthetic oligonucleotide
cgacgccgccagccagaagatgga

SEQ ID NO: 1304 - DNA, 24 bp, Artificial Sequence
  Description of Artificial Sequence: Synthetic oligonucleotide
gacgccgccagccagaagatggag

SEQ ID NO: 1305 - DNA, 24 bp, Artificial Sequence
  Description of Artificial Sequence: Synthetic oligonucleotide
acgccgccagccagaagatggagc

SEQ ID NO: 1306 - DNA, 23 bp, Artificial Sequence
  Description of Artificial Sequence: Synthetic oligonucleotide
cgccgccagccagaagatggagc

SEQ ID NO: 1307 - DNA, 23 bp, Artificial Sequence
  Description of Artificial Sequence: Synthetic oligonucleotide
gccgccagccagaagatggagcc

SEQ ID NO: 1308 - DNA, 23 bp, Artificial Sequence
  Description of Artificial Sequence: Synthetic oligonucleotide
ccgccagccagaagatggagccg

SEQ ID NO: 1309 - DNA, 23 bp, Artificial Sequence
  Description of Artificial Sequence: Synthetic oligonucleotide
cgccagccagaagatggagccgc

SEQ ID NO: 1310 - DNA, 23 bp, Artificial Sequence
  Description of Artificial Sequence: Synthetic oligonucleotide
gccagccagaagatggagccgcg

SEQ ID NO: 1311 - DNA, 23 bp, Artificial Sequence
  Description of Artificial Sequence: Synthetic oligonucleotide
ccagccagaagatggagccgcgg

SEQ ID NO: 1312 - DNA, 23 bp, Artificial Sequence
  Description of Artificial Sequence: Synthetic oligonucleotide
cagccagaagatggagccgcggg

SEQ ID NO: 1313 - DNA, 27 bp, Artificial Sequence
  Description of Artificial Sequence: Synthetic oligonucleotide
atcaccaagcgcaagtgggaggcggtt

SEQ ID NO: 1314 - DNA, 26 bp, Artificial Sequence
  Description of Artificial Sequence: Synthetic oligonucleotide
tcaccaagcgcaagtgggaggcggtt

SEQ ID NO: 1315 - DNA, 25 bp, Artificial Sequence
  Description of Artificial Sequence: Synthetic oligonucleotide
caccaagcgcaagtgggaggcggtt

SEQ ID NO: 1316 - DNA, 27 bp, Artificial Sequence
  Description of Artificial Sequence: Synthetic oligonucleotide
accaagcgcaagtgggaggcggttcat

SEQ ID NO: 1317 - DNA, 26 bp, Artificial Sequence
  Description of Artificial Sequence: Synthetic oligonucleotide
ccaagcgcaagtgggaggcggttcat

SEQ ID NO: 1318 - DNA, 26 bp, Artificial Sequence
  Description of Artificial Sequence: Synthetic oligonucleotide
caagcgcaagtgggaggcggttcatg

SEQ ID NO: 1319 - DNA, 26 bp, Artificial Sequence
  Description of Artificial Sequence: Synthetic oligonucleotide
aagcgcaagtgggaggcggttcatgc

SEQ ID NO: 1320 - DNA, 25 bp, Artificial Sequence
  Description of Artificial Sequence: Synthetic oligonucleotide
agcgcaagtgggaggcggttcatgc

SEQ ID NO: 1321 - DNA, 24 bp, Artificial Sequence
  Description of Artificial Sequence: Synthetic oligonucleotide
gcgcaagtgggaggcggttcatgc

SEQ ID NO: 1322 - DNA, 24 bp, Artificial Sequence
  Description of Artificial Sequence: Synthetic oligonucleotide
cgcaagtgggaggcggttcatgcg

SEQ ID NO: 1323 - DNA, 24 bp, Artificial Sequence
  Description of Artificial Sequence: Synthetic oligonucleotide
gcaagtgggaggcggttcatgcgg

SEQ ID NO: 1324 - DNA, 24 bp, Artificial Sequence
  Description of Artificial Sequence: Synthetic oligonucleotide
caagtgggaggcggttcatgcggc

SEQ ID NO: 1325 - DNA, 24 bp, Artificial Sequence
  Description of Artificial Sequence: Synthetic oligonucleotide
aagtgggaggcggttcatgcggcg

SEQ ID NO: 1326 - DNA, 23 bp, Artificial Sequence
  Description of Artificial Sequence: Synthetic oligonucleotide
agtgggaggcggttcatgcggcg

SEQ ID NO: 1327 - DNA, 22 bp, Artificial Sequence
  Description of Artificial Sequence: Synthetic oligonucleotide
gtgggaggcggttcatgcggcg

SEQ ID NO: 1328 - DNA, 23 bp, Artificial Sequence
  Description of Artificial Sequence: Synthetic oligonucleotide
tgggaggcggttcatgcggcgga

SEQ ID NO: 1329 - DNA, 22 bp, Artificial Sequence
  Description of Artificial Sequence: Synthetic oligonucleotide
gggaggcggttcatgcggcgga

SEQ ID NO: 1330 - DNA, 22 bp, Artificial Sequence
  Description of Artificial Sequence: Synthetic oligonucleotide
ggaggcggttcatgcggcggag

SEQ ID NO: 1331 - DNA, 23 bp, Artificial Sequence
  Description of Artificial Sequence: Synthetic oligonucleotide
gaggcggttcatgcggcggagca

SEQ ID NO: 1332 - DNA, 23 bp, Artificial Sequence
  Description of Artificial Sequence: Synthetic oligonucleotide
aggcggttcatgcggcggagcag

SEQ ID NO: 1333 - DNA, 22 bp, Artificial Sequence
  Description of Artificial Sequence: Synthetic oligonucleotide
ggcggttcatgcggcggagcag

SEQ ID NO: 1334 - DNA, 22 bp, Artificial Sequence
  Description of Artificial Sequence: Synthetic oligonucleotide
gcggttcatgcggcggagcagc

SEQ ID NO: 1335 - DNA, 22 bp, Artificial Sequence
  Description of Artificial Sequence: Synthetic oligonucleotide
cggttcatgcggcggagcagcg

SEQ ID NO: 1336 - DNA, 23 bp, Artificial Sequence
  Description of Artificial Sequence: Synthetic oligonucleotide
ggttcatgcggcggagcagcgga

SEQ ID NO: 1337 - DNA, 24 bp, Artificial Sequence
  Description of Artificial Sequence: Synthetic oligonucleotide
gttcatgcggcggagcagcggaga

SEQ ID NO: 1338 - DNA, 25 bp, Artificial Sequence
  Description of Artificial Sequence: Synthetic oligonucleotide
ttcatgcggcggagcagcggagagt

SEQ ID NO: 1339 - DNA, 24 bp, Artificial Sequence
  Description of Artificial Sequence: Synthetic oligonucleotide
tcatgcggcggagcagcggagagt

SEQ ID NO: 1340 - DNA, 33 bp, Artificial Sequence
  Description of Artificial Sequence: Synthetic oligonucleotide
gctctcactccatgaggtatttcttcacatccg

SEQ ID NO: 1341 - DNA, 34 bp, Artificial Sequence
  Description of Artificial Sequence: Synthetic oligonucleotide
ctctcactccatgaggtatttcttcacatccgtg

SEQ ID NO: 1342 - DNA, 35 bp, Artificial Sequence
  Description of Artificial Sequence: Synthetic oligonucleotide
tctcactccatgaggtatttcttcacatccgtgtc

SEQ ID NO: 1343 - DNA, 34 bp, Artificial Sequence
  Description of Artificial Sequence: Synthetic oligonucleotide
ctcactccatgaggtatttcttcacatccgtgtc

SEQ ID NO: 1344 - DNA, 34 bp, Artificial Sequence
  Description of Artificial Sequence: Synthetic oligonucleotide
tcactccatgaggtatttcttcacatccgtgtcc

SEQ ID NO: 1345 - DNA, 27 bp, Artificial Sequence
  Description of Artificial Sequence: Synthetic oligonucleotide
agaacgggaaggagacgctgcagcgta

SEQ ID NO: 1346 - DNA, 26 bp, Artificial Sequence
  Description of Artificial Sequence: Synthetic oligonucleotide
gaacgggaaggagacgctgcagcgta

SEQ ID NO: 1347 - DNA, 26 bp, Artificial Sequence
  Description of Artificial Sequence: Synthetic oligonucleotide
aacgggaaggagacgctgcagcgtac

SEQ ID NO: 1348 - DNA, 25 bp, Artificial Sequence
  Description of Artificial Sequence: Synthetic oligonucleotide
acgggaaggagacgctgcagcgtac

SEQ ID NO: 1349 - DNA, 24 bp, Artificial Sequence
  Description of Artificial Sequence: Synthetic oligonucleotide
cgggaaggagacgctgcagcgtac

SEQ ID NO: 1350 - DNA, 24 bp, Artificial Sequence
  Description of Artificial Sequence: Synthetic oligonucleotide
gggaaggagacgctgcagcgtacg

SEQ ID NO: 1351 - DNA, 24 bp, Artificial Sequence
  Description of Artificial Sequence: Synthetic oligonucleotide
ggaaggagacgctgcagcgtacgg

SEQ ID NO: 1352 - DNA, 24 bp, Artificial Sequence
  Description of Artificial Sequence: Synthetic oligonucleotide
tgcggttcgacagcgacgccgcaa

SEQ ID NO: 1353 - DNA, 23 bp, Artificial Sequence
  Description of Artificial Sequence: Synthetic oligonucleotide
gcggttcgacagcgacgccgcaa

SEQ ID NO: 1354 - DNA, 23 bp, Artificial Sequence
  Description of Artificial Sequence: Synthetic oligonucleotide
cggttcgacagcgacgccgcaag

SEQ ID NO: 1355 - DNA, 23 bp, Artificial Sequence
  Description of Artificial Sequence: Synthetic oligonucleotide
ggttcgacagcgacgccgcaagc

SEQ ID NO: 1356 - DNA, 24 bp, Artificial Sequence
  Description of Artificial Sequence: Synthetic oligonucleotide
gttcgacagcgacgccgcaagcca

SEQ ID NO: 1357 - DNA, 26 bp, Artificial Sequence
  Description of Artificial Sequence: Synthetic oligonucleotide
ttcgacagcgacgccgcaagccagaa

SEQ ID NO: 1358 - DNA, 25 bp, Artificial Sequence
  Description of Artificial Sequence: Synthetic oligonucleotide
tcgacagcgacgccgcaagccagaa

SEQ ID NO: 1359 - DNA, 24 bp, Artificial Sequence
  Description of Artificial Sequence: Synthetic oligonucleotide
cgacagcgacgccgcaagccagaa

SEQ ID NO: 1360 - DNA, 26 bp, Artificial Sequence
  Description of Artificial Sequence: Synthetic oligonucleotide
gacagcgacgccgcaagccagaagat

SEQ ID NO: 1361 - DNA, 26 bp, Artificial Sequence
  Description of Artificial Sequence: Synthetic oligonucleotide
acagcgacgccgcaagccagaagatg

SEQ ID NO: 1362 - DNA, 25 bp, Artificial Sequence
  Description of Artificial Sequence: Synthetic oligonucleotide
cagcgacgccgcaagccagaagatg

SEQ ID NO: 1363 - DNA, 26 bp, Artificial Sequence
  Description of Artificial Sequence: Synthetic oligonucleotide
agcgacgccgcaagccagaagatgga

SEQ ID NO: 1364 - DNA, 25 bp, Artificial Sequence
  Description of Artificial Sequence: Synthetic oligonucleotide
gcgacgccgcaagccagaagatgga

SEQ ID NO: 1365 - DNA, 25 bp, Artificial Sequence
  Description of Artificial Sequence: Synthetic oligonucleotide
cgacgccgcaagccagaagatggag

SEQ ID NO: 1366 - DNA, 25 bp, Artificial Sequence
  Description of Artificial Sequence: Synthetic oligonucleotide
gacgccgcaagccagaagatggagc

SEQ ID NO: 1367 - DNA, 25 bp, Artificial Sequence
  Description of Artificial Sequence: Synthetic oligonucleotide
acgccgcaagccagaagatggagcc

SEQ ID NO: 1368 - DNA, 24 bp, Artificial Sequence
  Description of Artificial Sequence: Synthetic oligonucleotide
cgccgcaagccagaagatggagcc

SEQ ID NO: 1369 - DNA, 24 bp, Artificial Sequence
  Description of Artificial Sequence: Synthetic oligonucleotide
gccgcaagccagaagatggagccg

SEQ ID NO: 1370 - DNA, 24 bp, Artificial Sequence
  Description of Artificial Sequence: Synthetic oligonucleotide
ccgcaagccagaagatggagccgc

SEQ ID NO: 1371 - DNA, 24 bp, Artificial Sequence
  Description of Artificial Sequence: Synthetic oligonucleotide
cgcaagccagaagatggagccgcg

SEQ ID NO: 1372 - DNA, 24 bp, Artificial Sequence
  Description of Artificial Sequence: Synthetic oligonucleotide
gcaagccagaagatggagccgcgg

SEQ ID NO: 1373 - DNA, 24 bp, Artificial Sequence
  Description of Artificial Sequence: Synthetic oligonucleotide
caagccagaagatggagccgcggg

SEQ ID NO: 1374 - DNA, 24 bp, Artificial Sequence
  Description of Artificial Sequence: Synthetic oligonucleotide
aagccagaagatggagccgcgggc

SEQ ID NO: 1375 - DNA, 24 bp, Artificial Sequence
  Description of Artificial Sequence: Synthetic oligonucleotide
aagtgggaggcggtccatgcggca

SEQ ID NO: 1376 - DNA, 23 bp, Artificial Sequence
  Description of Artificial Sequence: Synthetic oligonucleotide
agtgggaggcggtccatgcggca

SEQ ID NO: 1377 - DNA, 22 bp, Artificial Sequence
  Description of Artificial Sequence: Synthetic oligonucleotide
gtgggaggcggtccatgcggca

SEQ ID NO: 1378 - DNA, 23 bp, Artificial Sequence
  Description of Artificial Sequence: Synthetic oligonucleotide
tgggaggcggtccatgcggcaga

SEQ ID NO: 1379 - DNA, 22 bp, Artificial Sequence
  Description of Artificial Sequence: Synthetic oligonucleotide
gggaggcggtccatgcggcaga

SEQ ID NO: 1380 - DNA, 22 bp, Artificial Sequence
  Description of Artificial Sequence: Synthetic oligonucleotide
ggaggcggtccatgcggcagag

SEQ ID NO: 1381 - DNA, 23 bp, Artificial Sequence
  Description of Artificial Sequence: Synthetic oligonucleotide
gaggcggtccatgcggcagagca

SEQ ID NO: 1382 - DNA, 23 bp, Artificial Sequence
  Description of Artificial Sequence: Synthetic oligonucleotide
aggcggtccatgcggcagagcag

SEQ ID NO: 1383 - DNA, 22 bp, Artificial Sequence
  Description of Artificial Sequence: Synthetic oligonucleotide
ggcggtccatgcggcagagcag

SEQ ID NO: 1384 - DNA, 22 bp, Artificial Sequence
  Description of Artificial Sequence: Synthetic oligonucleotide
gcggtccatgcggcagagcagc

SEQ ID NO: 1385 - DNA, 22 bp, Artificial Sequence
  Description of Artificial Sequence: Synthetic oligonucleotide
cggtccatgcggcagagcagcg

SEQ ID NO: 1386 - DNA, 23 bp, Artificial Sequence
  Description of Artificial Sequence: Synthetic oligonucleotide
ggtccatgcggcagagcagcgga

SEQ ID NO: 1387 - DNA, 24 bp, Artificial Sequence
  Description of Artificial Sequence: Synthetic oligonucleotide
gtccatgcggcagagcagcggaga

SEQ ID NO: 1388 - DNA, 25 bp, Artificial Sequence
  Description of Artificial Sequence: Synthetic oligonucleotide
tccatgcggcagagcagcggagagt

SEQ ID NO: 1389 - DNA, 24 bp, Artificial Sequence
  Description of Artificial Sequence: Synthetic oligonucleotide
ccatgcggcagagcagcggagagt

SEQ ID NO: 1390 - DNA, 26 bp, Artificial Sequence
  Description of Artificial Sequence: Synthetic oligonucleotide
catgcggcagagcagcggagagtcta

SEQ ID NO: 1391 - DNA, 26 bp, Artificial Sequence
  Description of Artificial Sequence: Synthetic oligonucleotide
atgcggcagagcagcggagagtctac

SEQ ID NO: 1392 - DNA, 25 bp, Artificial Sequence
  Description of Artificial Sequence: Synthetic oligonucleotide
tgcggcagagcagcggagagtctac

SEQ ID NO: 1393 - DNA, 24 bp, Artificial Sequence
  Description of Artificial Sequence: Synthetic oligonucleotide
gcggcagagcagcggagagtctac

SEQ ID NO: 1394 - DNA, 25 bp, Artificial Sequence
  Description of Artificial Sequence: Synthetic oligonucleotide
cggcagagcagcggagagtctacct

SEQ ID NO: 1395 - DNA, 25 bp, Artificial Sequence
  Description of Artificial Sequence: Synthetic oligonucleotide
ggcagagcagcggagagtctacctg

SEQ ID NO: 1396 - DNA, 26 bp, Artificial Sequence
  Description of Artificial Sequence: Synthetic oligonucleotide
gcagagcagcggagagtctacctgga

SEQ ID NO: 1397 - DNA, 26 bp, Artificial Sequence
  Description of Artificial Sequence: Synthetic oligonucleotide
cagagcagcggagagtctacctggag

SEQ ID NO: 1398 - DNA, 26 bp, Artificial Sequence
  Description of Artificial Sequence: Synthetic oligonucleotide
agagcagcggagagtctacctggagg

SEQ ID NO: 1399 - DNA, 24 bp, Artificial Sequence
  Description of Artificial Sequence: Synthetic oligonucleotide
tatggctgcgacgtggggccggat

SEQ ID NO: 1400 - DNA, 23 bp, Artificial Sequence
  Description of Artificial Sequence: Synthetic oligonucleotide
atggctgcgacgtggggccggat

SEQ ID NO: 1401 - DNA, 22 bp, Artificial Sequence
  Description of Artificial Sequence: Synthetic oligonucleotide
tggctgcgacgtggggccggat

SEQ ID NO: 1402 - DNA, 21 bp, Artificial Sequence
  Description of Artificial Sequence: Synthetic oligonucleotide
ggctgcgacgtggggccggat

SEQ ID NO: 1403 - DNA, 21 bp, Artificial Sequence
  Description of Artificial Sequence: Synthetic oligonucleotide
gctgcgacgtggggccggatg

SEQ ID NO: 1404 - DNA, 21 bp, Artificial Sequence
  Description of Artificial Sequence: Synthetic oligonucleotide
ctgcgacgtggggccggatgg

SEQ ID NO: 1405 - DNA, 21 bp, Artificial Sequence
  Description of Artificial Sequence: Synthetic oligonucleotide
tgcgacgtggggccggatggg

SEQ ID NO: 1406 - DNA, 20 bp, Artificial Sequence
  Description of Artificial Sequence: Synthetic oligonucleotide
gcgacgtggggccggatggg

SEQ ID NO: 1407 - DNA, 20 bp, Artificial Sequence
  Description of Artificial Sequence: Synthetic oligonucleotide
cgacgtggggccggatgggc

SEQ ID NO: 1408 - DNA, 20 bp, Artificial Sequence
  Description of Artificial Sequence: Synthetic oligonucleotide
gacgtggggccggatgggcg

SEQ ID NO: 1409 - DNA, 22 bp, Artificial Sequence
  Description of Artificial Sequence: Synthetic oligonucleotide
acgtggggccggatgggcgctt

SEQ ID NO: 1410 - DNA, 21 bp, Artificial Sequence
  Description of Artificial Sequence: Synthetic oligonucleotide
cgtggggccggatgggcgctt

SEQ ID NO: 1411 - DNA, 21 bp, Artificial Sequence
  Description of Artificial Sequence: Synthetic oligonucleotide
gtggggccggatgggcgcttc

SEQ ID NO: 1412 - DNA, 22 bp, Artificial Sequence
  Description of Artificial Sequence: Synthetic oligonucleotide
tggggccggatgggcgcttcct

SEQ ID NO: 1413 - DNA, 21 bp, Artificial Sequence
  Description of Artificial Sequence: Synthetic oligonucleotide
ggggccggatgggcgcttcct

SEQ ID NO: 1414 - DNA, 21 bp, Artificial Sequence
  Description of Artificial Sequence: Synthetic oligonucleotide
gggccggatgggcgcttcctc

SEQ ID NO: 1415 - DNA, 21 bp, Artificial Sequence
  Description of Artificial Sequence: Synthetic oligonucleotide
ggccggatgggcgcttcctcc

SEQ ID NO: 1416 - DNA, 21 bp, Artificial Sequence
  Description of Artificial Sequence: Synthetic oligonucleotide
gccggatgggcgcttcctccg

SEQ ID NO: 1417 - DNA, 21 bp, Artificial Sequence
  Description of Artificial Sequence: Synthetic oligonucleotide
ccggatgggcgcttcctccgc

SEQ ID NO: 1418 - DNA, 21 bp, Artificial Sequence
  Description of Artificial Sequence: Synthetic oligonucleotide
cggatgggcgcttcctccgcg

SEQ ID NO: 1419 - DNA, 21 bp, Artificial Sequence
  Description of Artificial Sequence: Synthetic oligonucleotide
ggatgggcgcttcctccgcgg

SEQ ID NO: 1420 - DNA, 23 bp, Artificial Sequence
  Description of Artificial Sequence: Synthetic oligonucleotide
gatgggcgcttcctccgcgggta

SEQ ID NO: 1421 - DNA, 23 bp, Artificial Sequence
  Description of Artificial Sequence: Synthetic oligonucleotide
atgggcgcttcctccgcgggtac

SEQ ID NO: 1422 - DNA, 22 bp, Artificial Sequence
  Description of Artificial Sequence: Synthetic oligonucleotide
tgggcgcttcctccgcgggtac

SEQ ID NO: 1423 - DNA, 34 bp, Artificial Sequence
  Description of Artificial Sequence: Synthetic oligonucleotide
actccatgaggtatttcttcacatccgtgtccag

SEQ ID NO: 1424 - DNA, 33 bp, Artificial Sequence
  Description of Artificial Sequence: Synthetic oligonucleotide
ctccatgaggtatttcttcacatccgtgtccag

SEQ ID NO: 1425 - DNA, 33 bp, Artificial Sequence
  Description of Artificial Sequence: Synthetic oligonucleotide
tccatgaggtatttcttcacatccgtgtccagg

SEQ ID NO: 1426 - DNA, 32 bp, Artificial Sequence
  Description of Artificial Sequence: Synthetic oligonucleotide
ccatgaggtatttcttcacatccgtgtccagg

SEQ ID NO: 1427 - DNA, 32 bp, Artificial Sequence
  Description of Artificial Sequence: Synthetic oligonucleotide
catgaggtatttcttcacatccgtgtccaggc

SEQ ID NO: 1428 - DNA, 32 bp, Artificial Sequence
  Description of Artificial Sequence: Synthetic oligonucleotide
atgaggtatttcttcacatccgtgtccaggcc

SEQ ID NO: 1429 - DNA, 31 bp, Artificial Sequence
  Description of Artificial Sequence: Synthetic oligonucleotide
tgaggtatttcttcacatccgtgtccaggcc

SEQ ID NO: 1430 - DNA, 30 bp, Artificial Sequence
  Description of Artificial Sequence: Synthetic oligonucleotide
gaggtatttcttcacatccgtgtccaggcc

SEQ ID NO: 1431 - DNA, 30 bp, Artificial Sequence
  Description of Artificial Sequence: Synthetic oligonucleotide
aggtatttcttcacatccgtgtccaggccc

SEQ ID NO: 1432 - DNA, 29 bp, Artificial Sequence
  Description of Artificial Sequence: Synthetic oligonucleotide
ggtatttcttcacatccgtgtccaggccc

SEQ ID NO: 1433 - DNA, 29 bp, Artificial Sequence
  Description of Artificial Sequence: Synthetic oligonucleotide
gtatttcttcacatccgtgtccaggcccg

SEQ ID NO: 1434 - DNA, 29 bp, Artificial Sequence
  Description of Artificial Sequence: Synthetic oligonucleotide
tatttcttcacatccgtgtccaggcccgg

SEQ ID NO: 1435 - DNA, 28 bp, Artificial Sequence
  Description of Artificial Sequence: Synthetic oligonucleotide
atttcttcacatccgtgtccaggcccgg

SEQ ID NO: 1436 - DNA, 27 bp, Artificial Sequence
  Description of Artificial Sequence: Synthetic oligonucleotide
tttcttcacatccgtgtccaggcccgg

SEQ ID NO: 1437 - DNA, 26 bp, Artificial Sequence
  Description of Artificial Sequence: Synthetic oligonucleotide
ttcttcacatccgtgtccaggcccgg

SEQ ID NO: 1438 - DNA, 25 bp, Artificial Sequence
  Description of Artificial Sequence: Synthetic oligonucleotide
tcttcacatccgtgtccaggcccgg

SEQ ID NO: 1439 - DNA, 24 bp, Artificial Sequence
  Description of Artificial Sequence: Synthetic oligonucleotide
cttcacatccgtgtccaggcccgg

SEQ ID NO: 1440 - DNA, 24 bp, Artificial Sequence
  Description of Artificial Sequence: Synthetic oligonucleotide
ttcacatccgtgtccaggcccggc

SEQ ID NO: 1441 - DNA, 23 bp, Artificial Sequence
  Description of Artificial Sequence: Synthetic oligonucleotide
tcacatccgtgtccaggcccggc

SEQ ID NO: 1442 - DNA, 22 bp, Artificial Sequence
  Description of Artificial Sequence: Synthetic oligonucleotide
cacatccgtgtccaggcccggc

SEQ ID NO: 1443 - DNA, 22 bp, Artificial Sequence
  Description of Artificial Sequence: Synthetic oligonucleotide
acatccgtgtccaggcccggcc

SEQ ID NO: 1444 - DNA, 21 bp, Artificial Sequence
  Description of Artificial Sequence: Synthetic oligonucleotide
catccgtgtccaggcccggcc

SEQ ID NO: 1445 - DNA, 21 bp, Artificial Sequence
  Description of Artificial Sequence: Synthetic oligonucleotide
atccgtgtccaggcccggccg

SEQ ID NO: 1446 - DNA, 20 bp, Artificial Sequence
  Description of Artificial Sequence: Synthetic oligonucleotide
tccgtgtccaggcccggccg

SEQ ID NO: 1447 - DNA, 20 bp, Artificial Sequence
  Description of Artificial Sequence: Synthetic oligonucleotide
ccgtgtccaggcccggccgt

SEQ ID NO: 1448 - DNA, 20 bp, Artificial Sequence
  Description of Artificial Sequence: Synthetic oligonucleotide
cgtgtccaggcccggccgct

SEQ ID NO: 1449 - DNA, 20 bp, Artificial Sequence
  Description of Artificial Sequence: Synthetic oligonucleotide
gtgtccaggcccggccgcgt

SEQ ID NO: 1450 - DNA, 20 bp, Artificial Sequence
  Description of Artificial Sequence: Synthetic oligonucleotide
tgtccaggcccggccgcggt

SEQ ID NO: 1451 - DNA, 20 bp, Artificial Sequence
  Description of Artificial Sequence: Synthetic oligonucleotide
gtccaggcccggccgcggtt

SEQ ID NO: 1452 - DNA, 20 bp, Artificial Sequence
  Description of Artificial Sequence: Synthetic oligonucleotide
tccaggcccggccgcgggtt

SEQ ID NO: 1453 - DNA, 20 bp, Artificial Sequence
  Description of Artificial Sequence: Synthetic oligonucleotide
ccaggcccggccgcgggttt

SEQ ID NO: 1454 - DNA, 20 bp, Artificial Sequence
  Description of Artificial Sequence: Synthetic oligonucleotide
caggcccggccgcggggatt

SEQ ID NO: 1455 - DNA, 20 bp, Artificial Sequence
  Description of Artificial Sequence: Synthetic oligonucleotide
aggcccggccgcggggagtt

SEQ ID NO: 1456 - DNA, 23 bp, Artificial Sequence
  Description of Artificial Sequence: Synthetic oligonucleotide
aggacctgcgctcttggaccgcc

SEQ ID NO: 1457 - DNA, 22 bp, Artificial Sequence
  Description of Artificial Sequence: Synthetic oligonucleotide
ggacctgcgctcttggaccgcc

SEQ ID NO: 1458 - DNA, 22 bp, Artificial Sequence
  Description of Artificial Sequence: Synthetic oligonucleotide
gacctgcgctcttggaccgccg

SEQ ID NO: 1459 - DNA, 22 bp, Artificial Sequence
  Description of Artificial Sequence: Synthetic oligonucleotide
acctgcgctcttggaccgccgc

SEQ ID NO: 1460 - DNA, 21 bp, Artificial Sequence
  Description of Artificial Sequence: Synthetic oligonucleotide
cctgcgctcttggaccgccgc

SEQ ID NO: 1461 - DNA, 21 bp, Artificial Sequence
  Description of Artificial Sequence: Synthetic oligonucleotide
ctgcgctcttggaccgccgcg

SEQ ID NO: 1462 - DNA, 22 bp, Artificial Sequence
  Description of Artificial Sequence: Synthetic oligonucleotide
tgcgctcttggaccgccgcgga

SEQ ID NO: 1463 - DNA, 21 bp, Artificial Sequence
  Description of Artificial Sequence: Synthetic oligonucleotide
gcgctcttggaccgccgcgga

SEQ ID NO: 1464 - DNA, 23 bp, Artificial Sequence
  Description of Artificial Sequence: Synthetic oligonucleotide
cgctcttggaccgccgcggacat

SEQ ID NO: 1465 - DNA, 23 bp, Artificial Sequence
  Description of Artificial Sequence: Synthetic oligonucleotide
gctcttggaccgccgcggacatg

SEQ ID NO: 1466 - DNA, 23 bp, Artificial Sequence
  Description of Artificial Sequence: Synthetic oligonucleotide
ctcttggaccgccgcggacatgg

SEQ ID NO: 1467 - DNA, 24 bp, Artificial Sequence
  Description of Artificial Sequence: Synthetic oligonucleotide
tcttggaccgccgcggacatggca

SEQ ID NO: 1468 - DNA, 23 bp, Artificial Sequence
  Description of Artificial Sequence: Synthetic oligonucleotide
cttggaccgccgcggacatggca

SEQ ID NO: 1469 - DNA, 23 bp, Artificial Sequence
  Description of Artificial Sequence: Synthetic oligonucleotide
ttggaccgccgcggacatggcag

SEQ ID NO: 1470 - DNA, 22 bp, Artificial Sequence
  Description of Artificial Sequence: Synthetic oligonucleotide
tggaccgccgcggacatggcag

SEQ ID NO: 1471 - DNA, 21 bp, Artificial Sequence
  Description of Artificial Sequence: Synthetic oligonucleotide
ggaccgccgcggacatggcag

SEQ ID NO: 1472 - DNA, 22 bp, Artificial Sequence
  Description of Artificial Sequence: Synthetic oligonucleotide
gaccgccgcggacatggcagct

SEQ ID NO: 1473 - DNA, 23 bp, Artificial Sequence
  Description of Artificial Sequence: Synthetic oligonucleotide
accgccgcggacatggcagctca

SEQ ID NO: 1474 - DNA, 22 bp, Artificial Sequence
  Description of Artificial Sequence: Synthetic oligonucleotide
ccgccgcggacatggcagctca

SEQ ID NO: 1475 - DNA, 24 bp, Artificial Sequence
  Description of Artificial Sequence: Synthetic oligonucleotide
cgccgcggacatggcagctcagat

SEQ ID NO: 1476 - DNA, 25 bp, Artificial Sequence
  Description of Artificial Sequence: Synthetic oligonucleotide
gccgcggacatggcagctcagatca

SEQ ID NO: 1477 - DNA, 25 bp, Artificial Sequence
  Description of Artificial Sequence: Synthetic oligonucleotide
ccgcggacatggcagctcagatcac

SEQ ID NO: 1478 - DNA, 27 bp, Artificial Sequence
  Description of Artificial Sequence: Synthetic oligonucleotide
cgcggacatggcagctcagatcaccaa

SEQ ID NO: 1479 - DNA, 28 bp, Artificial Sequence
  Description of Artificial Sequence: Synthetic oligonucleotide
cgggctcccactccatgaggtatttctc

SEQ ID NO: 1480 - DNA, 28 bp, Artificial Sequence
  Description of Artificial Sequence: Synthetic oligonucleotide
gggctcccactccatgaggtatttctcc

SEQ ID NO: 1481 - DNA, 29 bp, Artificial Sequence
  Description of Artificial Sequence: Synthetic oligonucleotide
ggctcccactccatgaggtatttctccac

SEQ ID NO: 1482 - DNA, 31 bp, Artificial Sequence
  Description of Artificial Sequence: Synthetic oligonucleotide
gctcccactccatgaggtatttctccacatc

SEQ ID NO: 1483 - DNA, 31 bp, Artificial Sequence
  Description of Artificial Sequence: Synthetic oligonucleotide
ctcccactccatgaggtatttctccacatcc

SEQ ID NO: 1484 - DNA, 31 bp, Artificial Sequence
  Description of Artificial Sequence: Synthetic oligonucleotide
tcccactccatgaggtatttctccacatccg

SEQ ID NO: 1485 - DNA, 30 bp, Artificial Sequence
  Description of Artificial Sequence: Synthetic oligonucleotide
cccactccatgaggtatttctccacatccg

SEQ ID NO: 1486 - DNA, 31 bp, Artificial Sequence
  Description of Artificial Sequence: Synthetic oligonucleotide
ccactccatgaggtatttctccacatccgtg

SEQ ID NO: 1487 - DNA, 32 bp, Artificial Sequence
  Description of Artificial Sequence: Synthetic oligonucleotide
cactccatgaggtatttctccacatccgtgtc

SEQ ID NO: 1488 - DNA, 32 bp, Artificial Sequence
  Description of Artificial Sequence: Synthetic oligonucleotide
actccatgaggtatttctccacatccgtgtcc

SEQ ID NO: 1489 - DNA, 31 bp, Artificial Sequence
  Description of Artificial Sequence: Synthetic oligonucleotide
ctccatgaggtatttctccacatccgtgtcc

SEQ ID NO: 1490 - DNA, 31 bp, Artificial Sequence
  Description of Artificial Sequence: Synthetic oligonucleotide
tccatgaggtatttctccacatccgtgtccc

SEQ ID NO: 1491 - DNA, 30 bp, Artificial Sequence
  Description of Artificial Sequence: Synthetic oligonucleotide
ccatgaggtatttctccacatccgtgtccc

SEQ ID NO: 1492 - DNA, 30 bp, Artificial Sequence
  Description of Artificial Sequence: Synthetic oligonucleotide
catgaggtatttctccacatccgtgtcccg

SEQ ID NO: 1493 - DNA, 30 bp, Artificial Sequence
  Description of Artificial Sequence: Synthetic oligonucleotide
atgaggtatttctccacatccgtgtcccgg

SEQ ID NO: 1494 - DNA, 29 bp, Artificial Sequence
  Description of Artificial Sequence: Synthetic oligonucleotide
tgaggtatttctccacatccgtgtcccgg

SEQ ID NO: 1495 - DNA, 28 bp, Artificial Sequence
  Description of Artificial Sequence: Synthetic oligonucleotide
gaggtatttctccacatccgtgtcccgg

SEQ ID NO: 1496 - DNA, 28 bp, Artificial Sequence
  Description of Artificial Sequence: Synthetic oligonucleotide
aggtatttctccacatccgtgtcccggc

SEQ ID NO: 1497 - DNA, 27 bp, Artificial Sequence
  Description of Artificial Sequence: Synthetic oligonucleotide
ggtatttctccacatccgtgtcccggc

SEQ ID NO: 1498 - DNA, 27 bp, Artificial Sequence
  Description of Artificial Sequence: Synthetic oligonucleotide
gtatttctccacatccgtgtcccggcc

SEQ ID NO: 1499 - DNA, 27 bp, Artificial Sequence
  Description of Artificial Sequence: Synthetic oligonucleotide
tatttctccacatccgtgtcccggccc

SEQ ID NO: 1500 - DNA, 26 bp, Artificial Sequence
  Description of Artificial Sequence: Synthetic oligonucleotide
atttctccacatccgtgtcccggccc

SEQ ID NO: 1501 - DNA, 25 bp, Artificial Sequence
  Description of Artificial Sequence: Synthetic oligonucleotide
tttctccacatccgtgtcccggccc

SEQ ID NO: 1502 - DNA, 24 bp, Artificial Sequence
  Description of Artificial Sequence: Synthetic oligonucleotide
ttctccacatccgtgtcccggccc

SEQ ID NO: 1503 - DNA, 23 bp, Artificial Sequence
  Description of Artificial Sequence: Synthetic oligonucleotide
tctccacatccgtgtcccggccc

SEQ ID NO: 1504 - DNA, 22 bp, Artificial Sequence
  Description of Artificial Sequence: Synthetic oligonucleotide
ctccacatccgtgtcccggccc

SEQ ID NO: 1505 - DNA, 22 bp, Artificial Sequence
  Description of Artificial Sequence: Synthetic oligonucleotide
tccacatccgtgtcccggcccg

SEQ ID NO: 1506 - DNA, 21 bp, Artificial Sequence
  Description of Artificial Sequence: Synthetic oligonucleotide
ccacatccgtgtcccggcccg

SEQ ID NO: 1507 - DNA, 22 bp, Artificial Sequence
  Description of Artificial Sequence: Synthetic oligonucleotide
acatccgtgtcccggcccggca

SEQ ID NO: 1508 - DNA, 21 bp, Artificial Sequence
  Description of Artificial Sequence: Synthetic oligonucleotide
catccgtgtcccggcccggca

SEQ ID NO: 1509 - DNA, 22 bp, Artificial Sequence
  Description of Artificial Sequence: Synthetic oligonucleotide
atccgtgtcccggcccggcagt

SEQ ID NO: 1510 - DNA, 21 bp, Artificial Sequence
  Description of Artificial Sequence: Synthetic oligonucleotide
tccgtgtcccggcccggcagt

SEQ ID NO: 1511 - DNA, 20 bp, Artificial Sequence
  Description of Artificial Sequence: Synthetic oligonucleotide
ccgtgtcccggcccggcagt

SEQ ID NO: 1512 - DNA, 20 bp, Artificial Sequence
  Description of Artificial Sequence: Synthetic oligonucleotide
cgtgtcccggcccggcagtg

SEQ ID NO: 1513 - DNA, 21 bp, Artificial Sequence
  Description of Artificial Sequence: Synthetic oligonucleotide
gtgtcccggcccggcagtgga

SEQ ID NO: 1514 - DNA, 22 bp, Artificial Sequence
  Description of Artificial Sequence: Synthetic oligonucleotide
tgtcccggcccggcagtggaga

SEQ ID NO: 1515 - DNA, 21 bp, Artificial Sequence
  Description of Artificial Sequence: Synthetic oligonucleotide
gtcccggcccggcagtggaga

SEQ ID NO: 1516 - DNA, 21 bp, Artificial Sequence
  Description of Artificial Sequence: Synthetic oligonucleotide
tcccggcccggcagtggagag

SEQ ID NO: 1517 - DNA, 20 bp, Artificial Sequence
  Description of Artificial Sequence: Synthetic oligonucleotide
cccggcccggcagtggagag

SEQ ID NO: 1518 - DNA, 20 bp, Artificial Sequence
  Description of Artificial Sequence: Synthetic oligonucleotide
ccggcccggcagtggagagc

SEQ ID NO: 1519 - DNA, 20 bp, Artificial Sequence
  Description of Artificial Sequence: Synthetic oligonucleotide
cggcccggcagtggagagcc

SEQ ID NO: 1520 - DNA, 20 bp, Artificial Sequence
  Description of Artificial Sequence: Synthetic oligonucleotide
ggcccggcagtggagagccc

SEQ ID NO: 1521 - DNA, 20 bp, Artificial Sequence
  Description of Artificial Sequence: Synthetic oligonucleotide
gcccggcagtggagagcccc

SEQ ID NO: 1522 - DNA, 20 bp, Artificial Sequence
  Description of Artificial Sequence: Synthetic oligonucleotide
cccggcagtggagagccccg

SEQ ID NO: 1523 - DNA, 22 bp, Artificial Sequence
  Description of Artificial Sequence: Synthetic oligonucleotide
ccggcagtggagagccccgctt

SEQ ID NO: 1524 - DNA, 24 bp, Artificial Sequence
  Description of Artificial Sequence: Synthetic oligonucleotide
cggcagtggagagccccgcttcat

SEQ ID NO: 1525 - DNA, 24 bp, Artificial Sequence
  Description of Artificial Sequence: Synthetic oligonucleotide
ggcagtggagagccccgcttcatc

SEQ ID NO: 1526 - DNA, 24 bp, Artificial Sequence
  Description of Artificial Sequence: Synthetic oligonucleotide
gcagtggagagccccgcttcatcg

SEQ ID NO: 1527 - DNA, 25 bp, Artificial Sequence
  Description of Artificial Sequence: Synthetic oligonucleotide
cagtggagagccccgcttcatcgca

SEQ ID NO: 1528 - DNA, 26 bp, Artificial Sequence
  Description of Artificial Sequence: Synthetic oligonucleotide
agtggagagccccgcttcatcgcagt

SEQ ID NO: 1529 - DNA, 25 bp, Artificial Sequence
  Description of Artificial Sequence: Synthetic oligonucleotide
gtggagagccccgcttcatcgcagt

SEQ ID NO: 1530 - DNA, 25 bp, Artificial Sequence
  Description of Artificial Sequence: Synthetic oligonucleotide
tggagagccccgcttcatcgcagtg

SEQ ID NO: 1531 - DNA, 24 bp, Artificial Sequence
  Description of Artificial Sequence: Synthetic oligonucleotide
ggagagccccgcttcatcgcagtg

SEQ ID NO: 1532 - DNA, 24 bp, Artificial Sequence
  Description of Artificial Sequence: Synthetic oligonucleotide
gagagccccgcttcatcgcagtgg

SEQ ID NO: 1533 - DNA, 24 bp, Artificial Sequence
  Description of Artificial Sequence: Synthetic oligonucleotide
agagccccgcttcatcgcagtggg

SEQ ID NO: 1534 - DNA, 23 bp, Artificial Sequence
  Description of Artificial Sequence: Synthetic oligonucleotide
gagccccgcttcatcgcagtggg

SEQ ID NO: 1535 - DNA, 25 bp, Artificial Sequence
  Description of Artificial Sequence: Synthetic oligonucleotide
agccccgcttcatcgcagtgggcta

SEQ ID NO: 1536 - DNA, 24 bp, Artificial Sequence
  Description of Artificial Sequence: Synthetic oligonucleotide
gccccgcttcatcgcagtgggcta

SEQ ID NO: 1537 - DNA, 24 bp, Artificial Sequence
  Description of Artificial Sequence: Synthetic oligonucleotide
ccccgcttcatcgcagtgggctac

SEQ ID NO: 1538 - DNA, 25 bp, Artificial Sequence
  Description of Artificial Sequence: Synthetic oligonucleotide
cccgcttcatcgcagtgggctacgt

SEQ ID NO: 1539 - DNA, 25 bp, Artificial Sequence
  Description of Artificial Sequence: Synthetic oligonucleotide
ccgcttcatcgcagtgggctacgtg

SEQ ID NO: 1540 - DNA, 26 bp, Artificial Sequence
  Description of Artificial Sequence: Synthetic oligonucleotide
cgcttcatcgcagtgggctacgtgga

SEQ ID NO: 1541 - DNA, 26 bp, Artificial Sequence
  Description of Artificial Sequence: Synthetic oligonucleotide
gcttcatcgcagtgggctacgtggac

SEQ ID NO: 1542 - DNA, 27 bp, Artificial Sequence
  Description of Artificial Sequence: Synthetic oligonucleotide
cttcatcgcagtgggctacgtggacga

SEQ ID NO: 1543 - DNA, 27 bp, Artificial Sequence
  Description of Artificial Sequence: Synthetic oligonucleotide
ttcatcgcagtgggctacgtggacgac

SEQ ID NO: 1544 - DNA, 27 bp, Artificial Sequence
  Description of Artificial Sequence: Synthetic oligonucleotide
tcatcgcagtgggctacgtggacgaca

SEQ ID NO: 1545 - DNA, 26 bp, Artificial Sequence
  Description of Artificial Sequence: Synthetic oligonucleotide
catcgcagtgggctacgtggacgaca

SEQ ID NO: 1546 - DNA, 26 bp, Artificial Sequence
  Description of Artificial Sequence: Synthetic oligonucleotide
atcgcagtgggctacgtggacgacac

SEQ ID NO: 1547 - DNA, 25 bp, Artificial Sequence
  Description of Artificial Sequence: Synthetic oligonucleotide
tcgcagtgggctacgtggacgacac

SEQ ID NO: 1548 - DNA, 24 bp, Artificial Sequence
  Description of Artificial Sequence: Synthetic oligonucleotide
cgcagtgggctacgtggacgacac

SEQ ID NO: 1549 - DNA, 24 bp, Artificial Sequence
  Description of Artificial Sequence: Synthetic oligonucleotide
gcagtgggctacgtggacgacacg

SEQ ID NO: 1550 - DNA, 25 bp, Artificial Sequence
  Description of Artificial Sequence: Synthetic oligonucleotide
cagtgggctacgtggacgacacgca

SEQ ID NO: 1551 - DNA, 27 bp, Artificial Sequence
  Description of Artificial Sequence: Synthetic oligonucleotide
agtgggctacgtggacgacacgcagtt

SEQ ID NO: 1552 - DNA, 28 bp, Artificial Sequence
  Description of Artificial Sequence: Synthetic oligonucleotide
cgaggacggttctcacaccatccagatg

SEQ ID NO: 1553 - DNA, 30 bp, Artificial Sequence
  Description of Artificial Sequence: Synthetic oligonucleotide
gaggacggttctcacaccatccagatgatg

SEQ ID NO: 1554 - DNA, 33 bp, Artificial Sequence
  Description of Artificial Sequence: Synthetic oligonucleotide
aggacggttctcacaccatccagatgatgtatg

SEQ ID NO: 1555 - DNA, 32 bp, Artificial Sequence
  Description of Artificial Sequence: Synthetic oligonucleotide
ggacggttctcacaccatccagatgatgtatg

SEQ ID NO: 1556 - DNA, 32 bp, Artificial Sequence
  Description of Artificial Sequence: Synthetic oligonucleotide
gacggttctcacaccatccagatgatgtatgg

SEQ ID NO: 1557 - DNA, 32 bp, Artificial Sequence
  Description of Artificial Sequence: Synthetic oligonucleotide
acggttctcacaccatccagatgatgtatggc

SEQ ID NO: 1558 - DNA, 31 bp, Artificial Sequence
  Description of Artificial Sequence: Synthetic oligonucleotide
cggttctcacaccatccagatgatgtatggc

SEQ ID NO: 1559 - DNA, 32 bp, Artificial Sequence
  Description of Artificial Sequence: Synthetic oligonucleotide
ggttctcacaccatccagatgatgtatggctg

SEQ ID NO: 1560 - DNA, 32 bp, Artificial Sequence
  Description of Artificial Sequence: Synthetic oligonucleotide
gttctcacaccatccagatgatgtatggctgc

SEQ ID NO: 1561 - DNA, 32 bp, Artificial Sequence
  Description of Artificial Sequence: Synthetic oligonucleotide
ttctcacaccatccagatgatgtatggctgcg

SEQ ID NO: 1562 - DNA, 31 bp, Artificial Sequence
  Description of Artificial Sequence: Synthetic oligonucleotide
tctcacaccatccagatgatgtatggctgcg

SEQ ID NO: 1563 - DNA, 30 bp, Artificial Sequence
  Description of Artificial Sequence: Synthetic oligonucleotide
ctcacaccatccagatgatgtatggctgcg

SEQ ID NO: 1564 - DNA, 31 bp, Artificial Sequence
  Description of Artificial Sequence: Synthetic oligonucleotide
tcacaccatccagatgatgtatggctgcgac

SEQ ID NO: 1565 - DNA, 30 bp, Artificial Sequence
  Description of Artificial Sequence: Synthetic oligonucleotide
cacaccatccagatgatgtatggctgcgac

SEQ ID NO: 1566 - DNA, 30 bp, Artificial Sequence
  Description of Artificial Sequence: Synthetic oligonucleotide
acaccatccagatgatgtatggctgcgacg

SEQ ID NO: 1567 - DNA, 29 bp, Artificial Sequence
  Description of Artificial Sequence: Synthetic oligonucleotide
caccatccagatgatgtatggctgcgacg

SEQ ID NO: 1568 - DNA, 30 bp, Artificial Sequence
  Description of Artificial Sequence: Synthetic oligonucleotide
accatccagatgatgtatggctgcgacgtg

SEQ ID NO: 1569 - DNA, 29 bp, Artificial Sequence
  Description of Artificial Sequence: Synthetic oligonucleotide
ccatccagatgatgtatggctgcgacgtg

SEQ ID NO: 1570 - DNA, 29 bp, Artificial Sequence
  Description of Artificial Sequence: Synthetic oligonucleotide
catccagatgatgtatggctgcgacgtgg

SEQ ID NO: 1571 - DNA, 29 bp, Artificial Sequence
  Description of Artificial Sequence: Synthetic oligonucleotide
atccagatgatgtatggctgcgacgtggg

SEQ ID NO: 1572 - DNA, 28 bp, Artificial Sequence
  Description of Artificial Sequence: Synthetic oligonucleotide
tccagatgatgtatggctgcgacgtggg

SEQ ID NO: 1573 - DNA, 27 bp, Artificial Sequence
  Description of Artificial Sequence: Synthetic oligonucleotide
ccagatgatgtatggctgcgacgtggg

SEQ ID NO: 1574 - DNA, 27 bp, Artificial Sequence
  Description of Artificial Sequence: Synthetic oligonucleotide
cagatgatgtatggctgcgacgtgggg

SEQ ID NO: 1575 - DNA, 27 bp, Artificial Sequence
  Description of Artificial Sequence: Synthetic oligonucleotide
agatgatgtatggctgcgacgtggggc

SEQ ID NO: 1576 - DNA, 26 bp, Artificial Sequence
  Description of Artificial Sequence: Synthetic oligonucleotide
gatgatgtatggctgcgacgtggggc

SEQ ID NO: 1577 - DNA, 26 bp, Artificial Sequence
  Description of Artificial Sequence: Synthetic oligonucleotide
atgatgtatggctgcgacgtggggcc

SEQ ID NO: 1578 - DNA, 25 bp, Artificial Sequence
  Description of Artificial Sequence: Synthetic oligonucleotide
tgatgtatggctgcgacgtggggcc

SEQ ID NO: 1579 - DNA, 24 bp, Artificial Sequence
  Description of Artificial Sequence: Synthetic oligonucleotide
gatgtatggctgcgacgtggggcc

SEQ ID NO: 1580 - DNA, 27 bp, Artificial Sequence
  Description of Artificial Sequence: Synthetic oligonucleotide
gtgatcactggagctgtggtcgctgct

SEQ ID NO: 1581 - DNA, 27 bp, Artificial Sequence
  Description of Artificial Sequence: Synthetic oligonucleotide
tgatcactggagctgtggtcgctgctg

SEQ ID NO: 1582 - DNA, 27 bp, Artificial Sequence
  Description of Artificial Sequence: Synthetic oligonucleotide
gatcactggagctgtggtcgctgctgt

SEQ ID NO: 1583 - DNA, 27 bp, Artificial Sequence
  Description of Artificial Sequence: Synthetic oligonucleotide
atcactggagctgtggtcgctgctgtg

SEQ ID NO: 1584 - DNA, 27 bp, Artificial Sequence
  Description of Artificial Sequence: Synthetic oligonucleotide
tcactggagctgtggtcgctgctgtga

SEQ ID NO: 1585 - DNA, 27 bp, Artificial Sequence
  Description of Artificial Sequence: Synthetic oligonucleotide
cactggagctgtggtcgctgctgtgat

SEQ ID NO: 1586 - DNA, 27 bp, Artificial Sequence
  Description of Artificial Sequence: Synthetic oligonucleotide
actggagctgtggtcgctgctgtgatg

SEQ ID NO: 1587 - DNA, 27 bp, Artificial Sequence
  Description of Artificial Sequence: Synthetic oligonucleotide
ctggagctgtggtcgctgctgtgatgt

SEQ ID NO: 1588 - DNA, 27 bp, Artificial Sequence
  Description of Artificial Sequence: Synthetic oligonucleotide
tggagctgtggtcgctgctgtgatgtg

SEQ ID NO: 1589 - DNA, 26 bp, Artificial Sequence
  Description of Artificial Sequence: Synthetic oligonucleotide
ggagctgtggtcgctgctgtgatgtg

SEQ ID NO: 1590 - DNA, 27 bp, Artificial Sequence
  Description of Artificial Sequence: Synthetic oligonucleotide
gagctgtggtcgctgctgtgatgtgga

SEQ ID NO: 1591 - DNA, 27 bp, Artificial Sequence
  Description of Artificial Sequence: Synthetic oligonucleotide
agctgtggtcgctgctgtgatgtggag

SEQ ID NO: 1592 - DNA, 26 bp, Artificial Sequence
  Description of Artificial Sequence: Synthetic oligonucleotide
gctgtggtcgctgctgtgatgtggag

SEQ ID NO: 1593 - DNA, 27 bp, Artificial Sequence
  Description of Artificial Sequence: Synthetic oligonucleotide
ctgtggtcgctgctgtgatgtggagga

SEQ ID NO: 1594 - DNA, 27 bp, Artificial Sequence
  Description of Artificial Sequence: Synthetic oligonucleotide
tgtggtcgctgctgtgatgtggaggag

SEQ ID NO: 1595 - DNA, 26 bp, Artificial Sequence
  Description of Artificial Sequence: Synthetic oligonucleotide
gtggtcgctgctgtgatgtggaggag

SEQ ID NO: 1596 - DNA, 27 bp, Artificial Sequence
  Description of Artificial Sequence: Synthetic oligonucleotide
tggtcgctgctgtgatgtggaggagga

SEQ ID NO: 1597 - DNA, 27 bp, Artificial Sequence
  Description of Artificial Sequence: Synthetic oligonucleotide
ggtcgctgctgtgatgtggaggaggaa

SEQ ID NO: 1598 - DNA, 27 bp, Artificial Sequence
  Description of Artificial Sequence: Synthetic oligonucleotide
gtcgctgctgtgatgtggaggaggaag

SEQ ID NO: 1599 - DNA, 28 bp, Artificial Sequence
  Description of Artificial Sequence: Synthetic oligonucleotide
tcgctgctgtgatgtggaggaggaagag

SEQ ID NO: 1600 - DNA, 27 bp, Artificial Sequence
  Description of Artificial Sequence: Synthetic oligonucleotide
cgctgctgtgatgtggaggaggaagag

SEQ ID NO: 1601 - DNA, 27 bp, Artificial Sequence
  Description of Artificial Sequence: Synthetic oligonucleotide
gctgctgtgatgtggaggaggaagagc

SEQ ID NO: 1602 - DNA, 28 bp, Artificial Sequence
  Description of Artificial Sequence: Synthetic oligonucleotide
ctgctgtgatgtggaggaggaagagctc

SEQ ID NO: 1603 - DNA, 29 bp, Artificial Sequence
  Description of Artificial Sequence: Synthetic oligonucleotide
tgctgtgatgtggaggaggaagagctcag

SEQ ID NO: 1604 - DNA, 28 bp, Artificial Sequence
  Description of Artificial Sequence: Synthetic oligonucleotide
gctgtgatgtggaggaggaagagctcag

SEQ ID NO: 1605 - DNA, 31 bp, Artificial Sequence
  Description of Artificial Sequence: Synthetic oligonucleotide
ctgtgatgtggaggaggaagagctcagatag

SEQ ID NO: 1606 - DNA, 35 bp, Artificial Sequence
  Description of Artificial Sequence: Synthetic oligonucleotide
tgtgatgtggaggaggaagagctcagatagaaaag

SEQ ID NO: 1607 - DNA, 20 bp, Artificial Sequence
  Description of Artificial Sequence: Synthetic oligonucleotide
tgcagcgcacggaccccccc

SEQ ID NO: 1608 - DNA, 20 bp, Artificial Sequence
  Description of Artificial Sequence: Synthetic oligonucleotide
gcagcgcacggaccccccct

SEQ ID NO: 1609 - DNA, 21 bp, Artificial Sequence
  Description of Artificial Sequence: Synthetic oligonucleotide
cagcgcacggaccccccccaa

SEQ ID NO: 1610 - DNA, 22 bp, Artificial Sequence
  Description of Artificial Sequence: Synthetic oligonucleotide
agcgcacggaccccccccaaga

SEQ ID NO: 1611 - DNA, 21 bp, Artificial Sequence
  Description of Artificial Sequence: Synthetic oligonucleotide
gcgcacggaccccccccaaga

SEQ ID NO: 1612 - DNA, 22 bp, Artificial Sequence
  Description of Artificial Sequence: Synthetic oligonucleotide
cgcacggaccccccccaagaca

SEQ ID NO: 1613 - DNA, 26 bp, Artificial Sequence
  Description of Artificial Sequence: Synthetic oligonucleotide
gcacggaccccccccaagacacatat

SEQ ID NO: 1614 - DNA, 27 bp, Artificial Sequence
  Description of Artificial Sequence: Synthetic oligonucleotide
cacggaccccccccaagacacatatga

SEQ ID NO: 1615 - DNA, 27 bp, Artificial Sequence
  Description of Artificial Sequence: Synthetic oligonucleotide
acggaccccccccaagacacatatgac

SEQ ID NO: 1616 - DNA, 26 bp, Artificial Sequence
  Description of Artificial Sequence: Synthetic oligonucleotide
cggaccccccccaagacacatatgac

SEQ ID NO: 1617 - DNA, 26 bp, Artificial Sequence
  Description of Artificial Sequence: Synthetic oligonucleotide
ggaccccccccaagacacatatgacc

SEQ ID NO: 1618 - DNA, 27 bp, Artificial Sequence
  Description of Artificial Sequence: Synthetic oligonucleotide
gaccccccccaagacacatatgaccca

SEQ ID NO: 1619 - DNA, 27 bp, Artificial Sequence
  Description of Artificial Sequence: Synthetic oligonucleotide
accccccccaagacacatatgacccac

SEQ ID NO: 1620 - DNA, 26 bp, Artificial Sequence
  Description of Artificial Sequence: Synthetic oligonucleotide
ccccccccaagacacatatgacccac

SEQ ID NO: 1621 - DNA, 23 bp, Artificial Sequence
  Description of Artificial Sequence: Synthetic oligonucleotide
gcggtccatgcggcggagcagtt

SEQ ID NO: 1622 - DNA, 24 bp, Artificial Sequence
  Description of Artificial Sequence: Synthetic oligonucleotide
cggtccatgcggcggagcagttga

SEQ ID NO: 1623 - DNA, 25 bp, Artificial Sequence
  Description of Artificial Sequence: Synthetic oligonucleotide
ggtccatgcggcggagcagttgaga

SEQ ID NO: 1624 - DNA, 25 bp, Artificial Sequence
  Description of Artificial Sequence: Synthetic oligonucleotide
gtccatgcggcggagcagttgagag

SEQ ID NO: 1625 - DNA, 25 bp, Artificial Sequence
  Description of Artificial Sequence: Synthetic oligonucleotide
tccatgcggcggagcagttgagagc

SEQ ID NO: 1626 - DNA, 24 bp, Artificial Sequence
  Description of Artificial Sequence: Synthetic oligonucleotide
ccatgcggcggagcagttgagagc

SEQ ID NO: 1627 - DNA, 26 bp, Artificial Sequence
  Description of Artificial Sequence: Synthetic oligonucleotide
catgcggcggagcagttgagagccta

SEQ ID NO: 1628 - DNA, 26 bp, Artificial Sequence
  Description of Artificial Sequence: Synthetic oligonucleotide
atgcggcggagcagttgagagcctac

SEQ ID NO: 1629 - DNA, 25 bp, Artificial Sequence
  Description of Artificial Sequence: Synthetic oligonucleotide
tgcggcggagcagttgagagcctac

SEQ ID NO: 1630 - DNA, 24 bp, Artificial Sequence
  Description of Artificial Sequence: Synthetic oligonucleotide
gcggcggagcagttgagagcctac

SEQ ID NO: 1631 - DNA, 25 bp, Artificial Sequence
  Description of Artificial Sequence: Synthetic oligonucleotide
cggcggagcagttgagagcctacct

SEQ ID NO: 1632 - DNA, 25 bp, Artificial Sequence
  Description of Artificial Sequence: Synthetic oligonucleotide
ggcggagcagttgagagcctacctg

SEQ ID NO: 1633 - DNA, 26 bp, Artificial Sequence
  Description of Artificial Sequence: Synthetic oligonucleotide
gcggagcagttgagagcctacctgga

SEQ ID NO: 1634 - DNA, 26 bp, Artificial Sequence
  Description of Artificial Sequence: Synthetic oligonucleotide
cggagcagttgagagcctacctggag

SEQ ID NO: 1635 - DNA, 26 bp, Artificial Sequence
  Description of Artificial Sequence: Synthetic oligonucleotide
ggagcagttgagagcctacctggagg

SEQ ID NO: 1636 - DNA, 26 bp, Artificial Sequence
  Description of Artificial Sequence: Synthetic oligonucleotide
gagcagttgagagcctacctggaggg

SEQ ID NO: 1637 - DNA, 26 bp, Artificial Sequence
  Description of Artificial Sequence: Synthetic oligonucleotide
agcagttgagagcctacctggagggc

SEQ ID NO: 1638 - DNA, 25 bp, Artificial Sequence
  Description of Artificial Sequence: Synthetic oligonucleotide
gcagttgagagcctacctggagggc

SEQ ID NO: 1639 - DNA, 25 bp, Artificial Sequence
  Description of Artificial Sequence: Synthetic oligonucleotide
cagttgagagcctacctggagggcc

SEQ ID NO: 1640 - DNA, 25 bp, Artificial Sequence
  Description of Artificial Sequence: Synthetic oligonucleotide
agttgagagcctacctggagggccg

SEQ ID NO: 1641 - DNA, 24 bp, Artificial Sequence
  Description of Artificial Sequence: Synthetic oligonucleotide
gttgagagcctacctggagggccg

SEQ ID NO: 1642 - DNA, 25 bp, Artificial Sequence
  Description of Artificial Sequence: Synthetic oligonucleotide
ttgagagcctacctggagggccggt

SEQ ID NO: 1643 - DNA, 24 bp, Artificial Sequence
  Description of Artificial Sequence: Synthetic oligonucleotide
tgagagcctacctggagggccggt

SEQ ID NO: 1644 - DNA, 23 bp, Artificial Sequence
  Description of Artificial Sequence: Synthetic oligonucleotide
gagagcctacctggagggccggt

SEQ ID NO: 1645 - DNA, 23 bp, Artificial Sequence
  Description of Artificial Sequence: Synthetic oligonucleotide
agagcctacctggagggccggtg

SEQ ID NO: 1646 - DNA, 22 bp, Artificial Sequence
  Description of Artificial Sequence: Synthetic oligonucleotide
gagcctacctggagggccggtg

SEQ ID NO: 1647 - DNA, 22 bp, Artificial Sequence
  Description of Artificial Sequence: Synthetic oligonucleotide
agcctacctggagggccggtgc

SEQ ID NO: 1648 - DNA, 21 bp, Artificial Sequence
  Description of Artificial Sequence: Synthetic oligonucleotide
gcctacctggagggccggtgc

SEQ ID NO: 1649 - DNA, 22 bp, Artificial Sequence
  Description of Artificial Sequence: Synthetic oligonucleotide
cctacctggagggccggtgcgt

SEQ ID NO: 1650 - DNA, 24 bp, Artificial Sequence
  Description of Artificial Sequence: Synthetic oligonucleotide
gggcgccgtggatagagcaggaga

SEQ ID NO: 1651 - DNA, 24 bp, Artificial Sequence
  Description of Artificial Sequence: Synthetic oligonucleotide
ggcgccgtggatagagcaggagag

SEQ ID NO: 1652 - DNA, 24 bp, Artificial Sequence
  Description of Artificial Sequence: Synthetic oligonucleotide
gcgccgtggatagagcaggagagg

SEQ ID NO: 1653 - DNA, 24 bp, Artificial Sequence
  Description of Artificial Sequence: Synthetic oligonucleotide
cgccgtggatagagcaggagaggc

SEQ ID NO: 1654 - DNA, 25 bp, Artificial Sequence
  Description of Artificial Sequence: Synthetic oligonucleotide
gccgtggatagagcaggagaggcct

SEQ ID NO: 1655 - DNA, 26 bp, Artificial Sequence
  Description of Artificial Sequence: Synthetic oligonucleotide
ccgtggatagagcaggagaggcctga

SEQ ID NO: 1656 - DNA, 27 bp, Artificial Sequence
  Description of Artificial Sequence: Synthetic oligonucleotide
cgtggatagagcaggagaggcctgagt

SEQ ID NO: 1657 - DNA, 30 bp, Artificial Sequence
  Description of Artificial Sequence: Synthetic oligonucleotide
gtggatagagcaggagaggcctgagtattg

SEQ ID NO: 1658 - DNA, 30 bp, Artificial Sequence
  Description of Artificial Sequence: Synthetic oligonucleotide
tggatagagcaggagaggcctgagtattgg

SEQ ID NO: 1659 - DNA, 29 bp, Artificial Sequence
  Description of Artificial Sequence: Synthetic oligonucleotide
ggatagagcaggagaggcctgagtattgg

SEQ ID NO: 1660 - DNA, 29 bp, Artificial Sequence
  Description of Artificial Sequence: Synthetic oligonucleotide
gatagagcaggagaggcctgagtattggg

SEQ ID NO: 1661 - DNA, 30 bp, Artificial Sequence
  Description of Artificial Sequence: Synthetic oligonucleotide
atagagcaggagaggcctgagtattgggac

SEQ ID NO: 1662 - DNA, 29 bp, Artificial Sequence
  Description of Artificial Sequence: Synthetic oligonucleotide
tagagcaggagaggcctgagtattgggac

SEQ ID NO: 1663 - DNA, 28 bp, Artificial Sequence
  Description of Artificial Sequence: Synthetic oligonucleotide
agagcaggagaggcctgagtattgggac

SEQ ID NO: 1664 - DNA, 27 bp, Artificial Sequence
  Description of Artificial Sequence: Synthetic oligonucleotide
gagcaggagaggcctgagtattgggac

SEQ ID NO: 1665 - DNA, 27 bp, Artificial Sequence
  Description of Artificial Sequence: Synthetic oligonucleotide
agcaggagaggcctgagtattgggacc

SEQ ID NO: 1666 - DNA, 27 bp, Artificial Sequence
  Description of Artificial Sequence: Synthetic oligonucleotide
gcaggagaggcctgagtattgggacca

SEQ ID NO: 1667 - DNA, 27 bp, Artificial Sequence
  Description of Artificial Sequence: Synthetic oligonucleotide
caggagaggcctgagtattgggaccag

SEQ ID NO: 1668 - DNA, 27 bp, Artificial Sequence
  Description of Artificial Sequence: Synthetic oligonucleotide
aggagaggcctgagtattgggaccagg

SEQ ID NO: 1669 - DNA, 27 bp, Artificial Sequence
  Description of Artificial Sequence: Synthetic oligonucleotide
ggagaggcctgagtattgggaccagga

SEQ ID NO: 1670 - DNA, 27 bp, Artificial Sequence
  Description of Artificial Sequence: Synthetic oligonucleotide
gagaggcctgagtattgggaccaggag

SEQ ID NO: 1671 - DNA, 28 bp, Artificial Sequence
  Description of Artificial Sequence: Synthetic oligonucleotide
agaggcctgagtattgggaccaggagac

SEQ ID NO: 1672 - DNA, 27 bp, Artificial Sequence
  Description of Artificial Sequence: Synthetic oligonucleotide
gaggcctgagtattgggaccaggagac

SEQ ID NO: 1673 - DNA, 28 bp, Artificial Sequence
  Description of Artificial Sequence: Synthetic oligonucleotide
aggcctgagtattgggaccaggagacac

SEQ ID NO: 1674 - DNA, 27 bp, Artificial Sequence
  Description of Artificial Sequence: Synthetic oligonucleotide
ggcctgagtattgggaccaggagacac

SEQ ID NO: 1675 - DNA, 27 bp, Artificial Sequence
  Description of Artificial Sequence: Synthetic oligonucleotide
gcctgagtattgggaccaggagacacg

SEQ ID NO: 1676 - DNA, 27 bp, Artificial Sequence
  Description of Artificial Sequence: Synthetic oligonucleotide
cctgagtattgggaccaggagacacgg

SEQ ID NO: 1677 - DNA, 30 bp, Artificial Sequence
  Description of Artificial Sequence: Synthetic oligonucleotide
ctgagtattgggaccaggagacacggaatg

SEQ ID NO: 1678 - DNA, 31 bp, Artificial Sequence
  Description of Artificial Sequence: Synthetic oligonucleotide
tgagtattgggaccaggagacacggaatgtg

SEQ ID NO: 1679 - DNA, 30 bp, Artificial Sequence
  Description of Artificial Sequence: Synthetic oligonucleotide
gagtattgggaccaggagacacggaatgtg

SEQ ID NO: 1680 - DNA, 32 bp, Artificial Sequence
  Description of Artificial Sequence: Synthetic oligonucleotide
agtattgggaccaggagacacggaatgtgaag

SEQ ID NO: 1681 - DNA, 31 bp, Artificial Sequence
  Description of Artificial Sequence: Synthetic oligonucleotide
gtattgggaccaggagacacggaatgtgaag

SEQ ID NO: 1682 - DNA, 31 bp, Artificial Sequence
  Description of Artificial Sequence: Synthetic oligonucleotide
tattgggaccaggagacacggaatgtgaagg

SEQ ID NO: 1683 - DNA, 30 bp, Artificial Sequence
  Description of Artificial Sequence: Synthetic oligonucleotide
attgggaccaggagacacggaatgtgaagg

SEQ ID NO: 1684 - DNA, 29 bp, Artificial Sequence
  Description of Artificial Sequence: Synthetic oligonucleotide
ttgggaccaggagacacggaatgtgaagg

SEQ ID NO: 1685 - DNA, 28 bp, Artificial Sequence
  Description of Artificial Sequence: Synthetic oligonucleotide
tgggaccaggagacacggaatgtgaagg

SEQ ID NO: 1686 - DNA, 27 bp, Artificial Sequence
  Description of Artificial Sequence: Synthetic oligonucleotide
gggaccaggagacacggaatgtgaagg

SEQ ID NO: 1687 - DNA, 27 bp, Artificial Sequence
  Description of Artificial Sequence: Synthetic oligonucleotide
ggaccaggagacacggaatgtgaaggc

SEQ ID NO: 1688 - DNA, 27 bp, Artificial Sequence
  Description of Artificial Sequence: Synthetic oligonucleotide
gaccaggagacacggaatgtgaaggcc

SEQ ID NO: 1689 - DNA, 27 bp, Artificial Sequence
  Description of Artificial Sequence: Synthetic oligonucleotide
accaggagacacggaatgtgaaggccc

SEQ ID NO: 1690 - DNA, 27 bp, Artificial Sequence
  Description of Artificial Sequence: Synthetic oligonucleotide
ccaggagacacggaatgtgaaggccca

SEQ ID NO: 1691 - DNA, 27 bp, Artificial Sequence
  Description of Artificial Sequence: Synthetic oligonucleotide
caggagacacggaatgtgaaggcccac

SEQ ID NO: 1692 - DNA, 28 bp, Artificial Sequence
  Description of Artificial Sequence: Synthetic oligonucleotide
aggagacacggaatgtgaaggcccactc

SEQ ID NO: 1693 - DNA, 27 bp, Artificial Sequence
  Description of Artificial Sequence: Synthetic oligonucleotide
ggagacacggaatgtgaaggcccactc

SEQ ID NO: 1694 - DNA, 28 bp, Artificial Sequence
  Description of Artificial Sequence: Synthetic oligonucleotide
gagacacggaatgtgaaggcccactcac

SEQ ID NO: 1695 - DNA, 29 bp, Artificial Sequence
  Description of Artificial Sequence: Synthetic oligonucleotide
agacacggaatgtgaaggcccactcacag

SEQ ID NO: 1696 - DNA, 28 bp, Artificial Sequence
  Description of Artificial Sequence: Synthetic oligonucleotide
gacacggaatgtgaaggcccactcacag

SEQ ID NO: 1697 - DNA, 29 bp, Artificial Sequence
  Description of Artificial Sequence: Synthetic oligonucleotide
acacggaatgtgaaggcccactcacagac

SEQ ID NO: 1698 - DNA, 28 bp, Artificial Sequence
  Description of Artificial Sequence: Synthetic oligonucleotide
cacggaatgtgaaggcccactcacagac

SEQ ID NO: 1699 - DNA, 29 bp, Artificial Sequence
  Description of Artificial Sequence: Synthetic oligonucleotide
acggaatgtgaaggcccactcacagactg

SEQ ID NO: 1700 - DNA, 28 bp, Artificial Sequence
  Description of Artificial Sequence: Synthetic oligonucleotide
cggaatgtgaaggcccactcacagactg

SEQ ID NO: 1701 - DNA, 29 bp, Artificial Sequence
  Description of Artificial Sequence: Synthetic oligonucleotide
ggaatgtgaaggcccactcacagactgac

SEQ ID NO: 1702 - DNA, 29 bp, Artificial Sequence
  Description of Artificial Sequence: Synthetic oligonucleotide
gaatgtgaaggcccactcacagactgacc

SEQ ID NO: 1703 - DNA, 29 bp, Artificial Sequence
  Description of Artificial Sequence: Synthetic oligonucleotide
aatgtgaaggcccactcacagactgaccg

SEQ ID NO: 1704 - DNA, 28 bp, Artificial Sequence
  Description of Artificial Sequence: Synthetic oligonucleotide
atgtgaaggcccactcacagactgaccg

SEQ ID NO: 1705 - DNA, 27 bp, Artificial Sequence
  Description of Artificial Sequence: Synthetic oligonucleotide
tgtgaaggcccactcacagactgaccg

SEQ ID NO: 1706 - DNA, 27 bp, Artificial Sequence
  Description of Artificial Sequence: Synthetic oligonucleotide
gtgaaggcccactcacagactgaccga

SEQ ID NO: 1707 - DNA, 27 bp, Artificial Sequence
  Description of Artificial Sequence: Synthetic oligonucleotide
gaaggcccactcacagactgaccgaga

SEQ ID NO: 1708 - DNA, 27 bp, Artificial Sequence
  Description of Artificial Sequence: Synthetic oligonucleotide
aaggcccactcacagactgaccgagag

SEQ ID NO: 1709 - DNA, 27 bp, Artificial Sequence
  Description of Artificial Sequence: Synthetic oligonucleotide
aggcccactcacagactgaccgagaga

SEQ ID NO: 1710 - DNA, 27 bp, Artificial Sequence
  Description of Artificial Sequence: Synthetic oligonucleotide
ggcccactcacagactgaccgagagaa

SEQ ID NO: 1711 - DNA, 27 bp, Artificial Sequence
  Description of Artificial Sequence: Synthetic oligonucleotide
gcccactcacagactgaccgagagaac

SEQ ID NO: 1712 - DNA, 27 bp, Artificial Sequence
  Description of Artificial Sequence: Synthetic oligonucleotide
cccactcacagactgaccgagagaacc

SEQ ID NO: 1713 - DNA, 28 bp, Artificial Sequence
  Description of Artificial Sequence: Synthetic oligonucleotide
ccactcacagactgaccgagagaacctg

SEQ ID NO: 1714 - DNA, 28 bp, Artificial Sequence
  Description of Artificial Sequence: Synthetic oligonucleotide
cactcacagactgaccgagagaacctgg

SEQ ID NO: 1715 - DNA, 28 bp, Artificial Sequence
  Description of Artificial Sequence: Synthetic oligonucleotide
actcacagactgaccgagagaacctggg

SEQ ID NO: 1716 - DNA, 27 bp, Artificial Sequence
  Description of Artificial Sequence: Synthetic oligonucleotide
ctcacagactgaccgagagaacctggg

SEQ ID NO: 1717 - DNA, 27 bp, Artificial Sequence
  Description of Artificial Sequence: Synthetic oligonucleotide
tcacagactgaccgagagaacctgggg

SEQ ID NO: 1718 - DNA, 27 bp, Artificial Sequence
  Description of Artificial Sequence: Synthetic oligonucleotide
cacagactgaccgagagaacctgggga

SEQ ID NO: 1719 - DNA, 27 bp, Artificial Sequence
  Description of Artificial Sequence: Synthetic oligonucleotide
acagactgaccgagagaacctggggac

SEQ ID NO: 1720 - DNA, 26 bp, Artificial Sequence
  Description of Artificial Sequence: Synthetic oligonucleotide
cagactgaccgagagaacctggggac

SEQ ID NO: 1721 - DNA, 26 bp, Artificial Sequence
  Description of Artificial Sequence: Synthetic oligonucleotide
agactgaccgagagaacctggggacc

SEQ ID NO: 1722 - DNA, 25 bp, Artificial Sequence
  Description of Artificial Sequence: Synthetic oligonucleotide
gactgaccgagagaacctggggacc

SEQ ID NO: 1723 - DNA, 26 bp, Artificial Sequence
  Description of Artificial Sequence: Synthetic oligonucleotide
actgaccgagagaacctggggaccct

SEQ ID NO: 1724 - DNA, 25 bp, Artificial Sequence
  Description of Artificial Sequence: Synthetic oligonucleotide
ctgaccgagagaacctggggaccct

SEQ ID NO: 1725 - DNA, 25 bp, Artificial Sequence
  Description of Artificial Sequence: Synthetic oligonucleotide
tgaccgagagaacctggggaccctg

SEQ ID NO: 1726 - DNA, 24 bp, Artificial Sequence
  Description of Artificial Sequence: Synthetic oligonucleotide
gaccgagagaacctggggaccctg

SEQ ID NO: 1727 - DNA, 24 bp, Artificial Sequence
  Description of Artificial Sequence: Synthetic oligonucleotide
accgagagaacctggggaccctgc

SEQ ID NO: 1728 - DNA, 23 bp, Artificial Sequence
  Description of Artificial Sequence: Synthetic oligonucleotide
ccgagagaacctggggaccctgc

SEQ ID NO: 1729 - DNA, 23 bp, Artificial Sequence
  Description of Artificial Sequence: Synthetic oligonucleotide
cgagagaacctggggaccctgcg

SEQ ID NO: 1730 - DNA, 23 bp, Artificial Sequence
  Description of Artificial Sequence: Synthetic oligonucleotide
gagagaacctggggaccctgcgc

SEQ ID NO: 1731 - DNA, 23 bp, Artificial Sequence
  Description of Artificial Sequence: Synthetic oligonucleotide
agagaacctggggaccctgcgcg

SEQ ID NO: 1732 - DNA, 22 bp, Artificial Sequence
  Description of Artificial Sequence: Synthetic oligonucleotide
gagaacctggggaccctgcgcg

SEQ ID NO: 1733 - DNA, 22 bp, Artificial Sequence
  Description of Artificial Sequence: Synthetic oligonucleotide
agaacctggggaccctgcgcgg

SEQ ID NO: 1734 - DNA, 25 bp, Artificial Sequence
  Description of Artificial Sequence: Synthetic oligonucleotide
cgcggctactacaaccagagcgagg

SEQ ID NO: 1735 - DNA, 25 bp, Artificial Sequence
  Description of Artificial Sequence: Synthetic oligonucleotide
gcggctactacaaccagagcgaggc

SEQ ID NO: 1736 - DNA, 25 bp, Artificial Sequence
  Description of Artificial Sequence: Synthetic oligonucleotide
cggctactacaaccagagcgaggcc

SEQ ID NO: 1737 - DNA, 25 bp, Artificial Sequence
  Description of Artificial Sequence: Synthetic oligonucleotide
ggctactacaaccagagcgaggccg

SEQ ID NO: 1738 - DNA, 27 bp, Artificial Sequence
  Description of Artificial Sequence: Synthetic oligonucleotide
gctactacaaccagagcgaggccggtt

SEQ ID NO: 1739 - DNA, 27 bp, Artificial Sequence
  Description of Artificial Sequence: Synthetic oligonucleotide
ctactacaaccagagcgaggccggttc

SEQ ID NO: 1740 - DNA, 28 bp, Artificial Sequence
  Description of Artificial Sequence: Synthetic oligonucleotide
tactacaaccagagcgaggccggttctc

SEQ ID NO: 1741 - DNA, 27 bp, Artificial Sequence
  Description of Artificial Sequence: Synthetic oligonucleotide
actacaaccagagcgaggccggttctc

SEQ ID NO: 1742 - DNA, 27 bp, Artificial Sequence
  Description of Artificial Sequence: Synthetic oligonucleotide
ctacaaccagagcgaggccggttctca

SEQ ID NO: 1743 - DNA, 27 bp, Artificial Sequence
  Description of Artificial Sequence: Synthetic oligonucleotide
tacaaccagagcgaggccggttctcac

SEQ ID NO: 1744 - DNA, 27 bp, Artificial Sequence
  Description of Artificial Sequence: Synthetic oligonucleotide
acaaccagagcgaggccggttctcaca

SEQ ID NO: 1745 - DNA, 26 bp, Artificial Sequence
  Description of Artificial Sequence: Synthetic oligonucleotide
caaccagagcgaggccggttctcaca

SEQ ID NO: 1746 - DNA, 26 bp, Artificial Sequence
  Description of Artificial Sequence: Synthetic oligonucleotide
aaccagagcgaggccggttctcacac

SEQ ID NO: 1747 - DNA, 25 bp, Artificial Sequence
  Description of Artificial Sequence: Synthetic oligonucleotide
accagagcgaggccggttctcacac

SEQ ID NO: 1748 - DNA, 24 bp, Artificial Sequence
  Description of Artificial Sequence: Synthetic oligonucleotide
ccagagcgaggccggttctcacac

SEQ ID NO: 1749 - DNA, 26 bp, Artificial Sequence
  Description of Artificial Sequence: Synthetic oligonucleotide
cagagcgaggccggttctcacaccat

SEQ ID NO: 1750 - DNA, 26 bp, Artificial Sequence
  Description of Artificial Sequence: Synthetic oligonucleotide
agagcgaggccggttctcacaccatc

SEQ ID NO: 1751 - DNA, 25 bp, Artificial Sequence
  Description of Artificial Sequence: Synthetic oligonucleotide
gagcgaggccggttctcacaccatc

SEQ ID NO: 1752 - DNA, 26 bp, Artificial Sequence
  Description of Artificial Sequence: Synthetic oligonucleotide
agcgaggccggttctcacaccatcca

SEQ ID NO: 1753 - DNA, 25 bp, Artificial Sequence
  Description of Artificial Sequence: Synthetic oligonucleotide
gcgaggccggttctcacaccatcca

SEQ ID NO: 1754 - DNA, 27 bp, Artificial Sequence
  Description of Artificial Sequence: Synthetic oligonucleotide
cgaggccggttctcacaccatccagat

SEQ ID NO: 1755 - DNA, 30 bp, Artificial Sequence
  Description of Artificial Sequence: Synthetic oligonucleotide
gaggccggttctcacaccatccagataatg

SEQ ID NO: 1756 - DNA, 33 bp, Artificial Sequence
  Description of Artificial Sequence: Synthetic oligonucleotide
aggccggttctcacaccatccagataatgtatg

SEQ ID NO: 1757 - DNA, 32 bp, Artificial Sequence
  Description of Artificial Sequence: Synthetic oligonucleotide
ggccggttctcacaccatccagataatgtatg

SEQ ID NO: 1758 - DNA, 32 bp, Artificial Sequence
  Description of Artificial Sequence: Synthetic oligonucleotide
gccggttctcacaccatccagataatgtatgg

SEQ ID NO: 1759 - DNA, 32 bp, Artificial Sequence
  Description of Artificial Sequence: Synthetic oligonucleotide
ccggttctcacaccatccagataatgtatggc

SEQ ID NO: 1760 - DNA, 25 bp, Artificial Sequence
  Description of Artificial Sequence: Synthetic oligonucleotide
cagcggagagtctacctggagggct

SEQ ID NO: 1761 - DNA, 25 bp, Artificial Sequence
  Description of Artificial Sequence: Synthetic oligonucleotide
agcggagagtctacctggagggctg

SEQ ID NO: 1762 - DNA, 24 bp, Artificial Sequence
  Description of Artificial Sequence: Synthetic oligonucleotide
gcggagagtctacctggagggctg

SEQ ID NO: 1763 - DNA, 25 bp, Artificial Sequence
  Description of Artificial Sequence: Synthetic oligonucleotide
cggagagtctacctggagggctggt

SEQ ID NO: 1764 - DNA, 25 bp, Artificial Sequence
  Description of Artificial Sequence: Synthetic oligonucleotide
ggagagtctacctggagggctggtg

SEQ ID NO: 1765 - DNA, 25 bp, Artificial Sequence
  Description of Artificial Sequence: Synthetic oligonucleotide
gagagtctacctggagggctggtgc

SEQ ID NO: 1766 - DNA, 26 bp, Artificial Sequence
  Description of Artificial Sequence: Synthetic oligonucleotide
agagtctacctggagggctggtgcgt

SEQ ID NO: 1767 - DNA, 25 bp, Artificial Sequence
  Description of Artificial Sequence: Synthetic oligonucleotide
gagtctacctggagggctggtgcgt

SEQ ID NO: 1768 - DNA, 25 bp, Artificial Sequence
  Description of Artificial Sequence: Synthetic oligonucleotide
agtctacctggagggctggtgcgtg

SEQ ID NO: 1769 - DNA, 24 bp, Artificial Sequence
  Description of Artificial Sequence: Synthetic oligonucleotide
gtctacctggagggctggtgcgtg

SEQ ID NO: 1770 - DNA, 25 bp, Artificial Sequence
  Description of Artificial Sequence: Synthetic oligonucleotide
tctacctggagggctggtgcgtgga

SEQ ID NO: 1771 - DNA, 24 bp, Artificial Sequence
  Description of Artificial Sequence: Synthetic oligonucleotide
ctacctggagggctggtgcgtgga

SEQ ID NO: 1772 - DNA, 24 bp, Artificial Sequence
  Description of Artificial Sequence: Synthetic oligonucleotide
tacctggagggctggtgcgtggac

SEQ ID NO: 1773 - DNA, 23 bp, Artificial Sequence
  Description of Artificial Sequence: Synthetic oligonucleotide
acctggagggctggtgcgtggac

SEQ ID NO: 1774 - DNA, 22 bp, Artificial Sequence
  Description of Artificial Sequence: Synthetic oligonucleotide
cctggagggctggtgcgtggac

SEQ ID NO: 1775 - DNA, 22 bp, Artificial Sequence
  Description of Artificial Sequence: Synthetic oligonucleotide
ctggagggctggtgcgtggacg

SEQ ID NO: 1776 - DNA, 22 bp, Artificial Sequence
  Description of Artificial Sequence: Synthetic oligonucleotide
tggagggctggtgcgtggacgg

SEQ ID NO: 1777 - DNA, 21 bp, Artificial Sequence
  Description of Artificial Sequence: Synthetic oligonucleotide
ggagggctggtgcgtggacgg

SEQ ID NO: 1778 - DNA, 21 bp, Artificial Sequence
  Description of Artificial Sequence: Synthetic oligonucleotide
gagggctggtgcgtggacggg

SEQ ID NO: 1779 - DNA, 22 bp, Artificial Sequence
  Description of Artificial Sequence: Synthetic oligonucleotide
agggctggtgcgtggacgggct

SEQ ID NO: 1780 - DNA, 21 bp, Artificial Sequence
  Description of Artificial Sequence: Synthetic oligonucleotide
gggctggtgcgtggacgggct

SEQ ID NO: 1781 - DNA, 21 bp, Artificial Sequence
  Description of Artificial Sequence: Synthetic oligonucleotide
ggctggtgcgtggacgggctc

SEQ ID NO: 1782 - DNA, 21 bp, Artificial Sequence
  Description of Artificial Sequence: Synthetic oligonucleotide
gctggtgcgtggacgggctcc

SEQ ID NO: 1783 - DNA, 21 bp, Artificial Sequence
  Description of Artificial Sequence: Synthetic oligonucleotide
ctggtgcgtggacgggctccg

SEQ ID NO: 1784 - DNA, 22 bp, Artificial Sequence
  Description of Artificial Sequence: Synthetic oligonucleotide
tggtgcgtggacgggctccgca

SEQ ID NO: 1785 - DNA, 27 bp, Artificial Sequence
  Description of Artificial Sequence: Synthetic oligonucleotide
gtgggctacgtggacgacacgcagtta

SEQ ID NO: 1786 - DNA, 27 bp, Artificial Sequence
  Description of Artificial Sequence: Synthetic oligonucleotide
tgggctacgtggacgacacgcagttag

SEQ ID NO: 1787 - DNA, 27 bp, Artificial Sequence
  Description of Artificial Sequence: Synthetic oligonucleotide
gggctacgtggacgacacgcagttagt

SEQ ID NO: 1788 - DNA, 27 bp, Artificial Sequence
  Description of Artificial Sequence: Synthetic oligonucleotide
ggctacgtggacgacacgcagttagtg

SEQ ID NO: 1789 - DNA, 27 bp, Artificial Sequence
  Description of Artificial Sequence: Synthetic oligonucleotide
gctacgtggacgacacgcagttagtgc

SEQ ID NO: 1790 - DNA, 27 bp, Artificial Sequence
  Description of Artificial Sequence: Synthetic oligonucleotide
ctacgtggacgacacgcagttagtgcg

SEQ ID NO: 1791 - DNA, 27 bp, Artificial Sequence
  Description of Artificial Sequence: Synthetic oligonucleotide
tacgtggacgacacgcagttagtgcgg

SEQ ID NO: 1792 - DNA, 27 bp, Artificial Sequence
  Description of Artificial Sequence: Synthetic oligonucleotide
acgtggacgacacgcagttagtgcggt

SEQ ID NO: 1793 - DNA, 27 bp, Artificial Sequence
  Description of Artificial Sequence: Synthetic oligonucleotide
cgtggacgacacgcagttagtgcggtt

SEQ ID NO: 1794 - DNA, 27 bp, Artificial Sequence
  Description of Artificial Sequence: Synthetic oligonucleotide
gtggacgacacgcagttagtgcggttc

SEQ ID NO: 1795 - DNA, 27 bp, Artificial Sequence
  Description of Artificial Sequence: Synthetic oligonucleotide
tggacgacacgcagttagtgcggttcg

SEQ ID NO: 1796 - DNA, 27 bp, Artificial Sequence
  Description of Artificial Sequence: Synthetic oligonucleotide
ggacgacacgcagttagtgcggttcga

SEQ ID NO: 1797 - DNA, 27 bp, Artificial Sequence
  Description of Artificial Sequence: Synthetic oligonucleotide
gacgacacgcagttagtgcggttcgac

SEQ ID NO: 1798 - DNA, 28 bp, Artificial Sequence
  Description of Artificial Sequence: Synthetic oligonucleotide
acgacacgcagttagtgcggttcgacag

SEQ ID NO: 1799 - DNA, 27 bp, Artificial Sequence
  Description of Artificial Sequence: Synthetic oligonucleotide
cgacacgcagttagtgcggttcgacag

SEQ ID NO: 1800 - DNA, 27 bp, Artificial Sequence
  Description of Artificial Sequence: Synthetic oligonucleotide
gacacgcagttagtgcggttcgacagc

SEQ ID NO: 1801 - DNA, 27 bp, Artificial Sequence
  Description of Artificial Sequence: Synthetic oligonucleotide
acacgcagttagtgcggttcgacagcg

SEQ ID NO: 1802 - DNA, 27 bp, Artificial Sequence
  Description of Artificial Sequence: Synthetic oligonucleotide
cacgcagttagtgcggttcgacagcga

SEQ ID NO: 1803 - DNA, 27 bp, Artificial Sequence
  Description of Artificial Sequence: Synthetic oligonucleotide
acgcagttagtgcggttcgacagcgac

SEQ ID NO: 1804 - DNA, 26 bp, Artificial Sequence
  Description of Artificial Sequence: Synthetic oligonucleotide
cgcagttagtgcggttcgacagcgac

SEQ ID NO: 1805 - DNA, 26 bp, Artificial Sequence
  Description of Artificial Sequence: Synthetic oligonucleotide
gcagttagtgcggttcgacagcgacg

SEQ ID NO: 1806 - DNA, 26 bp, Artificial Sequence
  Description of Artificial Sequence: Synthetic oligonucleotide
cagttagtgcggttcgacagcgacgc

SEQ ID NO: 1807 - DNA, 26 bp, Artificial Sequence
  Description of Artificial Sequence: Synthetic oligonucleotide
agttagtgcggttcgacagcgacgcc

SEQ ID NO: 1808 - DNA, 25 bp, Artificial Sequence
  Description of Artificial Sequence: Synthetic oligonucleotide
gttagtgcggttcgacagcgacgcc

SEQ ID NO: 1809 - DNA, 25 bp, Artificial Sequence
  Description of Artificial Sequence: Synthetic oligonucleotide
ttagtgcggttcgacagcgacgccg

SEQ ID NO: 1810 - DNA, 24 bp, Artificial Sequence
  Description of Artificial Sequence: Synthetic oligonucleotide
tagtgcggttcgacagcgacgccg

SEQ ID NO: 1811 - DNA, 23 bp, Artificial Sequence
  Description of Artificial Sequence: Synthetic oligonucleotide
agtgcggttcgacagcgacgccg

SEQ ID NO: 1812 - DNA, 25 bp, Artificial Sequence
  Description of Artificial Sequence: Synthetic oligonucleotide
atcaccaagcgcaagtgggaggcgg

SEQ ID NO: 1813 - DNA, 24 bp, Artificial Sequence
  Description of Artificial Sequence: Synthetic oligonucleotide
tcaccaagcgcaagtgggaggcgg

SEQ ID NO: 1814 - DNA, 23 bp, Artificial Sequence
  Description of Artificial Sequence: Synthetic oligonucleotide
caccaagcgcaagtgggaggcgg

SEQ ID NO: 1815 - DNA, 23 bp, Artificial Sequence
  Description of Artificial Sequence: Synthetic oligonucleotide
accaagcgcaagtgggaggcggc

SEQ ID NO: 1816 - DNA, 22 bp, Artificial Sequence
  Description of Artificial Sequence: Synthetic oligonucleotide
ccaagcgcaagtgggaggcggc

SEQ ID NO: 1817 - DNA, 22 bp, Artificial Sequence
  Description of Artificial Sequence: Synthetic oligonucleotide
caagcgcaagtgggaggcggcc

SEQ ID NO: 1818 - DNA, 22 bp, Artificial Sequence
  Description of Artificial Sequence: Synthetic oligonucleotide
aagcgcaagtgggaggcggccc

SEQ ID NO: 1819 - DNA, 21 bp, Artificial Sequence
  Description of Artificial Sequence: Synthetic oligonucleotide
agcgcaagtgggaggcggccc

SEQ ID NO: 1820 - DNA, 20 bp, Artificial Sequence
  Description of Artificial Sequence: Synthetic oligonucleotide
gcgcaagtgggaggcggccc

SEQ ID NO: 1821 - DNA, 21 bp, Artificial Sequence
  Description of Artificial Sequence: Synthetic oligonucleotide
cgcaagtgggaggcggcccgt

SEQ ID NO: 1822 - DNA, 21 bp, Artificial Sequence
  Description of Artificial Sequence: Synthetic oligonucleotide
gcaagtgggaggcggcccgtc

SEQ ID NO: 1823 - DNA, 21 bp, Artificial Sequence
  Description of Artificial Sequence: Synthetic oligonucleotide
caagtgggaggcggcccgtcg

SEQ ID NO: 1824 - DNA, 21 bp, Artificial Sequence
  Description of Artificial Sequence: Synthetic oligonucleotide
aagtgggaggcggcccgtcgg

SEQ ID NO: 1825 - DNA, 20 bp, Artificial Sequence
  Description of Artificial Sequence: Synthetic oligonucleotide
agtgggaggcggcccgtcgg

SEQ ID NO: 1826 - DNA, 20 bp, Artificial Sequence
  Description of Artificial Sequence: Synthetic oligonucleotide
gtgggaggcggcccgtcggt

SEQ ID NO: 1827 - DNA, 20 bp, Artificial Sequence
  Description of Artificial Sequence: Synthetic oligonucleotide
tgggaggcggcccgtcgggt

SEQ ID NO: 1828 - DNA, 20 bp, Artificial Sequence
  Description of Artificial Sequence: Synthetic oligonucleotide
gggaggcggcccgtcgggtt

SEQ ID NO: 1829 - DNA, 20 bp, Artificial Sequence
  Description of Artificial Sequence: Synthetic oligonucleotide
ggaggcggcccgtcgggctt

SEQ ID NO: 1830 - DNA, 20 bp, Artificial Sequence
  Description of Artificial Sequence: Synthetic oligonucleotide
gaggcggcccgtcgggcgtt

SEQ ID NO: 1831 - DNA, 20 bp, Artificial Sequence
  Description of Artificial Sequence: Synthetic oligonucleotide
aggcggcccgtcgggcggat

SEQ ID NO: 1832 - DNA, 20 bp, Artificial Sequence
  Description of Artificial Sequence: Synthetic oligonucleotide
ggcggcccgtcgggcggatt

SEQ ID NO: 1833 - DNA, 20 bp, Artificial Sequence
  Description of Artificial Sequence: Synthetic oligonucleotide
gcggcccgtcgggcggagtt

SEQ ID NO: 1834 - DNA, 20 bp, Artificial Sequence
  Description of Artificial Sequence: Synthetic oligonucleotide
cggcccgtcgggcggagcat

SEQ ID NO: 1835 - DNA, 20 bp, Artificial Sequence
  Description of Artificial Sequence: Synthetic oligonucleotide
ggcccgtcgggcggagcagt

SEQ ID NO: 1836 - DNA, 20 bp, Artificial Sequence
  Description of Artificial Sequence: Synthetic oligonucleotide
gcccgtcgggcggagcagct

SEQ ID NO: 1837 - DNA, 20 bp, Artificial Sequence
  Description of Artificial Sequence: Synthetic oligonucleotide
cccgtcgggcggagcagcgt

SEQ ID NO: 1838 - DNA, 20 bp, Artificial Sequence
  Description of Artificial Sequence: Synthetic oligonucleotide
ccgtcgggcggagcagcgga

SEQ ID NO: 1839 - DNA, 21 bp, Artificial Sequence
  Description of Artificial Sequence: Synthetic oligonucleotide
cgtcgggcggagcagcggaga

SEQ ID NO: 1840 - DNA, 22 bp, Artificial Sequence
  Description of Artificial Sequence: Synthetic oligonucleotide
gtcgggcggagcagcggagagt

SEQ ID NO: 1841 - DNA, 24 bp, Artificial Sequence
  Description of Artificial Sequence: Synthetic oligonucleotide
tcgggcggagcagcggagagtcta

SEQ ID NO: 1842 - DNA, 23 bp, Artificial Sequence
  Description of Artificial Sequence: Synthetic oligonucleotide
cgggcggagcagcggagagtcta

SEQ ID NO: 1843 - DNA, 23 bp, Artificial Sequence
  Description of Artificial Sequence: Synthetic oligonucleotide
gggcggagcagcggagagtctac

SEQ ID NO: 1844 - DNA, 26 bp, Artificial Sequence
  Description of Artificial Sequence: Synthetic oligonucleotide
gggctccgcagatacctggagaacga

SEQ ID NO: 1845 - DNA, 26 bp, Artificial Sequence
  Description of Artificial Sequence: Synthetic oligonucleotide
ggctccgcagatacctggagaacgac

SEQ ID NO: 1846 - DNA, 26 bp, Artificial Sequence
  Description of Artificial Sequence: Synthetic oligonucleotide
gctccgcagatacctggagaacgacc

SEQ ID NO: 1847 - DNA, 26 bp, Artificial Sequence
  Description of Artificial Sequence: Synthetic oligonucleotide
ctccgcagatacctggagaacgaccc

SEQ ID NO: 1848 - DNA, 26 bp, Artificial Sequence
  Description of Artificial Sequence: Synthetic oligonucleotide
tccgcagatacctggagaacgacccc

SEQ ID NO: 1849 - DNA, 25 bp, Artificial Sequence
  Description of Artificial Sequence: Synthetic oligonucleotide
ccgcagatacctggagaacgacccc

SEQ ID NO: 1850 - DNA, 25 bp, Artificial Sequence
  Description of Artificial Sequence: Synthetic oligonucleotide
cgcagatacctggagaacgaccccc

SEQ ID NO: 1851 - DNA, 25 bp, Artificial Sequence
  Description of Artificial Sequence: Synthetic oligonucleotide
gcagatacctggagaacgacccccc

SEQ ID NO: 1852 - DNA, 27 bp, Artificial Sequence
  Description of Artificial Sequence: Synthetic oligonucleotide
cagatacctggagaacgacccccccaa

SEQ ID NO: 1853 - DNA, 27 bp, Artificial Sequence
  Description of Artificial Sequence: Synthetic oligonucleotide
agatacctggagaacgacccccccaag

SEQ ID NO: 1854 - DNA, 27 bp, Artificial Sequence
  Description of Artificial Sequence: Synthetic oligonucleotide
gatacctggagaacgacccccccaaga

SEQ ID NO: 1855 - DNA, 27 bp, Artificial Sequence
  Description of Artificial Sequence: Synthetic oligonucleotide
atacctggagaacgacccccccaagac

SEQ ID NO: 1856 - DNA, 27 bp, Artificial Sequence
  Description of Artificial Sequence: Synthetic oligonucleotide
tacctggagaacgacccccccaagaca

SEQ ID NO: 1857 - DNA, 26 bp, Artificial Sequence
  Description of Artificial Sequence: Synthetic oligonucleotide
acctggagaacgacccccccaagaca

SEQ ID NO: 1858 - DNA, 25 bp, Artificial Sequence
  Description of Artificial Sequence: Synthetic oligonucleotide
cctggagaacgacccccccaagaca

SEQ ID NO: 1859 - DNA, 27 bp, Artificial Sequence
  Description of Artificial Sequence: Synthetic oligonucleotide
ctggagaacgacccccccaagacacat

SEQ ID NO: 1860 - DNA, 29 bp, Artificial Sequence
  Description of Artificial Sequence: Synthetic oligonucleotide
tggagaacgacccccccaagacacatatg

SEQ ID NO: 1861 - DNA, 28 bp, Artificial Sequence
  Description of Artificial Sequence: Synthetic oligonucleotide
ggagaacgacccccccaagacacatatg

SEQ ID NO: 1862 - DNA, 29 bp, Artificial Sequence
  Description of Artificial Sequence: Synthetic oligonucleotide
gagaacgacccccccaagacacatatgac

SEQ ID NO: 1863 - DNA, 29 bp, Artificial Sequence
  Description of Artificial Sequence: Synthetic oligonucleotide
agaacgacccccccaagacacatatgacc

SEQ ID NO: 1864 - DNA, 28 bp, Artificial Sequence
  Description of Artificial Sequence: Synthetic oligonucleotide
gaacgacccccccaagacacatatgacc

SEQ ID NO: 1865 - DNA, 28 bp, Artificial Sequence
  Description of Artificial Sequence: Synthetic oligonucleotide
aacgacccccccaagacacatatgaccc

SEQ ID NO: 1866 - DNA, 27 bp, Artificial Sequence
  Description of Artificial Sequence: Synthetic oligonucleotide
acgacccccccaagacacatatgaccc

SEQ ID NO: 1867 - DNA, 27 bp, Artificial Sequence
  Description of Artificial Sequence: Synthetic oligonucleotide
cgacccccccaagacacatatgaccca

SEQ ID NO: 1868 - DNA, 24 bp, Artificial Sequence
  Description of Artificial Sequence: Synthetic oligonucleotide
aagcgcaagtgggaggcggcccat

SEQ ID NO: 1869 - DNA, 23 bp, Artificial Sequence
  Description of Artificial Sequence: Synthetic oligonucleotide
agcgcaagtgggaggcggcccat

SEQ ID NO: 1870 - DNA, 22 bp, Artificial Sequence
  Description of Artificial Sequence: Synthetic oligonucleotide
gcgcaagtgggaggcggcccat

SEQ ID NO: 1871 - DNA, 23 bp, Artificial Sequence
  Description of Artificial Sequence: Synthetic oligonucleotide
cgcaagtgggaggcggcccatgt

SEQ ID NO: 1872 - DNA, 23 bp, Artificial Sequence
  Description of Artificial Sequence: Synthetic oligonucleotide
gcaagtgggaggcggcccatgtg

SEQ ID NO: 1873 - DNA, 23 bp, Artificial Sequence
  Description of Artificial Sequence: Synthetic oligonucleotide
caagtgggaggcggcccatgtgg

SEQ ID NO: 1874 - DNA, 23 bp, Artificial Sequence
  Description of Artificial Sequence: Synthetic oligonucleotide
aagtgggaggcggcccatgtggc

SEQ ID NO: 1875 - DNA, 22 bp, Artificial Sequence
  Description of Artificial Sequence: Synthetic oligonucleotide
agtgggaggcggcccatgtggc

SEQ ID NO: 1876 - DNA, 21 bp, Artificial Sequence
  Description of Artificial Sequence: Synthetic oligonucleotide
gtgggaggcggcccatgtggc

SEQ ID NO: 1877 - DNA, 21 bp, Artificial Sequence
  Description of Artificial Sequence: Synthetic oligonucleotide
tgggaggcggcccatgtggcg

SEQ ID NO: 1878 - DNA, 20 bp, Artificial Sequence
  Description of Artificial Sequence: Synthetic oligonucleotide
gggaggcggcccatgtggcg

SEQ ID NO: 1879 - DNA, 21 bp, Artificial Sequence
  Description of Artificial Sequence: Synthetic oligonucleotide
ggaggcggcccatgtggcgga

SEQ ID NO: 1880 - DNA, 21 bp, Artificial Sequence
  Description of Artificial Sequence: Synthetic oligonucleotide
gaggcggcccatgtggcggag

SEQ ID NO: 1881 - DNA, 22 bp, Artificial Sequence
  Description of Artificial Sequence: Synthetic oligonucleotide
aggcggcccatgtggcggagca

SEQ ID NO: 1882 - DNA, 21 bp, Artificial Sequence
  Description of Artificial Sequence: Synthetic oligonucleotide
ggcggcccatgtggcggagca

SEQ ID NO: 1883 - DNA, 21 bp, Artificial Sequence
  Description of Artificial Sequence: Synthetic oligonucleotide
gcggcccatgtggcggagcag

SEQ ID NO: 1884 - DNA, 22 bp, Artificial Sequence
  Description of Artificial Sequence: Synthetic oligonucleotide
cggcccatgtggcggagcagca

SEQ ID NO: 1885 - DNA, 23 bp, Artificial Sequence
  Description of Artificial Sequence: Synthetic oligonucleotide
ggcccatgtggcggagcagcaga

SEQ ID NO: 1886 - DNA, 24 bp, Artificial Sequence
  Description of Artificial Sequence: Synthetic oligonucleotide
gcccatgtggcggagcagcagaga

SEQ ID NO: 1887 - DNA, 24 bp, Artificial Sequence
  Description of Artificial Sequence: Synthetic oligonucleotide
cccatgtggcggagcagcagagag

SEQ ID NO: 1888 - DNA, 24 bp, Artificial Sequence
  Description of Artificial Sequence: Synthetic oligonucleotide
ccatgtggcggagcagcagagagc

SEQ ID NO: 1889 - DNA, 26 bp, Artificial Sequence
  Description of Artificial Sequence: Synthetic oligonucleotide
catgtggcggagcagcagagagccta

SEQ ID NO: 1890 - DNA, 26 bp, Artificial Sequence
  Description of Artificial Sequence: Synthetic oligonucleotide
atgtggcggagcagcagagagcctac

SEQ ID NO: 1891 - DNA, 25 bp, Artificial Sequence
  Description of Artificial Sequence: Synthetic oligonucleotide
tgtggcggagcagcagagagcctac

SEQ ID NO: 1892 - DNA, 24 bp, Artificial Sequence
  Description of Artificial Sequence: Synthetic oligonucleotide
gtggcggagcagcagagagcctac

SEQ ID NO: 1893 - DNA, 25 bp, Artificial Sequence
  Description of Artificial Sequence: Synthetic oligonucleotide
tggcggagcagcagagagcctacct

SEQ ID NO: 1894 - DNA, 24 bp, Artificial Sequence
  Description of Artificial Sequence: Synthetic oligonucleotide
ggcggagcagcagagagcctacct

SEQ ID NO: 1895 - DNA, 24 bp, Artificial Sequence
  Description of Artificial Sequence: Synthetic oligonucleotide
gcggagcagcagagagcctacctg

SEQ ID NO: 1896 - DNA, 25 bp, Artificial Sequence
  Description of Artificial Sequence: Synthetic oligonucleotide
cggagcagcagagagcctacctgga

SEQ ID NO: 1897 - DNA, 25 bp, Artificial Sequence
  Description of Artificial Sequence: Synthetic oligonucleotide
ggagcagcagagagcctacctggag

SEQ ID NO: 1898 - DNA, 25 bp, Artificial Sequence
  Description of Artificial Sequence: Synthetic oligonucleotide
gagcagcagagagcctacctggagg

SEQ ID NO: 1899 - DNA, 25 bp, Artificial Sequence
  Description of Artificial Sequence: Synthetic oligonucleotide
agcagcagagagcctacctggaggg

SEQ ID NO: 1900 - DNA, 24 bp, Artificial Sequence
  Description of Artificial Sequence: Synthetic oligonucleotide
gcagcagagagcctacctggaggg

SEQ ID NO: 1901 - DNA, 25 bp, Artificial Sequence
  Description of Artificial Sequence: Synthetic oligonucleotide
cagcagagagcctacctggagggca

SEQ ID NO: 1902 - DNA, 25 bp, Artificial Sequence
  Description of Artificial Sequence: Synthetic oligonucleotide
agcagagagcctacctggagggcac

SEQ ID NO: 1903 - DNA, 24 bp, Artificial Sequence
  Description of Artificial Sequence: Synthetic oligonucleotide
gcagagagcctacctggagggcac

SEQ ID NO: 1904 - DNA, 25 bp, Artificial Sequence
  Description of Artificial Sequence: Synthetic oligonucleotide
cagagagcctacctggagggcacgt

SEQ ID NO: 1905 - DNA, 25 bp, Artificial Sequence
  Description of Artificial Sequence: Synthetic oligonucleotide
agagagcctacctggagggcacgtg

SEQ ID NO: 1906 - DNA, 24 bp, Artificial Sequence
  Description of Artificial Sequence: Synthetic oligonucleotide
gagagcctacctggagggcacgtg

SEQ ID NO: 1907 - DNA, 24 bp, Artificial Sequence
  Description of Artificial Sequence: Synthetic oligonucleotide
agagcctacctggagggcacgtgc

SEQ ID NO: 1908 - DNA, 23 bp, Artificial Sequence
  Description of Artificial Sequence: Synthetic oligonucleotide
gagcctacctggagggcacgtgc

SEQ ID NO: 1909 - DNA, 24 bp, Artificial Sequence
  Description of Artificial Sequence: Synthetic oligonucleotide
agcctacctggagggcacgtgcgt

SEQ ID NO: 1910 - DNA, 23 bp, Artificial Sequence
  Description of Artificial Sequence: Synthetic oligonucleotide
gcctacctggagggcacgtgcgt

SEQ ID NO: 1911 - DNA, 23 bp, Artificial Sequence
  Description of Artificial Sequence: Synthetic oligonucleotide
cctacctggagggcacgtgcgtg

SEQ ID NO: 1912 - DNA, 24 bp, Artificial Sequence
  Description of Artificial Sequence: Synthetic oligonucleotide
ctacctggagggcacgtgcgtgga

SEQ ID NO: 1913 - DNA, 24 bp, Artificial Sequence
  Description of Artificial Sequence: Synthetic oligonucleotide
tacctggagggcacgtgcgtggac

SEQ ID NO: 1914 - DNA, 23 bp, Artificial Sequence
  Description of Artificial Sequence: Synthetic oligonucleotide
acctggagggcacgtgcgtggac

SEQ ID NO: 1915 - DNA, 22 bp, Artificial Sequence
  Description of Artificial Sequence: Synthetic oligonucleotide
cctggagggcacgtgcgtggac

SEQ ID NO: 1916 - DNA, 22 bp, Artificial Sequence
  Description of Artificial Sequence: Synthetic oligonucleotide
ctggagggcacgtgcgtggacg

SEQ ID NO: 1917 - DNA, 22 bp, Artificial Sequence
  Description of Artificial Sequence: Synthetic oligonucleotide
tggagggcacgtgcgtggacgg

SEQ ID NO: 1918 - DNA, 21 bp, Artificial Sequence
  Description of Artificial Sequence: Synthetic oligonucleotide
ggagggcacgtgcgtggacgg

SEQ ID NO: 1919 - DNA, 21 bp, Artificial Sequence
  Description of Artificial Sequence: Synthetic oligonucleotide
gagggcacgtgcgtggacggg

SEQ ID NO: 1920 - DNA, 22 bp, Artificial Sequence
  Description of Artificial Sequence: Synthetic oligonucleotide
agggcacgtgcgtggacgggct

SEQ ID NO: 1921 - DNA, 21 bp, Artificial Sequence
  Description of Artificial Sequence: Synthetic oligonucleotide
gggcacgtgcgtggacgggct

SEQ ID NO: 1922 - DNA, 21 bp, Artificial Sequence
  Description of Artificial Sequence: Synthetic oligonucleotide
ggcacgtgcgtggacgggctc

SEQ ID NO: 1923 - DNA, 21 bp, Artificial Sequence
  Description of Artificial Sequence: Synthetic oligonucleotide
gcacgtgcgtggacgggctcc

SEQ ID NO: 1924 - DNA, 21 bp, Artificial Sequence
  Description of Artificial Sequence: Synthetic oligonucleotide
cacgtgcgtggacgggctccg

SEQ ID NO: 1925 - DNA, 22 bp, Artificial Sequence
  Description of Artificial Sequence: Synthetic oligonucleotide
acgtgcgtggacgggctccgca

SEQ ID NO: 1926 - DNA, 21 bp, Artificial Sequence
  Description of Artificial Sequence: Synthetic oligonucleotide
cgtgcgtggacgggctccgca

SEQ ID NO: 1927 - DNA, 29 bp, Artificial Sequence
  Description of Artificial Sequence: Synthetic oligonucleotide
accaggagacacggaatatgaaggcccag

SEQ ID NO: 1928 - DNA, 28 bp, Artificial Sequence
  Description of Artificial Sequence: Synthetic oligonucleotide
ccaggagacacggaatatgaaggcccag

SEQ ID NO: 1929 - DNA, 29 bp, Artificial Sequence
  Description of Artificial Sequence: Synthetic oligonucleotide
caggagacacggaatatgaaggcccagtc

SEQ ID NO: 1930 - DNA, 30 bp, Artificial Sequence
  Description of Artificial Sequence: Synthetic oligonucleotide
aggagacacggaatatgaaggcccagtcac

SEQ ID NO: 1931 - DNA, 29 bp, Artificial Sequence
  Description of Artificial Sequence: Synthetic oligonucleotide
ggagacacggaatatgaaggcccagtcac

SEQ ID NO: 1932 - DNA, 30 bp, Artificial Sequence
  Description of Artificial Sequence: Synthetic oligonucleotide
gagacacggaatatgaaggcccagtcacag

SEQ ID NO: 1933 - DNA, 31 bp, Artificial Sequence
  Description of Artificial Sequence: Synthetic oligonucleotide
agacacggaatatgaaggcccagtcacagac

SEQ ID NO: 1934 - DNA, 30 bp, Artificial Sequence
  Description of Artificial Sequence: Synthetic oligonucleotide
gacacggaatatgaaggcccagtcacagac

SEQ ID NO: 1935 - DNA, 31 bp, Artificial Sequence
  Description of Artificial Sequence: Synthetic oligonucleotide
acacggaatatgaaggcccagtcacagactg

SEQ ID NO: 1936 - DNA, 30 bp, Artificial Sequence
  Description of Artificial Sequence: Synthetic oligonucleotide
cacggaatatgaaggcccagtcacagactg

SEQ ID NO: 1937 - DNA, 31 bp, Artificial Sequence
  Description of Artificial Sequence: Synthetic oligonucleotide
acggaatatgaaggcccagtcacagactgac

SEQ ID NO: 1938 - DNA, 30 bp, Artificial Sequence
  Description of Artificial Sequence: Synthetic oligonucleotide
cggaatatgaaggcccagtcacagactgac

SEQ ID NO: 1939 - DNA, 30 bp, Artificial Sequence
  Description of Artificial Sequence: Synthetic oligonucleotide
ggaatatgaaggcccagtcacagactgacc

SEQ ID NO: 1940 - DNA, 30 bp, Artificial Sequence
  Description of Artificial Sequence: Synthetic oligonucleotide
gaatatgaaggcccagtcacagactgaccg

SEQ ID NO: 1941 - DNA, 31 bp, Artificial Sequence
  Description of Artificial Sequence: Synthetic oligonucleotide
aatatgaaggcccagtcacagactgaccgag

SEQ ID NO: 1942 - DNA, 30 bp, Artificial Sequence
  Description of Artificial Sequence: Synthetic oligonucleotide
atatgaaggcccagtcacagactgaccgag

SEQ ID NO: 1943 - DNA, 29 bp, Artificial Sequence
  Description of Artificial Sequence: Synthetic oligonucleotide
tatgaaggcccagtcacagactgaccgag

SEQ ID NO: 1944 - DNA, 28 bp, Artificial Sequence
  Description of Artificial Sequence: Synthetic oligonucleotide
atgaaggcccagtcacagactgaccgag

SEQ ID NO: 1945 - DNA, 27 bp, Artificial Sequence
  Description of Artificial Sequence: Synthetic oligonucleotide
tgaaggcccagtcacagactgaccgag

SEQ ID NO: 1946 - DNA, 27 bp, Artificial Sequence
  Description of Artificial Sequence: Synthetic oligonucleotide
gaaggcccagtcacagactgaccgagt

SEQ ID NO: 1947 - DNA, 27 bp, Artificial Sequence
  Description of Artificial Sequence: Synthetic oligonucleotide
aaggcccagtcacagactgaccgagtg

SEQ ID NO: 1948 - DNA, 26 bp, Artificial Sequence
  Description of Artificial Sequence: Synthetic oligonucleotide
aggcccagtcacagactgaccgagtg

SEQ ID NO: 1949 - DNA, 25 bp, Artificial Sequence
  Description of Artificial Sequence: Synthetic oligonucleotide
ggcccagtcacagactgaccgagtg

SEQ ID NO: 1950 - DNA, 26 bp, Artificial Sequence
  Description of Artificial Sequence: Synthetic oligonucleotide
gcccagtcacagactgaccgagtgga

SEQ ID NO: 1951 - DNA, 26 bp, Artificial Sequence
  Description of Artificial Sequence: Synthetic oligonucleotide
cccagtcacagactgaccgagtggac

SEQ ID NO: 1952 - DNA, 27 bp, Artificial Sequence
  Description of Artificial Sequence: Synthetic oligonucleotide
ccagtcacagactgaccgagtggacct

SEQ ID NO: 1953 - DNA, 27 bp, Artificial Sequence
  Description of Artificial Sequence: Synthetic oligonucleotide
cagtcacagactgaccgagtggacctg

SEQ ID NO: 1954 - DNA, 27 bp, Artificial Sequence
  Description of Artificial Sequence: Synthetic oligonucleotide
agtcacagactgaccgagtggacctgg

SEQ ID NO: 1955 - DNA, 26 bp, Artificial Sequence
  Description of Artificial Sequence: Synthetic oligonucleotide
gtcacagactgaccgagtggacctgg

SEQ ID NO: 1956 - DNA, 26 bp, Artificial Sequence
  Description of Artificial Sequence: Synthetic oligonucleotide
tcacagactgaccgagtggacctggg

SEQ ID NO: 1957 - DNA, 25 bp, Artificial Sequence
  Description of Artificial Sequence: Synthetic oligonucleotide
cacagactgaccgagtggacctggg

SEQ ID NO: 1958 - DNA, 26 bp, Artificial Sequence
  Description of Artificial Sequence: Synthetic oligonucleotide
acagactgaccgagtggacctgggga

SEQ ID NO: 1959 - DNA, 25 bp, Artificial Sequence
  Description of Artificial Sequence: Synthetic oligonucleotide
cagactgaccgagtggacctgggga

SEQ ID NO: 1960 - DNA, 25 bp, Artificial Sequence
  Description of Artificial Sequence: Synthetic oligonucleotide
agactgaccgagtggacctggggac

SEQ ID NO: 1961 - DNA, 24 bp, Artificial Sequence
  Description of Artificial Sequence: Synthetic oligonucleotide
gactgaccgagtggacctggggac

SEQ ID NO: 1962 - DNA, 24 bp, Artificial Sequence
  Description of Artificial Sequence: Synthetic oligonucleotide
actgaccgagtggacctggggacc

SEQ ID NO: 1963 - DNA, 23 bp, Artificial Sequence
  Description of Artificial Sequence: Synthetic oligonucleotide
ctgaccgagtggacctggggacc

SEQ ID NO: 1964 - DNA, 24 bp, Artificial Sequence
  Description of Artificial Sequence: Synthetic oligonucleotide
tgaccgagtggacctggggaccct

SEQ ID NO: 1965 - DNA, 23 bp, Artificial Sequence
  Description of Artificial Sequence: Synthetic oligonucleotide
gaccgagtggacctggggaccct

SEQ ID NO: 1966 - DNA, 23 bp, Artificial Sequence
  Description of Artificial Sequence: Synthetic oligonucleotide
accgagtggacctggggaccctg

SEQ ID NO: 1967 - DNA, 22 bp, Artificial Sequence
  Description of Artificial Sequence: Synthetic oligonucleotide
ccgagtggacctggggaccctg

SEQ ID NO: 1968 - DNA, 22 bp, Artificial Sequence
  Description of Artificial Sequence: Synthetic oligonucleotide
cgagtggacctggggaccctgc

SEQ ID NO: 1969 - DNA, 22 bp, Artificial Sequence
  Description of Artificial Sequence: Synthetic oligonucleotide
gagtggacctggggaccctgcg

SEQ ID NO: 1970 - DNA, 22 bp, Artificial Sequence
  Description of Artificial Sequence: Synthetic oligonucleotide
agtggacctggggaccctgcgc

SEQ ID NO: 1971 - DNA, 21 bp, Artificial Sequence
  Description of Artificial Sequence: Synthetic oligonucleotide
gtggacctggggaccctgcgc

SEQ ID NO: 1972 - DNA, 21 bp, Artificial Sequence
  Description of Artificial Sequence: Synthetic oligonucleotide
tggacctggggaccctgcgcg

SEQ ID NO: 1973 - DNA, 20 bp, Artificial Sequence
  Description of Artificial Sequence: Synthetic oligonucleotide
ggacctggggaccctgcgcg

SEQ ID NO: 1974 - DNA, 20 bp, Artificial Sequence
  Description of Artificial Sequence: Synthetic oligonucleotide
gacctggggaccctgcgcgg

SEQ ID NO: 1975 - DNA, 25 bp, Artificial Sequence
  Description of Artificial Sequence: Synthetic oligonucleotide
cagcggagagtctacctggagggca

SEQ ID NO: 1976 - DNA, 25 bp, Artificial Sequence
  Description of Artificial Sequence: Synthetic oligonucleotide
agcggagagtctacctggagggcac

SEQ ID NO: 1977 - DNA, 24 bp, Artificial Sequence
  Description of Artificial Sequence: Synthetic oligonucleotide
gcggagagtctacctggagggcac

SEQ ID NO: 1978 - DNA, 25 bp, Artificial Sequence
  Description of Artificial Sequence: Synthetic oligonucleotide
cggagagtctacctggagggcacgt

SEQ ID NO: 1979 - DNA, 25 bp, Artificial Sequence
  Description of Artificial Sequence: Synthetic oligonucleotide
ggagagtctacctggagggcacgtg

SEQ ID NO: 1980 - DNA, 25 bp, Artificial Sequence
  Description of Artificial Sequence: Synthetic oligonucleotide
gagagtctacctggagggcacgtgc

SEQ ID NO: 1981 - DNA, 26 bp, Artificial Sequence
  Description of Artificial Sequence: Synthetic oligonucleotide
agagtctacctggagggcacgtgcgt

SEQ ID NO: 1982 - DNA, 25 bp, Artificial Sequence
  Description of Artificial Sequence: Synthetic oligonucleotide
gagtctacctggagggcacgtgcgt

SEQ ID NO: 1983 - DNA, 25 bp, Artificial Sequence
  Description of Artificial Sequence: Synthetic oligonucleotide
agtctacctggagggcacgtgcgtg

SEQ ID NO: 1984 - DNA, 24 bp, Artificial Sequence
  Description of Artificial Sequence: Synthetic oligonucleotide
gtctacctggagggcacgtgcgtg

SEQ ID NO: 1985 - DNA, 25 bp, Artificial Sequence
  Description of Artificial Sequence: Synthetic oligonucleotide
tctacctggagggcacgtgcgtgga

SEQ ID NO: 1986 - DNA, 24 bp, Artificial Sequence
  Description of Artificial Sequence: Synthetic oligonucleotide
agcggagagtctacctggagggcg

SEQ ID NO: 1987 - DNA, 23 bp, Artificial Sequence
  Description of Artificial Sequence: Synthetic oligonucleotide
gcggagagtctacctggagggcg

SEQ ID NO: 1988 - DNA, 24 bp, Artificial Sequence
  Description of Artificial Sequence: Synthetic oligonucleotide
cggagagtctacctggagggcggt

SEQ ID NO: 1989 - DNA, 24 bp, Artificial Sequence
  Description of Artificial Sequence: Synthetic oligonucleotide
ggagagtctacctggagggcggtg

SEQ ID NO: 1990 - DNA, 24 bp, Artificial Sequence
  Description of Artificial Sequence: Synthetic oligonucleotide
gagagtctacctggagggcggtgc

SEQ ID NO: 1991 - DNA, 25 bp, Artificial Sequence
  Description of Artificial Sequence: Synthetic oligonucleotide
agagtctacctggagggcggtgcgt

SEQ ID NO: 1992 - DNA, 24 bp, Artificial Sequence
  Description of Artificial Sequence: Synthetic oligonucleotide
gagtctacctggagggcggtgcgt

SEQ ID NO: 1993 - DNA, 24 bp, Artificial Sequence
  Description of Artificial Sequence: Synthetic oligonucleotide
agtctacctggagggcggtgcgtg

SEQ ID NO: 1994 - DNA, 23 bp, Artificial Sequence
  Description of Artificial Sequence: Synthetic oligonucleotide
gtctacctggagggcggtgcgtg

SEQ ID NO: 1995 - DNA, 24 bp, Artificial Sequence
  Description of Artificial Sequence: Synthetic oligonucleotide
tctacctggagggcggtgcgtgga

SEQ ID NO: 1996 - DNA, 23 bp, Artificial Sequence
  Description of Artificial Sequence: Synthetic oligonucleotide
ctacctggagggcggtgcgtgga

SEQ ID NO: 1997 - DNA, 23 bp, Artificial Sequence
  Description of Artificial Sequence: Synthetic oligonucleotide
tacctggagggcggtgcgtggac

SEQ ID NO: 1998 - DNA, 22 bp, Artificial Sequence
  Description of Artificial Sequence: Synthetic oligonucleotide
acctggagggcggtgcgtggac

SEQ ID NO: 1999 - DNA, 21 bp, Artificial Sequence
  Description of Artificial Sequence: Synthetic oligonucleotide
cctggagggcggtgcgtggac

SEQ ID NO: 2000 - DNA, 21 bp, Artificial Sequence
  Description of Artificial Sequence: Synthetic oligonucleotide
ctggagggcggtgcgtggacg

SEQ ID NO: 2001 - DNA, 21 bp, Artificial Sequence
  Description of Artificial Sequence: Synthetic oligonucleotide
tggagggcggtgcgtggacgg

SEQ ID NO: 2002 - DNA, 20 bp, Artificial Sequence
  Description of Artificial Sequence: Synthetic oligonucleotide
ggagggcggtgcgtggacgg

SEQ ID NO: 2003 - DNA, 20 bp, Artificial Sequence
  Description of Artificial Sequence: Synthetic oligonucleotide
gagggcggtgcgtggacggg

SEQ ID NO: 2004 - DNA, 21 bp, Artificial Sequence
  Description of Artificial Sequence: Synthetic oligonucleotide
agggcggtgcgtggacgggct

SEQ ID NO: 2005 - DNA, 20 bp, Artificial Sequence
  Description of Artificial Sequence: Synthetic oligonucleotide
gggcggtgcgtggacgggct

SEQ ID NO: 2006 - DNA, 20 bp, Artificial Sequence
  Description of Artificial Sequence: Synthetic oligonucleotide
ggcggtgcgtggacgggctc

SEQ ID NO: 2007 - DNA, 20 bp, Artificial Sequence
  Description of Artificial Sequence: Synthetic oligonucleotide
gcggtgcgtggacgggctcc

SEQ ID NO: 2008 - DNA, 20 bp, Artificial Sequence
  Description of Artificial Sequence: Synthetic oligonucleotide
ggaggcggtccatgcggcgg

SEQ ID NO: 2009 - DNA, 21 bp, Artificial Sequence
  Description of Artificial Sequence: Synthetic oligonucleotide
gaggcggtccatgcggcggga

SEQ ID NO: 2010 - DNA, 21 bp, Artificial Sequence
  Description of Artificial Sequence: Synthetic oligonucleotide
aggcggtccatgcggcgggag

SEQ ID NO: 2011 - DNA, 20 bp, Artificial Sequence
  Description of Artificial Sequence: Synthetic oligonucleotide
ggcggtccatgcggcgggag

SEQ ID NO: 2012 - DNA, 21 bp, Artificial Sequence
  Description of Artificial Sequence: Synthetic oligonucleotide
gcggtccatgcggcgggagca

SEQ ID NO: 2013 - DNA, 21 bp, Artificial Sequence
  Description of Artificial Sequence: Synthetic oligonucleotide
cggtccatgcggcgggagcag

SEQ ID NO: 2014 - DNA, 21 bp, Artificial Sequence
  Description of Artificial Sequence: Synthetic oligonucleotide
ggtccatgcggcgggagcagc

SEQ ID NO: 2015 - DNA, 21 bp, Artificial Sequence
  Description of Artificial Sequence: Synthetic oligonucleotide
gtccatgcggcgggagcagcg

SEQ ID NO: 2016 - DNA, 22 bp, Artificial Sequence
  Description of Artificial Sequence: Synthetic oligonucleotide
tccatgcggcgggagcagcgga

SEQ ID NO: 2017 - DNA, 21 bp, Artificial Sequence
  Description of Artificial Sequence: Synthetic oligonucleotide
ccatgcggcgggagcagcgga

SEQ ID NO: 2018 - DNA, 22 bp, Artificial Sequence
  Description of Artificial Sequence: Synthetic oligonucleotide
catgcggcgggagcagcggaga

SEQ ID NO: 2019 - DNA, 23 bp, Artificial Sequence
  Description of Artificial Sequence: Synthetic oligonucleotide
atgcggcgggagcagcggagagt

SEQ ID NO: 2020 - DNA, 22 bp, Artificial Sequence
  Description of Artificial Sequence: Synthetic oligonucleotide
tgcggcgggagcagcggagagt

SEQ ID NO: 2021 - DNA, 21 bp, Artificial Sequence
  Description of Artificial Sequence: Synthetic oligonucleotide
gcggcgggagcagcggagagt

SEQ ID NO: 2022 - DNA, 23 bp, Artificial Sequence
  Description of Artificial Sequence: Synthetic oligonucleotide
cggcgggagcagcggagagtcta

SEQ ID NO: 2023 - DNA, 23 bp, Artificial Sequence
  Description of Artificial Sequence: Synthetic oligonucleotide
ggcgggagcagcggagagtctac

SEQ ID NO: 2024 - DNA, 24 bp, Artificial Sequence
  Description of Artificial Sequence: Synthetic oligonucleotide
gcgggagcagcggagagtctacct

SEQ ID NO: 2025 - DNA, 24 bp, Artificial Sequence
  Description of Artificial Sequence: Synthetic oligonucleotide
cgggagcagcggagagtctacctg

SEQ ID NO: 2026 - DNA, 25 bp, Artificial Sequence
  Description of Artificial Sequence: Synthetic oligonucleotide
gggagcagcggagagtctacctgga

SEQ ID NO: 2027 - DNA, 26 bp, Artificial Sequence
  Description of Artificial Sequence: Synthetic oligonucleotide
gaaggcccagtcacagactgaccgag

SEQ ID NO: 2028 - DNA, 26 bp, Artificial Sequence
  Description of Artificial Sequence: Synthetic oligonucleotide
aaggcccagtcacagactgaccgagc

SEQ ID NO: 2029 - DNA, 25 bp, Artificial Sequence
  Description of Artificial Sequence: Synthetic oligonucleotide
aggcccagtcacagactgaccgagc

SEQ ID NO: 2030 - DNA, 24 bp, Artificial Sequence
  Description of Artificial Sequence: Synthetic oligonucleotide
ggcccagtcacagactgaccgagc

SEQ ID NO: 2031 - DNA, 26 bp, Artificial Sequence
  Description of Artificial Sequence: Synthetic oligonucleotide
gcccagtcacagactgaccgagcgaa

SEQ ID NO: 2032 - DNA, 26 bp, Artificial Sequence
  Description of Artificial Sequence: Synthetic oligonucleotide
cccagtcacagactgaccgagcgaac

SEQ ID NO: 2033 - DNA, 27 bp, Artificial Sequence
  Description of Artificial Sequence: Synthetic oligonucleotide
ccagtcacagactgaccgagcgaacct

SEQ ID NO: 2034 - DNA, 27 bp, Artificial Sequence
  Description of Artificial Sequence: Synthetic oligonucleotide
cagtcacagactgaccgagcgaacctg

SEQ ID NO: 2035 - DNA, 27 bp, Artificial Sequence
  Description of Artificial Sequence: Synthetic oligonucleotide
agtcacagactgaccgagcgaacctgg

SEQ ID NO: 2036 - DNA, 26 bp, Artificial Sequence
  Description of Artificial Sequence: Synthetic oligonucleotide
gtcacagactgaccgagcgaacctgg

SEQ ID NO: 2037 - DNA, 23 bp, Artificial Sequence
  Description of Artificial Sequence: Synthetic oligonucleotide
gcgagccagaagatggagccgcc

SEQ ID NO: 2038 - DNA, 23 bp, Artificial Sequence
  Description of Artificial Sequence: Synthetic oligonucleotide
cgagccagaagatggagccgccg

SEQ ID NO: 2039 - DNA, 23 bp, Artificial Sequence
  Description of Artificial Sequence: Synthetic oligonucleotide
gagccagaagatggagccgccgg

SEQ ID NO: 2040 - DNA, 23 bp, Artificial Sequence
  Description of Artificial Sequence: Synthetic oligonucleotide
agccagaagatggagccgccggc

SEQ ID NO: 2041 - DNA, 22 bp, Artificial Sequence
  Description of Artificial Sequence: Synthetic oligonucleotide
gccagaagatggagccgccggc

SEQ ID NO: 2042 - DNA, 22 bp, Artificial Sequence
  Description of Artificial Sequence: Synthetic oligonucleotide
ccagaagatggagccgccggcg

SEQ ID NO: 2043 - DNA, 22 bp, Artificial Sequence
  Description of Artificial Sequence: Synthetic oligonucleotide
cagaagatggagccgccggcgc

SEQ ID NO: 2044 - DNA, 22 bp, Artificial Sequence
  Description of Artificial Sequence: Synthetic oligonucleotide
agaagatggagccgccggcgcc

SEQ ID NO: 2045 - DNA, 21 bp, Artificial Sequence
  Description of Artificial Sequence: Synthetic oligonucleotide
gaagatggagccgccggcgcc

SEQ ID NO: 2046 - DNA, 22 bp, Artificial Sequence
  Description of Artificial Sequence: Synthetic oligonucleotide
aagatggagccgccggcgccgt

SEQ ID NO: 2047 - DNA, 21 bp, Artificial Sequence
  Description of Artificial Sequence: Synthetic oligonucleotide
agatggagccgccggcgccgt

SEQ ID NO: 2048 - DNA, 20 bp, Artificial Sequence
  Description of Artificial Sequence: Synthetic oligonucleotide
gatggagccgccggcgccgt

SEQ ID NO: 2049 - DNA, 20 bp, Artificial Sequence
  Description of Artificial Sequence: Synthetic oligonucleotide
atggagccgccggcgccgtg

SEQ ID NO: 2050 - DNA, 20 bp, Artificial Sequence
  Description of Artificial Sequence: Synthetic oligonucleotide
tggagccgccggcgccgtgt

SEQ ID NO: 2051 - DNA, 20 bp, Artificial Sequence
  Description of Artificial Sequence: Synthetic oligonucleotide
ggagccgccggcgccgtgtt

SEQ ID NO: 2052 - DNA, 21 bp, Artificial Sequence
  Description of Artificial Sequence: Synthetic oligonucleotide
gagccgccggcgccgtggata

SEQ ID NO: 2053 - DNA, 22 bp, Artificial Sequence
  Description of Artificial Sequence: Synthetic oligonucleotide
agccgccggcgccgtggataga

SEQ ID NO: 2054 - DNA, 21 bp, Artificial Sequence
  Description of Artificial Sequence: Synthetic oligonucleotide
gccgccggcgccgtggataga

SEQ ID NO: 2055 - DNA, 21 bp, Artificial Sequence
  Description of Artificial Sequence: Synthetic oligonucleotide
ccgccggcgccgtggatagag

SEQ ID NO: 2056 - DNA, 22 bp, Artificial Sequence
  Description of Artificial Sequence: Synthetic oligonucleotide
cgccggcgccgtggatagagca

SEQ ID NO: 2057 - DNA, 22 bp, Artificial Sequence
  Description of Artificial Sequence: Synthetic oligonucleotide
gccggcgccgtggatagagcag

SEQ ID NO: 2058 - DNA, 23 bp, Artificial Sequence
  Description of Artificial Sequence: Synthetic oligonucleotide
ccggcgccgtggatagagcagga

SEQ ID NO: 2059 - DNA, 23 bp, Artificial Sequence
  Description of Artificial Sequence: Synthetic oligonucleotide
cggcgccgtggatagagcaggag

SEQ ID NO: 2060 - DNA, 27 bp, Artificial Sequence
  Description of Artificial Sequence: Synthetic oligonucleotide
gctactacaaccagagcgaggacggtg

SEQ ID NO: 2061 - DNA, 27 bp, Artificial Sequence
  Description of Artificial Sequence: Synthetic oligonucleotide
ctactacaaccagagcgaggacggtgc

SEQ ID NO: 2062 - DNA, 28 bp, Artificial Sequence
  Description of Artificial Sequence: Synthetic oligonucleotide
tactacaaccagagcgaggacggtgctc

SEQ ID NO: 2063 - DNA, 27 bp, Artificial Sequence
  Description of Artificial Sequence: Synthetic oligonucleotide
actacaaccagagcgaggacggtgctc

SEQ ID NO: 2064 - DNA, 27 bp, Artificial Sequence
  Description of Artificial Sequence: Synthetic oligonucleotide
ctacaaccagagcgaggacggtgctca

SEQ ID NO: 2065 - DNA, 27 bp, Artificial Sequence
  Description of Artificial Sequence: Synthetic oligonucleotide
tacaaccagagcgaggacggtgctcac

SEQ ID NO: 2066 - DNA, 27 bp, Artificial Sequence
  Description of Artificial Sequence: Synthetic oligonucleotide
acaaccagagcgaggacggtgctcaca

SEQ ID NO: 2067 - DNA, 26 bp, Artificial Sequence
  Description of Artificial Sequence: Synthetic oligonucleotide
caaccagagcgaggacggtgctcaca

SEQ ID NO: 2068 - DNA, 26 bp, Artificial Sequence
  Description of Artificial Sequence: Synthetic oligonucleotide
aaccagagcgaggacggtgctcacac

SEQ ID NO: 2069 - DNA, 25 bp, Artificial Sequence
  Description of Artificial Sequence: Synthetic oligonucleotide
accagagcgaggacggtgctcacac

SEQ ID NO: 2070 - DNA, 24 bp, Artificial Sequence
  Description of Artificial Sequence: Synthetic oligonucleotide
ccagagcgaggacggtgctcacac

SEQ ID NO: 2071 - DNA, 26 bp, Artificial Sequence
  Description of Artificial Sequence: Synthetic oligonucleotide
cagagcgaggacggtgctcacaccat

SEQ ID NO: 2072 - DNA, 26 bp, Artificial Sequence
  Description of Artificial Sequence: Synthetic oligonucleotide
agagcgaggacggtgctcacaccatc

SEQ ID NO: 2073 - DNA, 25 bp, Artificial Sequence
  Description of Artificial Sequence: Synthetic oligonucleotide
gagcgaggacggtgctcacaccatc

SEQ ID NO: 2074 - DNA, 26 bp, Artificial Sequence
  Description of Artificial Sequence: Synthetic oligonucleotide
agcgaggacggtgctcacaccatcca

SEQ ID NO: 2075 - DNA, 25 bp, Artificial Sequence
  Description of Artificial Sequence: Synthetic oligonucleotide
gcgaggacggtgctcacaccatcca

SEQ ID NO: 2076 - DNA, 27 bp, Artificial Sequence
  Description of Artificial Sequence: Synthetic oligonucleotide
cgaggacggtgctcacaccatccagat

SEQ ID NO: 2077 - DNA, 30 bp, Artificial Sequence
  Description of Artificial Sequence: Synthetic oligonucleotide
gaggacggtgctcacaccatccagataatg

SEQ ID NO: 2078 - DNA, 33 bp, Artificial Sequence
  Description of Artificial Sequence: Synthetic oligonucleotide
aggacggtgctcacaccatccagataatgtatg

SEQ ID NO: 2079 - DNA, 32 bp, Artificial Sequence
  Description of Artificial Sequence: Synthetic oligonucleotide
ggacggtgctcacaccatccagataatgtatg

SEQ ID NO: 2080 - DNA, 32 bp, Artificial Sequence
  Description of Artificial Sequence: Synthetic oligonucleotide
gacggtgctcacaccatccagataatgtatgg

SEQ ID NO: 2081 - DNA, 32 bp, Artificial Sequence
  Description of Artificial Sequence: Synthetic oligonucleotide
acggtgctcacaccatccagataatgtatggc

SEQ ID NO: 2082 - DNA, 31 bp, Artificial Sequence
  Description of Artificial Sequence: Synthetic oligonucleotide
cggtgctcacaccatccagataatgtatggc

SEQ ID NO: 2083 - DNA, 32 bp, Artificial Sequence
  Description of Artificial Sequence: Synthetic oligonucleotide
ggtgctcacaccatccagataatgtatggctg

SEQ ID NO: 2084 - DNA, 32 bp, Artificial Sequence
  Description of Artificial Sequence: Synthetic oligonucleotide
gtgctcacaccatccagataatgtatggctgc

SEQ ID NO: 2085 - DNA, 32 bp, Artificial Sequence
  Description of Artificial Sequence: Synthetic oligonucleotide
tgctcacaccatccagataatgtatggctgcg

SEQ ID NO: 2086 - DNA, 31 bp, Artificial Sequence
  Description of Artificial Sequence: Synthetic oligonucleotide
gctcacaccatccagataatgtatggctgcg

SEQ ID NO: 2087 - DNA, 26 bp, Artificial Sequence
  Description of Artificial Sequence: Synthetic oligonucleotide
accagagcgaggacggttctcacacc

SEQ ID NO: 2088 - DNA, 25 bp, Artificial Sequence
  Description of Artificial Sequence: Synthetic oligonucleotide
ccagagcgaggacggttctcacacc

SEQ ID NO: 2089 - DNA, 26 bp, Artificial Sequence
  Description of Artificial Sequence: Synthetic oligonucleotide
cagagcgaggacggttctcacaccgt

SEQ ID NO: 2090 - DNA, 26 bp, Artificial Sequence
  Description of Artificial Sequence: Synthetic oligonucleotide
agagcgaggacggttctcacaccgtc

SEQ ID NO: 2091 - DNA, 25 bp, Artificial Sequence
  Description of Artificial Sequence: Synthetic oligonucleotide
gagcgaggacggttctcacaccgtc

SEQ ID NO: 2092 - DNA, 26 bp, Artificial Sequence
  Description of Artificial Sequence: Synthetic oligonucleotide
agcgaggacggttctcacaccgtcca

SEQ ID NO: 2093 - DNA, 25 bp, Artificial Sequence
  Description of Artificial Sequence: Synthetic oligonucleotide
gcgaggacggttctcacaccgtcca

SEQ ID NO: 2094 - DNA, 26 bp, Artificial Sequence
  Description of Artificial Sequence: Synthetic oligonucleotide
cgaggacggttctcacaccgtccaga

SEQ ID NO: 2095 - DNA, 26 bp, Artificial Sequence
  Description of Artificial Sequence: Synthetic oligonucleotide
gaggacggttctcacaccgtccagag

SEQ ID NO: 2096 - DNA, 27 bp, Artificial Sequence
  Description of Artificial Sequence: Synthetic oligonucleotide
aggacggttctcacaccgtccagagga

SEQ ID NO: 2097 - DNA, 27 bp, Artificial Sequence
  Description of Artificial Sequence: Synthetic oligonucleotide
ggacggttctcacaccgtccagaggat

SEQ ID NO: 2098 - DNA, 27 bp, Artificial Sequence
  Description of Artificial Sequence: Synthetic oligonucleotide
gacggttctcacaccgtccagaggatg

SEQ ID NO: 2099 - DNA, 30 bp, Artificial Sequence
  Description of Artificial Sequence: Synthetic oligonucleotide
acggttctcacaccgtccagaggatgtatg

SEQ ID NO: 2100 - DNA, 29 bp, Artificial Sequence
  Description of Artificial Sequence: Synthetic oligonucleotide
cggttctcacaccgtccagaggatgtatg

SEQ ID NO: 2101 - DNA, 29 bp, Artificial Sequence
  Description of Artificial Sequence: Synthetic oligonucleotide
ggttctcacaccgtccagaggatgtatgg

SEQ ID NO: 2102 - DNA, 29 bp, Artificial Sequence
  Description of Artificial Sequence: Synthetic oligonucleotide
gttctcacaccgtccagaggatgtatggc

SEQ ID NO: 2103 - DNA, 30 bp, Artificial Sequence
  Description of Artificial Sequence: Synthetic oligonucleotide
ttctcacaccgtccagaggatgtatggctg

SEQ ID NO: 2104 - DNA, 29 bp, Artificial Sequence
  Description of Artificial Sequence: Synthetic oligonucleotide
tctcacaccgtccagaggatgtatggctg

SEQ ID NO: 2105 - DNA, 28 bp, Artificial Sequence
  Description of Artificial Sequence: Synthetic oligonucleotide
ctcacaccgtccagaggatgtatggctg

SEQ ID NO: 2106 - DNA, 28 bp, Artificial Sequence
  Description of Artificial Sequence: Synthetic oligonucleotide
tcacaccgtccagaggatgtatggctgc

SEQ ID NO: 2107 - DNA, 27 bp, Artificial Sequence
  Description of Artificial Sequence: Synthetic oligonucleotide
cacaccgtccagaggatgtatggctgc

SEQ ID NO: 2108 - DNA, 27 bp, Artificial Sequence
  Description of Artificial Sequence: Synthetic oligonucleotide
acaccgtccagaggatgtatggctgcg

SEQ ID NO: 2109 - DNA, 27 bp, Artificial Sequence
  Description of Artificial Sequence: Synthetic oligonucleotide
caccgtccagaggatgtatggctgcga

SEQ ID NO: 2110 - DNA, 27 bp, Artificial Sequence
  Description of Artificial Sequence: Synthetic oligonucleotide
accgtccagaggatgtatggctgcgac

SEQ ID NO: 2111 - DNA, 26 bp, Artificial Sequence
  Description of Artificial Sequence: Synthetic oligonucleotide
ccgtccagaggatgtatggctgcgac

SEQ ID NO: 2112 - DNA, 27 bp, Artificial Sequence
  Description of Artificial Sequence: Synthetic oligonucleotide
cgtccagaggatgtatggctgcgacgt

SEQ ID NO: 2113 - DNA, 27 bp, Artificial Sequence
  Description of Artificial Sequence: Synthetic oligonucleotide
gtccagaggatgtatggctgcgacgtg

SEQ ID NO: 2114 - DNA, 27 bp, Artificial Sequence
  Description of Artificial Sequence: Synthetic oligonucleotide
tccagaggatgtatggctgcgacgtgg

SEQ ID NO: 2115 - DNA, 26 bp, Artificial Sequence
  Description of Artificial Sequence: Synthetic oligonucleotide
ccagaggatgtatggctgcgacgtgg

SEQ ID NO: 2116 - DNA, 26 bp, Artificial Sequence
  Description of Artificial Sequence: Synthetic oligonucleotide
cagaggatgtatggctgcgacgtggg

SEQ ID NO: 2117 - DNA, 26 bp, Artificial Sequence
  Description of Artificial Sequence: Synthetic oligonucleotide
agaggatgtatggctgcgacgtgggg

SEQ ID NO: 2118 - DNA, 25 bp, Artificial Sequence
  Description of Artificial Sequence: Synthetic oligonucleotide
gaggatgtatggctgcgacgtgggg

SEQ ID NO: 2119 - DNA, 25 bp, Artificial Sequence
  Description of Artificial Sequence: Synthetic oligonucleotide
aggatgtatggctgcgacgtggggc

SEQ ID NO: 2120 - DNA, 24 bp, Artificial Sequence
  Description of Artificial Sequence: Synthetic oligonucleotide
ggatgtatggctgcgacgtggggc

SEQ ID NO: 2121 - DNA, 21 bp, Artificial Sequence
  Description of Artificial Sequence: Synthetic oligonucleotide
cggcccatgtggcggagcagc

SEQ ID NO: 2122 - DNA, 21 bp, Artificial Sequence
  Description of Artificial Sequence: Synthetic oligonucleotide
ggcccatgtggcggagcagcg

SEQ ID NO: 2123 - DNA, 22 bp, Artificial Sequence
  Description of Artificial Sequence: Synthetic oligonucleotide
gcccatgtggcggagcagcgga

SEQ ID NO: 2124 - DNA, 23 bp, Artificial Sequence
  Description of Artificial Sequence: Synthetic oligonucleotide
cccatgtggcggagcagcggaga

SEQ ID NO: 2125 - DNA, 24 bp, Artificial Sequence
  Description of Artificial Sequence: Synthetic oligonucleotide
ccatgtggcggagcagcggagagt

SEQ ID NO: 2126 - DNA, 26 bp, Artificial Sequence
  Description of Artificial Sequence: Synthetic oligonucleotide
catgtggcggagcagcggagagtcta

SEQ ID NO: 2127 - DNA, 26 bp, Artificial Sequence
  Description of Artificial Sequence: Synthetic oligonucleotide
atgtggcggagcagcggagagtctac

SEQ ID NO: 2128 - DNA, 25 bp, Artificial Sequence
  Description of Artificial Sequence: Synthetic oligonucleotide
tgtggcggagcagcggagagtctac

SEQ ID NO: 2129 - DNA, 24 bp, Artificial Sequence
  Description of Artificial Sequence: Synthetic oligonucleotide
gtggcggagcagcggagagtctac

SEQ ID NO: 2130 - DNA, 25 bp, Artificial Sequence
  Description of Artificial Sequence: Synthetic oligonucleotide
tggcggagcagcggagagtctacct

SEQ ID NO: 2131 - DNA, 24 bp, Artificial Sequence
  Description of Artificial Sequence: Synthetic oligonucleotide
gggatggggaggaccagacccaca

SEQ ID NO: 2132 - DNA, 25 bp, Artificial Sequence
  Description of Artificial Sequence: Synthetic oligonucleotide
ggatggggaggaccagacccacaca

SEQ ID NO: 2133 - DNA, 25 bp, Artificial Sequence
  Description of Artificial Sequence: Synthetic oligonucleotide
gatggggaggaccagacccacacac

SEQ ID NO: 2134 - DNA, 25 bp, Artificial Sequence
  Description of Artificial Sequence: Synthetic oligonucleotide
atggggaggaccagacccacacacg

SEQ ID NO: 2135 - DNA, 24 bp, Artificial Sequence
  Description of Artificial Sequence: Synthetic oligonucleotide
tggggaggaccagacccacacacg

SEQ ID NO: 2136 - DNA, 23 bp, Artificial Sequence
  Description of Artificial Sequence: Synthetic oligonucleotide
ggggaggaccagacccacacacg

SEQ ID NO: 2137 - DNA, 24 bp, Artificial Sequence
  Description of Artificial Sequence: Synthetic oligonucleotide
gggaggaccagacccacacacgga

SEQ ID NO: 2138 - DNA, 24 bp, Artificial Sequence
  Description of Artificial Sequence: Synthetic oligonucleotide
ggaggaccagacccacacacggag

SEQ ID NO: 2139 - DNA, 25 bp, Artificial Sequence
  Description of Artificial Sequence: Synthetic oligonucleotide
gaggaccagacccacacacggagct

SEQ ID NO: 2140 - DNA, 25 bp, Artificial Sequence
  Description of Artificial Sequence: Synthetic oligonucleotide
aggaccagacccacacacggagctc

SEQ ID NO: 2141 - DNA, 24 bp, Artificial Sequence
  Description of Artificial Sequence: Synthetic oligonucleotide
ggaccagacccacacacggagctc

SEQ ID NO: 2142 - DNA, 25 bp, Artificial Sequence
  Description of Artificial Sequence: Synthetic oligonucleotide
gaccagacccacacacggagctcgt

SEQ ID NO: 2143 - DNA, 25 bp, Artificial Sequence
  Description of Artificial Sequence: Synthetic oligonucleotide
accagacccacacacggagctcgtg

SEQ ID NO: 2144 - DNA, 24 bp, Artificial Sequence
  Description of Artificial Sequence: Synthetic oligonucleotide
ccagacccacacacggagctcgtg

SEQ ID NO: 2145 - DNA, 25 bp, Artificial Sequence
  Description of Artificial Sequence: Synthetic oligonucleotide
cagacccacacacggagctcgtgga

SEQ ID NO: 2146 - DNA, 26 bp, Artificial Sequence
  Description of Artificial Sequence: Synthetic oligonucleotide
agacccacacacggagctcgtggaga

SEQ ID NO: 2147 - DNA, 25 bp, Artificial Sequence
  Description of Artificial Sequence: Synthetic oligonucleotide
gacccacacacggagctcgtggaga

SEQ ID NO: 2148 - DNA, 25 bp, Artificial Sequence
  Description of Artificial Sequence: Synthetic oligonucleotide
acccacacacggagctcgtggagac

SEQ ID NO: 2149 - DNA, 24 bp, Artificial Sequence
  Description of Artificial Sequence: Synthetic oligonucleotide
cccacacacggagctcgtggagac

SEQ ID NO: 2150 - DNA, 25 bp, Artificial Sequence
  Description of Artificial Sequence: Synthetic oligonucleotide
ccacacacggagctcgtggagacca

SEQ ID NO: 2151 - DNA, 25 bp, Artificial Sequence
  Description of Artificial Sequence: Synthetic oligonucleotide
cacacacggagctcgtggagaccag

SEQ ID NO: 2152 - DNA, 25 bp, Artificial Sequence
  Description of Artificial Sequence: Synthetic oligonucleotide
acacacggagctcgtggagaccagg

SEQ ID NO: 2153 - DNA, 24 bp, Artificial Sequence
  Description of Artificial Sequence: Synthetic oligonucleotide
cacacggagctcgtggagaccagg

SEQ ID NO: 2154 - DNA, 29 bp, Artificial Sequence
  Description of Artificial Sequence: Synthetic oligonucleotide
ggagtattgggaccaggagacacggaatg

SEQ ID NO: 2155 - DNA, 33 bp, Artificial Sequence
  Description of Artificial Sequence: Synthetic oligonucleotide
gctcccactccatgaagtatttcttcacatccg

SEQ ID NO: 2156 - DNA, 34 bp, Artificial Sequence
  Description of Artificial Sequence: Synthetic oligonucleotide
ctcccactccatgaagtatttcttcacatccgtg

SEQ ID NO: 2157 - DNA, 35 bp, Artificial Sequence
  Description of Artificial Sequence: Synthetic oligonucleotide
tcccactccatgaagtatttcttcacatccgtgtc

SEQ ID NO: 2158 - DNA, 34 bp, Artificial Sequence
  Description of Artificial Sequence: Synthetic oligonucleotide
cccactccatgaagtatttcttcacatccgtgtc

SEQ ID NO: 2159 - DNA, 34 bp, Artificial Sequence
  Description of Artificial Sequence: Synthetic oligonucleotide
ccactccatgaagtatttcttcacatccgtgtcc

SEQ ID NO: 2160 - DNA, 34 bp, Artificial Sequence
  Description of Artificial Sequence: Synthetic oligonucleotide
cactccatgaagtatttcttcacatccgtgtccc

SEQ ID NO: 2161 - DNA, 34 bp, Artificial Sequence
  Description of Artificial Sequence: Synthetic oligonucleotide
actccatgaagtatttcttcacatccgtgtcccg

SEQ ID NO: 2162 - DNA, 33 bp, Artificial Sequence
  Description of Artificial Sequence: Synthetic oligonucleotide
ctccatgaagtatttcttcacatccgtgtcccg

SEQ ID NO: 2163 - DNA, 33 bp, Artificial Sequence
  Description of Artificial Sequence: Synthetic oligonucleotide
tccatgaagtatttcttcacatccgtgtcccgg

SEQ ID NO: 2164 - DNA, 32 bp, Artificial Sequence
  Description of Artificial Sequence: Synthetic oligonucleotide
ccatgaagtatttcttcacatccgtgtcccgg

SEQ ID NO: 2165 - DNA, 32 bp, Artificial Sequence
  Description of Artificial Sequence: Synthetic oligonucleotide
catgaagtatttcttcacatccgtgtcccggc

SEQ ID NO: 2166 - DNA, 32 bp, Artificial Sequence
  Description of Artificial Sequence: Synthetic oligonucleotide
atgaagtatttcttcacatccgtgtcccggcc

SEQ ID NO: 2167 - DNA, 31 bp, Artificial Sequence
  Description of Artificial Sequence: Synthetic oligonucleotide
tgaagtatttcttcacatccgtgtcccggcc

SEQ ID NO: 2168 - DNA, 30 bp, Artificial Sequence
  Description of Artificial Sequence: Synthetic oligonucleotide
gaagtatttcttcacatccgtgtcccggcc

SEQ ID NO: 2169 - DNA, 30 bp, Artificial Sequence
  Description of Artificial Sequence: Synthetic oligonucleotide
aagtatttcttcacatccgtgtcccggccc

SEQ ID NO: 2170 - DNA, 29 bp, Artificial Sequence
  Description of Artificial Sequence: Synthetic oligonucleotide
agtatttcttcacatccgtgtcccggccc

SEQ ID NO: 2171 - DNA, 22 bp, Artificial Sequence
  Description of Artificial Sequence: Synthetic oligonucleotide
cggtccatgcggcggagcagca

SEQ ID NO: 2172 - DNA, 23 bp, Artificial Sequence
  Description of Artificial Sequence: Synthetic oligonucleotide
ggtccatgcggcggagcagcaga

SEQ ID NO: 2173 - DNA, 24 bp, Artificial Sequence
  Description of Artificial Sequence: Synthetic oligonucleotide
gtccatgcggcggagcagcagaga

SEQ ID NO: 2174 - DNA, 25 bp, Artificial Sequence
  Description of Artificial Sequence: Synthetic oligonucleotide
tccatgcggcggagcagcagagagt

SEQ ID NO: 2175 - DNA, 24 bp, Artificial Sequence
  Description of Artificial Sequence: Synthetic oligonucleotide
ccatgcggcggagcagcagagagt

SEQ ID NO: 2176 - DNA, 26 bp, Artificial Sequence
  Description of Artificial Sequence: Synthetic oligonucleotide
catgcggcggagcagcagagagtcta

SEQ ID NO: 2177 - DNA, 26 bp, Artificial Sequence
  Description of Artificial Sequence: Synthetic oligonucleotide
atgcggcggagcagcagagagtctac

SEQ ID NO: 2178 - DNA, 25 bp, Artificial Sequence
  Description of Artificial Sequence: Synthetic oligonucleotide
tgcggcggagcagcagagagtctac

SEQ ID NO: 2179 - DNA, 24 bp, Artificial Sequence
  Description of Artificial Sequence: Synthetic oligonucleotide
gcggcggagcagcagagagtctac

SEQ ID NO: 2180 - DNA, 25 bp, Artificial Sequence
  Description of Artificial Sequence: Synthetic oligonucleotide
cggcggagcagcagagagtctacct

SEQ ID NO: 2181 - DNA, 25 bp, Artificial Sequence
  Description of Artificial Sequence: Synthetic oligonucleotide
ggcggagcagcagagagtctacctg

SEQ ID NO: 2182 - DNA, 26 bp, Artificial Sequence
  Description of Artificial Sequence: Synthetic oligonucleotide
gcggagcagcagagagtctacctgga

SEQ ID NO: 2183 - DNA, 26 bp, Artificial Sequence
  Description of Artificial Sequence: Synthetic oligonucleotide
cggagcagcagagagtctacctggag

SEQ ID NO: 2184 - DNA, 26 bp, Artificial Sequence
  Description of Artificial Sequence: Synthetic oligonucleotide
ggagcagcagagagtctacctggagg

SEQ ID NO: 2185 - DNA, 26 bp, Artificial Sequence
  Description of Artificial Sequence: Synthetic oligonucleotide
gagcagcagagagtctacctggaggg

SEQ ID NO: 2186 - DNA, 26 bp, Artificial Sequence
  Description of Artificial Sequence: Synthetic oligonucleotide
agcagcagagagtctacctggagggc

SEQ ID NO: 2187 - DNA, 25 bp, Artificial Sequence
  Description of Artificial Sequence: Synthetic oligonucleotide
gcagcagagagtctacctggagggc

SEQ ID NO: 2188 - DNA, 25 bp, Artificial Sequence
  Description of Artificial Sequence: Synthetic oligonucleotide
cagcagagagtctacctggagggcc

SEQ ID NO: 2189 - DNA, 25 bp, Artificial Sequence
  Description of Artificial Sequence: Synthetic oligonucleotide
agcagagagtctacctggagggccg

SEQ ID NO: 2190 - DNA, 24 bp, Artificial Sequence
  Description of Artificial Sequence: Synthetic oligonucleotide
gcagagagtctacctggagggccg

SEQ ID NO: 2191 - DNA, 25 bp, Artificial Sequence
  Description of Artificial Sequence: Synthetic oligonucleotide
cagagagtctacctggagggccggt

SEQ ID NO: 2192 - DNA, 25 bp, Artificial Sequence
  Description of Artificial Sequence: Synthetic oligonucleotide
agagagtctacctggagggccggtg

SEQ ID NO: 2193 - DNA, 22 bp, Artificial Sequence
  Description of Artificial Sequence: Synthetic oligonucleotide
cgcaagtgggaggcggcccatg

SEQ ID NO: 2194 - DNA, 22 bp, Artificial Sequence
  Description of Artificial Sequence: Synthetic oligonucleotide
gcaagtgggaggcggcccatgc

SEQ ID NO: 2195 - DNA, 22 bp, Artificial Sequence
  Description of Artificial Sequence: Synthetic oligonucleotide
caagtgggaggcggcccatgcg

SEQ ID NO: 2196 - DNA, 22 bp, Artificial Sequence
  Description of Artificial Sequence: Synthetic oligonucleotide
aagtgggaggcggcccatgcgg

SEQ ID NO: 2197 - DNA, 21 bp, Artificial Sequence
  Description of Artificial Sequence: Synthetic oligonucleotide
agtgggaggcggcccatgcgg

SEQ ID NO: 2198 - DNA, 20 bp, Artificial Sequence
  Description of Artificial Sequence: Synthetic oligonucleotide
gtgggaggcggcccatgcgg

SEQ ID NO: 2199 - DNA, 20 bp, Artificial Sequence
  Description of Artificial Sequence: Synthetic oligonucleotide
tgggaggcggcccatgcggc

SEQ ID NO: 2200 - DNA, 20 bp, Artificial Sequence
  Description of Artificial Sequence: Synthetic oligonucleotide
gggaggcggcccatgcggct

SEQ ID NO: 2201 - DNA, 20 bp, Artificial Sequence
  Description of Artificial Sequence: Synthetic oligonucleotide
ggaggcggcccatgcggcgt

SEQ ID NO: 2202 - DNA, 20 bp, Artificial Sequence
  Description of Artificial Sequence: Synthetic oligonucleotide
gaggcggcccatgcggcgga

SEQ ID NO: 2203 - DNA, 20 bp, Artificial Sequence
  Description of Artificial Sequence: Synthetic oligonucleotide
aggcggcccatgcggcggag

SEQ ID NO: 2204 - DNA, 20 bp, Artificial Sequence
  Description of Artificial Sequence: Synthetic oligonucleotide
ggcggcccatgcggcggagt

SEQ ID NO: 2205 - DNA, 20 bp, Artificial Sequence
  Description of Artificial Sequence: Synthetic oligonucleotide
gcggcccatgcggcggagca

SEQ ID NO: 2206 - DNA, 20 bp, Artificial Sequence
  Description of Artificial Sequence: Synthetic oligonucleotide
cggcccatgcggcggagcag

SEQ ID NO: 2207 - DNA, 20 bp, Artificial Sequence
  Description of Artificial Sequence: Synthetic oligonucleotide
ggcccatgcggcggagcagc

SEQ ID NO: 2208 - DNA, 20 bp, Artificial Sequence
  Description of Artificial Sequence: Synthetic oligonucleotide
gcccatgcggcggagcagcg

SEQ ID NO: 2209 - DNA, 21 bp, Artificial Sequence
  Description of Artificial Sequence: Synthetic oligonucleotide
cccatgcggcggagcagcgga

SEQ ID NO: 2210 - DNA, 26 bp, Artificial Sequence
  Description of Artificial Sequence: Synthetic oligonucleotide
gcggagcagcggagagtctacctgta

SEQ ID NO: 2211 - DNA, 26 bp, Artificial Sequence
  Description of Artificial Sequence: Synthetic oligonucleotide
cggagcagcggagagtctacctgtag

SEQ ID NO: 2212 - DNA, 26 bp, Artificial Sequence
  Description of Artificial Sequence: Synthetic oligonucleotide
ggagcagcggagagtctacctgtagg

SEQ ID NO: 2213 - DNA, 26 bp, Artificial Sequence
  Description of Artificial Sequence: Synthetic oligonucleotide
gagcagcggagagtctacctgtaggg

SEQ ID NO: 2214 - DNA, 26 bp, Artificial Sequence
  Description of Artificial Sequence: Synthetic oligonucleotide
agcagcggagagtctacctgtagggc

SEQ ID NO: 2215 - DNA, 25 bp, Artificial Sequence
  Description of Artificial Sequence: Synthetic oligonucleotide
gcagcggagagtctacctgtagggc

SEQ ID NO: 2216 - DNA, 25 bp, Artificial Sequence
  Description of Artificial Sequence: Synthetic oligonucleotide
cagcggagagtctacctgtagggcc

SEQ ID NO: 2217 - DNA, 25 bp, Artificial Sequence
  Description of Artificial Sequence: Synthetic oligonucleotide
agcggagagtctacctgtagggccg

SEQ ID NO: 2218 - DNA, 24 bp, Artificial Sequence
  Description of Artificial Sequence: Synthetic oligonucleotide
gcggagagtctacctgtagggccg

SEQ ID NO: 2219 - DNA, 25 bp, Artificial Sequence
  Description of Artificial Sequence: Synthetic oligonucleotide
cggagagtctacctgtagggccggt

SEQ ID NO: 2220 - DNA, 25 bp, Artificial Sequence
  Description of Artificial Sequence: Synthetic oligonucleotide
ggagagtctacctgtagggccggtg

SEQ ID NO: 2221 - DNA, 25 bp, Artificial Sequence
  Description of Artificial Sequence: Synthetic oligonucleotide
gagagtctacctgtagggccggtgc

SEQ ID NO: 2222 - DNA, 26 bp, Artificial Sequence
  Description of Artificial Sequence: Synthetic oligonucleotide
agagtctacctgtagggccggtgcgt

SEQ ID NO: 2223 - DNA, 25 bp, Artificial Sequence
  Description of Artificial Sequence: Synthetic oligonucleotide
gagtctacctgtagggccggtgcgt

SEQ ID NO: 2224 - DNA, 25 bp, Artificial Sequence
  Description of Artificial Sequence: Synthetic oligonucleotide
agtctacctgtagggccggtgcgtg

SEQ ID NO: 2225 - DNA, 24 bp, Artificial Sequence
  Description of Artificial Sequence: Synthetic oligonucleotide
gtctacctgtagggccggtgcgtg

SEQ ID NO: 2226 - DNA, 25 bp, Artificial Sequence
  Description of Artificial Sequence: Synthetic oligonucleotide
tctacctgtagggccggtgcgtgga

SEQ ID NO: 2227 - DNA, 24 bp, Artificial Sequence
  Description of Artificial Sequence: Synthetic oligonucleotide
ctacctgtagggccggtgcgtgga

SEQ ID NO: 2228 - DNA, 24 bp, Artificial Sequence
  Description of Artificial Sequence: Synthetic oligonucleotide
tacctgtagggccggtgcgtggac

SEQ ID NO: 2229 - DNA, 23 bp, Artificial Sequence
  Description of Artificial Sequence: Synthetic oligonucleotide
acctgtagggccggtgcgtggac

SEQ ID NO: 2230 - DNA, 22 bp, Artificial Sequence
  Description of Artificial Sequence: Synthetic oligonucleotide
cctgtagggccggtgcgtggac

SEQ ID NO: 2231 - DNA, 22 bp, Artificial Sequence
  Description of Artificial Sequence: Synthetic oligonucleotide
ctgtagggccggtgcgtggacg

SEQ ID NO: 2232 - DNA, 22 bp, Artificial Sequence
  Description of Artificial Sequence: Synthetic oligonucleotide
tgtagggccggtgcgtggacgg

SEQ ID NO: 2233 - DNA, 21 bp, Artificial Sequence
  Description of Artificial Sequence: Synthetic oligonucleotide
gtagggccggtgcgtggacgg

SEQ ID NO: 2234 - DNA, 21 bp, Artificial Sequence
  Description of Artificial Sequence: Synthetic oligonucleotide
tagggccggtgcgtggacggg

SEQ ID NO: 2235 - DNA, 27 bp, Artificial Sequence
  Description of Artificial Sequence: Synthetic oligonucleotide
gaaggcccactcacagactgaccgagt

SEQ ID NO: 2236 - DNA, 27 bp, Artificial Sequence
  Description of Artificial Sequence: Synthetic oligonucleotide
aaggcccactcacagactgaccgagtg

SEQ ID NO: 2237 - DNA, 26 bp, Artificial Sequence
  Description of Artificial Sequence: Synthetic oligonucleotide
aggcccactcacagactgaccgagtg

SEQ ID NO: 2238 - DNA, 25 bp, Artificial Sequence
  Description of Artificial Sequence: Synthetic oligonucleotide
ggcccactcacagactgaccgagtg

SEQ ID NO: 2239 - DNA, 26 bp, Artificial Sequence
  Description of Artificial Sequence: Synthetic oligonucleotide
gcccactcacagactgaccgagtgga

SEQ ID NO: 2240 - DNA, 26 bp, Artificial Sequence
  Description of Artificial Sequence: Synthetic oligonucleotide
cccactcacagactgaccgagtggac

SEQ ID NO: 2241 - DNA, 27 bp, Artificial Sequence
  Description of Artificial Sequence: Synthetic oligonucleotide
ccactcacagactgaccgagtggacct

SEQ ID NO: 2242 - DNA, 27 bp, Artificial Sequence
  Description of Artificial Sequence: Synthetic oligonucleotide
cactcacagactgaccgagtggacctg

SEQ ID NO: 2243 - DNA, 27 bp, Artificial Sequence
  Description of Artificial Sequence: Synthetic oligonucleotide
actcacagactgaccgagtggacctgg

SEQ ID NO: 2244 - DNA, 26 bp, Artificial Sequence
  Description of Artificial Sequence: Synthetic oligonucleotide
ctcacagactgaccgagtggacctgg

SEQ ID NO: 2245 - DNA, 32 bp, Artificial Sequence
  Description of Artificial Sequence: Synthetic oligonucleotide
tccatgaggtatttcttcacatccgtgtcccc

SEQ ID NO: 2246 - DNA, 31 bp, Artificial Sequence
  Description of Artificial Sequence: Synthetic oligonucleotide
ccatgaggtatttcttcacatccgtgtcccc

SEQ ID NO: 2247 - DNA, 31 bp, Artificial Sequence
  Description of Artificial Sequence: Synthetic oligonucleotide
catgaggtatttcttcacatccgtgtccccg

SEQ ID NO: 2248 - DNA, 31 bp, Artificial Sequence
  Description of Artificial Sequence: Synthetic oligonucleotide
atgaggtatttcttcacatccgtgtccccgc

SEQ ID NO: 2249 - DNA, 30 bp, Artificial Sequence
  Description of Artificial Sequence: Synthetic oligonucleotide
tgaggtatttcttcacatccgtgtccccgc

SEQ ID NO: 2250 - DNA, 29 bp, Artificial Sequence
  Description of Artificial Sequence: Synthetic oligonucleotide
gaggtatttcttcacatccgtgtccccgc

SEQ ID NO: 2251 - DNA, 29 bp, Artificial Sequence
  Description of Artificial Sequence: Synthetic oligonucleotide
aggtatttcttcacatccgtgtccccgcc

SEQ ID NO: 2252 - DNA, 28 bp, Artificial Sequence
  Description of Artificial Sequence: Synthetic oligonucleotide
ggtatttcttcacatccgtgtccccgcc

SEQ ID NO: 2253 - DNA, 28 bp, Artificial Sequence
  Description of Artificial Sequence: Synthetic oligonucleotide
gtatttcttcacatccgtgtccccgccc

SEQ ID NO: 2254 - DNA, 28 bp, Artificial Sequence
  Description of Artificial Sequence: Synthetic oligonucleotide
tatttcttcacatccgtgtccccgcccg

SEQ ID NO: 2255 - DNA, 27 bp, Artificial Sequence
  Description of Artificial Sequence: Synthetic oligonucleotide
atttcttcacatccgtgtccccgcccg

SEQ ID NO: 2256 - DNA, 26 bp, Artificial Sequence
  Description of Artificial Sequence: Synthetic oligonucleotide
tttcttcacatccgtgtccccgcccg

SEQ ID NO: 2257 - DNA, 25 bp, Artificial Sequence
  Description of Artificial Sequence: Synthetic oligonucleotide
ttcttcacatccgtgtccccgcccg

SEQ ID NO: 2258 - DNA, 24 bp, Artificial Sequence
  Description of Artificial Sequence: Synthetic oligonucleotide
tcttcacatccgtgtccccgcccg

SEQ ID NO: 2259 - DNA, 23 bp, Artificial Sequence
  Description of Artificial Sequence: Synthetic oligonucleotide
cttcacatccgtgtccccgcccg

SEQ ID NO: 2260 - DNA, 23 bp, Artificial Sequence
  Description of Artificial Sequence: Synthetic oligonucleotide
ttcacatccgtgtccccgcccgg

SEQ ID NO: 2261 - DNA, 22 bp, Artificial Sequence
  Description of Artificial Sequence: Synthetic oligonucleotide
tcacatccgtgtccccgcccgg

SEQ ID NO: 2262 - DNA, 21 bp, Artificial Sequence
  Description of Artificial Sequence: Synthetic oligonucleotide
cacatccgtgtccccgcccgg

SEQ ID NO: 2263 - DNA, 21 bp, Artificial Sequence
  Description of Artificial Sequence: Synthetic oligonucleotide
acatccgtgtccccgcccggc

SEQ ID NO: 2264 - DNA, 20 bp, Artificial Sequence
  Description of Artificial Sequence: Synthetic oligonucleotide
catccgtgtccccgcccggc

SEQ ID NO: 2265 - DNA, 20 bp, Artificial Sequence
  Description of Artificial Sequence: Synthetic oligonucleotide
atccgtgtccccgcccggcc

SEQ ID NO: 2266 - DNA, 20 bp, Artificial Sequence
  Description of Artificial Sequence: Synthetic oligonucleotide
tccgtgtccccgcccggcct

SEQ ID NO: 2267 - DNA, 20 bp, Artificial Sequence
  Description of Artificial Sequence: Synthetic oligonucleotide
ccgtgtccccgcccggcctt

SEQ ID NO: 2268 - DNA, 20 bp, Artificial Sequence
  Description of Artificial Sequence: Synthetic oligonucleotide
cgtgtccccgcccggccgtt

SEQ ID NO: 2269 - DNA, 20 bp, Artificial Sequence
  Description of Artificial Sequence: Synthetic oligonucleotide
gtgtccccgcccggccgctt

SEQ ID NO: 2270 - DNA, 20 bp, Artificial Sequence
  Description of Artificial Sequence: Synthetic oligonucleotide
tgtccccgcccggccgcgtt

SEQ ID NO: 2271 - DNA, 20 bp, Artificial Sequence
  Description of Artificial Sequence: Synthetic oligonucleotide
gtccccgcccggccgcgttt

SEQ ID NO: 2272 - DNA, 20 bp, Artificial Sequence
  Description of Artificial Sequence: Synthetic oligonucleotide
tccccgcccggccgcggttt

SEQ ID NO: 2273 - DNA, 20 bp, Artificial Sequence
  Description of Artificial Sequence: Synthetic oligonucleotide
ccccgcccggccgcggtttt

SEQ ID NO: 2274 - DNA, 20 bp, Artificial Sequence
  Description of Artificial Sequence: Synthetic oligonucleotide
cccgcccggccgcgggtttt

SEQ ID NO: 2275 - DNA, 20 bp, Artificial Sequence
  Description of Artificial Sequence: Synthetic oligonucleotide
ccgcccggccgcggggattt

SEQ ID NO: 2276 - DNA, 20 bp, Artificial Sequence
  Description of Artificial Sequence: Synthetic oligonucleotide
cgcccggccgcggggagttt

SEQ ID NO: 2277 - DNA, 22 bp, Artificial Sequence
  Description of Artificial Sequence: Synthetic oligonucleotide
ggcgcttcctccgcgggtacca

SEQ ID NO: 2278 - DNA, 22 bp, Artificial Sequence
  Description of Artificial Sequence: Synthetic oligonucleotide
gcgcttcctccgcgggtaccac

SEQ ID NO: 2279 - DNA, 23 bp, Artificial Sequence
  Description of Artificial Sequence: Synthetic oligonucleotide
cgcttcctccgcgggtaccacca

SEQ ID NO: 2280 - DNA, 25 bp, Artificial Sequence
  Description of Artificial Sequence: Synthetic oligonucleotide
gcttcctccgcgggtaccaccagta

SEQ ID NO: 2281 - DNA, 25 bp, Artificial Sequence
  Description of Artificial Sequence: Synthetic oligonucleotide
cttcctccgcgggtaccaccagtac

SEQ ID NO: 2282 - DNA, 25 bp, Artificial Sequence
  Description of Artificial Sequence: Synthetic oligonucleotide
ttcctccgcgggtaccaccagtacg

SEQ ID NO: 2283 - DNA, 24 bp, Artificial Sequence
  Description of Artificial Sequence: Synthetic oligonucleotide
tcctccgcgggtaccaccagtacg

SEQ ID NO: 2284 - DNA, 23 bp, Artificial Sequence
  Description of Artificial Sequence: Synthetic oligonucleotide
cctccgcgggtaccaccagtacg

SEQ ID NO: 2285 - DNA, 23 bp, Artificial Sequence
  Description of Artificial Sequence: Synthetic oligonucleotide
ctccgcgggtaccaccagtacgc

SEQ ID NO: 2286 - DNA, 25 bp, Artificial Sequence
  Description of Artificial Sequence: Synthetic oligonucleotide
tccgcgggtaccaccagtacgccta

SEQ ID NO: 2287 - DNA, 24 bp, Artificial Sequence
  Description of Artificial Sequence: Synthetic oligonucleotide
ccgcgggtaccaccagtacgccta

SEQ ID NO: 2288 - DNA, 24 bp, Artificial Sequence
  Description of Artificial Sequence: Synthetic oligonucleotide
cgcgggtaccaccagtacgcctac

SEQ ID NO: 2289 - DNA, 25 bp, Artificial Sequence
  Description of Artificial Sequence: Synthetic oligonucleotide
gcgggtaccaccagtacgcctacga

SEQ ID NO: 2290 - DNA, 25 bp, Artificial Sequence
  Description of Artificial Sequence: Synthetic oligonucleotide
cgggtaccaccagtacgcctacgac

SEQ ID NO: 2291 - DNA, 25 bp, Artificial Sequence
  Description of Artificial Sequence: Synthetic oligonucleotide
gggtaccaccagtacgcctacgacg

SEQ ID NO: 2292 - DNA, 25 bp, Artificial Sequence
  Description of Artificial Sequence: Synthetic oligonucleotide
ggtaccaccagtacgcctacgacgg

SEQ ID NO: 2293 - DNA, 27 bp, Artificial Sequence
  Description of Artificial Sequence: Synthetic oligonucleotide
gtaccaccagtacgcctacgacggcaa

SEQ ID NO: 2294 - DNA, 27 bp, Artificial Sequence
  Description of Artificial Sequence: Synthetic oligonucleotide
taccaccagtacgcctacgacggcaag

SEQ ID NO: 2295 - DNA, 26 bp, Artificial Sequence
  Description of Artificial Sequence: Synthetic oligonucleotide
accaccagtacgcctacgacggcaag

SEQ ID NO: 2296 - DNA, 25 bp, Artificial Sequence
  Description of Artificial Sequence: Synthetic oligonucleotide
ccaccagtacgcctacgacggcaag

SEQ ID NO: 2297 - DNA, 27 bp, Artificial Sequence
  Description of Artificial Sequence: Synthetic oligonucleotide
caccagtacgcctacgacggcaaggat

SEQ ID NO: 2298 - DNA, 29 bp, Artificial Sequence
  Description of Artificial Sequence: Synthetic oligonucleotide
accagtacgcctacgacggcaaggattac

SEQ ID NO: 2299 - DNA, 28 bp, Artificial Sequence
  Description of Artificial Sequence: Synthetic oligonucleotide
ccagtacgcctacgacggcaaggattac

SEQ ID NO: 2300 - DNA, 30 bp, Artificial Sequence
  Description of Artificial Sequence: Synthetic oligonucleotide
cagtacgcctacgacggcaaggattacatc

SEQ ID NO: 2301 - DNA, 30 bp, Artificial Sequence
  Description of Artificial Sequence: Synthetic oligonucleotide
agtacgcctacgacggcaaggattacatcg

SEQ ID NO: 2302 - DNA, 29 bp, Artificial Sequence
  Description of Artificial Sequence: Synthetic oligonucleotide
gtacgcctacgacggcaaggattacatcg

SEQ ID NO: 2303 - DNA, 29 bp, Artificial Sequence
  Description of Artificial Sequence: Synthetic oligonucleotide
tacgcctacgacggcaaggattacatcgc

SEQ ID NO: 2304 - DNA, 28 bp, Artificial Sequence
  Description of Artificial Sequence: Synthetic oligonucleotide
gatagagcaggaggggccggagtattag

SEQ ID NO: 2305 - DNA, 28 bp, Artificial Sequence
  Description of Artificial Sequence: Synthetic oligonucleotide
atagagcaggaggggccggagtattagg

SEQ ID NO: 2306 - DNA, 27 bp, Artificial Sequence
  Description of Artificial Sequence: Synthetic oligonucleotide
tagagcaggaggggccggagtattagg

SEQ ID NO: 2307 - DNA, 27 bp, Artificial Sequence
  Description of Artificial Sequence: Synthetic oligonucleotide
agagcaggaggggccggagtattagga

SEQ ID NO: 2308 - DNA, 26 bp, Artificial Sequence
  Description of Artificial Sequence: Synthetic oligonucleotide
gagcaggaggggccggagtattagga

SEQ ID NO: 2309 - DNA, 26 bp, Artificial Sequence
  Description of Artificial Sequence: Synthetic oligonucleotide
agcaggaggggccggagtattaggac

SEQ ID NO: 2310 - DNA, 25 bp, Artificial Sequence
  Description of Artificial Sequence: Synthetic oligonucleotide
gcaggaggggccggagtattaggac

SEQ ID NO: 2311 - DNA, 26 bp, Artificial Sequence
  Description of Artificial Sequence: Synthetic oligonucleotide
caggaggggccggagtattaggacca

SEQ ID NO: 2312 - DNA, 26 bp, Artificial Sequence
  Description of Artificial Sequence: Synthetic oligonucleotide
aggaggggccggagtattaggaccag

SEQ ID NO: 2313 - DNA, 25 bp, Artificial Sequence
  Description of Artificial Sequence: Synthetic oligonucleotide
ggaggggccggagtattaggaccag

SEQ ID NO: 2314 - DNA, 26 bp, Artificial Sequence
  Description of Artificial Sequence: Synthetic oligonucleotide
gaggggccggagtattaggaccagga

SEQ ID NO: 2315 - DNA, 27 bp, Artificial Sequence
  Description of Artificial Sequence: Synthetic oligonucleotide
aggggccggagtattaggaccaggaga

SEQ ID NO: 2316 - DNA, 26 bp, Artificial Sequence
  Description of Artificial Sequence: Synthetic oligonucleotide
ggggccggagtattaggaccaggaga

SEQ ID NO: 2317 - DNA, 27 bp, Artificial Sequence
  Description of Artificial Sequence: Synthetic oligonucleotide
gggccggagtattaggaccaggagaca

SEQ ID NO: 2318 - DNA, 27 bp, Artificial Sequence
  Description of Artificial Sequence: Synthetic oligonucleotide
ggccggagtattaggaccaggagacac

SEQ ID NO: 2319 - DNA, 27 bp, Artificial Sequence
  Description of Artificial Sequence: Synthetic oligonucleotide
gccggagtattaggaccaggagacacg

SEQ ID NO: 2320 - DNA, 27 bp, Artificial Sequence
  Description of Artificial Sequence: Synthetic oligonucleotide
ccggagtattaggaccaggagacacgg

SEQ ID NO: 2321 - DNA, 32 bp, Artificial Sequence
  Description of Artificial Sequence: Synthetic oligonucleotide
cggagtattaggaccaggagacacggaatatg

SEQ ID NO: 2322 - DNA, 34 bp, Artificial Sequence
  Description of Artificial Sequence: Synthetic oligonucleotide
ggagtattaggaccaggagacacggaatatgaag

SEQ ID NO: 2323 - DNA, 34 bp, Artificial Sequence
  Description of Artificial Sequence: Synthetic oligonucleotide
gagtattaggaccaggagacacggaatatgaagg

SEQ ID NO: 2324 - DNA, 34 bp, Artificial Sequence
  Description of Artificial Sequence: Synthetic oligonucleotide
agtattaggaccaggagacacggaatatgaaggc

SEQ ID NO: 2325 - DNA, 33 bp, Artificial Sequence
  Description of Artificial Sequence: Synthetic oligonucleotide
gtattaggaccaggagacacggaatatgaaggc

SEQ ID NO: 2326 - DNA, 33 bp, Artificial Sequence
  Description of Artificial Sequence: Synthetic oligonucleotide
tattaggaccaggagacacggaatatgaaggcc

SEQ ID NO: 2327 - DNA, 32 bp, Artificial Sequence
  Description of Artificial Sequence: Synthetic oligonucleotide
attaggaccaggagacacggaatatgaaggcc

SEQ ID NO: 2328 - DNA, 31 bp, Artificial Sequence
  Description of Artificial Sequence: Synthetic oligonucleotide
ttaggaccaggagacacggaatatgaaggcc

SEQ ID NO: 2329 - DNA, 30 bp, Artificial Sequence
  Description of Artificial Sequence: Synthetic oligonucleotide
taggaccaggagacacggaatatgaaggcc

SEQ ID NO: 2330 - DNA, 29 bp, Artificial Sequence
  Description of Artificial Sequence: Synthetic oligonucleotide
aggaccaggagacacggaatatgaaggcc

SEQ ID NO: 2331 - DNA, 25 bp, Artificial Sequence
  Description of Artificial Sequence: Synthetic oligonucleotide
aaggagacgctgcagcgcacggaca

SEQ ID NO: 2332 - DNA, 24 bp, Artificial Sequence
  Description of Artificial Sequence: Synthetic oligonucleotide
aggagacgctgcagcgcacggaca

SEQ ID NO: 2333 - DNA, 23 bp, Artificial Sequence
  Description of Artificial Sequence: Synthetic oligonucleotide
ggagacgctgcagcgcacggaca

SEQ ID NO: 2334 - DNA, 23 bp, Artificial Sequence
  Description of Artificial Sequence: Synthetic oligonucleotide
gagacgctgcagcgcacggacac

SEQ ID NO: 2335 - DNA, 23 bp, Artificial Sequence
  Description of Artificial Sequence: Synthetic oligonucleotide
agacgctgcagcgcacggacacc

SEQ ID NO: 2336 - DNA, 22 bp, Artificial Sequence
  Description of Artificial Sequence: Synthetic oligonucleotide
gacgctgcagcgcacggacacc

SEQ ID NO: 2337 - DNA, 22 bp, Artificial Sequence
  Description of Artificial Sequence: Synthetic oligonucleotide
acgctgcagcgcacggacaccc

SEQ ID NO: 2338 - DNA, 21 bp, Artificial Sequence
  Description of Artificial Sequence: Synthetic oligonucleotide
cgctgcagcgcacggacaccc

SEQ ID NO: 2339 - DNA, 21 bp, Artificial Sequence
  Description of Artificial Sequence: Synthetic oligonucleotide
gctgcagcgcacggacacccc

SEQ ID NO: 2340 - DNA, 23 bp, Artificial Sequence
  Description of Artificial Sequence: Synthetic oligonucleotide
ctgcagcgcacggacacccccaa

SEQ ID NO: 2341 - DNA, 24 bp, Artificial Sequence
  Description of Artificial Sequence: Synthetic oligonucleotide
tgcagcgcacggacacccccaaga

SEQ ID NO: 2342 - DNA, 23 bp, Artificial Sequence
  Description of Artificial Sequence: Synthetic oligonucleotide
gcagcgcacggacacccccaaga

SEQ ID NO: 2343 - DNA, 24 bp, Artificial Sequence
  Description of Artificial Sequence: Synthetic oligonucleotide
cagcgcacggacacccccaagaca

SEQ ID NO: 2344 - DNA, 27 bp, Artificial Sequence
  Description of Artificial Sequence: Synthetic oligonucleotide
agcgcacggacacccccaagacacata

SEQ ID NO: 2345 - DNA, 27 bp, Artificial Sequence
  Description of Artificial Sequence: Synthetic oligonucleotide
gcgcacggacacccccaagacacatat

SEQ ID NO: 2346 - DNA, 27 bp, Artificial Sequence
  Description of Artificial Sequence: Synthetic oligonucleotide
cgcacggacacccccaagacacatatg

SEQ ID NO: 2347 - DNA, 28 bp, Artificial Sequence
  Description of Artificial Sequence: Synthetic oligonucleotide
gcacggacacccccaagacacatatgac

SEQ ID NO: 2348 - DNA, 28 bp, Artificial Sequence
  Description of Artificial Sequence: Synthetic oligonucleotide
cacggacacccccaagacacatatgacc

SEQ ID NO: 2349 - DNA, 28 bp, Artificial Sequence
  Description of Artificial Sequence: Synthetic oligonucleotide
acggacacccccaagacacatatgaccc

SEQ ID NO: 2350 - DNA, 27 bp, Artificial Sequence
  Description of Artificial Sequence: Synthetic oligonucleotide
cggacacccccaagacacatatgaccc

SEQ ID NO: 2351 - DNA, 28 bp, Artificial Sequence
  Description of Artificial Sequence: Synthetic oligonucleotide
ggacacccccaagacacatatgacccac

SEQ ID NO: 2352 - DNA, 28 bp, Artificial Sequence
  Description of Artificial Sequence: Synthetic oligonucleotide
gacacccccaagacacatatgacccacc

SEQ ID NO: 2353 - DNA, 29 bp, Artificial Sequence
  Description of Artificial Sequence: Synthetic oligonucleotide
acacccccaagacacatatgacccaccac

SEQ ID NO: 2354 - DNA, 28 bp, Artificial Sequence
  Description of Artificial Sequence: Synthetic oligonucleotide
cacccccaagacacatatgacccaccac

SEQ ID NO: 2355 - DNA, 28 bp, Artificial Sequence
  Description of Artificial Sequence: Synthetic oligonucleotide
acccccaagacacatatgacccaccacc

SEQ ID NO: 2356 - DNA, 24 bp, Artificial Sequence
  Description of Artificial Sequence: Synthetic oligonucleotide
gagccagaagatggagccgcggga

SEQ ID NO: 2357 - DNA, 24 bp, Artificial Sequence
  Description of Artificial Sequence: Synthetic oligonucleotide
agccagaagatggagccgcgggag

SEQ ID NO: 2358 - DNA, 23 bp, Artificial Sequence
  Description of Artificial Sequence: Synthetic oligonucleotide
gccagaagatggagccgcgggag

SEQ ID NO: 2359 - DNA, 23 bp, Artificial Sequence
  Description of Artificial Sequence: Synthetic oligonucleotide
ccagaagatggagccgcgggagc

SEQ ID NO: 2360 - DNA, 23 bp, Artificial Sequence
  Description of Artificial Sequence: Synthetic oligonucleotide
cagaagatggagccgcgggagcc

SEQ ID NO: 2361 - DNA, 24 bp, Artificial Sequence
  Description of Artificial Sequence: Synthetic oligonucleotide
agaagatggagccgcgggagccgt

SEQ ID NO: 2362 - DNA, 23 bp, Artificial Sequence
  Description of Artificial Sequence: Synthetic oligonucleotide
gaagatggagccgcgggagccgt

SEQ ID NO: 2363 - DNA, 23 bp, Artificial Sequence
  Description of Artificial Sequence: Synthetic oligonucleotide
aagatggagccgcgggagccgtg

SEQ ID NO: 2364 - DNA, 22 bp, Artificial Sequence
  Description of Artificial Sequence: Synthetic oligonucleotide
agatggagccgcgggagccgtg

SEQ ID NO: 2365 - DNA, 21 bp, Artificial Sequence
  Description of Artificial Sequence: Synthetic oligonucleotide
gatggagccgcgggagccgtg

SEQ ID NO: 2366 - DNA, 24 bp, Artificial Sequence
  Description of Artificial Sequence: Synthetic oligonucleotide
atggagccgcgggagccgtggata

SEQ ID NO: 2367 - DNA, 23 bp, Artificial Sequence
  Description of Artificial Sequence: Synthetic oligonucleotide
tggagccgcgggagccgtggata

SEQ ID NO: 2368 - DNA, 22 bp, Artificial Sequence
  Description of Artificial Sequence: Synthetic oligonucleotide
ggagccgcgggagccgtggata

SEQ ID NO: 2369 - DNA, 23 bp, Artificial Sequence
  Description of Artificial Sequence: Synthetic oligonucleotide
gagccgcgggagccgtggataga

SEQ ID NO: 2370 - DNA, 23 bp, Artificial Sequence
  Description of Artificial Sequence: Synthetic oligonucleotide
agccgcgggagccgtggatagag

SEQ ID NO: 2371 - DNA, 22 bp, Artificial Sequence
  Description of Artificial Sequence: Synthetic oligonucleotide
gccgcgggagccgtggatagag

SEQ ID NO: 2372 - DNA, 23 bp, Artificial Sequence
  Description of Artificial Sequence: Synthetic oligonucleotide
ccgcgggagccgtggatagagca

SEQ ID NO: 2373 - DNA, 23 bp, Artificial Sequence
  Description of Artificial Sequence: Synthetic oligonucleotide
cgcgggagccgtggatagagcag

SEQ ID NO: 2374 - DNA, 24 bp, Artificial Sequence
  Description of Artificial Sequence: Synthetic oligonucleotide
gcgggagccgtggatagagcagga

SEQ ID NO: 2375 - DNA, 24 bp, Artificial Sequence
  Description of Artificial Sequence: Synthetic oligonucleotide
cgggagccgtggatagagcaggag

SEQ ID NO: 2376 - DNA, 24 bp, Artificial Sequence
  Description of Artificial Sequence: Synthetic oligonucleotide
gggagccgtggatagagcaggagg

SEQ ID NO: 2377 - DNA, 24 bp, Artificial Sequence
  Description of Artificial Sequence: Synthetic oligonucleotide
ggagccgtggatagagcaggaggg

SEQ ID NO: 2378 - DNA, 24 bp, Artificial Sequence
  Description of Artificial Sequence: Synthetic oligonucleotide
gagccgtggatagagcaggagggg

SEQ ID NO: 2379 - DNA, 24 bp, Artificial Sequence
  Description of Artificial Sequence: Synthetic oligonucleotide
agccgtggatagagcaggaggggc

SEQ ID NO: 2380 - DNA, 26 bp, Artificial Sequence
  Description of Artificial Sequence: Synthetic oligonucleotide
aaggagacgctgcagcgcacggagat

SEQ ID NO: 2381 - DNA, 25 bp, Artificial Sequence
  Description of Artificial Sequence: Synthetic oligonucleotide
aggagacgctgcagcgcacggagat

SEQ ID NO: 2382 - DNA, 24 bp, Artificial Sequence
  Description of Artificial Sequence: Synthetic oligonucleotide
ggagacgctgcagcgcacggagat

SEQ ID NO: 2383 - DNA, 25 bp, Artificial Sequence
  Description of Artificial Sequence: Synthetic oligonucleotide
gagacgctgcagcgcacggagatca

SEQ ID NO: 2384 - DNA, 26 bp, Artificial Sequence
  Description of Artificial Sequence: Synthetic oligonucleotide
agacgctgcagcgcacggagatcaca

SEQ ID NO: 2385 - DNA, 25 bp, Artificial Sequence
  Description of Artificial Sequence: Synthetic oligonucleotide
gacgctgcagcgcacggagatcaca

SEQ ID NO: 2386 - DNA, 26 bp, Artificial Sequence
  Description of Artificial Sequence: Synthetic oligonucleotide
acgctgcagcgcacggagatcacact

SEQ ID NO: 2387 - DNA, 25 bp, Artificial Sequence
  Description of Artificial Sequence: Synthetic oligonucleotide
cgctgcagcgcacggagatcacact

SEQ ID NO: 2388 - DNA, 26 bp, Artificial Sequence
  Description of Artificial Sequence: Synthetic oligonucleotide
gctgcagcgcacggagatcacactga

SEQ ID NO: 2389 - DNA, 26 bp, Artificial Sequence
  Description of Artificial Sequence: Synthetic oligonucleotide
ctgcagcgcacggagatcacactgac

SEQ ID NO: 2390 - DNA, 27 bp, Artificial Sequence
  Description of Artificial Sequence: Synthetic oligonucleotide
tgcagcgcacggagatcacactgacct

SEQ ID NO: 2391 - DNA, 26 bp, Artificial Sequence
  Description of Artificial Sequence: Synthetic oligonucleotide
gcagcgcacggagatcacactgacct

SEQ ID NO: 2392 - DNA, 26 bp, Artificial Sequence
  Description of Artificial Sequence: Synthetic oligonucleotide
cagcgcacggagatcacactgacctg

SEQ ID NO: 2393 - DNA, 26 bp, Artificial Sequence
  Description of Artificial Sequence: Synthetic oligonucleotide
agcgcacggagatcacactgacctgg

SEQ ID NO: 2394 - DNA, 25 bp, Artificial Sequence
  Description of Artificial Sequence: Synthetic oligonucleotide
gcgcacggagatcacactgacctgg

SEQ ID NO: 2395 - DNA, 26 bp, Artificial Sequence
  Description of Artificial Sequence: Synthetic oligonucleotide
cgcacggagatcacactgacctggca

SEQ ID NO: 2396 - DNA, 26 bp, Artificial Sequence
  Description of Artificial Sequence: Synthetic oligonucleotide
gcacggagatcacactgacctggcag

SEQ ID NO: 2397 - DNA, 26 bp, Artificial Sequence
  Description of Artificial Sequence: Synthetic oligonucleotide
cacggagatcacactgacctggcagc

SEQ ID NO: 2398 - DNA, 26 bp, Artificial Sequence
  Description of Artificial Sequence: Synthetic oligonucleotide
acggagatcacactgacctggcagcg

SEQ ID NO: 2399 - DNA, 26 bp, Artificial Sequence
  Description of Artificial Sequence: Synthetic oligonucleotide
aacgaggacctgcgctcttggaccgt

SEQ ID NO: 2400 - DNA, 25 bp, Artificial Sequence
  Description of Artificial Sequence: Synthetic oligonucleotide
acgaggacctgcgctcttggaccgt

SEQ ID NO: 2401 - DNA, 24 bp, Artificial Sequence
  Description of Artificial Sequence: Synthetic oligonucleotide
cgaggacctgcgctcttggaccgt

SEQ ID NO: 2402 - DNA, 24 bp, Artificial Sequence
  Description of Artificial Sequence: Synthetic oligonucleotide
gaggacctgcgctcttggaccgtg

SEQ ID NO: 2403 - DNA, 24 bp, Artificial Sequence
  Description of Artificial Sequence: Synthetic oligonucleotide
aggacctgcgctcttggaccgtgg

SEQ ID NO: 2404 - DNA, 23 bp, Artificial Sequence
  Description of Artificial Sequence: Synthetic oligonucleotide
ggacctgcgctcttggaccgtgg

SEQ ID NO: 2405 - DNA, 23 bp, Artificial Sequence
  Description of Artificial Sequence: Synthetic oligonucleotide
gacctgcgctcttggaccgtggc

SEQ ID NO: 2406 - DNA, 23 bp, Artificial Sequence
  Description of Artificial Sequence: Synthetic oligonucleotide
acctgcgctcttggaccgtggcg

SEQ ID NO: 2407 - DNA, 22 bp, Artificial Sequence
  Description of Artificial Sequence: Synthetic oligonucleotide
cctgcgctcttggaccgtggcg

SEQ ID NO: 2408 - DNA, 23 bp, Artificial Sequence
  Description of Artificial Sequence: Synthetic oligonucleotide
ctgcgctcttggaccgtggcgga

SEQ ID NO: 2409 - DNA, 25 bp, Artificial Sequence
  Description of Artificial Sequence: Synthetic oligonucleotide
tgcgctcttggaccgtggcggacat

SEQ ID NO: 2410 - DNA, 24 bp, Artificial Sequence
  Description of Artificial Sequence: Synthetic oligonucleotide
gcgctcttggaccgtggcggacat

SEQ ID NO: 2411 - DNA, 24 bp, Artificial Sequence
  Description of Artificial Sequence: Synthetic oligonucleotide
cgctcttggaccgtggcggacatg

SEQ ID NO: 2412 - DNA, 24 bp, Artificial Sequence
  Description of Artificial Sequence: Synthetic oligonucleotide
gctcttggaccgtggcggacatgg

SEQ ID NO: 2413 - DNA, 25 bp, Artificial Sequence
  Description of Artificial Sequence: Synthetic oligonucleotide
ctcttggaccgtggcggacatggca

SEQ ID NO: 2414 - DNA, 25 bp, Artificial Sequence
  Description of Artificial Sequence: Synthetic oligonucleotide
tcttggaccgtggcggacatggcag

SEQ ID NO: 2415 - DNA, 24 bp, Artificial Sequence
  Description of Artificial Sequence: Synthetic oligonucleotide
cttggaccgtggcggacatggcag

SEQ ID NO: 2416 - DNA, 25 bp, Artificial Sequence
  Description of Artificial Sequence: Synthetic oligonucleotide
ttggaccgtggcggacatggcagct

SEQ ID NO: 2417 - DNA, 24 bp, Artificial Sequence
  Description of Artificial Sequence: Synthetic oligonucleotide
tggaccgtggcggacatggcagct

SEQ ID NO: 2418 - DNA, 23 bp, Artificial Sequence
  Description of Artificial Sequence: Synthetic oligonucleotide
ggaccgtggcggacatggcagct

SEQ ID NO: 2419 - DNA, 24 bp, Artificial Sequence
  Description of Artificial Sequence: Synthetic oligonucleotide
gaccgtggcggacatggcagctca

SEQ ID NO: 2420 - DNA, 26 bp, Artificial Sequence
  Description of Artificial Sequence: Synthetic oligonucleotide
accgtggcggacatggcagctcagat

SEQ ID NO: 2421 - DNA, 25 bp, Artificial Sequence
  Description of Artificial Sequence: Synthetic oligonucleotide
ccgtggcggacatggcagctcagat

SEQ ID NO: 2422 - DNA, 26 bp, Artificial Sequence
  Description of Artificial Sequence: Synthetic oligonucleotide
cgtggcggacatggcagctcagatca

SEQ ID NO: 2423 - DNA, 26 bp, Artificial Sequence
  Description of Artificial Sequence: Synthetic oligonucleotide
gtggcggacatggcagctcagatcac

SEQ ID NO: 2424 - DNA, 27 bp, Artificial Sequence
  Description of Artificial Sequence: Synthetic oligonucleotide
tggcggacatggcagctcagatcacca

SEQ ID NO: 2425 - DNA, 22 bp, Artificial Sequence
  Description of Artificial Sequence: Synthetic oligonucleotide
gggtaccggcaggacgcctacg

SEQ ID NO: 2426 - DNA, 22 bp, Artificial Sequence
  Description of Artificial Sequence: Synthetic oligonucleotide
ggtaccggcaggacgcctacgg

SEQ ID NO: 2427 - DNA, 22 bp, Artificial Sequence
  Description of Artificial Sequence: Synthetic oligonucleotide
gtaccggcaggacgcctacggc

SEQ ID NO: 2428 - DNA, 22 bp, Artificial Sequence
  Description of Artificial Sequence: Synthetic oligonucleotide
taccggcaggacgcctacggcg

SEQ ID NO: 2429 - DNA, 21 bp, Artificial Sequence
  Description of Artificial Sequence: Synthetic oligonucleotide
accggcaggacgcctacggcg

SEQ ID NO: 2430 - DNA, 20 bp, Artificial Sequence
  Description of Artificial Sequence: Synthetic oligonucleotide
ccggcaggacgcctacggcg

SEQ ID NO: 2431 - DNA, 20 bp, Artificial Sequence
  Description of Artificial Sequence: Synthetic oligonucleotide
cggcaggacgcctacggcgg

SEQ ID NO: 2432 - DNA, 22 bp, Artificial Sequence
  Description of Artificial Sequence: Synthetic oligonucleotide
ggcaggacgcctacggcggcaa

SEQ ID NO: 2433 - DNA, 22 bp, Artificial Sequence
  Description of Artificial Sequence: Synthetic oligonucleotide
gcaggacgcctacggcggcaag

SEQ ID NO: 2434 - DNA, 26 bp, Artificial Sequence
  Description of Artificial Sequence: Synthetic oligonucleotide
caggacgcctacggcggcaaggatta

SEQ ID NO: 2435 - DNA, 27 bp, Artificial Sequence
  Description of Artificial Sequence: Synthetic oligonucleotide
aggacgcctacggcggcaaggattaca

SEQ ID NO: 2436 - DNA, 27 bp, Artificial Sequence
  Description of Artificial Sequence: Synthetic oligonucleotide
ggacgcctacggcggcaaggattacat

SEQ ID NO: 2437 - DNA, 27 bp, Artificial Sequence
  Description of Artificial Sequence: Synthetic oligonucleotide
gacgcctacggcggcaaggattacatc

SEQ ID NO: 2438 - DNA, 27 bp, Artificial Sequence
  Description of Artificial Sequence: Synthetic oligonucleotide
acgcctacggcggcaaggattacatcg

SEQ ID NO: 2439 - DNA, 26 bp, Artificial Sequence
  Description of Artificial Sequence: Synthetic oligonucleotide
cgcctacggcggcaaggattacatcg

SEQ ID NO: 2440 - DNA, 26 bp, Artificial Sequence
  Description of Artificial Sequence: Synthetic oligonucleotide
gcctacggcggcaaggattacatcgc

SEQ ID NO: 2441 - DNA, 26 bp, Artificial Sequence
  Description of Artificial Sequence: Synthetic oligonucleotide
cctacggcggcaaggattacatcgcc

SEQ ID NO: 2442 - DNA, 27 bp, Artificial Sequence
  Description of Artificial Sequence: Synthetic oligonucleotide
ctacggcggcaaggattacatcgccct

SEQ ID NO: 2443 - DNA, 27 bp, Artificial Sequence
  Description of Artificial Sequence: Synthetic oligonucleotide
tacggcggcaaggattacatcgccctg

SEQ ID NO: 2444 - DNA, 27 bp, Artificial Sequence
  Description of Artificial Sequence: Synthetic oligonucleotide
acggcggcaaggattacatcgccctga

SEQ ID NO: 2445 - DNA, 27 bp, Artificial Sequence
  Description of Artificial Sequence: Synthetic oligonucleotide
cggcggcaaggattacatcgccctgaa

SEQ ID NO: 2446 - DNA, 27 bp, Artificial Sequence
  Description of Artificial Sequence: Synthetic oligonucleotide
ggcggcaaggattacatcgccctgaac

SEQ ID NO: 2447 - DNA, 27 bp, Artificial Sequence
  Description of Artificial Sequence: Synthetic oligonucleotide
gcggcaaggattacatcgccctgaacg

SEQ ID NO: 2448 - DNA, 26 bp, Artificial Sequence
  Description of Artificial Sequence: Synthetic oligonucleotide
gatggggaggaccagacccaggacat

SEQ ID NO: 2449 - DNA, 26 bp, Artificial Sequence
  Description of Artificial Sequence: Synthetic oligonucleotide
atggggaggaccagacccaggacatg

SEQ ID NO: 2450 - DNA, 25 bp, Artificial Sequence
  Description of Artificial Sequence: Synthetic oligonucleotide
tggggaggaccagacccaggacatg

SEQ ID NO: 2451 - DNA, 24 bp, Artificial Sequence
  Description of Artificial Sequence: Synthetic oligonucleotide
ggggaggaccagacccaggacatg

SEQ ID NO: 2452 - DNA, 25 bp, Artificial Sequence
  Description of Artificial Sequence: Synthetic oligonucleotide
gggaggaccagacccaggacatgga

SEQ ID NO: 2453 - DNA, 25 bp, Artificial Sequence
  Description of Artificial Sequence: Synthetic oligonucleotide
ggaggaccagacccaggacatggag

SEQ ID NO: 2454 - DNA, 26 bp, Artificial Sequence
  Description of Artificial Sequence: Synthetic oligonucleotide
gaggaccagacccaggacatggagct

SEQ ID NO: 2455 - DNA, 26 bp, Artificial Sequence
  Description of Artificial Sequence: Synthetic oligonucleotide
aggaccagacccaggacatggagctc

SEQ ID NO: 2456 - DNA, 25 bp, Artificial Sequence
  Description of Artificial Sequence: Synthetic oligonucleotide
ggaccagacccaggacatggagctc

SEQ ID NO: 2457 - DNA, 26 bp, Artificial Sequence
  Description of Artificial Sequence: Synthetic oligonucleotide
gaccagacccaggacatggagctcgt

SEQ ID NO: 2458 - DNA, 26 bp, Artificial Sequence
  Description of Artificial Sequence: Synthetic oligonucleotide
accagacccaggacatggagctcgtg

SEQ ID NO: 2459 - DNA, 25 bp, Artificial Sequence
  Description of Artificial Sequence: Synthetic oligonucleotide
ccagacccaggacatggagctcgtg

SEQ ID NO: 2460 - DNA, 26 bp, Artificial Sequence
  Description of Artificial Sequence: Synthetic oligonucleotide
cagacccaggacatggagctcgtgga

SEQ ID NO: 2461 - DNA, 27 bp, Artificial Sequence
  Description of Artificial Sequence: Synthetic oligonucleotide
agacccaggacatggagctcgtggaga

SEQ ID NO: 2462 - DNA, 26 bp, Artificial Sequence
  Description of Artificial Sequence: Synthetic oligonucleotide
gacccaggacatggagctcgtggaga

SEQ ID NO: 2463 - DNA, 26 bp, Artificial Sequence
  Description of Artificial Sequence: Synthetic oligonucleotide
acccaggacatggagctcgtggagac

SEQ ID NO: 2464 - DNA, 25 bp, Artificial Sequence
  Description of Artificial Sequence: Synthetic oligonucleotide
cccaggacatggagctcgtggagac

SEQ ID NO: 2465 - DNA, 26 bp, Artificial Sequence
  Description of Artificial Sequence: Synthetic oligonucleotide
ccaggacatggagctcgtggagacca

SEQ ID NO: 2466 - DNA, 26 bp, Artificial Sequence
  Description of Artificial Sequence: Synthetic oligonucleotide
caggacatggagctcgtggagaccag

SEQ ID NO: 2467 - DNA, 26 bp, Artificial Sequence
  Description of Artificial Sequence: Synthetic oligonucleotide
aggacatggagctcgtggagaccagg

SEQ ID NO: 2468 - DNA, 25 bp, Artificial Sequence
  Description of Artificial Sequence: Synthetic oligonucleotide
ggacatggagctcgtggagaccagg

SEQ ID NO: 2469 - DNA, 25 bp, Artificial Sequence
  Description of Artificial Sequence: Synthetic oligonucleotide
gacatggagctcgtggagaccaggc

SEQ ID NO: 2470 - DNA, 26 bp, Artificial Sequence
  Description of Artificial Sequence: Synthetic oligonucleotide
acatggagctcgtggagaccaggcct

SEQ ID NO: 2471 - DNA, 25 bp, Artificial Sequence
  Description of Artificial Sequence: Synthetic oligonucleotide
catggagctcgtggagaccaggcct

SEQ ID NO: 2472 - DNA, 25 bp, Artificial Sequence
  Description of Artificial Sequence: Synthetic oligonucleotide
atggagctcgtggagaccaggcctg

SEQ ID NO: 2473 - DNA, 24 bp, Artificial Sequence
  Description of Artificial Sequence: Synthetic oligonucleotide
tggagctcgtggagaccaggcctg

SEQ ID NO: 2474 - DNA, 31 bp, Artificial Sequence
  Description of Artificial Sequence: Synthetic oligonucleotide
catccagataatgtatggctgcgacgtggag

SEQ ID NO: 2475 - DNA, 31 bp, Artificial Sequence
  Description of Artificial Sequence: Synthetic oligonucleotide
atccagataatgtatggctgcgacgtggagc

SEQ ID NO: 2476 - DNA, 30 bp, Artificial Sequence
  Description of Artificial Sequence: Synthetic oligonucleotide
tccagataatgtatggctgcgacgtggagc

SEQ ID NO: 2477 - DNA, 29 bp, Artificial Sequence
  Description of Artificial Sequence: Synthetic oligonucleotide
ccagataatgtatggctgcgacgtggagc

SEQ ID NO: 2478 - DNA, 29 bp, Artificial Sequence
  Description of Artificial Sequence: Synthetic oligonucleotide
cagataatgtatggctgcgacgtggagcc

SEQ ID NO: 2479 - DNA, 29 bp, Artificial Sequence
  Description of Artificial Sequence: Synthetic oligonucleotide
agataatgtatggctgcgacgtggagccg

SEQ ID NO: 2480 - DNA, 28 bp, Artificial Sequence
  Description of Artificial Sequence: Synthetic oligonucleotide
gataatgtatggctgcgacgtggagccg

SEQ ID NO: 2481 - DNA, 28 bp, Artificial Sequence
  Description of Artificial Sequence: Synthetic oligonucleotide
ataatgtatggctgcgacgtggagccgg

SEQ ID NO: 2482 - DNA, 27 bp, Artificial Sequence
  Description of Artificial Sequence: Synthetic oligonucleotide
taatgtatggctgcgacgtggagccgg

SEQ ID NO: 2483 - DNA, 27 bp, Artificial Sequence
  Description of Artificial Sequence: Synthetic oligonucleotide
aatgtatggctgcgacgtggagccgga

SEQ ID NO: 2484 - DNA, 26 bp, Artificial Sequence
  Description of Artificial Sequence: Synthetic oligonucleotide
atgtatggctgcgacgtggagccgga

SEQ ID NO: 2485 - DNA, 25 bp, Artificial Sequence
  Description of Artificial Sequence: Synthetic oligonucleotide
tgtatggctgcgacgtggagccgga

SEQ ID NO: 2486 - DNA, 24 bp, Artificial Sequence
  Description of Artificial Sequence: Synthetic oligonucleotide
gtatggctgcgacgtggagccgga

SEQ ID NO: 2487 - DNA, 24 bp, Artificial Sequence
  Description of Artificial Sequence: Synthetic oligonucleotide
tatggctgcgacgtggagccggac

SEQ ID NO: 2488 - DNA, 23 bp, Artificial Sequence
  Description of Artificial Sequence: Synthetic oligonucleotide
atggctgcgacgtggagccggac

SEQ ID NO: 2489 - DNA, 22 bp, Artificial Sequence
  Description of Artificial Sequence: Synthetic oligonucleotide
tggctgcgacgtggagccggac

SEQ ID NO: 2490 - DNA, 21 bp, Artificial Sequence
  Description of Artificial Sequence: Synthetic oligonucleotide
ggctgcgacgtggagccggac

SEQ ID NO: 2491 - DNA, 21 bp, Artificial Sequence
  Description of Artificial Sequence: Synthetic oligonucleotide
gctgcgacgtggagccggacg

SEQ ID NO: 2492 - DNA, 21 bp, Artificial Sequence
  Description of Artificial Sequence: Synthetic oligonucleotide
ctgcgacgtggagccggacgg

SEQ ID NO: 2493 - DNA, 21 bp, Artificial Sequence
  Description of Artificial Sequence: Synthetic oligonucleotide
tgcgacgtggagccggacggg

SEQ ID NO: 2494 - DNA, 20 bp, Artificial Sequence
  Description of Artificial Sequence: Synthetic oligonucleotide
gcgacgtggagccggacggg

SEQ ID NO: 2495 - DNA, 20 bp, Artificial Sequence
  Description of Artificial Sequence: Synthetic oligonucleotide
cgacgtggagccggacgggc

SEQ ID NO: 2496 - DNA, 20 bp, Artificial Sequence
  Description of Artificial Sequence: Synthetic oligonucleotide
gacgtggagccggacgggcg

SEQ ID NO: 2497 - DNA, 22 bp, Artificial Sequence
  Description of Artificial Sequence: Synthetic oligonucleotide
acgtggagccggacgggcgctt

SEQ ID NO: 2498 - DNA, 21 bp, Artificial Sequence
  Description of Artificial Sequence: Synthetic oligonucleotide
cgtggagccggacgggcgctt

SEQ ID NO: 2499 - DNA, 21 bp, Artificial Sequence
  Description of Artificial Sequence: Synthetic oligonucleotide
gtggagccggacgggcgcttc

SEQ ID NO: 2500 - DNA, 22 bp, Artificial Sequence
  Description of Artificial Sequence: Synthetic oligonucleotide
tggagccggacgggcgcttcct

SEQ ID NO: 2501 - DNA, 21 bp, Artificial Sequence
  Description of Artificial Sequence: Synthetic oligonucleotide
ggagccggacgggcgcttcct

SEQ ID NO: 2502 - DNA, 21 bp, Artificial Sequence
  Description of Artificial Sequence: Synthetic oligonucleotide
gagccggacgggcgcttcctc

SEQ ID NO: 2503 - DNA, 21 bp, Artificial Sequence
  Description of Artificial Sequence: Synthetic oligonucleotide
agccggacgggcgcttcctcc

SEQ ID NO: 2504 - DNA, 21 bp, Artificial Sequence
  Description of Artificial Sequence: Synthetic oligonucleotide
gccggacgggcgcttcctcca

SEQ ID NO: 2505 - DNA, 21 bp, Artificial Sequence
  Description of Artificial Sequence: Synthetic oligonucleotide
ccggacgggcgcttcctccac

SEQ ID NO: 2506 - DNA, 21 bp, Artificial Sequence
  Description of Artificial Sequence: Synthetic oligonucleotide
cggacgggcgcttcctccacg

SEQ ID NO: 2507 - DNA, 21 bp, Artificial Sequence
  Description of Artificial Sequence: Synthetic oligonucleotide
ggacgggcgcttcctccacgg

SEQ ID NO: 2508 - DNA, 23 bp, Artificial Sequence
  Description of Artificial Sequence: Synthetic oligonucleotide
gacgggcgcttcctccacgggta

SEQ ID NO: 2509 - DNA, 23 bp, Artificial Sequence
  Description of Artificial Sequence: Synthetic oligonucleotide
acgggcgcttcctccacgggtac

SEQ ID NO: 2510 - DNA, 22 bp, Artificial Sequence
  Description of Artificial Sequence: Synthetic oligonucleotide
cgggcgcttcctccacgggtac

SEQ ID NO: 2511 - DNA, 22 bp, Artificial Sequence
  Description of Artificial Sequence: Synthetic oligonucleotide
gggcgcttcctccacgggtacc

SEQ ID NO: 2512 - DNA, 22 bp, Artificial Sequence
  Description of Artificial Sequence: Synthetic oligonucleotide
ggcgcttcctccacgggtaccg

SEQ ID NO: 2513 - DNA, 22 bp, Artificial Sequence
  Description of Artificial Sequence: Synthetic oligonucleotide
gcgcttcctccacgggtaccgg

SEQ ID NO: 2514 - DNA, 23 bp, Artificial Sequence
  Description of Artificial Sequence: Synthetic oligonucleotide
cgcttcctccacgggtaccggca

SEQ ID NO: 2515 - DNA, 23 bp, Artificial Sequence
  Description of Artificial Sequence: Synthetic oligonucleotide
gcttcctccacgggtaccggcag

SEQ ID NO: 2516 - DNA, 24 bp, Artificial Sequence
  Description of Artificial Sequence: Synthetic oligonucleotide
cttcctccacgggtaccggcagga

SEQ ID NO: 2517 - DNA, 24 bp, Artificial Sequence
  Description of Artificial Sequence: Synthetic oligonucleotide
ttcctccacgggtaccggcaggac

SEQ ID NO: 2518 - DNA, 23 bp, Artificial Sequence
  Description of Artificial Sequence: Synthetic oligonucleotide
tcctccacgggtaccggcaggac

SEQ ID NO: 2519 - DNA, 22 bp, Artificial Sequence
  Description of Artificial Sequence: Synthetic oligonucleotide
cctccacgggtaccggcaggac

SEQ ID NO: 2520 - DNA, 22 bp, Artificial Sequence
  Description of Artificial Sequence: Synthetic oligonucleotide
ctccacgggtaccggcaggacg

SEQ ID NO: 2521 - DNA, 22 bp, Artificial Sequence
  Description of Artificial Sequence: Synthetic oligonucleotide
tccacgggtaccggcaggacgc

SEQ ID NO: 2522 - DNA, 21 bp, Artificial Sequence
  Description of Artificial Sequence: Synthetic oligonucleotide
ccacgggtaccggcaggacgc

SEQ ID NO: 2523 - DNA, 23 bp, Artificial Sequence
  Description of Artificial Sequence: Synthetic oligonucleotide
cacgggtaccggcaggacgccta

SEQ ID NO: 2524 - DNA, 23 bp, Artificial Sequence
  Description of Artificial Sequence: Synthetic oligonucleotide
acgggtaccggcaggacgcctac

SEQ ID NO: 2525 - DNA, 23 bp, Artificial Sequence
  Description of Artificial Sequence: Synthetic oligonucleotide
gacctgcgctcttggaccgcggt

SEQ ID NO: 2526 - DNA, 23 bp, Artificial Sequence
  Description of Artificial Sequence: Synthetic oligonucleotide
acctgcgctcttggaccgcggtg

SEQ ID NO: 2527 - DNA, 22 bp, Artificial Sequence
  Description of Artificial Sequence: Synthetic oligonucleotide
cctgcgctcttggaccgcggtg

SEQ ID NO: 2528 - DNA, 23 bp, Artificial Sequence
  Description of Artificial Sequence: Synthetic oligonucleotide
ctgcgctcttggaccgcggtgga

SEQ ID NO: 2529 - DNA, 25 bp, Artificial Sequence
  Description of Artificial Sequence: Synthetic oligonucleotide
tgcgctcttggaccgcggtggacat

SEQ ID NO: 2530 - DNA, 24 bp, Artificial Sequence
  Description of Artificial Sequence: Synthetic oligonucleotide
gcgctcttggaccgcggtggacat

SEQ ID NO: 2531 - DNA, 24 bp, Artificial Sequence
  Description of Artificial Sequence: Synthetic oligonucleotide
cgctcttggaccgcggtggacatg

SEQ ID NO: 2532 - DNA, 24 bp, Artificial Sequence
  Description of Artificial Sequence: Synthetic oligonucleotide
gctcttggaccgcggtggacatgg

SEQ ID NO: 2533 - DNA, 25 bp, Artificial Sequence
  Description of Artificial Sequence: Synthetic oligonucleotide
ctcttggaccgcggtggacatggca

SEQ ID NO: 2534 - DNA, 25 bp, Artificial Sequence
  Description of Artificial Sequence: Synthetic oligonucleotide
tcttggaccgcggtggacatggcag

SEQ ID NO: 2535 - DNA, 24 bp, Artificial Sequence
  Description of Artificial Sequence: Synthetic oligonucleotide
cttggaccgcggtggacatggcag

SEQ ID NO: 2536 - DNA, 25 bp, Artificial Sequence
  Description of Artificial Sequence: Synthetic oligonucleotide
ttggaccgcggtggacatggcagct

SEQ ID NO: 2537 - DNA, 24 bp, Artificial Sequence
  Description of Artificial Sequence: Synthetic oligonucleotide
tggaccgcggtggacatggcagct

SEQ ID NO: 2538 - DNA, 23 bp, Artificial Sequence
  Description of Artificial Sequence: Synthetic oligonucleotide
ggaccgcggtggacatggcagct

SEQ ID NO: 2539 - DNA, 24 bp, Artificial Sequence
  Description of Artificial Sequence: Synthetic oligonucleotide
gaccgcggtggacatggcagctca

SEQ ID NO: 2540 - DNA, 26 bp, Artificial Sequence
  Description of Artificial Sequence: Synthetic oligonucleotide
accgcggtggacatggcagctcagat

SEQ ID NO: 2541 - DNA, 25 bp, Artificial Sequence
  Description of Artificial Sequence: Synthetic oligonucleotide
ccgcggtggacatggcagctcagat

SEQ ID NO: 2542 - DNA, 26 bp, Artificial Sequence
  Description of Artificial Sequence: Synthetic oligonucleotide
cgcggtggacatggcagctcagatca

SEQ ID NO: 2543 - DNA, 26 bp, Artificial Sequence
  Description of Artificial Sequence: Synthetic oligonucleotide
gcggtggacatggcagctcagatcac

SEQ ID NO: 2544 - DNA, 27 bp, Artificial Sequence
  Description of Artificial Sequence: Synthetic oligonucleotide
cggtggacatggcagctcagatcacca

SEQ ID NO: 2545 - DNA, 28 bp, Artificial Sequence
  Description of Artificial Sequence: Synthetic oligonucleotide
ggtggacatggcagctcagatcaccaag

SEQ ID NO: 2546 - DNA, 28 bp, Artificial Sequence
  Description of Artificial Sequence: Synthetic oligonucleotide
gtggacatggcagctcagatcaccaagc

SEQ ID NO: 2547 - DNA, 28 bp, Artificial Sequence
  Description of Artificial Sequence: Synthetic oligonucleotide
tggacatggcagctcagatcaccaagcg

SEQ ID NO: 2548 - DNA, 30 bp, Artificial Sequence
  Description of Artificial Sequence: Synthetic oligonucleotide
tacaaccagagcgaggacggttctcacatc

SEQ ID NO: 2549 - DNA, 29 bp, Artificial Sequence
  Description of Artificial Sequence: Synthetic oligonucleotide
acaaccagagcgaggacggttctcacatc

SEQ ID NO: 2550 - DNA, 28 bp, Artificial Sequence
  Description of Artificial Sequence: Synthetic oligonucleotide
caaccagagcgaggacggttctcacatc

SEQ ID NO: 2551 - DNA, 30 bp, Artificial Sequence
  Description of Artificial Sequence: Synthetic oligonucleotide
aaccagagcgaggacggttctcacatcatc

SEQ ID NO: 2552 - DNA, 29 bp, Artificial Sequence
  Description of Artificial Sequence: Synthetic oligonucleotide
accagagcgaggacggttctcacatcatc

SEQ ID NO: 2553 - DNA, 28 bp, Artificial Sequence
  Description of Artificial Sequence: Synthetic oligonucleotide
ccagagcgaggacggttctcacatcatc

SEQ ID NO: 2554 - DNA, 28 bp, Artificial Sequence
  Description of Artificial Sequence: Synthetic oligonucleotide
cagagcgaggacggttctcacatcatcc

SEQ ID NO: 2555 - DNA, 29 bp, Artificial Sequence
  Description of Artificial Sequence: Synthetic oligonucleotide
agagcgaggacggttctcacatcatccag

SEQ ID NO: 2556 - DNA, 28 bp, Artificial Sequence
  Description of Artificial Sequence: Synthetic oligonucleotide
gagcgaggacggttctcacatcatccag

SEQ ID NO: 2557 - DNA, 33 bp, Artificial Sequence
  Description of Artificial Sequence: Synthetic oligonucleotide
agcgaggacggttctcacatcatccagataatg

SEQ ID NO: 2558 - DNA, 32 bp, Artificial Sequence
  Description of Artificial Sequence: Synthetic oligonucleotide
gcgaggacggttctcacatcatccagataatg

SEQ ID NO: 2559 - DNA, 35 bp, Artificial Sequence
  Description of Artificial Sequence: Synthetic oligonucleotide
cgaggacggttctcacatcatccagataatgtatg

SEQ ID NO: 2560 - DNA, 35 bp, Artificial Sequence
  Description of Artificial Sequence: Synthetic oligonucleotide
gaggacggttctcacatcatccagataatgtatgg

SEQ ID NO: 2561 - DNA, 35 bp, Artificial Sequence
  Description of Artificial Sequence: Synthetic oligonucleotide
aggacggttctcacatcatccagataatgtatggc

SEQ ID NO: 2562 - DNA, 34 bp, Artificial Sequence
  Description of Artificial Sequence: Synthetic oligonucleotide
ggacggttctcacatcatccagataatgtatggc

SEQ ID NO: 2563 - DNA, 35 bp, Artificial Sequence
  Description of Artificial Sequence: Synthetic oligonucleotide
gacggttctcacatcatccagataatgtatggctg

SEQ ID NO: 2564 - DNA, 35 bp, Artificial Sequence
  Description of Artificial Sequence: Synthetic oligonucleotide
acggttctcacatcatccagataatgtatggctgc

SEQ ID NO: 2565 - DNA, 34 bp, Artificial Sequence
  Description of Artificial Sequence: Synthetic oligonucleotide
cggttctcacatcatccagataatgtatggctgc

SEQ ID NO: 2566 - DNA, 34 bp, Artificial Sequence
  Description of Artificial Sequence: Synthetic oligonucleotide
ggttctcacatcatccagataatgtatggctgcg

SEQ ID NO: 2567 - DNA, 35 bp, Artificial Sequence
  Description of Artificial Sequence: Synthetic oligonucleotide
gttctcacatcatccagataatgtatggctgcgac

SEQ ID NO: 2568 - DNA, 35 bp, Artificial Sequence
  Description of Artificial Sequence: Synthetic oligonucleotide
ttctcacatcatccagataatgtatggctgcgacg

SEQ ID NO: 2569 - DNA, 34 bp, Artificial Sequence
  Description of Artificial Sequence: Synthetic oligonucleotide
tctcacatcatccagataatgtatggctgcgacg

SEQ ID NO: 2570 - DNA, 33 bp, Artificial Sequence
  Description of Artificial Sequence: Synthetic oligonucleotide
ctcacatcatccagataatgtatggctgcgacg

SEQ ID NO: 2571 - DNA, 34 bp, Artificial Sequence
  Description of Artificial Sequence: Synthetic oligonucleotide
tcacatcatccagataatgtatggctgcgacgtg

SEQ ID NO: 2572 - DNA, 33 bp, Artificial Sequence
  Description of Artificial Sequence: Synthetic oligonucleotide
cacatcatccagataatgtatggctgcgacgtg

SEQ ID NO: 2573 - DNA, 33 bp, Artificial Sequence
  Description of Artificial Sequence: Synthetic oligonucleotide
acatcatccagataatgtatggctgcgacgtgg

SEQ ID NO: 2574 - DNA, 32 bp, Artificial Sequence
  Description of Artificial Sequence: Synthetic oligonucleotide
catcatccagataatgtatggctgcgacgtgg

SEQ ID NO: 2575 - DNA, 32 bp, Artificial Sequence
  Description of Artificial Sequence: Synthetic oligonucleotide
atcatccagataatgtatggctgcgacgtggg

SEQ ID NO: 2576 - DNA, 31 bp, Artificial Sequence
  Description of Artificial Sequence: Synthetic oligonucleotide
tcatccagataatgtatggctgcgacgtggg

SEQ ID NO: 2577 - DNA, 32 bp, Artificial Sequence
  Description of Artificial Sequence: Synthetic oligonucleotide
accatccagataatgtatggctgcgacgtgtg

SEQ ID NO: 2578 - DNA, 31 bp, Artificial Sequence
  Description of Artificial Sequence: Synthetic oligonucleotide
ccatccagataatgtatggctgcgacgtgtg

SEQ ID NO: 2579 - DNA, 31 bp, Artificial Sequence
  Description of Artificial Sequence: Synthetic oligonucleotide
catccagataatgtatggctgcgacgtgtgg

SEQ ID NO: 2580 - DNA, 31 bp, Artificial Sequence
  Description of Artificial Sequence: Synthetic oligonucleotide
atccagataatgtatggctgcgacgtgtggc

SEQ ID NO: 2581 - DNA, 30 bp, Artificial Sequence
  Description of Artificial Sequence: Synthetic oligonucleotide
tccagataatgtatggctgcgacgtgtggc

SEQ ID NO: 2582 - DNA, 29 bp, Artificial Sequence
  Description of Artificial Sequence: Synthetic oligonucleotide
ccagataatgtatggctgcgacgtgtggc

SEQ ID NO: 2583 - DNA, 29 bp, Artificial Sequence
  Description of Artificial Sequence: Synthetic oligonucleotide
cagataatgtatggctgcgacgtgtggcc

SEQ ID NO: 2584 - DNA, 29 bp, Artificial Sequence
  Description of Artificial Sequence: Synthetic oligonucleotide
agataatgtatggctgcgacgtgtggccg

SEQ ID NO: 2585 - DNA, 28 bp, Artificial Sequence
  Description of Artificial Sequence: Synthetic oligonucleotide
gataatgtatggctgcgacgtgtggccg

SEQ ID NO: 2586 - DNA, 28 bp, Artificial Sequence
  Description of Artificial Sequence: Synthetic oligonucleotide
ataatgtatggctgcgacgtgtggccgg

SEQ ID NO: 2587 - DNA, 27 bp, Artificial Sequence
  Description of Artificial Sequence: Synthetic oligonucleotide
taatgtatggctgcgacgtgtggccgg

SEQ ID NO: 2588 - DNA, 27 bp, Artificial Sequence
  Description of Artificial Sequence: Synthetic oligonucleotide
aatgtatggctgcgacgtgtggccgga

SEQ ID NO: 2589 - DNA, 26 bp, Artificial Sequence
  Description of Artificial Sequence: Synthetic oligonucleotide
atgtatggctgcgacgtgtggccgga

SEQ ID NO: 2590 - DNA, 25 bp, Artificial Sequence
  Description of Artificial Sequence: Synthetic oligonucleotide
tgtatggctgcgacgtgtggccgga

SEQ ID NO: 2591 - DNA, 24 bp, Artificial Sequence
  Description of Artificial Sequence: Synthetic oligonucleotide
gtatggctgcgacgtgtggccgga

SEQ ID NO: 2592 - DNA, 24 bp, Artificial Sequence
  Description of Artificial Sequence: Synthetic oligonucleotide
tatggctgcgacgtgtggccggac

SEQ ID NO: 2593 - DNA, 23 bp, Artificial Sequence
  Description of Artificial Sequence: Synthetic oligonucleotide
atggctgcgacgtgtggccggac

SEQ ID NO: 2594 - DNA, 22 bp, Artificial Sequence
  Description of Artificial Sequence: Synthetic oligonucleotide
tggctgcgacgtgtggccggac

SEQ ID NO: 2595 - DNA, 21 bp, Artificial Sequence
  Description of Artificial Sequence: Synthetic oligonucleotide
ggctgcgacgtgtggccggac

SEQ ID NO: 2596 - DNA, 21 bp, Artificial Sequence
  Description of Artificial Sequence: Synthetic oligonucleotide
gctgcgacgtgtggccggacg

SEQ ID NO: 2597 - DNA, 21 bp, Artificial Sequence
  Description of Artificial Sequence: Synthetic oligonucleotide
ctgcgacgtgtggccggacgg

SEQ ID NO: 2598 - DNA, 21 bp, Artificial Sequence
  Description of Artificial Sequence: Synthetic oligonucleotide
tgcgacgtgtggccggacggg

SEQ ID NO: 2599 - DNA, 20 bp, Artificial Sequence
  Description of Artificial Sequence: Synthetic oligonucleotide
gcgacgtgtggccggacggg

SEQ ID NO: 2600 - DNA, 20 bp, Artificial Sequence
  Description of Artificial Sequence: Synthetic oligonucleotide
cgacgtgtggccggacgggc

SEQ ID NO: 2601 - DNA, 20 bp, Artificial Sequence
  Description of Artificial Sequence: Synthetic oligonucleotide
gacgtgtggccggacgggcg

SEQ ID NO: 2602 - DNA, 22 bp, Artificial Sequence
  Description of Artificial Sequence: Synthetic oligonucleotide
acgtgtggccggacgggcgctt

SEQ ID NO: 2603 - DNA, 21 bp, Artificial Sequence
  Description of Artificial Sequence: Synthetic oligonucleotide
cgtgtggccggacgggcgctt

SEQ ID NO: 2604 - DNA, 21 bp, Artificial Sequence
  Description of Artificial Sequence: Synthetic oligonucleotide
gtgtggccggacgggcgcttc

SEQ ID NO: 2605 - DNA, 22 bp, Artificial Sequence
  Description of Artificial Sequence: Synthetic oligonucleotide
tgtggccggacgggcgcttcct

SEQ ID NO: 2606 - DNA, 21 bp, Artificial Sequence
  Description of Artificial Sequence: Synthetic oligonucleotide
gtggccggacgggcgcttcct

SEQ ID NO: 2607 - DNA, 21 bp, Artificial Sequence
  Description of Artificial Sequence: Synthetic oligonucleotide
tggccggacgggcgcttcctc

SEQ ID NO: 2608 - DNA, 31 bp, Artificial Sequence
  Description of Artificial Sequence: Synthetic oligonucleotide
gctcccactccatgaggtatttctacacctc

SEQ ID NO: 2609 - DNA, 31 bp, Artificial Sequence
  Description of Artificial Sequence: Synthetic oligonucleotide
ctcccactccatgaggtatttctacacctcc

SEQ ID NO: 2610 - DNA, 31 bp, Artificial Sequence
  Description of Artificial Sequence: Synthetic oligonucleotide
tcccactccatgaggtatttctacacctccg

SEQ ID NO: 2611 - DNA, 30 bp, Artificial Sequence
  Description of Artificial Sequence: Synthetic oligonucleotide
cccactccatgaggtatttctacacctccg

SEQ ID NO: 2612 - DNA, 31 bp, Artificial Sequence
  Description of Artificial Sequence: Synthetic oligonucleotide
ccactccatgaggtatttctacacctccgtg

SEQ ID NO: 2613 - DNA, 32 bp, Artificial Sequence
  Description of Artificial Sequence: Synthetic oligonucleotide
cactccatgaggtatttctacacctccgtgtc

SEQ ID NO: 2614 - DNA, 32 bp, Artificial Sequence
  Description of Artificial Sequence: Synthetic oligonucleotide
actccatgaggtatttctacacctccgtgtcc

SEQ ID NO: 2615 - DNA, 31 bp, Artificial Sequence
  Description of Artificial Sequence: Synthetic oligonucleotide
ctccatgaggtatttctacacctccgtgtcc

SEQ ID NO: 2616 - DNA, 31 bp, Artificial Sequence
  Description of Artificial Sequence: Synthetic oligonucleotide
tccatgaggtatttctacacctccgtgtccc

SEQ ID NO: 2617 - DNA, 30 bp, Artificial Sequence
  Description of Artificial Sequence: Synthetic oligonucleotide
ccatgaggtatttctacacctccgtgtccc

SEQ ID NO: 2618 - DNA, 30 bp, Artificial Sequence
  Description of Artificial Sequence: Synthetic oligonucleotide
catgaggtatttctacacctccgtgtcccg

SEQ ID NO: 2619 - DNA, 30 bp, Artificial Sequence
  Description of Artificial Sequence: Synthetic oligonucleotide
atgaggtatttctacacctccgtgtcccgg

SEQ ID NO: 2620 - DNA, 29 bp, Artificial Sequence
  Description of Artificial Sequence: Synthetic oligonucleotide
tgaggtatttctacacctccgtgtcccgg

SEQ ID NO: 2621 - DNA, 28 bp, Artificial Sequence
  Description of Artificial Sequence: Synthetic oligonucleotide
gaggtatttctacacctccgtgtcccgg

SEQ ID NO: 2622 - DNA, 28 bp, Artificial Sequence
  Description of Artificial Sequence: Synthetic oligonucleotide
aggtatttctacacctccgtgtcccggc

SEQ ID NO: 2623 - DNA, 27 bp, Artificial Sequence
  Description of Artificial Sequence: Synthetic oligonucleotide
ggtatttctacacctccgtgtcccggc

SEQ ID NO: 2624 - DNA, 27 bp, Artificial Sequence
  Description of Artificial Sequence: Synthetic oligonucleotide
gtatttctacacctccgtgtcccggcc

SEQ ID NO: 2625 - DNA, 27 bp, Artificial Sequence
  Description of Artificial Sequence: Synthetic oligonucleotide
tatttctacacctccgtgtcccggccc

SEQ ID NO: 2626 - DNA, 26 bp, Artificial Sequence
  Description of Artificial Sequence: Synthetic oligonucleotide
atttctacacctccgtgtcccggccc

SEQ ID NO: 2627 - DNA, 25 bp, Artificial Sequence
  Description of Artificial Sequence: Synthetic oligonucleotide
tttctacacctccgtgtcccggccc

SEQ ID NO: 2628 - DNA, 24 bp, Artificial Sequence
  Description of Artificial Sequence: Synthetic oligonucleotide
ttctacacctccgtgtcccggccc

SEQ ID NO: 2629 - DNA, 23 bp, Artificial Sequence
  Description of Artificial Sequence: Synthetic oligonucleotide
tctacacctccgtgtcccggccc

SEQ ID NO: 2630 - DNA, 22 bp, Artificial Sequence
  Description of Artificial Sequence: Synthetic oligonucleotide
ctacacctccgtgtcccggccc

SEQ ID NO: 2631 - DNA, 22 bp, Artificial Sequence
  Description of Artificial Sequence: Synthetic oligonucleotide
tacacctccgtgtcccggcccg

SEQ ID NO: 2632 - DNA, 21 bp, Artificial Sequence
  Description of Artificial Sequence: Synthetic oligonucleotide
acacctccgtgtcccggcccg

SEQ ID NO: 2633 - DNA, 20 bp, Artificial Sequence
  Description of Artificial Sequence: Synthetic oligonucleotide
cacctccgtgtcccggcccg

SEQ ID NO: 2634 - DNA, 20 bp, Artificial Sequence
  Description of Artificial Sequence: Synthetic oligonucleotide
acctccgtgtcccggcccgg

SEQ ID NO: 2635 - DNA, 20 bp, Artificial Sequence
  Description of Artificial Sequence: Synthetic oligonucleotide
cctccgtgtcccggcccggt

SEQ ID NO: 2636 - DNA, 20 bp, Artificial Sequence
  Description of Artificial Sequence: Synthetic oligonucleotide
ctccgtgtcccggcccggct

SEQ ID NO: 2637 - DNA, 23 bp, Artificial Sequence
  Description of Artificial Sequence: Synthetic oligonucleotide
cgctcttggaccgcggcggactt

SEQ ID NO: 2638 - DNA, 23 bp, Artificial Sequence
  Description of Artificial Sequence: Synthetic oligonucleotide
gctcttggaccgcggcggacttg

SEQ ID NO: 2639 - DNA, 23 bp, Artificial Sequence
  Description of Artificial Sequence: Synthetic oligonucleotide
ctcttggaccgcggcggacttgg

SEQ ID NO: 2640 - DNA, 24 bp, Artificial Sequence
  Description of Artificial Sequence: Synthetic oligonucleotide
tcttggaccgcggcggacttggca

SEQ ID NO: 2641 - DNA, 23 bp, Artificial Sequence
  Description of Artificial Sequence: Synthetic oligonucleotide
cttggaccgcggcggacttggca

SEQ ID NO: 2642 - DNA, 23 bp, Artificial Sequence
  Description of Artificial Sequence: Synthetic oligonucleotide
ttggaccgcggcggacttggcag

SEQ ID NO: 2643 - DNA, 22 bp, Artificial Sequence
  Description of Artificial Sequence: Synthetic oligonucleotide
tggaccgcggcggacttggcag

SEQ ID NO: 2644 - DNA, 21 bp, Artificial Sequence
  Description of Artificial Sequence: Synthetic oligonucleotide
ggaccgcggcggacttggcag

SEQ ID NO: 2645 - DNA, 22 bp, Artificial Sequence
  Description of Artificial Sequence: Synthetic oligonucleotide
gaccgcggcggacttggcagct

SEQ ID NO: 2646 - DNA, 23 bp, Artificial Sequence
  Description of Artificial Sequence: Synthetic oligonucleotide
accgcggcggacttggcagctca

SEQ ID NO: 2647 - DNA, 22 bp, Artificial Sequence
  Description of Artificial Sequence: Synthetic oligonucleotide
ccgcggcggacttggcagctca

SEQ ID NO: 2648 - DNA, 24 bp, Artificial Sequence
  Description of Artificial Sequence: Synthetic oligonucleotide
cgcggcggacttggcagctcagat

SEQ ID NO: 2649 - DNA, 25 bp, Artificial Sequence
  Description of Artificial Sequence: Synthetic oligonucleotide
gcggcggacttggcagctcagatca

SEQ ID NO: 2650 - DNA, 25 bp, Artificial Sequence
  Description of Artificial Sequence: Synthetic oligonucleotide
cggcggacttggcagctcagatcac

SEQ ID NO: 2651 - DNA, 27 bp, Artificial Sequence
  Description of Artificial Sequence: Synthetic oligonucleotide
ggcggacttggcagctcagatcaccaa

SEQ ID NO: 2652 - DNA, 27 bp, Artificial Sequence
  Description of Artificial Sequence: Synthetic oligonucleotide
gcggacttggcagctcagatcaccaag

SEQ ID NO: 2653 - DNA, 27 bp, Artificial Sequence
  Description of Artificial Sequence: Synthetic oligonucleotide
cggacttggcagctcagatcaccaagc

SEQ ID NO: 2654 - DNA, 27 bp, Artificial Sequence
  Description of Artificial Sequence: Synthetic oligonucleotide
ggacttggcagctcagatcaccaagcg

SEQ ID NO: 2655 - DNA, 27 bp, Artificial Sequence
  Description of Artificial Sequence: Synthetic oligonucleotide
gacttggcagctcagatcaccaagcgc

SEQ ID NO: 2656 - DNA, 29 bp, Artificial Sequence
  Description of Artificial Sequence: Synthetic oligonucleotide
acttggcagctcagatcaccaagcgcaag

SEQ ID NO: 2657 - DNA, 28 bp, Artificial Sequence
  Description of Artificial Sequence: Synthetic oligonucleotide
cttggcagctcagatcaccaagcgcaag

SEQ ID NO: 2658 - DNA, 29 bp, Artificial Sequence
  Description of Artificial Sequence: Synthetic oligonucleotide
ttggcagctcagatcaccaagcgcaagtg

SEQ ID NO: 2659 - DNA, 24 bp, Artificial Sequence
  Description of Artificial Sequence: Synthetic oligonucleotide
ctgggccctgggcttctaccctgt

SEQ ID NO: 2660 - DNA, 24 bp, Artificial Sequence
  Description of Artificial Sequence: Synthetic oligonucleotide
tgggccctgggcttctaccctgtg

SEQ ID NO: 2661 - DNA, 23 bp, Artificial Sequence
  Description of Artificial Sequence: Synthetic oligonucleotide
gggccctgggcttctaccctgtg

SEQ ID NO: 2662 - DNA, 24 bp, Artificial Sequence
  Description of Artificial Sequence: Synthetic oligonucleotide
ggccctgggcttctaccctgtgga

SEQ ID NO: 2663 - DNA, 26 bp, Artificial Sequence
  Description of Artificial Sequence: Synthetic oligonucleotide
gccctgggcttctaccctgtggagat

SEQ ID NO: 2664 - DNA, 27 bp, Artificial Sequence
  Description of Artificial Sequence: Synthetic oligonucleotide
ccctgggcttctaccctgtggagatca

SEQ ID NO: 2665 - DNA, 27 bp, Artificial Sequence
  Description of Artificial Sequence: Synthetic oligonucleotide
cctgggcttctaccctgtggagatcac

SEQ ID NO: 2666 - DNA, 28 bp, Artificial Sequence
  Description of Artificial Sequence: Synthetic oligonucleotide
ctgggcttctaccctgtggagatcacac

SEQ ID NO: 2667 - DNA, 29 bp, Artificial Sequence
  Description of Artificial Sequence: Synthetic oligonucleotide
tgggcttctaccctgtggagatcacactg

SEQ ID NO: 2668 - DNA, 28 bp, Artificial Sequence
  Description of Artificial Sequence: Synthetic oligonucleotide
gggcttctaccctgtggagatcacactg

SEQ ID NO: 2669 - DNA, 29 bp, Artificial Sequence
  Description of Artificial Sequence: Synthetic oligonucleotide
ggcttctaccctgtggagatcacactgac

SEQ ID NO: 2670 - DNA, 29 bp, Artificial Sequence
  Description of Artificial Sequence: Synthetic oligonucleotide
gcttctaccctgtggagatcacactgacc

SEQ ID NO: 2671 - DNA, 30 bp, Artificial Sequence
  Description of Artificial Sequence: Synthetic oligonucleotide
cttctaccctgtggagatcacactgacctg

SEQ ID NO: 2672 - DNA, 30 bp, Artificial Sequence
  Description of Artificial Sequence: Synthetic oligonucleotide
ttctaccctgtggagatcacactgacctgg

SEQ ID NO: 2673 - DNA, 29 bp, Artificial Sequence
  Description of Artificial Sequence: Synthetic oligonucleotide
tctaccctgtggagatcacactgacctgg

SEQ ID NO: 2674 - DNA, 28 bp, Artificial Sequence
  Description of Artificial Sequence: Synthetic oligonucleotide
ctaccctgtggagatcacactgacctgg

SEQ ID NO: 2675 - DNA, 28 bp, Artificial Sequence
  Description of Artificial Sequence: Synthetic oligonucleotide
taccctgtggagatcacactgacctggc

SEQ ID NO: 2676 - DNA, 27 bp, Artificial Sequence
  Description of Artificial Sequence: Synthetic oligonucleotide
accctgtggagatcacactgacctggc

SEQ ID NO: 2677 - DNA, 27 bp, Artificial Sequence
  Description of Artificial Sequence: Synthetic oligonucleotide
ccctgtggagatcacactgacctggca

SEQ ID NO: 2678 - DNA, 27 bp, Artificial Sequence
  Description of Artificial Sequence: Synthetic oligonucleotide
cctgtggagatcacactgacctggcag

SEQ ID NO: 2679 - DNA, 27 bp, Artificial Sequence
  Description of Artificial Sequence: Synthetic oligonucleotide
ctgtggagatcacactgacctggcagc

SEQ ID NO: 2680 - DNA, 27 bp, Artificial Sequence
  Description of Artificial Sequence: Synthetic oligonucleotide
tgtggagatcacactgacctggcagcg

SEQ ID NO: 2681 - DNA, 26 bp, Artificial Sequence
  Description of Artificial Sequence: Synthetic oligonucleotide
gtggagatcacactgacctggcagcg

SEQ ID NO: 2682 - DNA, 26 bp, Artificial Sequence
  Description of Artificial Sequence: Synthetic oligonucleotide
tggagatcacactgacctggcagcgg

SEQ ID NO: 2683 - DNA, 29 bp, Artificial Sequence
  Description of Artificial Sequence: Synthetic oligonucleotide
cgaggacggttctcacaccatccagatag

SEQ ID NO: 2684 - DNA, 30 bp, Artificial Sequence
  Description of Artificial Sequence: Synthetic oligonucleotide
gaggacggttctcacaccatccagatagtg

SEQ ID NO: 2685 - DNA, 33 bp, Artificial Sequence
  Description of Artificial Sequence: Synthetic oligonucleotide
aggacggttctcacaccatccagatagtgtatg

SEQ ID NO: 2686 - DNA, 32 bp, Artificial Sequence
  Description of Artificial Sequence: Synthetic oligonucleotide
ggacggttctcacaccatccagatagtgtatg

SEQ ID NO: 2687 - DNA, 32 bp, Artificial Sequence
  Description of Artificial Sequence: Synthetic oligonucleotide
gacggttctcacaccatccagatagtgtatgg

SEQ ID NO: 2688 - DNA, 32 bp, Artificial Sequence
  Description of Artificial Sequence: Synthetic oligonucleotide
acggttctcacaccatccagatagtgtatggc

SEQ ID NO: 2689 - DNA, 31 bp, Artificial Sequence
  Description of Artificial Sequence: Synthetic oligonucleotide
cggttctcacaccatccagatagtgtatggc

SEQ ID NO: 2690 - DNA, 32 bp, Artificial Sequence
  Description of Artificial Sequence: Synthetic oligonucleotide
ggttctcacaccatccagatagtgtatggctg

SEQ ID NO: 2691 - DNA, 32 bp, Artificial Sequence
  Description of Artificial Sequence: Synthetic oligonucleotide
gttctcacaccatccagatagtgtatggctgc

SEQ ID NO: 2692 - DNA, 32 bp, Artificial Sequence
  Description of Artificial Sequence: Synthetic oligonucleotide
ttctcacaccatccagatagtgtatggctgcg

SEQ ID NO: 2693 - DNA, 31 bp, Artificial Sequence
  Description of Artificial Sequence: Synthetic oligonucleotide
tctcacaccatccagatagtgtatggctgcg

SEQ ID NO: 2694 - DNA, 30 bp, Artificial Sequence
  Description of Artificial Sequence: Synthetic oligonucleotide
ctcacaccatccagatagtgtatggctgcg

SEQ ID NO: 2695 - DNA, 31 bp, Artificial Sequence
  Description of Artificial Sequence: Synthetic oligonucleotide
tcacaccatccagatagtgtatggctgcgac

SEQ ID NO: 2696 - DNA, 30 bp, Artificial Sequence
  Description of Artificial Sequence: Synthetic oligonucleotide
cacaccatccagatagtgtatggctgcgac

SEQ ID NO: 2697 - DNA, 30 bp, Artificial Sequence
  Description of Artificial Sequence: Synthetic oligonucleotide
acaccatccagatagtgtatggctgcgacg

SEQ ID NO: 2698 - DNA, 29 bp, Artificial Sequence
  Description of Artificial Sequence: Synthetic oligonucleotide
caccatccagatagtgtatggctgcgacg

SEQ ID NO: 2699 - DNA, 30 bp, Artificial Sequence
  Description of Artificial Sequence: Synthetic oligonucleotide
accatccagatagtgtatggctgcgacgtg

SEQ ID NO: 2700 - DNA, 29 bp, Artificial Sequence
  Description of Artificial Sequence: Synthetic oligonucleotide
ccatccagatagtgtatggctgcgacgtg

SEQ ID NO: 2701 - DNA, 29 bp, Artificial Sequence
  Description of Artificial Sequence: Synthetic oligonucleotide
catccagatagtgtatggctgcgacgtgg

SEQ ID NO: 2702 - DNA, 29 bp, Artificial Sequence
  Description of Artificial Sequence: Synthetic oligonucleotide
atccagatagtgtatggctgcgacgtggg

SEQ ID NO: 2703 - DNA, 28 bp, Artificial Sequence
  Description of Artificial Sequence: Synthetic oligonucleotide
tccagatagtgtatggctgcgacgtggg

SEQ ID NO: 2704 - DNA, 27 bp, Artificial Sequence
  Description of Artificial Sequence: Synthetic oligonucleotide
ccagatagtgtatggctgcgacgtggg

SEQ ID NO: 2705 - DNA, 27 bp, Artificial Sequence
  Description of Artificial Sequence: Synthetic oligonucleotide
cagatagtgtatggctgcgacgtgggg

SEQ ID NO: 2706 - DNA, 27 bp, Artificial Sequence
  Description of Artificial Sequence: Synthetic oligonucleotide
agatagtgtatggctgcgacgtggggc

SEQ ID NO: 2707 - DNA, 26 bp, Artificial Sequence
  Description of Artificial Sequence: Synthetic oligonucleotide
gatagtgtatggctgcgacgtggggc

SEQ ID NO: 2708 - DNA, 26 bp, Artificial Sequence
  Description of Artificial Sequence: Synthetic oligonucleotide
atagtgtatggctgcgacgtggggcc

SEQ ID NO: 2709 - DNA, 25 bp, Artificial Sequence
  Description of Artificial Sequence: Synthetic oligonucleotide
tagtgtatggctgcgacgtggggcc

SEQ ID NO: 2710 - DNA, 24 bp, Artificial Sequence
  Description of Artificial Sequence: Synthetic oligonucleotide
agtgtatggctgcgacgtggggcc

SEQ ID NO: 2711 - DNA, 23 bp, Artificial Sequence
  Description of Artificial Sequence: Synthetic oligonucleotide
gtgtatggctgcgacgtggggcc

SEQ ID NO: 2712 - DNA, 27 bp, Artificial Sequence
  Description of Artificial Sequence: Synthetic oligonucleotide
ggccggagtattgggaccaggagacat

SEQ ID NO: 2713 - DNA, 27 bp, Artificial Sequence
  Description of Artificial Sequence: Synthetic oligonucleotide
gccggagtattgggaccaggagacatg

SEQ ID NO: 2714 - DNA, 27 bp, Artificial Sequence
  Description of Artificial Sequence: Synthetic oligonucleotide
ccggagtattgggaccaggagacatgg

SEQ ID NO: 2715 - DNA, 32 bp, Artificial Sequence
  Description of Artificial Sequence: Synthetic oligonucleotide
cggagtattgggaccaggagacatggaatatg

SEQ ID NO: 2716 - DNA, 34 bp, Artificial Sequence
  Description of Artificial Sequence: Synthetic oligonucleotide
ggagtattgggaccaggagacatggaatatgaag

SEQ ID NO: 2717 - DNA, 34 bp, Artificial Sequence
  Description of Artificial Sequence: Synthetic oligonucleotide
gagtattgggaccaggagacatggaatatgaagg

SEQ ID NO: 2718 - DNA, 34 bp, Artificial Sequence
  Description of Artificial Sequence: Synthetic oligonucleotide
agtattgggaccaggagacatggaatatgaaggc

SEQ ID NO: 2719 - DNA, 33 bp, Artificial Sequence
  Description of Artificial Sequence: Synthetic oligonucleotide
gtattgggaccaggagacatggaatatgaaggc

SEQ ID NO: 2720 - DNA, 33 bp, Artificial Sequence
  Description of Artificial Sequence: Synthetic oligonucleotide
tattgggaccaggagacatggaatatgaaggcc

SEQ ID NO: 2721 - DNA, 32 bp, Artificial Sequence
  Description of Artificial Sequence: Synthetic oligonucleotide
attgggaccaggagacatggaatatgaaggcc

SEQ ID NO: 2722 - DNA, 31 bp, Artificial Sequence
  Description of Artificial Sequence: Synthetic oligonucleotide
ttgggaccaggagacatggaatatgaaggcc

SEQ ID NO: 2723 - DNA, 30 bp, Artificial Sequence
  Description of Artificial Sequence: Synthetic oligonucleotide
tgggaccaggagacatggaatatgaaggcc

SEQ ID NO: 2724 - DNA, 29 bp, Artificial Sequence
  Description of Artificial Sequence: Synthetic oligonucleotide
gggaccaggagacatggaatatgaaggcc

SEQ ID NO: 2725 - DNA, 29 bp, Artificial Sequence
  Description of Artificial Sequence: Synthetic oligonucleotide
ggaccaggagacatggaatatgaaggccc

SEQ ID NO: 2726 - DNA, 30 bp, Artificial Sequence
  Description of Artificial Sequence: Synthetic oligonucleotide
gaccaggagacatggaatatgaaggcccac

SEQ ID NO: 2727 - DNA, 31 bp, Artificial Sequence
  Description of Artificial Sequence: Synthetic oligonucleotide
accaggagacatggaatatgaaggcccactc

SEQ ID NO: 2728 - DNA, 30 bp, Artificial Sequence
  Description of Artificial Sequence: Synthetic oligonucleotide
ccaggagacatggaatatgaaggcccactc

SEQ ID NO: 2729 - DNA, 31 bp, Artificial Sequence
  Description of Artificial Sequence: Synthetic oligonucleotide
caggagacatggaatatgaaggcccactcac

SEQ ID NO: 2730 - DNA, 32 bp, Artificial Sequence
  Description of Artificial Sequence: Synthetic oligonucleotide
aggagacatggaatatgaaggcccactcacag

SEQ ID NO: 2731 - DNA, 31 bp, Artificial Sequence
  Description of Artificial Sequence: Synthetic oligonucleotide
ggagacatggaatatgaaggcccactcacag

SEQ ID NO: 2732 - DNA, 32 bp, Artificial Sequence
  Description of Artificial Sequence: Synthetic oligonucleotide
gagacatggaatatgaaggcccactcacagac

SEQ ID NO: 2733 - DNA, 33 bp, Artificial Sequence
  Description of Artificial Sequence: Synthetic oligonucleotide
agacatggaatatgaaggcccactcacagactg

SEQ ID NO: 2734 - DNA, 32 bp, Artificial Sequence
  Description of Artificial Sequence: Synthetic oligonucleotide
gacatggaatatgaaggcccactcacagactg

SEQ ID NO: 2735 - DNA, 33 bp, Artificial Sequence
  Description of Artificial Sequence: Synthetic oligonucleotide
acatggaatatgaaggcccactcacagactgac

SEQ ID NO: 2736 - DNA, 32 bp, Artificial Sequence
  Description of Artificial Sequence: Synthetic oligonucleotide
catggaatatgaaggcccactcacagactgac

SEQ ID NO: 2737 - DNA, 32 bp, Artificial Sequence
  Description of Artificial Sequence: Synthetic oligonucleotide
atggaatatgaaggcccactcacagactgacc

SEQ ID NO: 2738 - DNA, 31 bp, Artificial Sequence
  Description of Artificial Sequence: Synthetic oligonucleotide
tggaatatgaaggcccactcacagactgacc

SEQ ID NO: 2739 - DNA, 29 bp, Artificial Sequence
  Description of Artificial Sequence: Synthetic oligonucleotide
acatggcagctcagatcaccaagcgcaac

SEQ ID NO: 2740 - DNA, 28 bp, Artificial Sequence
  Description of Artificial Sequence: Synthetic oligonucleotide
catggcagctcagatcaccaagcgcaac

SEQ ID NO: 2741 - DNA, 29 bp, Artificial Sequence
  Description of Artificial Sequence: Synthetic oligonucleotide
atggcagctcagatcaccaagcgcaactg

SEQ ID NO: 2742 - DNA, 28 bp, Artificial Sequence
  Description of Artificial Sequence: Synthetic oligonucleotide
tggcagctcagatcaccaagcgcaactg

SEQ ID NO: 2743 - DNA, 27 bp, Artificial Sequence
  Description of Artificial Sequence: Synthetic oligonucleotide
ggcagctcagatcaccaagcgcaactg

SEQ ID NO: 2744 - DNA, 27 bp, Artificial Sequence
  Description of Artificial Sequence: Synthetic oligonucleotide
gcagctcagatcaccaagcgcaactgg

SEQ ID NO: 2745 - DNA, 27 bp, Artificial Sequence
  Description of Artificial Sequence: Synthetic oligonucleotide
cagctcagatcaccaagcgcaactggg

SEQ ID NO: 2746 - DNA, 28 bp, Artificial Sequence
  Description of Artificial Sequence: Synthetic oligonucleotide
agctcagatcaccaagcgcaactgggag

SEQ ID NO: 2747 - DNA, 27 bp, Artificial Sequence
  Description of Artificial Sequence: Synthetic oligonucleotide
gctcagatcaccaagcgcaactgggag

SEQ ID NO: 2748 - DNA, 27 bp, Artificial Sequence
  Description of Artificial Sequence: Synthetic oligonucleotide
ctcagatcaccaagcgcaactgggagg

SEQ ID NO: 2749 - DNA, 27 bp, Artificial Sequence
  Description of Artificial Sequence: Synthetic oligonucleotide
tcagatcaccaagcgcaactgggaggc

SEQ ID NO: 2750 - DNA, 26 bp, Artificial Sequence
  Description of Artificial Sequence: Synthetic oligonucleotide
cagatcaccaagcgcaactgggaggc

SEQ ID NO: 2751 - DNA, 26 bp, Artificial Sequence
  Description of Artificial Sequence: Synthetic oligonucleotide
agatcaccaagcgcaactgggaggcg

SEQ ID NO: 2752 - DNA, 25 bp, Artificial Sequence
  Description of Artificial Sequence: Synthetic oligonucleotide
gatcaccaagcgcaactgggaggcg

SEQ ID NO: 2753 - DNA, 26 bp, Artificial Sequence
  Description of Artificial Sequence: Synthetic oligonucleotide
atcaccaagcgcaactgggaggcggt

SEQ ID NO: 2754 - DNA, 25 bp, Artificial Sequence
  Description of Artificial Sequence: Synthetic oligonucleotide
tcaccaagcgcaactgggaggcggt

SEQ ID NO: 2755 - DNA, 24 bp, Artificial Sequence
  Description of Artificial Sequence: Synthetic oligonucleotide
caccaagcgcaactgggaggcggt

SEQ ID NO: 2756 - DNA, 24 bp, Artificial Sequence
  Description of Artificial Sequence: Synthetic oligonucleotide
accaagcgcaactgggaggcggtc

SEQ ID NO: 2757 - DNA, 23 bp, Artificial Sequence
  Description of Artificial Sequence: Synthetic oligonucleotide
ccaagcgcaactgggaggcggtc

SEQ ID NO: 2758 - DNA, 25 bp, Artificial Sequence
  Description of Artificial Sequence: Synthetic oligonucleotide
caagcgcaactgggaggcggtccat

SEQ ID NO: 2759 - DNA, 25 bp, Artificial Sequence
  Description of Artificial Sequence: Synthetic oligonucleotide
aagcgcaactgggaggcggtccatg

SEQ ID NO: 2760 - DNA, 24 bp, Artificial Sequence
  Description of Artificial Sequence: Synthetic oligonucleotide
agcgcaactgggaggcggtccatg

SEQ ID NO: 2761 - DNA, 23 bp, Artificial Sequence
  Description of Artificial Sequence: Synthetic oligonucleotide
gcgcaactgggaggcggtccatg

SEQ ID NO: 2762 - DNA, 23 bp, Artificial Sequence
  Description of Artificial Sequence: Synthetic oligonucleotide
cgcaactgggaggcggtccatgc

SEQ ID NO: 2763 - DNA, 23 bp, Artificial Sequence
  Description of Artificial Sequence: Synthetic oligonucleotide
gcaactgggaggcggtccatgcg

SEQ ID NO: 2764 - DNA, 23 bp, Artificial Sequence
  Description of Artificial Sequence: Synthetic oligonucleotide
caactgggaggcggtccatgcgg

SEQ ID NO: 2765 - DNA, 23 bp, Artificial Sequence
  Description of Artificial Sequence: Synthetic oligonucleotide
aactgggaggcggtccatgcggc

SEQ ID NO: 2766 - DNA, 22 bp, Artificial Sequence
  Description of Artificial Sequence: Synthetic oligonucleotide
actgggaggcggtccatgcggc

SEQ ID NO: 2767 - DNA, 21 bp, Artificial Sequence
  Description of Artificial Sequence: Synthetic oligonucleotide
ctgggaggcggtccatgcggc

SEQ ID NO: 2768 - DNA, 26 bp, Artificial Sequence
  Description of Artificial Sequence: Synthetic oligonucleotide
ggagcagcggagagtctacctggaga

SEQ ID NO: 2769 - DNA, 26 bp, Artificial Sequence
  Description of Artificial Sequence: Synthetic oligonucleotide
gagcagcggagagtctacctggagag

SEQ ID NO: 2770 - DNA, 26 bp, Artificial Sequence
  Description of Artificial Sequence: Synthetic oligonucleotide
agcagcggagagtctacctggagagc

SEQ ID NO: 2771 - DNA, 25 bp, Artificial Sequence
  Description of Artificial Sequence: Synthetic oligonucleotide
gcagcggagagtctacctggagagc

SEQ ID NO: 2772 - DNA, 25 bp, Artificial Sequence
  Description of Artificial Sequence: Synthetic oligonucleotide
cagcggagagtctacctggagagcc

SEQ ID NO: 2773 - DNA, 25 bp, Artificial Sequence
  Description of Artificial Sequence: Synthetic oligonucleotide
agcggagagtctacctggagagccg

SEQ ID NO: 2774 - DNA, 24 bp, Artificial Sequence
  Description of Artificial Sequence: Synthetic oligonucleotide
gcggagagtctacctggagagccg

SEQ ID NO: 2775 - DNA, 25 bp, Artificial Sequence
  Description of Artificial Sequence: Synthetic oligonucleotide
cggagagtctacctggagagccggt

SEQ ID NO: 2776 - DNA, 25 bp, Artificial Sequence
  Description of Artificial Sequence: Synthetic oligonucleotide
ggagagtctacctggagagccggtg

SEQ ID NO: 2777 - DNA, 25 bp, Artificial Sequence
  Description of Artificial Sequence: Synthetic oligonucleotide
gagagtctacctggagagccggtgc

SEQ ID NO: 2778 - DNA, 26 bp, Artificial Sequence
  Description of Artificial Sequence: Synthetic oligonucleotide
agagtctacctggagagccggtgcgt

SEQ ID NO: 2779 - DNA, 25 bp, Artificial Sequence
  Description of Artificial Sequence: Synthetic oligonucleotide
gagtctacctggagagccggtgcgt

SEQ ID NO: 2780 - DNA, 25 bp, Artificial Sequence
  Description of Artificial Sequence: Synthetic oligonucleotide
agtctacctggagagccggtgcgtg

SEQ ID NO: 2781 - DNA, 24 bp, Artificial Sequence
  Description of Artificial Sequence: Synthetic oligonucleotide
gtctacctggagagccggtgcgtg

SEQ ID NO: 2782 - DNA, 25 bp, Artificial Sequence
  Description of Artificial Sequence: Synthetic oligonucleotide
tctacctggagagccggtgcgtgga

SEQ ID NO: 2783 - DNA, 24 bp, Artificial Sequence
  Description of Artificial Sequence: Synthetic oligonucleotide
ctacctggagagccggtgcgtgga

SEQ ID NO: 2784 - DNA, 24 bp, Artificial Sequence
  Description of Artificial Sequence: Synthetic oligonucleotide
tacctggagagccggtgcgtggac

SEQ ID NO: 2785 - DNA, 23 bp, Artificial Sequence
  Description of Artificial Sequence: Synthetic oligonucleotide
acctggagagccggtgcgtggac

SEQ ID NO: 2786 - DNA, 22 bp, Artificial Sequence
  Description of Artificial Sequence: Synthetic oligonucleotide
cctggagagccggtgcgtggac

SEQ ID NO: 2787 - DNA, 22 bp, Artificial Sequence
  Description of Artificial Sequence: Synthetic oligonucleotide
ctggagagccggtgcgtggacg

SEQ ID NO: 2788 - DNA, 22 bp, Artificial Sequence
  Description of Artificial Sequence: Synthetic oligonucleotide
tggagagccggtgcgtggacgg

SEQ ID NO: 2789 - DNA, 21 bp, Artificial Sequence
  Description of Artificial Sequence: Synthetic oligonucleotide
ggagagccggtgcgtggacgg

SEQ ID NO: 2790 - DNA, 21 bp, Artificial Sequence
  Description of Artificial Sequence: Synthetic oligonucleotide
gagagccggtgcgtggacggg

SEQ ID NO: 2791 - DNA, 22 bp, Artificial Sequence
  Description of Artificial Sequence: Synthetic oligonucleotide
agagccggtgcgtggacgggct

SEQ ID NO: 2792 - DNA, 21 bp, Artificial Sequence
  Description of Artificial Sequence: Synthetic oligonucleotide
gagccggtgcgtggacgggct

SEQ ID NO: 2793 - DNA, 21 bp, Artificial Sequence
  Description of Artificial Sequence: Synthetic oligonucleotide
agccggtgcgtggacgggctc

SEQ ID NO: 2794 - DNA, 24 bp, Artificial Sequence
  Description of Artificial Sequence: Synthetic oligonucleotide
ttcctccgcgggtaccggcaggaa

SEQ ID NO: 2795 - DNA, 23 bp, Artificial Sequence
  Description of Artificial Sequence: Synthetic oligonucleotide
tcctccgcgggtaccggcaggaa

SEQ ID NO: 2796 - DNA, 22 bp, Artificial Sequence
  Description of Artificial Sequence: Synthetic oligonucleotide
cctccgcgggtaccggcaggaa

SEQ ID NO: 2797 - DNA, 22 bp, Artificial Sequence
  Description of Artificial Sequence: Synthetic oligonucleotide
ctccgcgggtaccggcaggaag

SEQ ID NO: 2798 - DNA, 22 bp, Artificial Sequence
  Description of Artificial Sequence: Synthetic oligonucleotide
tccgcgggtaccggcaggaagc

SEQ ID NO: 2799 - DNA, 21 bp, Artificial Sequence
  Description of Artificial Sequence: Synthetic oligonucleotide
ccgcgggtaccggcaggaagc

SEQ ID NO: 2800 - DNA, 23 bp, Artificial Sequence
  Description of Artificial Sequence: Synthetic oligonucleotide
cgcgggtaccggcaggaagccta

SEQ ID NO: 2801 - DNA, 23 bp, Artificial Sequence
  Description of Artificial Sequence: Synthetic oligonucleotide
gcgggtaccggcaggaagcctac

SEQ ID NO: 2802 - DNA, 24 bp, Artificial Sequence
  Description of Artificial Sequence: Synthetic oligonucleotide
cgggtaccggcaggaagcctacga

SEQ ID NO: 2803 - DNA, 24 bp, Artificial Sequence
  Description of Artificial Sequence: Synthetic oligonucleotide
gggtaccggcaggaagcctacgac

SEQ ID NO: 2804 - DNA, 24 bp, Artificial Sequence
  Description of Artificial Sequence: Synthetic oligonucleotide
ggtaccggcaggaagcctacgacg

SEQ ID NO: 2805 - DNA, 24 bp, Artificial Sequence
  Description of Artificial Sequence: Synthetic oligonucleotide
gtaccggcaggaagcctacgacgg

SEQ ID NO: 2806 - DNA, 26 bp, Artificial Sequence
  Description of Artificial Sequence: Synthetic oligonucleotide
taccggcaggaagcctacgacggcaa

SEQ ID NO: 2807 - DNA, 25 bp, Artificial Sequence
  Description of Artificial Sequence: Synthetic oligonucleotide
accggcaggaagcctacgacggcaa

SEQ ID NO: 2808 - DNA, 24 bp, Artificial Sequence
  Description of Artificial Sequence: Synthetic oligonucleotide
ccggcaggaagcctacgacggcaa

SEQ ID NO: 2809 - DNA, 24 bp, Artificial Sequence
  Description of Artificial Sequence: Synthetic oligonucleotide
cggcaggaagcctacgacggcaag

SEQ ID NO: 2810 - DNA, 27 bp, Artificial Sequence
  Description of Artificial Sequence: Synthetic oligonucleotide
ggcaggaagcctacgacggcaaggatt

SEQ ID NO: 2811 - DNA, 28 bp, Artificial Sequence
  Description of Artificial Sequence: Synthetic oligonucleotide
gcaggaagcctacgacggcaaggattac

SEQ ID NO: 2812 - DNA, 30 bp, Artificial Sequence
  Description of Artificial Sequence: Synthetic oligonucleotide
caggaagcctacgacggcaaggattacatc

SEQ ID NO: 2813 - DNA, 30 bp, Artificial Sequence
  Description of Artificial Sequence: Synthetic oligonucleotide
aggaagcctacgacggcaaggattacatcg

SEQ ID NO: 2814 - DNA, 29 bp, Artificial Sequence
  Description of Artificial Sequence: Synthetic oligonucleotide
ggaagcctacgacggcaaggattacatcg

SEQ ID NO: 2815 - DNA, 29 bp, Artificial Sequence
  Description of Artificial Sequence: Synthetic oligonucleotide
gaagcctacgacggcaaggattacatcgc

SEQ ID NO: 2816 - DNA, 29 bp, Artificial Sequence
  Description of Artificial Sequence: Synthetic oligonucleotide
aagcctacgacggcaaggattacatcgcc

SEQ ID NO: 2817 - DNA, 28 bp, Artificial Sequence
  Description of Artificial Sequence: Synthetic oligonucleotide
agcctacgacggcaaggattacatcgcc

SEQ ID NO: 2818 - DNA, 24 bp, Artificial Sequence
  Description of Artificial Sequence: Synthetic oligonucleotide
aggaggggccggagtattgggacc

SEQ ID NO: 2819 - DNA, 23 bp, Artificial Sequence
  Description of Artificial Sequence: Synthetic oligonucleotide
ggaggggccggagtattgggacc

SEQ ID NO: 2820 - DNA, 23 bp, Artificial Sequence
  Description of Artificial Sequence: Synthetic oligonucleotide
gaggggccggagtattgggaccg

SEQ ID NO: 2821 - DNA, 25 bp, Artificial Sequence
  Description of Artificial Sequence: Synthetic oligonucleotide
aggggccggagtattgggaccggaa

SEQ ID NO: 2822 - DNA, 24 bp, Artificial Sequence
  Description of Artificial Sequence: Synthetic oligonucleotide
ggggccggagtattgggaccggaa

SEQ ID NO: 2823 - DNA, 25 bp, Artificial Sequence
  Description of Artificial Sequence: Synthetic oligonucleotide
gggccggagtattgggaccggaaca

SEQ ID NO: 2824 - DNA, 26 bp, Artificial Sequence
  Description of Artificial Sequence: Synthetic oligonucleotide
ggccggagtattgggaccggaacaca

SEQ ID NO: 2825 - DNA, 26 bp, Artificial Sequence
  Description of Artificial Sequence: Synthetic oligonucleotide
gccggagtattgggaccggaacacac

SEQ ID NO: 2826 - DNA, 26 bp, Artificial Sequence
  Description of Artificial Sequence: Synthetic oligonucleotide
ccggagtattgggaccggaacacacg

SEQ ID NO: 2827 - DNA, 27 bp, Artificial Sequence
  Description of Artificial Sequence: Synthetic oligonucleotide
cggagtattgggaccggaacacacgga

SEQ ID NO: 2828 - DNA, 29 bp, Artificial Sequence
  Description of Artificial Sequence: Synthetic oligonucleotide
ggagtattgggaccggaacacacggaatg

SEQ ID NO: 2829 - DNA, 30 bp, Artificial Sequence
  Description of Artificial Sequence: Synthetic oligonucleotide
gagtattgggaccggaacacacggaatgtg

SEQ ID NO: 2830 - DNA, 32 bp, Artificial Sequence
  Description of Artificial Sequence: Synthetic oligonucleotide
agtattgggaccggaacacacggaatgtgaag

SEQ ID NO: 2831 - DNA, 31 bp, Artificial Sequence
  Description of Artificial Sequence: Synthetic oligonucleotide
gtattgggaccggaacacacggaatgtgaag

SEQ ID NO: 2832 - DNA, 31 bp, Artificial Sequence
  Description of Artificial Sequence: Synthetic oligonucleotide
tattgggaccggaacacacggaatgtgaagg

SEQ ID NO: 2833 - DNA, 30 bp, Artificial Sequence
  Description of Artificial Sequence: Synthetic oligonucleotide
attgggaccggaacacacggaatgtgaagg

SEQ ID NO: 2834 - DNA, 29 bp, Artificial Sequence
  Description of Artificial Sequence: Synthetic oligonucleotide
ttgggaccggaacacacggaatgtgaagg

SEQ ID NO: 2835 - DNA, 28 bp, Artificial Sequence
  Description of Artificial Sequence: Synthetic oligonucleotide
tgggaccggaacacacggaatgtgaagg

SEQ ID NO: 2836 - DNA, 27 bp, Artificial Sequence
  Description of Artificial Sequence: Synthetic oligonucleotide
gggaccggaacacacggaatgtgaagg

SEQ ID NO: 2837 - DNA, 27 bp, Artificial Sequence
  Description of Artificial Sequence: Synthetic oligonucleotide
ggaccggaacacacggaatgtgaaggc

SEQ ID NO: 2838 - DNA, 27 bp, Artificial Sequence
  Description of Artificial Sequence: Synthetic oligonucleotide
gaccggaacacacggaatgtgaaggcc

SEQ ID NO: 2839 - DNA, 27 bp, Artificial Sequence
  Description of Artificial Sequence: Synthetic oligonucleotide
accggaacacacggaatgtgaaggccc

SEQ ID NO: 2840 - DNA, 27 bp, Artificial Sequence
  Description of Artificial Sequence: Synthetic oligonucleotide
ccggaacacacggaatgtgaaggccca

SEQ ID NO: 2841 - DNA, 27 bp, Artificial Sequence
  Description of Artificial Sequence: Synthetic oligonucleotide
cggaacacacggaatgtgaaggcccac

SEQ ID NO: 2842 - DNA, 28 bp, Artificial Sequence
  Description of Artificial Sequence: Synthetic oligonucleotide
ggaacacacggaatgtgaaggcccactc

SEQ ID NO: 2843 - DNA, 29 bp, Artificial Sequence
  Description of Artificial Sequence: Synthetic oligonucleotide
gaacacacggaatgtgaaggcccactcac

SEQ ID NO: 2844 - DNA, 30 bp, Artificial Sequence
  Description of Artificial Sequence: Synthetic oligonucleotide
aacacacggaatgtgaaggcccactcacag

SEQ ID NO: 2845 - DNA, 29 bp, Artificial Sequence
  Description of Artificial Sequence: Synthetic oligonucleotide
acacacggaatgtgaaggcccactcacag

SEQ ID NO: 2846 - DNA, 28 bp, Artificial Sequence
  Description of Artificial Sequence: Synthetic oligonucleotide
cacacggaatgtgaaggcccactcacag

SEQ ID NO: 2847 - DNA, 26 bp, Artificial Sequence
  Description of Artificial Sequence: Synthetic oligonucleotide
gccctgaacgaggacctgcgctctta

SEQ ID NO: 2848 - DNA, 27 bp, Artificial Sequence
  Description of Artificial Sequence: Synthetic oligonucleotide
ccctgaacgaggacctgcgctcttaga

SEQ ID NO: 2849 - DNA, 27 bp, Artificial Sequence
  Description of Artificial Sequence: Synthetic oligonucleotide
cctgaacgaggacctgcgctcttagac

SEQ ID NO: 2850 - DNA, 27 bp, Artificial Sequence
  Description of Artificial Sequence: Synthetic oligonucleotide
ctgaacgaggacctgcgctcttagacc

SEQ ID NO: 2851 - DNA, 27 bp, Artificial Sequence
  Description of Artificial Sequence: Synthetic oligonucleotide
tgaacgaggacctgcgctcttagaccg

SEQ ID NO: 2852 - DNA, 26 bp, Artificial Sequence
  Description of Artificial Sequence: Synthetic oligonucleotide
gaacgaggacctgcgctcttagaccg

SEQ ID NO: 2853 - DNA, 26 bp, Artificial Sequence
  Description of Artificial Sequence: Synthetic oligonucleotide
aacgaggacctgcgctcttagaccgc

SEQ ID NO: 2854 - DNA, 25 bp, Artificial Sequence
  Description of Artificial Sequence: Synthetic oligonucleotide
acgaggacctgcgctcttagaccgc

SEQ ID NO: 2855 - DNA, 24 bp, Artificial Sequence
  Description of Artificial Sequence: Synthetic oligonucleotide
cgaggacctgcgctcttagaccgc

SEQ ID NO: 2856 - DNA, 24 bp, Artificial Sequence
  Description of Artificial Sequence: Synthetic oligonucleotide
gaggacctgcgctcttagaccgcg

SEQ ID NO: 2857 - DNA, 24 bp, Artificial Sequence
  Description of Artificial Sequence: Synthetic oligonucleotide
aggacctgcgctcttagaccgcgg

SEQ ID NO: 2858 - DNA, 23 bp, Artificial Sequence
  Description of Artificial Sequence: Synthetic oligonucleotide
ggacctgcgctcttagaccgcgg

SEQ ID NO: 2859 - DNA, 23 bp, Artificial Sequence
  Description of Artificial Sequence: Synthetic oligonucleotide
gacctgcgctcttagaccgcggc

SEQ ID NO: 2860 - DNA, 23 bp, Artificial Sequence
  Description of Artificial Sequence: Synthetic oligonucleotide
acctgcgctcttagaccgcggcg

SEQ ID NO: 2861 - DNA, 22 bp, Artificial Sequence
  Description of Artificial Sequence: Synthetic oligonucleotide
cctgcgctcttagaccgcggcg

SEQ ID NO: 2862 - DNA, 23 bp, Artificial Sequence
  Description of Artificial Sequence: Synthetic oligonucleotide
ctgcgctcttagaccgcggcgga

SEQ ID NO: 2863 - DNA, 25 bp, Artificial Sequence
  Description of Artificial Sequence: Synthetic oligonucleotide
tgcgctcttagaccgcggcggacat

SEQ ID NO: 2864 - DNA, 24 bp, Artificial Sequence
  Description of Artificial Sequence: Synthetic oligonucleotide
gcgctcttagaccgcggcggacat

SEQ ID NO: 2865 - DNA, 24 bp, Artificial Sequence
  Description of Artificial Sequence: Synthetic oligonucleotide
cgctcttagaccgcggcggacatg

SEQ ID NO: 2866 - DNA, 24 bp, Artificial Sequence
  Description of Artificial Sequence: Synthetic oligonucleotide
gctcttagaccgcggcggacatgg

SEQ ID NO: 2867 - DNA, 25 bp, Artificial Sequence
  Description of Artificial Sequence: Synthetic oligonucleotide
ctcttagaccgcggcggacatggca

SEQ ID NO: 2868 - DNA, 25 bp, Artificial Sequence
  Description of Artificial Sequence: Synthetic oligonucleotide
tcttagaccgcggcggacatggcag

SEQ ID NO: 2869 - DNA, 24 bp, Artificial Sequence
  Description of Artificial Sequence: Synthetic oligonucleotide
cttagaccgcggcggacatggcag

SEQ ID NO: 2870 - DNA, 25 bp, Artificial Sequence
  Description of Artificial Sequence: Synthetic oligonucleotide
ttagaccgcggcggacatggcagct

SEQ ID NO: 2871 - DNA, 24 bp, Artificial Sequence
  Description of Artificial Sequence: Synthetic oligonucleotide
tagaccgcggcggacatggcagct

SEQ ID NO: 2872 - DNA, 23 bp, Artificial Sequence
  Description of Artificial Sequence: Synthetic oligonucleotide
agaccgcggcggacatggcagct

SEQ ID NO: 2873 - DNA, 26 bp, Artificial Sequence
  Description of Artificial Sequence: Synthetic oligonucleotide
atgcggcggagcagcggagagtctaa

SEQ ID NO: 2874 - DNA, 25 bp, Artificial Sequence
  Description of Artificial Sequence: Synthetic oligonucleotide
tgcggcggagcagcggagagtctaa

SEQ ID NO: 2875 - DNA, 24 bp, Artificial Sequence
  Description of Artificial Sequence: Synthetic oligonucleotide
gcggcggagcagcggagagtctaa

SEQ ID NO: 2876 - DNA, 25 bp, Artificial Sequence
  Description of Artificial Sequence: Synthetic oligonucleotide
cggcggagcagcggagagtctaact

SEQ ID NO: 2877 - DNA, 25 bp, Artificial Sequence
  Description of Artificial Sequence: Synthetic oligonucleotide
ggcggagcagcggagagtctaactg

SEQ ID NO: 2878 - DNA, 26 bp, Artificial Sequence
  Description of Artificial Sequence: Synthetic oligonucleotide
gcggagcagcggagagtctaactgga

SEQ ID NO: 2879 - DNA, 26 bp, Artificial Sequence
  Description of Artificial Sequence: Synthetic oligonucleotide
cggagcagcggagagtctaactggag

SEQ ID NO: 2880 - DNA, 26 bp, Artificial Sequence
  Description of Artificial Sequence: Synthetic oligonucleotide
ggagcagcggagagtctaactggagg

SEQ ID NO: 2881 - DNA, 26 bp, Artificial Sequence
  Description of Artificial Sequence: Synthetic oligonucleotide
gagcagcggagagtctaactggaggg

SEQ ID NO: 2882 - DNA, 26 bp, Artificial Sequence
  Description of Artificial Sequence: Synthetic oligonucleotide
agcagcggagagtctaactggagggc

SEQ ID NO: 2883 - DNA, 25 bp, Artificial Sequence
  Description of Artificial Sequence: Synthetic oligonucleotide
gcagcggagagtctaactggagggc

SEQ ID NO: 2884 - DNA, 25 bp, Artificial Sequence
  Description of Artificial Sequence: Synthetic oligonucleotide
cagcggagagtctaactggagggcc

SEQ ID NO: 2885 - DNA, 25 bp, Artificial Sequence
  Description of Artificial Sequence: Synthetic oligonucleotide
agcggagagtctaactggagggccg

SEQ ID NO: 2886 - DNA, 24 bp, Artificial Sequence
  Description of Artificial Sequence: Synthetic oligonucleotide
gcggagagtctaactggagggccg

SEQ ID NO: 2887 - DNA, 25 bp, Artificial Sequence
  Description of Artificial Sequence: Synthetic oligonucleotide
cggagagtctaactggagggccggt

SEQ ID NO: 2888 - DNA, 25 bp, Artificial Sequence
  Description of Artificial Sequence: Synthetic oligonucleotide
ggagagtctaactggagggccggtg

SEQ ID NO: 2889 - DNA, 25 bp, Artificial Sequence
  Description of Artificial Sequence: Synthetic oligonucleotide
gagagtctaactggagggccggtgc

SEQ ID NO: 2890 - DNA, 26 bp, Artificial Sequence
  Description of Artificial Sequence: Synthetic oligonucleotide
agagtctaactggagggccggtgcgt

SEQ ID NO: 2891 - DNA, 25 bp, Artificial Sequence
  Description of Artificial Sequence: Synthetic oligonucleotide
gagtctaactggagggccggtgcgt

SEQ ID NO: 2892 - DNA, 25 bp, Artificial Sequence
  Description of Artificial Sequence: Synthetic oligonucleotide
agtctaactggagggccggtgcgtg

SEQ ID NO: 2893 - DNA, 24 bp, Artificial Sequence
  Description of Artificial Sequence: Synthetic oligonucleotide
gtctaactggagggccggtgcgtg

SEQ ID NO: 2894 - DNA, 25 bp, Artificial Sequence
  Description of Artificial Sequence: Synthetic oligonucleotide
tctaactggagggccggtgcgtgga

SEQ ID NO: 2895 - DNA, 24 bp, Artificial Sequence
  Description of Artificial Sequence: Synthetic oligonucleotide
ctaactggagggccggtgcgtgga

SEQ ID NO: 2896 - DNA, 24 bp, Artificial Sequence
  Description of Artificial Sequence: Synthetic oligonucleotide
taactggagggccggtgcgtggac

SEQ ID NO: 2897 - DNA, 23 bp, Artificial Sequence
  Description of Artificial Sequence: Synthetic oligonucleotide
aactggagggccggtgcgtggac

SEQ ID NO: 2898 - DNA, 22 bp, Artificial Sequence
  Description of Artificial Sequence: Synthetic oligonucleotide
actggagggccggtgcgtggac

SEQ ID NO: 2899 - DNA, 29 bp, Artificial Sequence
  Description of Artificial Sequence: Synthetic oligonucleotide
aaggattacatcgccctgaacgaggaccg

SEQ ID NO: 2900 - DNA, 28 bp, Artificial Sequence
  Description of Artificial Sequence: Synthetic oligonucleotide
aggattacatcgccctgaacgaggaccg

SEQ ID NO: 2901 - DNA, 27 bp, Artificial Sequence
  Description of Artificial Sequence: Synthetic oligonucleotide
ggattacatcgccctgaacgaggaccg

SEQ ID NO: 2902 - DNA, 27 bp, Artificial Sequence
  Description of Artificial Sequence: Synthetic oligonucleotide
gattacatcgccctgaacgaggaccgg

SEQ ID NO: 2903 - DNA, 27 bp, Artificial Sequence
  Description of Artificial Sequence: Synthetic oligonucleotide
attacatcgccctgaacgaggaccggc

SEQ ID NO: 2904 - DNA, 26 bp, Artificial Sequence
  Description of Artificial Sequence: Synthetic oligonucleotide
ttacatcgccctgaacgaggaccggc

SEQ ID NO: 2905 - DNA, 25 bp, Artificial Sequence
  Description of Artificial Sequence: Synthetic oligonucleotide
tacatcgccctgaacgaggaccggc

SEQ ID NO: 2906 - DNA, 24 bp, Artificial Sequence
  Description of Artificial Sequence: Synthetic oligonucleotide
acatcgccctgaacgaggaccggc

SEQ ID NO: 2907 - DNA, 23 bp, Artificial Sequence
  Description of Artificial Sequence: Synthetic oligonucleotide
catcgccctgaacgaggaccggc

SEQ ID NO: 2908 - DNA, 23 bp, Artificial Sequence
  Description of Artificial Sequence: Synthetic oligonucleotide
atcgccctgaacgaggaccggcg

SEQ ID NO: 2909 - DNA, 22 bp, Artificial Sequence
  Description of Artificial Sequence: Synthetic oligonucleotide
tcgccctgaacgaggaccggcg

SEQ ID NO: 2910 - DNA, 21 bp, Artificial Sequence
  Description of Artificial Sequence: Synthetic oligonucleotide
cgccctgaacgaggaccggcg

SEQ ID NO: 2911 - DNA, 22 bp, Artificial Sequence
  Description of Artificial Sequence: Synthetic oligonucleotide
gccctgaacgaggaccggcgct

SEQ ID NO: 2912 - DNA, 24 bp, Artificial Sequence
  Description of Artificial Sequence: Synthetic oligonucleotide
ccctgaacgaggaccggcgctctt

SEQ ID NO: 2913 - DNA, 24 bp, Artificial Sequence
  Description of Artificial Sequence: Synthetic oligonucleotide
cctgaacgaggaccggcgctcttg

SEQ ID NO: 2914 - DNA, 25 bp, Artificial Sequence
  Description of Artificial Sequence: Synthetic oligonucleotide
ctgaacgaggaccggcgctcttgga

SEQ ID NO: 2915 - DNA, 25 bp, Artificial Sequence
  Description of Artificial Sequence: Synthetic oligonucleotide
tgaacgaggaccggcgctcttggac

SEQ ID NO: 2916 - DNA, 24 bp, Artificial Sequence
  Description of Artificial Sequence: Synthetic oligonucleotide
gaacgaggaccggcgctcttggac

SEQ ID NO: 2917 - DNA, 24 bp, Artificial Sequence
  Description of Artificial Sequence: Synthetic oligonucleotide
aacgaggaccggcgctcttggacc

SEQ ID NO: 2918 - DNA, 23 bp, Artificial Sequence
  Description of Artificial Sequence: Synthetic oligonucleotide
acgaggaccggcgctcttggacc

SEQ ID NO: 2919 - DNA, 22 bp, Artificial Sequence
  Description of Artificial Sequence: Synthetic oligonucleotide
cgaggaccggcgctcttggacc

SEQ ID NO: 2920 - DNA, 22 bp, Artificial Sequence
  Description of Artificial Sequence: Synthetic oligonucleotide
gaggaccggcgctcttggaccg

SEQ ID NO: 2921 - DNA, 22 bp, Artificial Sequence
  Description of Artificial Sequence: Synthetic oligonucleotide
aggaccggcgctcttggaccgc

SEQ ID NO: 2922 - DNA, 21 bp, Artificial Sequence
  Description of Artificial Sequence: Synthetic oligonucleotide
ggaccggcgctcttggaccgc

SEQ ID NO: 2923 - DNA, 21 bp, Artificial Sequence
  Description of Artificial Sequence: Synthetic oligonucleotide
gaccggcgctcttggaccgcg

SEQ ID NO: 2924 - DNA, 21 bp, Artificial Sequence
  Description of Artificial Sequence: Synthetic oligonucleotide
accggcgctcttggaccgcgg

SEQ ID NO: 2925 - DNA, 20 bp, Artificial Sequence
  Description of Artificial Sequence: Synthetic oligonucleotide
ccggcgctcttggaccgcgg

SEQ ID NO: 2926 - DNA, 20 bp, Artificial Sequence
  Description of Artificial Sequence: Synthetic oligonucleotide
cggcgctcttggaccgcggc

SEQ ID NO: 2927 - DNA, 20 bp, Artificial Sequence
  Description of Artificial Sequence: Synthetic oligonucleotide
ggcgctcttggaccgcggcg

SEQ ID NO: 2928 - DNA, 29 bp, Artificial Sequence
  Description of Artificial Sequence: Synthetic oligonucleotide
ctactacaaccagagcgaggacggttctg

SEQ ID NO: 2929 - DNA, 30 bp, Artificial Sequence
  Description of Artificial Sequence: Synthetic oligonucleotide
tactacaaccagagcgaggacggttctgac

SEQ ID NO: 2930 - DNA, 29 bp, Artificial Sequence
  Description of Artificial Sequence: Synthetic oligonucleotide
actacaaccagagcgaggacggttctgac

SEQ ID NO: 2931 - DNA, 28 bp, Artificial Sequence
  Description of Artificial Sequence: Synthetic oligonucleotide
ctacaaccagagcgaggacggttctgac

SEQ ID NO: 2932 - DNA, 29 bp, Artificial Sequence
  Description of Artificial Sequence: Synthetic oligonucleotide
tacaaccagagcgaggacggttctgacac

SEQ ID NO: 2933 - DNA, 28 bp, Artificial Sequence
  Description of Artificial Sequence: Synthetic oligonucleotide
acaaccagagcgaggacggttctgacac

SEQ ID NO: 2934 - DNA, 27 bp, Artificial Sequence
  Description of Artificial Sequence: Synthetic oligonucleotide
caaccagagcgaggacggttctgacac

SEQ ID NO: 2935 - DNA, 27 bp, Artificial Sequence
  Description of Artificial Sequence: Synthetic oligonucleotide
aaccagagcgaggacggttctgacacc

SEQ ID NO: 2936 - DNA, 27 bp, Artificial Sequence
  Description of Artificial Sequence: Synthetic oligonucleotide
accagagcgaggacggttctgacacca

SEQ ID NO: 2937 - DNA, 27 bp, Artificial Sequence
  Description of Artificial Sequence: Synthetic oligonucleotide
ccagagcgaggacggttctgacaccat

SEQ ID NO: 2938 - DNA, 27 bp, Artificial Sequence
  Description of Artificial Sequence: Synthetic oligonucleotide
cagagcgaggacggttctgacaccatc

SEQ ID NO: 2939 - DNA, 27 bp, Artificial Sequence
  Description of Artificial Sequence: Synthetic oligonucleotide
agagcgaggacggttctgacaccatcc

SEQ ID NO: 2940 - DNA, 27 bp, Artificial Sequence
  Description of Artificial Sequence: Synthetic oligonucleotide
gagcgaggacggttctgacaccatcca

SEQ ID NO: 2941 - DNA, 27 bp, Artificial Sequence
  Description of Artificial Sequence: Synthetic oligonucleotide
agcgaggacggttctgacaccatccag

SEQ ID NO: 2942 - DNA, 27 bp, Artificial Sequence
  Description of Artificial Sequence: Synthetic oligonucleotide
gcgaggacggttctgacaccatccaga

SEQ ID NO: 2943 - DNA, 31 bp, Artificial Sequence
  Description of Artificial Sequence: Synthetic oligonucleotide
cgaggacggttctgacaccatccagataatg

SEQ ID NO: 2944 - DNA, 34 bp, Artificial Sequence
  Description of Artificial Sequence: Synthetic oligonucleotide
gaggacggttctgacaccatccagataatgtatg

SEQ ID NO: 2945 - DNA, 34 bp, Artificial Sequence
  Description of Artificial Sequence: Synthetic oligonucleotide
aggacggttctgacaccatccagataatgtatgg

SEQ ID NO: 2946 - DNA, 33 bp, Artificial Sequence
  Description of Artificial Sequence: Synthetic oligonucleotide
ggacggttctgacaccatccagataatgtatgg

SEQ ID NO: 2947 - DNA, 33 bp, Artificial Sequence
  Description of Artificial Sequence: Synthetic oligonucleotide
gacggttctgacaccatccagataatgtatggc

SEQ ID NO: 2948 - DNA, 34 bp, Artificial Sequence
  Description of Artificial Sequence: Synthetic oligonucleotide
acggttctgacaccatccagataatgtatggctg

SEQ ID NO: 2949 - DNA, 33 bp, Artificial Sequence
  Description of Artificial Sequence: Synthetic oligonucleotide
cggttctgacaccatccagataatgtatggctg

SEQ ID NO: 2950 - DNA, 33 bp, Artificial Sequence
  Description of Artificial Sequence: Synthetic oligonucleotide
ggttctgacaccatccagataatgtatggctgc

SEQ ID NO: 2951 - DNA, 33 bp, Artificial Sequence
  Description of Artificial Sequence: Synthetic oligonucleotide
gttctgacaccatccagataatgtatggctgcg

SEQ ID NO: 2952 - DNA, 34 bp, Artificial Sequence
  Description of Artificial Sequence: Synthetic oligonucleotide
ttctgacaccatccagataatgtatggctgcgac

SEQ ID NO: 2953 - DNA, 33 bp, Artificial Sequence
  Description of Artificial Sequence: Synthetic oligonucleotide
tctgacaccatccagataatgtatggctgcgac

SEQ ID NO: 2954 - DNA, 32 bp, Artificial Sequence
  Description of Artificial Sequence: Synthetic oligonucleotide
ctgacaccatccagataatgtatggctgcgac

SEQ ID NO: 2955 - DNA, 32 bp, Artificial Sequence
  Description of Artificial Sequence: Synthetic oligonucleotide
tgacaccatccagataatgtatggctgcgacg

SEQ ID NO: 2956 - DNA, 31 bp, Artificial Sequence
  Description of Artificial Sequence: Synthetic oligonucleotide
gacaccatccagataatgtatggctgcgacg

SEQ ID NO: 2957 - DNA, 28 bp, Artificial Sequence
  Description of Artificial Sequence: Synthetic oligonucleotide
taccctgcggagatcacactgacctgac

SEQ ID NO: 2958 - DNA, 27 bp, Artificial Sequence
  Description of Artificial Sequence: Synthetic oligonucleotide
accctgcggagatcacactgacctgac

SEQ ID NO: 2959 - DNA, 27 bp, Artificial Sequence
  Description of Artificial Sequence: Synthetic oligonucleotide
ccctgcggagatcacactgacctgaca

SEQ ID NO: 2960 - DNA, 27 bp, Artificial Sequence
  Description of Artificial Sequence: Synthetic oligonucleotide
cctgcggagatcacactgacctgacag

SEQ ID NO: 2961 - DNA, 27 bp, Artificial Sequence
  Description of Artificial Sequence: Synthetic oligonucleotide
ctgcggagatcacactgacctgacagc

SEQ ID NO: 2962 - DNA, 27 bp, Artificial Sequence
  Description of Artificial Sequence: Synthetic oligonucleotide
tgcggagatcacactgacctgacagcg

SEQ ID NO: 2963 - DNA, 26 bp, Artificial Sequence
  Description of Artificial Sequence: Synthetic oligonucleotide
gcggagatcacactgacctgacagcg

SEQ ID NO: 2964 - DNA, 26 bp, Artificial Sequence
  Description of Artificial Sequence: Synthetic oligonucleotide
cggagatcacactgacctgacagcgg

SEQ ID NO: 2965 - DNA, 27 bp, Artificial Sequence
  Description of Artificial Sequence: Synthetic oligonucleotide
ggagatcacactgacctgacagcggga

SEQ ID NO: 2966 - DNA, 28 bp, Artificial Sequence
  Description of Artificial Sequence: Synthetic oligonucleotide
gagatcacactgacctgacagcgggatg

SEQ ID NO: 2967 - DNA, 28 bp, Artificial Sequence
  Description of Artificial Sequence: Synthetic oligonucleotide
agatcacactgacctgacagcgggatgg

SEQ ID NO: 2968 - DNA, 27 bp, Artificial Sequence
  Description of Artificial Sequence: Synthetic oligonucleotide
gatcacactgacctgacagcgggatgg

SEQ ID NO: 2969 - DNA, 27 bp, Artificial Sequence
  Description of Artificial Sequence: Synthetic oligonucleotide
atcacactgacctgacagcgggatggg

SEQ ID NO: 2970 - DNA, 26 bp, Artificial Sequence
  Description of Artificial Sequence: Synthetic oligonucleotide
tcacactgacctgacagcgggatggg

SEQ ID NO: 2971 - DNA, 25 bp, Artificial Sequence
  Description of Artificial Sequence: Synthetic oligonucleotide
cacactgacctgacagcgggatggg

SEQ ID NO: 2972 - DNA, 26 bp, Artificial Sequence
  Description of Artificial Sequence: Synthetic oligonucleotide
acactgacctgacagcgggatgggga

SEQ ID NO: 2973 - DNA, 25 bp, Artificial Sequence
  Description of Artificial Sequence: Synthetic oligonucleotide
cactgacctgacagcgggatgggga

SEQ ID NO: 2974 - DNA, 25 bp, Artificial Sequence
  Description of Artificial Sequence: Synthetic oligonucleotide
actgacctgacagcgggatggggag

SEQ ID NO: 2975 - DNA, 24 bp, Artificial Sequence
  Description of Artificial Sequence: Synthetic oligonucleotide
ctgacctgacagcgggatggggag

SEQ ID NO: 2976 - DNA, 25 bp, Artificial Sequence
  Description of Artificial Sequence: Synthetic oligonucleotide
tgacctgacagcgggatggggagga

SEQ ID NO: 2977 - DNA, 24 bp, Artificial Sequence
  Description of Artificial Sequence: Synthetic oligonucleotide
gacctgacagcgggatggggagga

SEQ ID NO: 2978 - DNA, 24 bp, Artificial Sequence
  Description of Artificial Sequence: Synthetic oligonucleotide
acctgacagcgggatggggaggac

SEQ ID NO: 2979 - DNA, 23 bp, Artificial Sequence
  Description of Artificial Sequence: Synthetic oligonucleotide
cctgacagcgggatggggaggac

SEQ ID NO: 2980 - DNA, 24 bp, Artificial Sequence
  Description of Artificial Sequence: Synthetic oligonucleotide
ctgacagcgggatggggaggacca

SEQ ID NO: 2981 - DNA, 25 bp, Artificial Sequence
  Description of Artificial Sequence: Synthetic oligonucleotide
tgacagcgggatggggaggaccaga

SEQ ID NO: 2982 - DNA, 24 bp, Artificial Sequence
  Description of Artificial Sequence: Synthetic oligonucleotide
gacagcgggatggggaggaccaga

SEQ ID NO: 2983 - DNA, 24 bp, Artificial Sequence
  Description of Artificial Sequence: Synthetic oligonucleotide
acagcgggatggggaggaccagac

SEQ ID NO: 2984 - DNA, 30 bp, Artificial Sequence
  Description of Artificial Sequence: Synthetic oligonucleotide
gacggcaaggattacatcgccctgaactag

SEQ ID NO: 2985 - DNA, 30 bp, Artificial Sequence
  Description of Artificial Sequence: Synthetic oligonucleotide
acggcaaggattacatcgccctgaactagg

SEQ ID NO: 2986 - DNA, 29 bp, Artificial Sequence
  Description of Artificial Sequence: Synthetic oligonucleotide
cggcaaggattacatcgccctgaactagg

SEQ ID NO: 2987 - DNA, 30 bp, Artificial Sequence
  Description of Artificial Sequence: Synthetic oligonucleotide
ggcaaggattacatcgccctgaactaggac

SEQ ID NO: 2988 - DNA, 30 bp, Artificial Sequence
  Description of Artificial Sequence: Synthetic oligonucleotide
gcaaggattacatcgccctgaactaggacc

SEQ ID NO: 2989 - DNA, 31 bp, Artificial Sequence
  Description of Artificial Sequence: Synthetic oligonucleotide
caaggattacatcgccctgaactaggacctg

SEQ ID NO: 2990 - DNA, 31 bp, Artificial Sequence
  Description of Artificial Sequence: Synthetic oligonucleotide
aaggattacatcgccctgaactaggacctgc

SEQ ID NO: 2991 - DNA, 30 bp, Artificial Sequence
  Description of Artificial Sequence: Synthetic oligonucleotide
aggattacatcgccctgaactaggacctgc

SEQ ID NO: 2992 - DNA, 29 bp, Artificial Sequence
  Description of Artificial Sequence: Synthetic oligonucleotide
ggattacatcgccctgaactaggacctgc

SEQ ID NO: 2993 - DNA, 29 bp, Artificial Sequence
  Description of Artificial Sequence: Synthetic oligonucleotide
gattacatcgccctgaactaggacctgcg

SEQ ID NO: 2994 - DNA, 29 bp, Artificial Sequence
  Description of Artificial Sequence: Synthetic oligonucleotide
attacatcgccctgaactaggacctgcgc

SEQ ID NO: 2995 - DNA, 28 bp, Artificial Sequence
  Description of Artificial Sequence: Synthetic oligonucleotide
ttacatcgccctgaactaggacctgcgc

SEQ ID NO: 2996 - DNA, 27 bp, Artificial Sequence
  Description of Artificial Sequence: Synthetic oligonucleotide
tacatcgccctgaactaggacctgcgc

SEQ ID NO: 2997 - DNA, 27 bp, Artificial Sequence
  Description of Artificial Sequence: Synthetic oligonucleotide
acatcgccctgaactaggacctgcgct

SEQ ID NO: 2998 - DNA, 26 bp, Artificial Sequence
  Description of Artificial Sequence: Synthetic oligonucleotide
catcgccctgaactaggacctgcgct

SEQ ID NO: 2999 - DNA, 27 bp, Artificial Sequence
  Description of Artificial Sequence: Synthetic oligonucleotide
atcgccctgaactaggacctgcgctct

SEQ ID NO: 3000 - DNA, 27 bp, Artificial Sequence
  Description of Artificial Sequence: Synthetic oligonucleotide
tcgccctgaactaggacctgcgctctt

SEQ ID NO: 3001 - DNA, 26 bp, Artificial Sequence
  Description of Artificial Sequence: Synthetic oligonucleotide
cgccctgaactaggacctgcgctctt

SEQ ID NO: 3002 - DNA, 26 bp, Artificial Sequence
  Description of Artificial Sequence: Synthetic oligonucleotide
gccctgaactaggacctgcgctcttg

SEQ ID NO: 3003 - DNA, 27 bp, Artificial Sequence
  Description of Artificial Sequence: Synthetic oligonucleotide
ccctgaactaggacctgcgctcttgga

SEQ ID NO: 3004 - DNA, 27 bp, Artificial Sequence
  Description of Artificial Sequence: Synthetic oligonucleotide
cctgaactaggacctgcgctcttggac

SEQ ID NO: 3005 - DNA, 27 bp, Artificial Sequence
  Description of Artificial Sequence: Synthetic oligonucleotide
ctgaactaggacctgcgctcttggacc

SEQ ID NO: 3006 - DNA, 27 bp, Artificial Sequence
  Description of Artificial Sequence: Synthetic oligonucleotide
tgaactaggacctgcgctcttggaccg

SEQ ID NO: 3007 - DNA, 26 bp, Artificial Sequence
  Description of Artificial Sequence: Synthetic oligonucleotide
gaactaggacctgcgctcttggaccg

SEQ ID NO: 3008 - DNA, 26 bp, Artificial Sequence
  Description of Artificial Sequence: Synthetic oligonucleotide
aactaggacctgcgctcttggaccgc

SEQ ID NO: 3009 - DNA, 25 bp, Artificial Sequence
  Description of Artificial Sequence: Synthetic oligonucleotide
actaggacctgcgctcttggaccgc

SEQ ID NO: 3010 - DNA, 24 bp, Artificial Sequence
  Description of Artificial Sequence: Synthetic oligonucleotide
ctaggacctgcgctcttggaccgc

SEQ ID NO: 3011 - DNA, 24 bp, Artificial Sequence
  Description of Artificial Sequence: Synthetic oligonucleotide
taggacctgcgctcttggaccgcg

SEQ ID NO: 3012 - DNA, 27 bp, Artificial Sequence
  Description of Artificial Sequence: Synthetic oligonucleotide
cgtgggctacgtggacgacacgcattt

SEQ ID NO: 3013 - DNA, 27 bp, Artificial Sequence
  Description of Artificial Sequence: Synthetic oligonucleotide
gtgggctacgtggacgacacgcatttc

SEQ ID NO: 3014 - DNA, 27 bp, Artificial Sequence
  Description of Artificial Sequence: Synthetic oligonucleotide
tgggctacgtggacgacacgcatttcg

SEQ ID NO: 3015 - DNA, 27 bp, Artificial Sequence
  Description of Artificial Sequence: Synthetic oligonucleotide
gggctacgtggacgacacgcatttcgt

SEQ ID NO: 3016 - DNA, 27 bp, Artificial Sequence
  Description of Artificial Sequence: Synthetic oligonucleotide
ggctacgtggacgacacgcatttcgtg

SEQ ID NO: 3017 - DNA, 27 bp, Artificial Sequence
  Description of Artificial Sequence: Synthetic oligonucleotide
gctacgtggacgacacgcatttcgtgc

SEQ ID NO: 3018 - DNA, 27 bp, Artificial Sequence
  Description of Artificial Sequence: Synthetic oligonucleotide
ctacgtggacgacacgcatttcgtgcg

SEQ ID NO: 3019 - DNA, 27 bp, Artificial Sequence
  Description of Artificial Sequence: Synthetic oligonucleotide
tacgtggacgacacgcatttcgtgcgg

SEQ ID NO: 3020 - DNA, 27 bp, Artificial Sequence
  Description of Artificial Sequence: Synthetic oligonucleotide
acgtggacgacacgcatttcgtgcggt

SEQ ID NO: 3021 - DNA, 27 bp, Artificial Sequence
  Description of Artificial Sequence: Synthetic oligonucleotide
cgtggacgacacgcatttcgtgcggtt

SEQ ID NO: 3022 - DNA, 27 bp, Artificial Sequence
  Description of Artificial Sequence: Synthetic oligonucleotide
gtggacgacacgcatttcgtgcggttc

SEQ ID NO: 3023 - DNA, 27 bp, Artificial Sequence
  Description of Artificial Sequence: Synthetic oligonucleotide
tggacgacacgcatttcgtgcggttcg

SEQ ID NO: 3024 - DNA, 27 bp, Artificial Sequence
  Description of Artificial Sequence: Synthetic oligonucleotide
ggacgacacgcatttcgtgcggttcga

SEQ ID NO: 3025 - DNA, 27 bp, Artificial Sequence
  Description of Artificial Sequence: Synthetic oligonucleotide
gacgacacgcatttcgtgcggttcgac

SEQ ID NO: 3026 - DNA, 28 bp, Artificial Sequence
  Description of Artificial Sequence: Synthetic oligonucleotide
acgacacgcatttcgtgcggttcgacag

SEQ ID NO: 3027 - DNA, 27 bp, Artificial Sequence
  Description of Artificial Sequence: Synthetic oligonucleotide
cgacacgcatttcgtgcggttcgacag

SEQ ID NO: 3028 - DNA, 27 bp, Artificial Sequence
  Description of Artificial Sequence: Synthetic oligonucleotide
gacacgcatttcgtgcggttcgacagc

SEQ ID NO: 3029 - DNA, 27 bp, Artificial Sequence
  Description of Artificial Sequence: Synthetic oligonucleotide
acacgcatttcgtgcggttcgacagcg

SEQ ID NO: 3030 - DNA, 27 bp, Artificial Sequence
  Description of Artificial Sequence: Synthetic oligonucleotide
cacgcatttcgtgcggttcgacagcga

SEQ ID NO: 3031 - DNA, 27 bp, Artificial Sequence
  Description of Artificial Sequence: Synthetic oligonucleotide
acgcatttcgtgcggttcgacagcgac

SEQ ID NO: 3032 - DNA, 26 bp, Artificial Sequence
  Description of Artificial Sequence: Synthetic oligonucleotide
cgcatttcgtgcggttcgacagcgac

SEQ ID NO: 3033 - DNA, 26 bp, Artificial Sequence
  Description of Artificial Sequence: Synthetic oligonucleotide
gcatttcgtgcggttcgacagcgacg

SEQ ID NO: 3034 - DNA, 26 bp, Artificial Sequence
  Description of Artificial Sequence: Synthetic oligonucleotide
catttcgtgcggttcgacagcgacgc

SEQ ID NO: 3035 - DNA, 26 bp, Artificial Sequence
  Description of Artificial Sequence: Synthetic oligonucleotide
atttcgtgcggttcgacagcgacgcc

SEQ ID NO: 3036 - DNA, 25 bp, Artificial Sequence
  Description of Artificial Sequence: Synthetic oligonucleotide
tttcgtgcggttcgacagcgacgcc

SEQ ID NO: 3037 - DNA, 23 bp, Artificial Sequence
  Description of Artificial Sequence: Synthetic oligonucleotide
gggcgccgtggatagagcaggac

SEQ ID NO: 3038 - DNA, 23 bp, Artificial Sequence
  Description of Artificial Sequence: Synthetic oligonucleotide
ggcgccgtggatagagcaggacg

SEQ ID NO: 3039 - DNA, 23 bp, Artificial Sequence
  Description of Artificial Sequence: Synthetic oligonucleotide
gcgccgtggatagagcaggacgg

SEQ ID NO: 3040 - DNA, 23 bp, Artificial Sequence
  Description of Artificial Sequence: Synthetic oligonucleotide
cgccgtggatagagcaggacggg

SEQ ID NO: 3041 - DNA, 23 bp, Artificial Sequence
  Description of Artificial Sequence: Synthetic oligonucleotide
gccgtggatagagcaggacgggc

SEQ ID NO: 3042 - DNA, 23 bp, Artificial Sequence
  Description of Artificial Sequence: Synthetic oligonucleotide
ccgtggatagagcaggacgggcc

SEQ ID NO: 3043 - DNA, 23 bp, Artificial Sequence
  Description of Artificial Sequence: Synthetic oligonucleotide
cgtggatagagcaggacgggccg

SEQ ID NO: 3044 - DNA, 24 bp, Artificial Sequence
  Description of Artificial Sequence: Synthetic oligonucleotide
gtggatagagcaggacgggccgga

SEQ ID NO: 3045 - DNA, 27 bp, Artificial Sequence
  Description of Artificial Sequence: Synthetic oligonucleotide
tggatagagcaggacgggccggagtat

SEQ ID NO: 3046 - DNA, 27 bp, Artificial Sequence
  Description of Artificial Sequence: Synthetic oligonucleotide
ggatagagcaggacgggccggagtatt

SEQ ID NO: 3047 - DNA, 27 bp, Artificial Sequence
  Description of Artificial Sequence: Synthetic oligonucleotide
gatagagcaggacgggccggagtattg

SEQ ID NO: 3048 - DNA, 27 bp, Artificial Sequence
  Description of Artificial Sequence: Synthetic oligonucleotide
atagagcaggacgggccggagtattgg

SEQ ID NO: 3049 - DNA, 26 bp, Artificial Sequence
  Description of Artificial Sequence: Synthetic oligonucleotide
tagagcaggacgggccggagtattgg

SEQ ID NO: 3050 - DNA, 25 bp, Artificial Sequence
  Description of Artificial Sequence: Synthetic oligonucleotide
agagcaggacgggccggagtattgg

SEQ ID NO: 3051 - DNA, 24 bp, Artificial Sequence
  Description of Artificial Sequence: Synthetic oligonucleotide
gagcaggacgggccggagtattgg

SEQ ID NO: 3052 - DNA, 25 bp, Artificial Sequence
  Description of Artificial Sequence: Synthetic oligonucleotide
agcaggacgggccggagtattggga

SEQ ID NO: 3053 - DNA, 24 bp, Artificial Sequence
  Description of Artificial Sequence: Synthetic oligonucleotide
gcaggacgggccggagtattggga

SEQ ID NO: 3054 - DNA, 24 bp, Artificial Sequence
  Description of Artificial Sequence: Synthetic oligonucleotide
caggacgggccggagtattgggac

SEQ ID NO: 3055 - DNA, 25 bp, Artificial Sequence
  Description of Artificial Sequence: Synthetic oligonucleotide
aggacgggccggagtattgggacca

SEQ ID NO: 3056 - DNA, 24 bp, Artificial Sequence
  Description of Artificial Sequence: Synthetic oligonucleotide
ggacgggccggagtattgggacca

SEQ ID NO: 3057 - DNA, 24 bp, Artificial Sequence
  Description of Artificial Sequence: Synthetic oligonucleotide
gacgggccggagtattgggaccag

SEQ ID NO: 3058 - DNA, 25 bp, Artificial Sequence
  Description of Artificial Sequence: Synthetic oligonucleotide
acgggccggagtattgggaccagga

SEQ ID NO: 3059 - DNA, 24 bp, Artificial Sequence
  Description of Artificial Sequence: Synthetic oligonucleotide
cgggccggagtattgggaccagga

SEQ ID NO: 3060 - DNA, 23 bp, Artificial Sequence
  Description of Artificial Sequence: Synthetic oligonucleotide
gaggggccggagtattgggaccc

SEQ ID NO: 3061 - DNA, 23 bp, Artificial Sequence
  Description of Artificial Sequence: Synthetic oligonucleotide
aggggccggagtattgggacccg

SEQ ID NO: 3062 - DNA, 22 bp, Artificial Sequence
  Description of Artificial Sequence: Synthetic oligonucleotide
ggggccggagtattgggacccg

SEQ ID NO: 3063 - DNA, 23 bp, Artificial Sequence
  Description of Artificial Sequence: Synthetic oligonucleotide
gggccggagtattgggacccgga

SEQ ID NO: 3064 - DNA, 24 bp, Artificial Sequence
  Description of Artificial Sequence: Synthetic oligonucleotide
ggccggagtattgggacccggaga

SEQ ID NO: 3065 - DNA, 25 bp, Artificial Sequence
  Description of Artificial Sequence: Synthetic oligonucleotide
gccggagtattgggacccggagaca

SEQ ID NO: 3066 - DNA, 25 bp, Artificial Sequence
  Description of Artificial Sequence: Synthetic oligonucleotide
ccggagtattgggacccggagacac

SEQ ID NO: 3067 - DNA, 25 bp, Artificial Sequence
  Description of Artificial Sequence: Synthetic oligonucleotide
cggagtattgggacccggagacacg

SEQ ID NO: 3068 - DNA, 27 bp, Artificial Sequence
  Description of Artificial Sequence: Synthetic oligonucleotide
ggagtattgggacccggagacacggaa

SEQ ID NO: 3069 - DNA, 30 bp, Artificial Sequence
  Description of Artificial Sequence: Synthetic oligonucleotide
gagtattgggacccggagacacggaatatg

SEQ ID NO: 3070 - DNA, 32 bp, Artificial Sequence
  Description of Artificial Sequence: Synthetic oligonucleotide
agtattgggacccggagacacggaatatgaag

SEQ ID NO: 3071 - DNA, 31 bp, Artificial Sequence
  Description of Artificial Sequence: Synthetic oligonucleotide
gtattgggacccggagacacggaatatgaag

SEQ ID NO: 3072 - DNA, 31 bp, Artificial Sequence
  Description of Artificial Sequence: Synthetic oligonucleotide
tattgggacccggagacacggaatatgaagg

SEQ ID NO: 3073 - DNA, 30 bp, Artificial Sequence
  Description of Artificial Sequence: Synthetic oligonucleotide
attgggacccggagacacggaatatgaagg

SEQ ID NO: 3074 - DNA, 29 bp, Artificial Sequence
  Description of Artificial Sequence: Synthetic oligonucleotide
ttgggacccggagacacggaatatgaagg

SEQ ID NO: 3075 - DNA, 28 bp, Artificial Sequence
  Description of Artificial Sequence: Synthetic oligonucleotide
tgggacccggagacacggaatatgaagg

SEQ ID NO: 3076 - DNA, 27 bp, Artificial Sequence
  Description of Artificial Sequence: Synthetic oligonucleotide
gggacccggagacacggaatatgaagg

SEQ ID NO: 3077 - DNA, 27 bp, Artificial Sequence
  Description of Artificial Sequence: Synthetic oligonucleotide
ggacccggagacacggaatatgaaggc

SEQ ID NO: 3078 - DNA, 27 bp, Artificial Sequence
  Description of Artificial Sequence: Synthetic oligonucleotide
gacccggagacacggaatatgaaggcc

SEQ ID NO: 3079 - DNA, 27 bp, Artificial Sequence
  Description of Artificial Sequence: Synthetic oligonucleotide
acccggagacacggaatatgaaggccc

SEQ ID NO: 3080 - DNA, 27 bp, Artificial Sequence
  Description of Artificial Sequence: Synthetic oligonucleotide
cccggagacacggaatatgaaggccca

SEQ ID NO: 3081 - DNA, 27 bp, Artificial Sequence
  Description of Artificial Sequence: Synthetic oligonucleotide
ccggagacacggaatatgaaggcccac

SEQ ID NO: 3082 - DNA, 28 bp, Artificial Sequence
  Description of Artificial Sequence: Synthetic oligonucleotide
cggagacacggaatatgaaggcccactc

SEQ ID NO: 3083 - DNA, 25 bp, Artificial Sequence
  Description of Artificial Sequence: Synthetic oligonucleotide
ggcggacatggcagctcagatcacc

SEQ ID NO: 3084 - DNA, 26 bp, Artificial Sequence
  Description of Artificial Sequence: Synthetic oligonucleotide
gcggacatggcagctcagatcaccca

SEQ ID NO: 3085 - DNA, 26 bp, Artificial Sequence
  Description of Artificial Sequence: Synthetic oligonucleotide
cggacatggcagctcagatcacccag

SEQ ID NO: 3086 - DNA, 26 bp, Artificial Sequence
  Description of Artificial Sequence: Synthetic oligonucleotide
ggacatggcagctcagatcacccagc

SEQ ID NO: 3087 - DNA, 26 bp, Artificial Sequence
  Description of Artificial Sequence: Synthetic oligonucleotide
gacatggcagctcagatcacccagcg

SEQ ID NO: 3088 - DNA, 27 bp, Artificial Sequence
  Description of Artificial Sequence: Synthetic oligonucleotide
acatggcagctcagatcacccagcgca

SEQ ID NO: 3089 - DNA, 27 bp, Artificial Sequence
  Description of Artificial Sequence: Synthetic oligonucleotide
catggcagctcagatcacccagcgcaa

SEQ ID NO: 3090 - DNA, 27 bp, Artificial Sequence
  Description of Artificial Sequence: Synthetic oligonucleotide
atggcagctcagatcacccagcgcaag

SEQ ID NO: 3091 - DNA, 27 bp, Artificial Sequence
  Description of Artificial Sequence: Synthetic oligonucleotide
tggcagctcagatcacccagcgcaagt

SEQ ID NO: 3092 - DNA, 26 bp, Artificial Sequence
  Description of Artificial Sequence: Synthetic oligonucleotide
ggcagctcagatcacccagcgcaagt

SEQ ID NO: 3093 - DNA, 26 bp, Artificial Sequence
  Description of Artificial Sequence: Synthetic oligonucleotide
gcagctcagatcacccagcgcaagtg

SEQ ID NO: 3094 - DNA, 26 bp, Artificial Sequence
  Description of Artificial Sequence: Synthetic oligonucleotide
cagctcagatcacccagcgcaagtgg

SEQ ID NO: 3095 - DNA, 27 bp, Artificial Sequence
  Description of Artificial Sequence: Synthetic oligonucleotide
agctcagatcacccagcgcaagtggga

SEQ ID NO: 3096 - DNA, 26 bp, Artificial Sequence
  Description of Artificial Sequence: Synthetic oligonucleotide
gctcagatcacccagcgcaagtggga

SEQ ID NO: 3097 - DNA, 26 bp, Artificial Sequence
  Description of Artificial Sequence: Synthetic oligonucleotide
ctcagatcacccagcgcaagtgggag

SEQ ID NO: 3098 - DNA, 26 bp, Artificial Sequence
  Description of Artificial Sequence: Synthetic oligonucleotide
tcagatcacccagcgcaagtgggagg

SEQ ID NO: 3099 - DNA, 25 bp, Artificial Sequence
  Description of Artificial Sequence: Synthetic oligonucleotide
cagatcacccagcgcaagtgggagg

SEQ ID NO: 3100 - DNA, 25 bp, Artificial Sequence
  Description of Artificial Sequence: Synthetic oligonucleotide
agatcacccagcgcaagtgggaggc

SEQ ID NO: 3101 - DNA, 24 bp, Artificial Sequence
  Description of Artificial Sequence: Synthetic oligonucleotide
gatcacccagcgcaagtgggaggc

SEQ ID NO: 3102 - DNA, 24 bp, Artificial Sequence
  Description of Artificial Sequence: Synthetic oligonucleotide
atcacccagcgcaagtgggaggcg

SEQ ID NO: 3103 - DNA, 23 bp, Artificial Sequence
  Description of Artificial Sequence: Synthetic oligonucleotide
tcacccagcgcaagtgggaggcg

SEQ ID NO: 3104 - DNA, 22 bp, Artificial Sequence
  Description of Artificial Sequence: Synthetic oligonucleotide
cacccagcgcaagtgggaggcg

SEQ ID NO: 3105 - DNA, 23 bp, Artificial Sequence
  Description of Artificial Sequence: Synthetic oligonucleotide
acccagcgcaagtgggaggcggt

SEQ ID NO: 3106 - DNA, 22 bp, Artificial Sequence
  Description of Artificial Sequence: Synthetic oligonucleotide
cccagcgcaagtgggaggcggt

SEQ ID NO: 3107 - DNA, 22 bp, Artificial Sequence
  Description of Artificial Sequence: Synthetic oligonucleotide
ccagcgcaagtgggaggcggtc

SEQ ID NO: 3108 - DNA, 24 bp, Artificial Sequence
  Description of Artificial Sequence: Synthetic oligonucleotide
cagcgcaagtgggaggcggtccat

SEQ ID NO: 3109 - DNA, 24 bp, Artificial Sequence
  Description of Artificial Sequence: Synthetic oligonucleotide
cgccgtggatagagcaggaggggt

SEQ ID NO: 3110 - DNA, 24 bp, Artificial Sequence
  Description of Artificial Sequence: Synthetic oligonucleotide
gccgtggatagagcaggaggggtc

SEQ ID NO: 3111 - DNA, 24 bp, Artificial Sequence
  Description of Artificial Sequence: Synthetic oligonucleotide
ccgtggatagagcaggaggggtcg

SEQ ID NO: 3112 - DNA, 25 bp, Artificial Sequence
  Description of Artificial Sequence: Synthetic oligonucleotide
cgtggatagagcaggaggggtcgga

SEQ ID NO: 3113 - DNA, 27 bp, Artificial Sequence
  Description of Artificial Sequence: Synthetic oligonucleotide
gtggatagagcaggaggggtcggagta

SEQ ID NO: 3114 - DNA, 29 bp, Artificial Sequence
  Description of Artificial Sequence: Synthetic oligonucleotide
tggatagagcaggaggggtcggagtattg

SEQ ID NO: 3115 - DNA, 28 bp, Artificial Sequence
  Description of Artificial Sequence: Synthetic oligonucleotide
ggatagagcaggaggggtcggagtattg

SEQ ID NO: 3116 - DNA, 28 bp, Artificial Sequence
  Description of Artificial Sequence: Synthetic oligonucleotide
gatagagcaggaggggtcggagtattgg

SEQ ID NO: 3117 - DNA, 28 bp, Artificial Sequence
  Description of Artificial Sequence: Synthetic oligonucleotide
atagagcaggaggggtcggagtattggg

SEQ ID NO: 3118 - DNA, 27 bp, Artificial Sequence
  Description of Artificial Sequence: Synthetic oligonucleotide
tagagcaggaggggtcggagtattggg

SEQ ID NO: 3119 - DNA, 27 bp, Artificial Sequence
  Description of Artificial Sequence: Synthetic oligonucleotide
agagcaggaggggtcggagtattggga

SEQ ID NO: 3120 - DNA, 26 bp, Artificial Sequence
  Description of Artificial Sequence: Synthetic oligonucleotide
gagcaggaggggtcggagtattggga

SEQ ID NO: 3121 - DNA, 26 bp, Artificial Sequence
  Description of Artificial Sequence: Synthetic oligonucleotide
agcaggaggggtcggagtattgggac

SEQ ID NO: 3122 - DNA, 25 bp, Artificial Sequence
  Description of Artificial Sequence: Synthetic oligonucleotide
gcaggaggggtcggagtattgggac

SEQ ID NO: 3123 - DNA, 26 bp, Artificial Sequence
  Description of Artificial Sequence: Synthetic oligonucleotide
caggaggggtcggagtattgggacca

SEQ ID NO: 3124 - DNA, 26 bp, Artificial Sequence
  Description of Artificial Sequence: Synthetic oligonucleotide
aggaggggtcggagtattgggaccag

SEQ ID NO: 3125 - DNA, 25 bp, Artificial Sequence
  Description of Artificial Sequence: Synthetic oligonucleotide
ggaggggtcggagtattgggaccag

SEQ ID NO: 3126 - DNA, 26 bp, Artificial Sequence
  Description of Artificial Sequence: Synthetic oligonucleotide
gaggggtcggagtattgggaccagga

SEQ ID NO: 3127 - DNA, 27 bp, Artificial Sequence
  Description of Artificial Sequence: Synthetic oligonucleotide
aggggtcggagtattgggaccaggaga

SEQ ID NO: 3128 - DNA, 26 bp, Artificial Sequence
  Description of Artificial Sequence: Synthetic oligonucleotide
ggggtcggagtattgggaccaggaga

SEQ ID NO: 3129 - DNA, 27 bp, Artificial Sequence
  Description of Artificial Sequence: Synthetic oligonucleotide
gggtcggagtattgggaccaggagaca

SEQ ID NO: 3130 - DNA, 27 bp, Artificial Sequence
  Description of Artificial Sequence: Synthetic oligonucleotide
ggtcggagtattgggaccaggagacac

SEQ ID NO: 3131 - DNA, 27 bp, Artificial Sequence
  Description of Artificial Sequence: Synthetic oligonucleotide
gtcggagtattgggaccaggagacacg

SEQ ID NO: 3132 - DNA, 27 bp, Artificial Sequence
  Description of Artificial Sequence: Synthetic oligonucleotide
tcggagtattgggaccaggagacacgg

SEQ ID NO: 3133 - DNA, 27 bp, Artificial Sequence
  Description of Artificial Sequence: Synthetic oligonucleotide
agcgaggacggttctcacaccatccac

SEQ ID NO: 3134 - DNA, 27 bp, Artificial Sequence
  Description of Artificial Sequence: Synthetic oligonucleotide
gcgaggacggttctcacaccatccaca

SEQ ID NO: 3135 - DNA, 31 bp, Artificial Sequence
  Description of Artificial Sequence: Synthetic oligonucleotide
cgaggacggttctcacaccatccacataatg

SEQ ID NO: 3136 - DNA, 34 bp, Artificial Sequence
  Description of Artificial Sequence: Synthetic oligonucleotide
gaggacggttctcacaccatccacataatgtatg

SEQ ID NO: 3137 - DNA, 34 bp, Artificial Sequence
  Description of Artificial Sequence: Synthetic oligonucleotide
aggacggttctcacaccatccacataatgtatgg

SEQ ID NO: 3138 - DNA, 33 bp, Artificial Sequence
  Description of Artificial Sequence: Synthetic oligonucleotide
ggacggttctcacaccatccacataatgtatgg

SEQ ID NO: 3139 - DNA, 33 bp, Artificial Sequence
  Description of Artificial Sequence: Synthetic oligonucleotide
gacggttctcacaccatccacataatgtatggc

SEQ ID NO: 3140 - DNA, 34 bp, Artificial Sequence
  Description of Artificial Sequence: Synthetic oligonucleotide
acggttctcacaccatccacataatgtatggctg

SEQ ID NO: 3141 - DNA, 33 bp, Artificial Sequence
  Description of Artificial Sequence: Synthetic oligonucleotide
cggttctcacaccatccacataatgtatggctg

SEQ ID NO: 3142 - DNA, 33 bp, Artificial Sequence
  Description of Artificial Sequence: Synthetic oligonucleotide
ggttctcacaccatccacataatgtatggctgc

SEQ ID NO: 3143 - DNA, 33 bp, Artificial Sequence
  Description of Artificial Sequence: Synthetic oligonucleotide
gttctcacaccatccacataatgtatggctgcg

SEQ ID NO: 3144 - DNA, 34 bp, Artificial Sequence
  Description of Artificial Sequence: Synthetic oligonucleotide
ttctcacaccatccacataatgtatggctgcgac

SEQ ID NO: 3145 - DNA, 33 bp, Artificial Sequence
  Description of Artificial Sequence: Synthetic oligonucleotide
tctcacaccatccacataatgtatggctgcgac

SEQ ID NO: 3146 - DNA, 32 bp, Artificial Sequence
  Description of Artificial Sequence: Synthetic oligonucleotide
ctcacaccatccacataatgtatggctgcgac

SEQ ID NO: 3147 - DNA, 32 bp, Artificial Sequence
  Description of Artificial Sequence: Synthetic oligonucleotide
tcacaccatccacataatgtatggctgcgacg

SEQ ID NO: 3148 - DNA, 31 bp, Artificial Sequence
  Description of Artificial Sequence: Synthetic oligonucleotide
cacaccatccacataatgtatggctgcgacg

SEQ ID NO: 3149 - DNA, 32 bp, Artificial Sequence
  Description of Artificial Sequence: Synthetic oligonucleotide
acaccatccacataatgtatggctgcgacgtg

SEQ ID NO: 3150 - DNA, 31 bp, Artificial Sequence
  Description of Artificial Sequence: Synthetic oligonucleotide
caccatccacataatgtatggctgcgacgtg

SEQ ID NO: 3151 - DNA, 31 bp, Artificial Sequence
  Description of Artificial Sequence: Synthetic oligonucleotide
accatccacataatgtatggctgcgacgtgg

SEQ ID NO: 3152 - DNA, 30 bp, Artificial Sequence
  Description of Artificial Sequence: Synthetic oligonucleotide
ccatccacataatgtatggctgcgacgtgg

SEQ ID NO: 3153 - DNA, 30 bp, Artificial Sequence
  Description of Artificial Sequence: Synthetic oligonucleotide
catccacataatgtatggctgcgacgtggg

SEQ ID NO: 3154 - DNA, 30 bp, Artificial Sequence
  Description of Artificial Sequence: Synthetic oligonucleotide
atccacataatgtatggctgcgacgtgggg

SEQ ID NO: 3155 - DNA, 29 bp, Artificial Sequence
  Description of Artificial Sequence: Synthetic oligonucleotide
tccacataatgtatggctgcgacgtgggg

SEQ ID NO: 3156 - DNA, 28 bp, Artificial Sequence
  Description of Artificial Sequence: Synthetic oligonucleotide
ccacataatgtatggctgcgacgtgggg

SEQ ID NO: 3157 - DNA, 28 bp, Artificial Sequence
  Description of Artificial Sequence: Synthetic oligonucleotide
cacataatgtatggctgcgacgtggggc

SEQ ID NO: 3158 - DNA, 28 bp, Artificial Sequence
  Description of Artificial Sequence: Synthetic oligonucleotide
acataatgtatggctgcgacgtggggcc

SEQ ID NO: 3159 - DNA, 27 bp, Artificial Sequence
  Description of Artificial Sequence: Synthetic oligonucleotide
cataatgtatggctgcgacgtggggcc

SEQ ID NO: 3160 - DNA, 26 bp, Artificial Sequence
  Description of Artificial Sequence: Synthetic oligonucleotide
ggatagagcaggaggggccggagtat

SEQ ID NO: 3161 - DNA, 26 bp, Artificial Sequence
  Description of Artificial Sequence: Synthetic oligonucleotide
gatagagcaggaggggccggagtatc

SEQ ID NO: 3162 - DNA, 26 bp, Artificial Sequence
  Description of Artificial Sequence: Synthetic oligonucleotide
atagagcaggaggggccggagtatcg

SEQ ID NO: 3163 - DNA, 25 bp, Artificial Sequence
  Description of Artificial Sequence: Synthetic oligonucleotide
tagagcaggaggggccggagtatcg

SEQ ID NO: 3164 - DNA, 24 bp, Artificial Sequence
  Description of Artificial Sequence: Synthetic oligonucleotide
agagcaggaggggccggagtatcg

SEQ ID NO: 3165 - DNA, 23 bp, Artificial Sequence
  Description of Artificial Sequence: Synthetic oligonucleotide
gagcaggaggggccggagtatcg

SEQ ID NO: 3166 - DNA, 23 bp, Artificial Sequence
  Description of Artificial Sequence: Synthetic oligonucleotide
agcaggaggggccggagtatcgg

SEQ ID NO: 3167 - DNA, 22 bp, Artificial Sequence
  Description of Artificial Sequence: Synthetic oligonucleotide
gcaggaggggccggagtatcgg

SEQ ID NO: 3168 - DNA, 23 bp, Artificial Sequence
  Description of Artificial Sequence: Synthetic oligonucleotide
caggaggggccggagtatcggga

SEQ ID NO: 3169 - DNA, 23 bp, Artificial Sequence
  Description of Artificial Sequence: Synthetic oligonucleotide
aggaggggccggagtatcgggac

SEQ ID NO: 3170 - DNA, 22 bp, Artificial Sequence
  Description of Artificial Sequence: Synthetic oligonucleotide
ggaggggccggagtatcgggac

SEQ ID NO: 3171 - DNA, 23 bp, Artificial Sequence
  Description of Artificial Sequence: Synthetic oligonucleotide
gaggggccggagtatcgggacca

SEQ ID NO: 3172 - DNA, 23 bp, Artificial Sequence
  Description of Artificial Sequence: Synthetic oligonucleotide
aggggccggagtatcgggaccag

SEQ ID NO: 3173 - DNA, 22 bp, Artificial Sequence
  Description of Artificial Sequence: Synthetic oligonucleotide
ggggccggagtatcgggaccag

SEQ ID NO: 3174 - DNA, 23 bp, Artificial Sequence
  Description of Artificial Sequence: Synthetic oligonucleotide
gggccggagtatcgggaccagga

SEQ ID NO: 3175 - DNA, 24 bp, Artificial Sequence
  Description of Artificial Sequence: Synthetic oligonucleotide
ggccggagtatcgggaccaggaga

SEQ ID NO: 3176 - DNA, 25 bp, Artificial Sequence
  Description of Artificial Sequence: Synthetic oligonucleotide
gccggagtatcgggaccaggagaca

SEQ ID NO: 3177 - DNA, 25 bp, Artificial Sequence
  Description of Artificial Sequence: Synthetic oligonucleotide
ccggagtatcgggaccaggagacac

SEQ ID NO: 3178 - DNA, 25 bp, Artificial Sequence
  Description of Artificial Sequence: Synthetic oligonucleotide
cggagtatcgggaccaggagacacg

SEQ ID NO: 3179 - DNA, 27 bp, Artificial Sequence
  Description of Artificial Sequence: Synthetic oligonucleotide
ggagtatcgggaccaggagacacggaa

SEQ ID NO: 3180 - DNA, 30 bp, Artificial Sequence
  Description of Artificial Sequence: Synthetic oligonucleotide
gagtatcgggaccaggagacacggaatatg

SEQ ID NO: 3181 - DNA, 32 bp, Artificial Sequence
  Description of Artificial Sequence: Synthetic oligonucleotide
agtatcgggaccaggagacacggaatatgaag

SEQ ID NO: 3182 - DNA, 31 bp, Artificial Sequence
  Description of Artificial Sequence: Synthetic oligonucleotide
gtatcgggaccaggagacacggaatatgaag

SEQ ID NO: 3183 - DNA, 31 bp, Artificial Sequence
  Description of Artificial Sequence: Synthetic oligonucleotide
tatcgggaccaggagacacggaatatgaagg

SEQ ID NO: 3184 - DNA, 30 bp, Artificial Sequence
  Description of Artificial Sequence: Synthetic oligonucleotide
atcgggaccaggagacacggaatatgaagg

SEQ ID NO: 3185 - DNA, 29 bp, Artificial Sequence
  Description of Artificial Sequence: Synthetic oligonucleotide
tcgggaccaggagacacggaatatgaagg

SEQ ID NO: 3186 - DNA, 28 bp, Artificial Sequence
  Description of Artificial Sequence: Synthetic oligonucleotide
cgggaccaggagacacggaatatgaagg

SEQ ID NO: 3187 - DNA, 24 bp, Artificial Sequence
  Description of Artificial Sequence: Synthetic oligonucleotide
atgcggcggagcagcggagagtct

SEQ ID NO: 3188 - DNA, 23 bp, Artificial Sequence
  Description of Artificial Sequence: Synthetic oligonucleotide
tgcggcggagcagcggagagtct

SEQ ID NO: 3189 - DNA, 22 bp, Artificial Sequence
  Description of Artificial Sequence: Synthetic oligonucleotide
gcggcggagcagcggagagtct

SEQ ID NO: 3190 - DNA, 22 bp, Artificial Sequence
  Description of Artificial Sequence: Synthetic oligonucleotide
cggcggagcagcggagagtctg

SEQ ID NO: 3191 - DNA, 22 bp, Artificial Sequence
  Description of Artificial Sequence: Synthetic oligonucleotide
ggcggagcagcggagagtctgc

SEQ ID NO: 3192 - DNA, 23 bp, Artificial Sequence
  Description of Artificial Sequence: Synthetic oligonucleotide
gcggagcagcggagagtctgcct

SEQ ID NO: 3193 - DNA, 23 bp, Artificial Sequence
  Description of Artificial Sequence: Synthetic oligonucleotide
cggagcagcggagagtctgcctg

SEQ ID NO: 3194 - DNA, 24 bp, Artificial Sequence
  Description of Artificial Sequence: Synthetic oligonucleotide
ggagcagcggagagtctgcctgga

SEQ ID NO: 3195 - DNA, 24 bp, Artificial Sequence
  Description of Artificial Sequence: Synthetic oligonucleotide
gagcagcggagagtctgcctggag

SEQ ID NO: 3196 - DNA, 24 bp, Artificial Sequence
  Description of Artificial Sequence: Synthetic oligonucleotide
agcagcggagagtctgcctggagg

SEQ ID NO: 3197 - DNA, 23 bp, Artificial Sequence
  Description of Artificial Sequence: Synthetic oligonucleotide
gcagcggagagtctgcctggagg

SEQ ID NO: 3198 - DNA, 23 bp, Artificial Sequence
  Description of Artificial Sequence: Synthetic oligonucleotide
cagcggagagtctgcctggaggg

SEQ ID NO: 3199 - DNA, 23 bp, Artificial Sequence
  Description of Artificial Sequence: Synthetic oligonucleotide
agcggagagtctgcctggagggc

SEQ ID NO: 3200 - DNA, 22 bp, Artificial Sequence
  Description of Artificial Sequence: Synthetic oligonucleotide
gcggagagtctgcctggagggc

SEQ ID NO: 3201 - DNA, 22 bp, Artificial Sequence
  Description of Artificial Sequence: Synthetic oligonucleotide
cggagagtctgcctggagggcc

SEQ ID NO: 3202 - DNA, 22 bp, Artificial Sequence
  Description of Artificial Sequence: Synthetic oligonucleotide
ggagagtctgcctggagggccg

SEQ ID NO: 3203 - DNA, 23 bp, Artificial Sequence
  Description of Artificial Sequence: Synthetic oligonucleotide
gagagtctgcctggagggccggt

SEQ ID NO: 3204 - DNA, 23 bp, Artificial Sequence
  Description of Artificial Sequence: Synthetic oligonucleotide
agagtctgcctggagggccggtg

SEQ ID NO: 3205 - DNA, 22 bp, Artificial Sequence
  Description of Artificial Sequence: Synthetic oligonucleotide
gagtctgcctggagggccggtg

SEQ ID NO: 3206 - DNA, 22 bp, Artificial Sequence
  Description of Artificial Sequence: Synthetic oligonucleotide
agtctgcctggagggccggtgc

SEQ ID NO: 3207 - DNA, 21 bp, Artificial Sequence
  Description of Artificial Sequence: Synthetic oligonucleotide
gtctgcctggagggccggtgc

SEQ ID NO: 3208 - DNA, 22 bp, Artificial Sequence
  Description of Artificial Sequence: Synthetic oligonucleotide
tctgcctggagggccggtgcgt

SEQ ID NO: 3209 - DNA, 21 bp, Artificial Sequence
  Description of Artificial Sequence: Synthetic oligonucleotide
ctgcctggagggccggtgcgt

SEQ ID NO: 3210 - DNA, 21 bp, Artificial Sequence
  Description of Artificial Sequence: Synthetic oligonucleotide
tgcctggagggccggtgcgtg

SEQ ID NO: 3211 - DNA, 20 bp, Artificial Sequence
  Description of Artificial Sequence: Synthetic oligonucleotide
gcctggagggccggtgcgtg

SEQ ID NO: 3212 - DNA, 23 bp, Artificial Sequence
  Description of Artificial Sequence: Synthetic oligonucleotide
gtcatggcgccccgaaccctcgt

SEQ ID NO: 3213 - DNA, 23 bp, Artificial Sequence
  Description of Artificial Sequence: Synthetic oligonucleotide
tcatggcgccccgaaccctcgtc

SEQ ID NO: 3214 - DNA, 22 bp, Artificial Sequence
  Description of Artificial Sequence: Synthetic oligonucleotide
catggcgccccgaaccctcgtc

SEQ ID NO: 3215 - DNA, 23 bp, Artificial Sequence
  Description of Artificial Sequence: Synthetic oligonucleotide
atggcgccccgaaccctcgtcct

SEQ ID NO: 3216 - DNA, 22 bp, Artificial Sequence
  Description of Artificial Sequence: Synthetic oligonucleotide
tggcgccccgaaccctcgtcct

SEQ ID NO: 3217 - DNA, 21 bp, Artificial Sequence
  Description of Artificial Sequence: Synthetic oligonucleotide
ggcgccccgaaccctcgtcct

SEQ ID NO: 3218 - DNA, 21 bp, Artificial Sequence
  Description of Artificial Sequence: Synthetic oligonucleotide
gcgccccgaaccctcgtcctg

SEQ ID NO: 3219 - DNA, 23 bp, Artificial Sequence
  Description of Artificial Sequence: Synthetic oligonucleotide
cgccccgaaccctcgtcctgcta

SEQ ID NO: 3220 - DNA, 24 bp, Artificial Sequence
  Description of Artificial Sequence: Synthetic oligonucleotide
gccccgaaccctcgtcctgctact

SEQ ID NO: 3221 - DNA, 25 bp, Artificial Sequence
  Description of Artificial Sequence: Synthetic oligonucleotide
ccccgaaccctcgtcctgctactct

SEQ ID NO: 3222 - DNA, 25 bp, Artificial Sequence
  Description of Artificial Sequence: Synthetic oligonucleotide
cccgaaccctcgtcctgctactctc

SEQ ID NO: 3223 - DNA, 25 bp, Artificial Sequence
  Description of Artificial Sequence: Synthetic oligonucleotide
ccgaaccctcgtcctgctactctcg

SEQ ID NO: 3224 - DNA, 25 bp, Artificial Sequence
  Description of Artificial Sequence: Synthetic oligonucleotide
cgaaccctcgtcctgctactctcgg

SEQ ID NO: 3225 - DNA, 25 bp, Artificial Sequence
  Description of Artificial Sequence: Synthetic oligonucleotide
gaaccctcgtcctgctactctcggg

SEQ ID NO: 3226 - DNA, 25 bp, Artificial Sequence
  Description of Artificial Sequence: Synthetic oligonucleotide
aaccctcgtcctgctactctcgggg

SEQ ID NO: 3227 - DNA, 24 bp, Artificial Sequence
  Description of Artificial Sequence: Synthetic oligonucleotide
accctcgtcctgctactctcgggg

SEQ ID NO: 3228 - DNA, 23 bp, Artificial Sequence
  Description of Artificial Sequence: Synthetic oligonucleotide
ccctcgtcctgctactctcgggg

SEQ ID NO: 3229 - DNA, 23 bp, Artificial Sequence
  Description of Artificial Sequence: Synthetic oligonucleotide
cctcgtcctgctactctcggggg

SEQ ID NO: 3230 - DNA, 24 bp, Artificial Sequence
  Description of Artificial Sequence: Synthetic oligonucleotide
ctcgtcctgctactctcgggggct

SEQ ID NO: 3231 - DNA, 25 bp, Artificial Sequence
  Description of Artificial Sequence: Synthetic oligonucleotide
tcgtcctgctactctcgggggctct

SEQ ID NO: 3232 - DNA, 24 bp, Artificial Sequence
  Description of Artificial Sequence: Synthetic oligonucleotide
cgtcctgctactctcgggggctct

SEQ ID NO: 3233 - DNA, 24 bp, Artificial Sequence
  Description of Artificial Sequence: Synthetic oligonucleotide
gtcctgctactctcgggggctctg

SEQ ID NO: 3234 - DNA, 24 bp, Artificial Sequence
  Description of Artificial Sequence: Synthetic oligonucleotide
tcctgctactctcgggggctctgg

SEQ ID NO: 3235 - DNA, 23 bp, Artificial Sequence
  Description of Artificial Sequence: Synthetic oligonucleotide
cctgctactctcgggggctctgg

SEQ ID NO: 3236 - DNA, 23 bp, Artificial Sequence
  Description of Artificial Sequence: Synthetic oligonucleotide
ctgctactctcgggggctctggc

SEQ ID NO: 3237 - DNA, 23 bp, Artificial Sequence
  Description of Artificial Sequence: Synthetic oligonucleotide
tgctactctcgggggctctggcc

SEQ ID NO: 3238 - DNA, 22 bp, Artificial Sequence
  Description of Artificial Sequence: Synthetic oligonucleotide
gctactctcgggggctctggcc

SEQ ID NO: 3239 - DNA, 23 bp, Artificial Sequence
  Description of Artificial Sequence: Synthetic oligonucleotide
ctactctcgggggctctggccct

SEQ ID NO: 3240 - DNA, 24 bp, Artificial Sequence
  Description of Artificial Sequence: Synthetic oligonucleotide
tactctcgggggctctggccctga

SEQ ID NO: 3241 - DNA, 23 bp, Artificial Sequence
  Description of Artificial Sequence: Synthetic oligonucleotide
actctcgggggctctggccctga

SEQ ID NO: 3242 - DNA, 22 bp, Artificial Sequence
  Description of Artificial Sequence: Synthetic oligonucleotide
ctctcgggggctctggccctga

SEQ ID NO: 3243 - DNA, 22 bp, Artificial Sequence
  Description of Artificial Sequence: Synthetic oligonucleotide
tctcgggggctctggccctgac

SEQ ID NO: 3244 - DNA, 21 bp, Artificial Sequence
  Description of Artificial Sequence: Synthetic oligonucleotide
ctcgggggctctggccctgac

SEQ ID NO: 3245 - DNA, 21 bp, Artificial Sequence
  Description of Artificial Sequence: Synthetic oligonucleotide
tcgggggctctggccctgacc

SEQ ID NO: 3246 - DNA, 20 bp, Artificial Sequence
  Description of Artificial Sequence: Synthetic oligonucleotide
cgggggctctggccctgacc

SEQ ID NO: 3247 - DNA, 21 bp, Artificial Sequence
  Description of Artificial Sequence: Synthetic oligonucleotide
gggggctctggccctgaccca

SEQ ID NO: 3248 - DNA, 22 bp, Artificial Sequence
  Description of Artificial Sequence: Synthetic oligonucleotide
ggggctctggccctgacccaga

SEQ ID NO: 3249 - DNA, 22 bp, Artificial Sequence
  Description of Artificial Sequence: Synthetic oligonucleotide
gggctctggccctgacccagac

SEQ ID NO: 3250 - DNA, 23 bp, Artificial Sequence
  Description of Artificial Sequence: Synthetic oligonucleotide
ggctctggccctgacccagacct

SEQ ID NO: 3251 - DNA, 23 bp, Artificial Sequence
  Description of Artificial Sequence: Synthetic oligonucleotide
gctctggccctgacccagacctg

SEQ ID NO: 3252 - DNA, 23 bp, Artificial Sequence
  Description of Artificial Sequence: Synthetic oligonucleotide
ctctggccctgacccagacctgg

SEQ ID NO: 3253 - DNA, 23 bp, Artificial Sequence
  Description of Artificial Sequence: Synthetic oligonucleotide
tctggccctgacccagacctggg

SEQ ID NO: 3254 - DNA, 23 bp, Artificial Sequence
  Description of Artificial Sequence: Synthetic oligonucleotide
tgacccagacctgggcgggctct

SEQ ID NO: 3255 - DNA, 22 bp, Artificial Sequence
  Description of Artificial Sequence: Synthetic oligonucleotide
gacccagacctgggcgggctct

SEQ ID NO: 3256 - DNA, 23 bp, Artificial Sequence
  Description of Artificial Sequence: Synthetic oligonucleotide
acccagacctgggcgggctctca

SEQ ID NO: 3257 - DNA, 22 bp, Artificial Sequence
  Description of Artificial Sequence: Synthetic oligonucleotide
cccagacctgggcgggctctca

SEQ ID NO: 3258 - DNA, 23 bp, Artificial Sequence
  Description of Artificial Sequence: Synthetic oligonucleotide
ccagacctgggcgggctctcact

SEQ ID NO: 3259 - DNA, 23 bp, Artificial Sequence
  Description of Artificial Sequence: Synthetic oligonucleotide
cagacctgggcgggctctcactc

SEQ ID NO: 3260 - DNA, 25 bp, Artificial Sequence
  Description of Artificial Sequence: Synthetic oligonucleotide
agacctgggcgggctctcactccat

SEQ ID NO: 3261 - DNA, 24 bp, Artificial Sequence
  Description of Artificial Sequence: Synthetic oligonucleotide
gacctgggcgggctctcactccat

SEQ ID NO: 3262 - DNA, 25 bp, Artificial Sequence
  Description of Artificial Sequence: Synthetic oligonucleotide
acctgggcgggctctcactccatga

SEQ ID NO: 3263 - DNA, 24 bp, Artificial Sequence
  Description of Artificial Sequence: Synthetic oligonucleotide
cctgggcgggctctcactccatga

SEQ ID NO: 3264 - DNA, 24 bp, Artificial Sequence
  Description of Artificial Sequence: Synthetic oligonucleotide
ctgggcgggctctcactccatgag

SEQ ID NO: 3265 - DNA, 27 bp, Artificial Sequence
  Description of Artificial Sequence: Synthetic oligonucleotide
tgggcgggctctcactccatgaggtat

SEQ ID NO: 3266 - DNA, 27 bp, Artificial Sequence
  Description of Artificial Sequence: Synthetic oligonucleotide
gggcgggctctcactccatgaggtatt

SEQ ID NO: 3267 - DNA, 28 bp, Artificial Sequence
  Description of Artificial Sequence: Synthetic oligonucleotide
ggcgggctctcactccatgaggtatttc

SEQ ID NO: 3268 - DNA, 30 bp, Artificial Sequence
  Description of Artificial Sequence: Synthetic oligonucleotide
gcgggctctcactccatgaggtatttcttc

SEQ ID NO: 3269 - DNA, 31 bp, Artificial Sequence
  Description of Artificial Sequence: Synthetic oligonucleotide
cgggctctcactccatgaggtatttcttcac

SEQ ID NO: 3270 - DNA, 33 bp, Artificial Sequence
  Description of Artificial Sequence: Synthetic oligonucleotide
gggctctcactccatgaggtatttcttcacatc

SEQ ID NO: 3271 - DNA, 33 bp, Artificial Sequence
  Description of Artificial Sequence: Synthetic oligonucleotide
ggctctcactccatgaggtatttcttcacatcc

SEQ ID NO: 3272 - DNA, 22 bp, Artificial Sequence
  Description of Artificial Sequence: Synthetic oligonucleotide
cggggagccccgcttcatcgca

SEQ ID NO: 3273 - DNA, 23 bp, Artificial Sequence
  Description of Artificial Sequence: Synthetic oligonucleotide
ggggagccccgcttcatcgcagt

SEQ ID NO: 3274 - DNA, 23 bp, Artificial Sequence
  Description of Artificial Sequence: Synthetic oligonucleotide
gggagccccgcttcatcgcagtg

SEQ ID NO: 3275 - DNA, 23 bp, Artificial Sequence
  Description of Artificial Sequence: Synthetic oligonucleotide
ggagccccgcttcatcgcagtgg

SEQ ID NO: 3276 - DNA, 22 bp, Artificial Sequence
  Description of Artificial Sequence: Synthetic oligonucleotide
gacagcgacgccgcgagccaga

SEQ ID NO: 3277 - DNA, 22 bp, Artificial Sequence
  Description of Artificial Sequence: Synthetic oligonucleotide
acagcgacgccgcgagccagag

SEQ ID NO: 3278 - DNA, 21 bp, Artificial Sequence
  Description of Artificial Sequence: Synthetic oligonucleotide
cagcgacgccgcgagccagag

SEQ ID NO: 3279 - DNA, 23 bp, Artificial Sequence
  Description of Artificial Sequence: Synthetic oligonucleotide
agcgacgccgcgagccagaggat

SEQ ID NO: 3280 - DNA, 22 bp, Artificial Sequence
  Description of Artificial Sequence: Synthetic oligonucleotide
gcgacgccgcgagccagaggat

SEQ ID NO: 3281 - DNA, 22 bp, Artificial Sequence
  Description of Artificial Sequence: Synthetic oligonucleotide
cgacgccgcgagccagaggatg

SEQ ID NO: 3282 - DNA, 23 bp, Artificial Sequence
  Description of Artificial Sequence: Synthetic oligonucleotide
gacgccgcgagccagaggatgga

SEQ ID NO: 3283 - DNA, 23 bp, Artificial Sequence
  Description of Artificial Sequence: Synthetic oligonucleotide
acgccgcgagccagaggatggag

SEQ ID NO: 3284 - DNA, 22 bp, Artificial Sequence
  Description of Artificial Sequence: Synthetic oligonucleotide
cgccgcgagccagaggatggag

SEQ ID NO: 3285 - DNA, 22 bp, Artificial Sequence
  Description of Artificial Sequence: Synthetic oligonucleotide
gccgcgagccagaggatggagc

SEQ ID NO: 3286 - DNA, 22 bp, Artificial Sequence
  Description of Artificial Sequence: Synthetic oligonucleotide
ccgcgagccagaggatggagcc

SEQ ID NO: 3287 - DNA, 22 bp, Artificial Sequence
  Description of Artificial Sequence: Synthetic oligonucleotide
cgcgagccagaggatggagccg

SEQ ID NO: 3288 - DNA, 22 bp, Artificial Sequence
  Description of Artificial Sequence: Synthetic oligonucleotide
gcgagccagaggatggagccgc

SEQ ID NO: 3289 - DNA, 22 bp, Artificial Sequence
  Description of Artificial Sequence: Synthetic oligonucleotide
cgagccagaggatggagccgcg

SEQ ID NO: 3290 - DNA, 22 bp, Artificial Sequence
  Description of Artificial Sequence: Synthetic oligonucleotide
gagccagaggatggagccgcgg

SEQ ID NO: 3291 - DNA, 22 bp, Artificial Sequence
  Description of Artificial Sequence: Synthetic oligonucleotide
agccagaggatggagccgcggg

SEQ ID NO: 3292 - DNA, 21 bp, Artificial Sequence
  Description of Artificial Sequence: Synthetic oligonucleotide
gccagaggatggagccgcggg

SEQ ID NO: 3293 - DNA, 21 bp, Artificial Sequence
  Description of Artificial Sequence: Synthetic oligonucleotide
ccagaggatggagccgcgggc

SEQ ID NO: 3294 - DNA, 21 bp, Artificial Sequence
  Description of Artificial Sequence: Synthetic oligonucleotide
cagaggatggagccgcgggcg

SEQ ID NO: 3295 - DNA, 21 bp, Artificial Sequence
  Description of Artificial Sequence: Synthetic oligonucleotide
agaggatggagccgcgggcgc

SEQ ID NO: 3296 - DNA, 20 bp, Artificial Sequence
  Description of Artificial Sequence: Synthetic oligonucleotide
gaggatggagccgcgggcgc

SEQ ID NO: 3297 - DNA, 20 bp, Artificial Sequence
  Description of Artificial Sequence: Synthetic oligonucleotide
aggatggagccgcgggcgcc

SEQ ID NO: 3298 - DNA, 20 bp, Artificial Sequence
  Description of Artificial Sequence: Synthetic oligonucleotide
ggatggagccgcgggcgcct

SEQ ID NO: 3299 - DNA, 24 bp, Artificial Sequence
  Description of Artificial Sequence: Synthetic oligonucleotide
gcgccgtggatagagcaggagggt

SEQ ID NO: 3300 - DNA, 24 bp, Artificial Sequence
  Description of Artificial Sequence: Synthetic oligonucleotide
cgccgtggatagagcaggagggtc

SEQ ID NO: 3301 - DNA, 24 bp, Artificial Sequence
  Description of Artificial Sequence: Synthetic oligonucleotide
gccgtggatagagcaggagggtcc

SEQ ID NO: 3302 - DNA, 24 bp, Artificial Sequence
  Description of Artificial Sequence: Synthetic oligonucleotide
ccgtggatagagcaggagggtccg

SEQ ID NO: 3303 - DNA, 25 bp, Artificial Sequence
  Description of Artificial Sequence: Synthetic oligonucleotide
cgtggatagagcaggagggtccgga

SEQ ID NO: 3304 - DNA, 27 bp, Artificial Sequence
  Description of Artificial Sequence: Synthetic oligonucleotide
gtggatagagcaggagggtccggagta

SEQ ID NO: 3305 - DNA, 29 bp, Artificial Sequence
  Description of Artificial Sequence: Synthetic oligonucleotide
tggatagagcaggagggtccggagtattg

SEQ ID NO: 3306 - DNA, 28 bp, Artificial Sequence
  Description of Artificial Sequence: Synthetic oligonucleotide
ggatagagcaggagggtccggagtattg

SEQ ID NO: 3307 - DNA, 28 bp, Artificial Sequence
  Description of Artificial Sequence: Synthetic oligonucleotide
gatagagcaggagggtccggagtattgg

SEQ ID NO: 3308 - DNA, 28 bp, Artificial Sequence
  Description of Artificial Sequence: Synthetic oligonucleotide
atagagcaggagggtccggagtattggg

SEQ ID NO: 3309 - DNA, 27 bp, Artificial Sequence
  Description of Artificial Sequence: Synthetic oligonucleotide
tagagcaggagggtccggagtattggg

SEQ ID NO: 3310 - DNA, 27 bp, Artificial Sequence
  Description of Artificial Sequence: Synthetic oligonucleotide
agagcaggagggtccggagtattggga

SEQ ID NO: 3311 - DNA, 26 bp, Artificial Sequence
  Description of Artificial Sequence: Synthetic oligonucleotide
gagcaggagggtccggagtattggga

SEQ ID NO: 3312 - DNA, 26 bp, Artificial Sequence
  Description of Artificial Sequence: Synthetic oligonucleotide
agcaggagggtccggagtattgggac

SEQ ID NO: 3313 - DNA, 25 bp, Artificial Sequence
  Description of Artificial Sequence: Synthetic oligonucleotide
gcaggagggtccggagtattgggac

SEQ ID NO: 3314 - DNA, 25 bp, Artificial Sequence
  Description of Artificial Sequence: Synthetic oligonucleotide
caggagggtccggagtattgggacg

SEQ ID NO: 3315 - DNA, 25 bp, Artificial Sequence
  Description of Artificial Sequence: Synthetic oligonucleotide
aggagggtccggagtattgggacgg

SEQ ID NO: 3316 - DNA, 24 bp, Artificial Sequence
  Description of Artificial Sequence: Synthetic oligonucleotide
ggagggtccggagtattgggacgg

SEQ ID NO: 3317 - DNA, 24 bp, Artificial Sequence
  Description of Artificial Sequence: Synthetic oligonucleotide
gagggtccggagtattgggacggg

SEQ ID NO: 3318 - DNA, 25 bp, Artificial Sequence
  Description of Artificial Sequence: Synthetic oligonucleotide
agggtccggagtattgggacgggga

SEQ ID NO: 3319 - DNA, 24 bp, Artificial Sequence
  Description of Artificial Sequence: Synthetic oligonucleotide
gggtccggagtattgggacgggga

SEQ ID NO: 3320 - DNA, 25 bp, Artificial Sequence
  Description of Artificial Sequence: Synthetic oligonucleotide
ggtccggagtattgggacggggaga

SEQ ID NO: 3321 - DNA, 26 bp, Artificial Sequence
  Description of Artificial Sequence: Synthetic oligonucleotide
gtccggagtattgggacggggagaca

SEQ ID NO: 3322 - DNA, 26 bp, Artificial Sequence
  Description of Artificial Sequence: Synthetic oligonucleotide
tccggagtattgggacggggagacac

SEQ ID NO: 3323 - DNA, 25 bp, Artificial Sequence
  Description of Artificial Sequence: Synthetic oligonucleotide
ccggagtattgggacggggagacac

SEQ ID NO: 3324 - DNA, 25 bp, Artificial Sequence
  Description of Artificial Sequence: Synthetic oligonucleotide
cggagtattgggacggggagacacg

SEQ ID NO: 3325 - DNA, 27 bp, Artificial Sequence
  Description of Artificial Sequence: Synthetic oligonucleotide
ggagtattgggacggggagacacggaa

SEQ ID NO: 3326 - DNA, 28 bp, Artificial Sequence
  Description of Artificial Sequence: Synthetic oligonucleotide
gagtattgggacggggagacacggaaag

SEQ ID NO: 3327 - DNA, 29 bp, Artificial Sequence
  Description of Artificial Sequence: Synthetic oligonucleotide
agtattgggacggggagacacggaaagtg

SEQ ID NO: 3328 - DNA, 28 bp, Artificial Sequence
  Description of Artificial Sequence: Synthetic oligonucleotide
gtattgggacggggagacacggaaagtg

SEQ ID NO: 3329 - DNA, 30 bp, Artificial Sequence
  Description of Artificial Sequence: Synthetic oligonucleotide
tattgggacggggagacacggaaagtgaag

SEQ ID NO: 3330 - DNA, 29 bp, Artificial Sequence
  Description of Artificial Sequence: Synthetic oligonucleotide
attgggacggggagacacggaaagtgaag

SEQ ID NO: 3331 - DNA, 28 bp, Artificial Sequence
  Description of Artificial Sequence: Synthetic oligonucleotide
ttgggacggggagacacggaaagtgaag

SEQ ID NO: 3332 - DNA, 27 bp, Artificial Sequence
  Description of Artificial Sequence: Synthetic oligonucleotide
tgggacggggagacacggaaagtgaag

SEQ ID NO: 3333 - DNA, 26 bp, Artificial Sequence
  Description of Artificial Sequence: Synthetic oligonucleotide
gggacggggagacacggaaagtgaag

SEQ ID NO: 3334 - DNA, 26 bp, Artificial Sequence
  Description of Artificial Sequence: Synthetic oligonucleotide
ggacggggagacacggaaagtgaagg

SEQ ID NO: 3335 - DNA, 26 bp, Artificial Sequence
  Description of Artificial Sequence: Synthetic oligonucleotide
gacggggagacacggaaagtgaaggc

SEQ ID NO: 3336 - DNA, 26 bp, Artificial Sequence
  Description of Artificial Sequence: Synthetic oligonucleotide
acggggagacacggaaagtgaaggcc

SEQ ID NO: 3337 - DNA, 25 bp, Artificial Sequence
  Description of Artificial Sequence: Synthetic oligonucleotide
cggggagacacggaaagtgaaggcc

SEQ ID NO: 3338 - DNA, 26 bp, Artificial Sequence
  Description of Artificial Sequence: Synthetic oligonucleotide
ggggagacacggaaagtgaaggccca

SEQ ID NO: 3339 - DNA, 27 bp, Artificial Sequence
  Description of Artificial Sequence: Synthetic oligonucleotide
gggagacacggaaagtgaaggcccact

SEQ ID NO: 3340 - DNA, 27 bp, Artificial Sequence
  Description of Artificial Sequence: Synthetic oligonucleotide
ggagacacggaaagtgaaggcccactc

SEQ ID NO: 3341 - DNA, 28 bp, Artificial Sequence
  Description of Artificial Sequence: Synthetic oligonucleotide
gagacacggaaagtgaaggcccactcac

SEQ ID NO: 3342 - DNA, 29 bp, Artificial Sequence
  Description of Artificial Sequence: Synthetic oligonucleotide
agacacggaaagtgaaggcccactcacag

SEQ ID NO: 3343 - DNA, 28 bp, Artificial Sequence
  Description of Artificial Sequence: Synthetic oligonucleotide
gacacggaaagtgaaggcccactcacag

SEQ ID NO: 3344 - DNA, 29 bp, Artificial Sequence
  Description of Artificial Sequence: Synthetic oligonucleotide
acacggaaagtgaaggcccactcacagac

SEQ ID NO: 3345 - DNA, 28 bp, Artificial Sequence
  Description of Artificial Sequence: Synthetic oligonucleotide
cacggaaagtgaaggcccactcacagac

SEQ ID NO: 3346 - DNA, 29 bp, Artificial Sequence
  Description of Artificial Sequence: Synthetic oligonucleotide
acggaaagtgaaggcccactcacagactc

SEQ ID NO: 3347 - DNA, 28 bp, Artificial Sequence
  Description of Artificial Sequence: Synthetic oligonucleotide
cggaaagtgaaggcccactcacagactc

SEQ ID NO: 3348 - DNA, 29 bp, Artificial Sequence
  Description of Artificial Sequence: Synthetic oligonucleotide
ggaaagtgaaggcccactcacagactcac

SEQ ID NO: 3349 - DNA, 29 bp, Artificial Sequence
  Description of Artificial Sequence: Synthetic oligonucleotide
gaaagtgaaggcccactcacagactcacc

SEQ ID NO: 3350 - DNA, 29 bp, Artificial Sequence
  Description of Artificial Sequence: Synthetic oligonucleotide
aaagtgaaggcccactcacagactcaccg

SEQ ID NO: 3351 - DNA, 28 bp, Artificial Sequence
  Description of Artificial Sequence: Synthetic oligonucleotide
aagtgaaggcccactcacagactcaccg

SEQ ID NO: 3352 - DNA, 27 bp, Artificial Sequence
  Description of Artificial Sequence: Synthetic oligonucleotide
agtgaaggcccactcacagactcaccg

SEQ ID NO: 3353 - DNA, 27 bp, Artificial Sequence
  Description of Artificial Sequence: Synthetic oligonucleotide
gtgaaggcccactcacagactcaccga

SEQ ID NO: 3354 - DNA, 27 bp, Artificial Sequence
  Description of Artificial Sequence: Synthetic oligonucleotide
tgaaggcccactcacagactcaccgag

SEQ ID NO: 3355 - DNA, 27 bp, Artificial Sequence
  Description of Artificial Sequence: Synthetic oligonucleotide
gaaggcccactcacagactcaccgagt

SEQ ID NO: 3356 - DNA, 27 bp, Artificial Sequence
  Description of Artificial Sequence: Synthetic oligonucleotide
aaggcccactcacagactcaccgagtg

SEQ ID NO: 3357 - DNA, 26 bp, Artificial Sequence
  Description of Artificial Sequence: Synthetic oligonucleotide
aggcccactcacagactcaccgagtg

SEQ ID NO: 3358 - DNA, 25 bp, Artificial Sequence
  Description of Artificial Sequence: Synthetic oligonucleotide
ggcccactcacagactcaccgagtg

SEQ ID NO: 3359 - DNA, 26 bp, Artificial Sequence
  Description of Artificial Sequence: Synthetic oligonucleotide
gcccactcacagactcaccgagtgga

SEQ ID NO: 3360 - DNA, 26 bp, Artificial Sequence
  Description of Artificial Sequence: Synthetic oligonucleotide
cccactcacagactcaccgagtggac

SEQ ID NO: 3361 - DNA, 27 bp, Artificial Sequence
  Description of Artificial Sequence: Synthetic oligonucleotide
ccactcacagactcaccgagtggacct

SEQ ID NO: 3362 - DNA, 27 bp, Artificial Sequence
  Description of Artificial Sequence: Synthetic oligonucleotide
cactcacagactcaccgagtggacctg

SEQ ID NO: 3363 - DNA, 27 bp, Artificial Sequence
  Description of Artificial Sequence: Synthetic oligonucleotide
actcacagactcaccgagtggacctgg

SEQ ID NO: 3364 - DNA, 26 bp, Artificial Sequence
  Description of Artificial Sequence: Synthetic oligonucleotide
ctcacagactcaccgagtggacctgg

SEQ ID NO: 3365 - DNA, 26 bp, Artificial Sequence
  Description of Artificial Sequence: Synthetic oligonucleotide
tcacagactcaccgagtggacctggg

SEQ ID NO: 3366 - DNA, 25 bp, Artificial Sequence
  Description of Artificial Sequence: Synthetic oligonucleotide
cacagactcaccgagtggacctggg

SEQ ID NO: 3367 - DNA, 26 bp, Artificial Sequence
  Description of Artificial Sequence: Synthetic oligonucleotide
acagactcaccgagtggacctgggga

SEQ ID NO: 3368 - DNA, 25 bp, Artificial Sequence
  Description of Artificial Sequence: Synthetic oligonucleotide
cagactcaccgagtggacctgggga

SEQ ID NO: 3369 - DNA, 25 bp, Artificial Sequence
  Description of Artificial Sequence: Synthetic oligonucleotide
agactcaccgagtggacctggggac

SEQ ID NO: 3370 - DNA, 24 bp, Artificial Sequence
  Description of Artificial Sequence: Synthetic oligonucleotide
gactcaccgagtggacctggggac

SEQ ID NO: 3371 - DNA, 24 bp, Artificial Sequence
  Description of Artificial Sequence: Synthetic oligonucleotide
actcaccgagtggacctggggacc

SEQ ID NO: 3372 - DNA, 23 bp, Artificial Sequence
  Description of Artificial Sequence: Synthetic oligonucleotide
ctcaccgagtggacctggggacc

SEQ ID NO: 3373 - DNA, 24 bp, Artificial Sequence
  Description of Artificial Sequence: Synthetic oligonucleotide
tcaccgagtggacctggggaccct

SEQ ID NO: 3374 - DNA, 23 bp, Artificial Sequence
  Description of Artificial Sequence: Synthetic oligonucleotide
caccgagtggacctggggaccct

SEQ ID NO: 3375 - DNA, 24 bp, Artificial Sequence
  Description of Artificial Sequence: Synthetic oligonucleotide
cagagcgaggccggttctcacacc

SEQ ID NO: 3376 - DNA, 25 bp, Artificial Sequence
  Description of Artificial Sequence: Synthetic oligonucleotide
agagcgaggccggttctcacaccgt

SEQ ID NO: 3377 - DNA, 24 bp, Artificial Sequence
  Description of Artificial Sequence: Synthetic oligonucleotide
gagcgaggccggttctcacaccgt

SEQ ID NO: 3378 - DNA, 24 bp, Artificial Sequence
  Description of Artificial Sequence: Synthetic oligonucleotide
agcgaggccggttctcacaccgtc

SEQ ID NO: 3379 - DNA, 23 bp, Artificial Sequence
  Description of Artificial Sequence: Synthetic oligonucleotide
gcgaggccggttctcacaccgtc

SEQ ID NO: 3380 - DNA, 24 bp, Artificial Sequence
  Description of Artificial Sequence: Synthetic oligonucleotide
cgaggccggttctcacaccgtcca

SEQ ID NO: 3381 - DNA, 25 bp, Artificial Sequence
  Description of Artificial Sequence: Synthetic oligonucleotide
gaggccggttctcacaccgtccaga

SEQ ID NO: 3382 - DNA, 25 bp, Artificial Sequence
  Description of Artificial Sequence: Synthetic oligonucleotide
aggccggttctcacaccgtccagag

SEQ ID NO: 3383 - DNA, 24 bp, Artificial Sequence
  Description of Artificial Sequence: Synthetic oligonucleotide
ggccggttctcacaccgtccagag

SEQ ID NO: 3384 - DNA, 26 bp, Artificial Sequence
  Description of Artificial Sequence: Synthetic oligonucleotide
gccggttctcacaccgtccagaggat

SEQ ID NO: 3385 - DNA, 27 bp, Artificial Sequence
  Description of Artificial Sequence: Synthetic oligonucleotide
ccggttctcacaccgtccagaggatgt

SEQ ID NO: 3386 - DNA, 27 bp, Artificial Sequence
  Description of Artificial Sequence: Synthetic oligonucleotide
agaggatgtatggctgcgacgtggggt

SEQ ID NO: 3387 - DNA, 26 bp, Artificial Sequence
  Description of Artificial Sequence: Synthetic oligonucleotide
gaggatgtatggctgcgacgtggggt

SEQ ID NO: 3388 - DNA, 26 bp, Artificial Sequence
  Description of Artificial Sequence: Synthetic oligonucleotide
aggatgtatggctgcgacgtggggtc

SEQ ID NO: 3389 - DNA, 25 bp, Artificial Sequence
  Description of Artificial Sequence: Synthetic oligonucleotide
ggatgtatggctgcgacgtggggtc

SEQ ID NO: 3390 - DNA, 25 bp, Artificial Sequence
  Description of Artificial Sequence: Synthetic oligonucleotide
gatgtatggctgcgacgtggggtcg

SEQ ID NO: 3391 - DNA, 26 bp, Artificial Sequence
  Description of Artificial Sequence: Synthetic oligonucleotide
atgtatggctgcgacgtggggtcgga

SEQ ID NO: 3392 - DNA, 25 bp, Artificial Sequence
  Description of Artificial Sequence: Synthetic oligonucleotide
tgtatggctgcgacgtggggtcgga

SEQ ID NO: 3393 - DNA, 24 bp, Artificial Sequence
  Description of Artificial Sequence: Synthetic oligonucleotide
gtatggctgcgacgtggggtcgga

SEQ ID NO: 3394 - DNA, 25 bp, Artificial Sequence
  Description of Artificial Sequence: Synthetic oligonucleotide
tatggctgcgacgtggggtcggact

SEQ ID NO: 3395 - DNA, 24 bp, Artificial Sequence
  Description of Artificial Sequence: Synthetic oligonucleotide
atggctgcgacgtggggtcggact

SEQ ID NO: 3396 - DNA, 23 bp, Artificial Sequence
  Description of Artificial Sequence: Synthetic oligonucleotide
tggctgcgacgtggggtcggact

SEQ ID NO: 3397 - DNA, 22 bp, Artificial Sequence
  Description of Artificial Sequence: Synthetic oligonucleotide
ggctgcgacgtggggtcggact

SEQ ID NO: 3398 - DNA, 22 bp, Artificial Sequence
  Description of Artificial Sequence: Synthetic oligonucleotide
gctgcgacgtggggtcggactg

SEQ ID NO: 3399 - DNA, 22 bp, Artificial Sequence
  Description of Artificial Sequence: Synthetic oligonucleotide
ctgcgacgtggggtcggactgg

SEQ ID NO: 3400 - DNA, 22 bp, Artificial Sequence
  Description of Artificial Sequence: Synthetic oligonucleotide
tgcgacgtggggtcggactggc

SEQ ID NO: 3401 - DNA, 21 bp, Artificial Sequence
  Description of Artificial Sequence: Synthetic oligonucleotide
gcgacgtggggtcggactggc

SEQ ID NO: 3402 - DNA, 21 bp, Artificial Sequence
  Description of Artificial Sequence: Synthetic oligonucleotide
cgacgtggggtcggactggcg

SEQ ID NO: 3403 - DNA, 23 bp, Artificial Sequence
  Description of Artificial Sequence: Synthetic oligonucleotide
gacgtggggtcggactggcgctt

SEQ ID NO: 3404 - DNA, 23 bp, Artificial Sequence
  Description of Artificial Sequence: Synthetic oligonucleotide
acgtggggtcggactggcgcttc

SEQ ID NO: 3405 - DNA, 22 bp, Artificial Sequence
  Description of Artificial Sequence: Synthetic oligonucleotide
cgtggggtcggactggcgcttc

SEQ ID NO: 3406 - DNA, 23 bp, Artificial Sequence
  Description of Artificial Sequence: Synthetic oligonucleotide
gtggggtcggactggcgcttcct

SEQ ID NO: 3407 - DNA, 23 bp, Artificial Sequence
  Description of Artificial Sequence: Synthetic oligonucleotide
tggggtcggactggcgcttcctc

SEQ ID NO: 3408 - DNA, 22 bp, Artificial Sequence
  Description of Artificial Sequence: Synthetic oligonucleotide
ggggtcggactggcgcttcctc

SEQ ID NO: 3409 - DNA, 22 bp, Artificial Sequence
  Description of Artificial Sequence: Synthetic oligonucleotide
gggtcggactggcgcttcctcc

SEQ ID NO: 3410 - DNA, 22 bp, Artificial Sequence
  Description of Artificial Sequence: Synthetic oligonucleotide
ggtcggactggcgcttcctccg

SEQ ID NO: 3411 - DNA, 22 bp, Artificial Sequence
  Description of Artificial Sequence: Synthetic oligonucleotide
gtcggactggcgcttcctccgc

SEQ ID NO: 3412 - DNA, 22 bp, Artificial Sequence
  Description of Artificial Sequence: Synthetic oligonucleotide
tcggactggcgcttcctccgcg

SEQ ID NO: 3413 - DNA, 21 bp, Artificial Sequence
  Description of Artificial Sequence: Synthetic oligonucleotide
cggactggcgcttcctccgcg

SEQ ID NO: 3414 - DNA, 21 bp, Artificial Sequence
  Description of Artificial Sequence: Synthetic oligonucleotide
ggactggcgcttcctccgcgg

SEQ ID NO: 3415 - DNA, 23 bp, Artificial Sequence
  Description of Artificial Sequence: Synthetic oligonucleotide
gactggcgcttcctccgcgggta

SEQ ID NO: 3416 - DNA, 23 bp, Artificial Sequence
  Description of Artificial Sequence: Synthetic oligonucleotide
actggcgcttcctccgcgggtac

SEQ ID NO: 3417 - DNA, 22 bp, Artificial Sequence
  Description of Artificial Sequence: Synthetic oligonucleotide
ctggcgcttcctccgcgggtac

SEQ ID NO: 3418 - DNA, 23 bp, Artificial Sequence
  Description of Artificial Sequence: Synthetic oligonucleotide
tggcgcttcctccgcgggtacca

SEQ ID NO: 3419 - DNA, 31 bp, Artificial Sequence
  Description of Artificial Sequence: Synthetic oligonucleotide
tacgacggcaaggattacatcgccctgaaag

SEQ ID NO: 3420 - DNA, 30 bp, Artificial Sequence
  Description of Artificial Sequence: Synthetic oligonucleotide
acgacggcaaggattacatcgccctgaaag

SEQ ID NO: 3421 - DNA, 29 bp, Artificial Sequence
  Description of Artificial Sequence: Synthetic oligonucleotide
cgacggcaaggattacatcgccctgaaag

SEQ ID NO: 3422 - DNA, 30 bp, Artificial Sequence
  Description of Artificial Sequence: Synthetic oligonucleotide
gacggcaaggattacatcgccctgaaagag

SEQ ID NO: 3423 - DNA, 30 bp, Artificial Sequence
  Description of Artificial Sequence: Synthetic oligonucleotide
acggcaaggattacatcgccctgaaagagg

SEQ ID NO: 3424 - DNA, 29 bp, Artificial Sequence
  Description of Artificial Sequence: Synthetic oligonucleotide
cggcaaggattacatcgccctgaaagagg

SEQ ID NO: 3425 - DNA, 30 bp, Artificial Sequence
  Description of Artificial Sequence: Synthetic oligonucleotide
ggcaaggattacatcgccctgaaagaggac

SEQ ID NO: 3426 - DNA, 30 bp, Artificial Sequence
  Description of Artificial Sequence: Synthetic oligonucleotide
gcaaggattacatcgccctgaaagaggacc

SEQ ID NO: 3427 - DNA, 31 bp, Artificial Sequence
  Description of Artificial Sequence: Synthetic oligonucleotide
caaggattacatcgccctgaaagaggacctg

SEQ ID NO: 3428 - DNA, 31 bp, Artificial Sequence
  Description of Artificial Sequence: Synthetic oligonucleotide
aaggattacatcgccctgaaagaggacctgc

SEQ ID NO: 3429 - DNA, 30 bp, Artificial Sequence
  Description of Artificial Sequence: Synthetic oligonucleotide
aggattacatcgccctgaaagaggacctgc

SEQ ID NO: 3430 - DNA, 29 bp, Artificial Sequence
  Description of Artificial Sequence: Synthetic oligonucleotide
ggattacatcgccctgaaagaggacctgc

SEQ ID NO: 3431 - DNA, 29 bp, Artificial Sequence
  Description of Artificial Sequence: Synthetic oligonucleotide
gattacatcgccctgaaagaggacctgcg

SEQ ID NO: 3432 - DNA, 29 bp, Artificial Sequence
  Description of Artificial Sequence: Synthetic oligonucleotide
attacatcgccctgaaagaggacctgcgc

SEQ ID NO: 3433 - DNA, 28 bp, Artificial Sequence
  Description of Artificial Sequence: Synthetic oligonucleotide
ttacatcgccctgaaagaggacctgcgc

SEQ ID NO: 3434 - DNA, 27 bp, Artificial Sequence
  Description of Artificial Sequence: Synthetic oligonucleotide
tacatcgccctgaaagaggacctgcgc

SEQ ID NO: 3435 - DNA, 27 bp, Artificial Sequence
  Description of Artificial Sequence: Synthetic oligonucleotide
acatcgccctgaaagaggacctgcgct

SEQ ID NO: 3436 - DNA, 26 bp, Artificial Sequence
  Description of Artificial Sequence: Synthetic oligonucleotide
catcgccctgaaagaggacctgcgct

SEQ ID NO: 3437 - DNA, 27 bp, Artificial Sequence
  Description of Artificial Sequence: Synthetic oligonucleotide
atcgccctgaaagaggacctgcgctct

SEQ ID NO: 3438 - DNA, 27 bp, Artificial Sequence
  Description of Artificial Sequence: Synthetic oligonucleotide
tcgccctgaaagaggacctgcgctctt

SEQ ID NO: 3439 - DNA, 26 bp, Artificial Sequence
  Description of Artificial Sequence: Synthetic oligonucleotide
cgccctgaaagaggacctgcgctctt

SEQ ID NO: 3440 - DNA, 26 bp, Artificial Sequence
  Description of Artificial Sequence: Synthetic oligonucleotide
gccctgaaagaggacctgcgctcttg

SEQ ID NO: 3441 - DNA, 27 bp, Artificial Sequence
  Description of Artificial Sequence: Synthetic oligonucleotide
ccctgaaagaggacctgcgctcttgga

SEQ ID NO: 3442 - DNA, 27 bp, Artificial Sequence
  Description of Artificial Sequence: Synthetic oligonucleotide
cctgaaagaggacctgcgctcttggac

SEQ ID NO: 3443 - DNA, 27 bp, Artificial Sequence
  Description of Artificial Sequence: Synthetic oligonucleotide
ctgaaagaggacctgcgctcttggacc

SEQ ID NO: 3444 - DNA, 27 bp, Artificial Sequence
  Description of Artificial Sequence: Synthetic oligonucleotide
tgaaagaggacctgcgctcttggaccg

SEQ ID NO: 3445 - DNA, 26 bp, Artificial Sequence
  Description of Artificial Sequence: Synthetic oligonucleotide
gaaagaggacctgcgctcttggaccg

SEQ ID NO: 3446 - DNA, 26 bp, Artificial Sequence
  Description of Artificial Sequence: Synthetic oligonucleotide
aaagaggacctgcgctcttggaccgc

SEQ ID NO: 3447 - DNA, 25 bp, Artificial Sequence
  Description of Artificial Sequence: Synthetic oligonucleotide
aagaggacctgcgctcttggaccgc

SEQ ID NO: 3448 - DNA, 24 bp, Artificial Sequence
  Description of Artificial Sequence: Synthetic oligonucleotide
agaggacctgcgctcttggaccgc

SEQ ID NO: 3449 - DNA, 23 bp, Artificial Sequence
  Description of Artificial Sequence: Synthetic oligonucleotide
cgcggcggacatggcagctcaga

SEQ ID NO: 3450 - DNA, 23 bp, Artificial Sequence
  Description of Artificial Sequence: Synthetic oligonucleotide
gcggcggacatggcagctcagac

SEQ ID NO: 3451 - DNA, 24 bp, Artificial Sequence
  Description of Artificial Sequence: Synthetic oligonucleotide
cggcggacatggcagctcagacca

SEQ ID NO: 3452 - DNA, 24 bp, Artificial Sequence
  Description of Artificial Sequence: Synthetic oligonucleotide
ggcggacatggcagctcagaccac

SEQ ID NO: 3453 - DNA, 26 bp, Artificial Sequence
  Description of Artificial Sequence: Synthetic oligonucleotide
gcggacatggcagctcagaccaccaa

SEQ ID NO: 3454 - DNA, 26 bp, Artificial Sequence
  Description of Artificial Sequence: Synthetic oligonucleotide
cggacatggcagctcagaccaccaag

SEQ ID NO: 3455 - DNA, 27 bp, Artificial Sequence
  Description of Artificial Sequence: Synthetic oligonucleotide
ggacatggcagctcagaccaccaagca

SEQ ID NO: 3456 - DNA, 27 bp, Artificial Sequence
  Description of Artificial Sequence: Synthetic oligonucleotide
gacatggcagctcagaccaccaagcac

SEQ ID NO: 3457 - DNA, 29 bp, Artificial Sequence
  Description of Artificial Sequence: Synthetic oligonucleotide
acatggcagctcagaccaccaagcacaag

SEQ ID NO: 3458 - DNA, 28 bp, Artificial Sequence
  Description of Artificial Sequence: Synthetic oligonucleotide
catggcagctcagaccaccaagcacaag

SEQ ID NO: 3459 - DNA, 29 bp, Artificial Sequence
  Description of Artificial Sequence: Synthetic oligonucleotide
atggcagctcagaccaccaagcacaagtg

SEQ ID NO: 3460 - DNA, 28 bp, Artificial Sequence
  Description of Artificial Sequence: Synthetic oligonucleotide
tggcagctcagaccaccaagcacaagtg

SEQ ID NO: 3461 - DNA, 27 bp, Artificial Sequence
  Description of Artificial Sequence: Synthetic oligonucleotide
ggcagctcagaccaccaagcacaagtg

SEQ ID NO: 3462 - DNA, 27 bp, Artificial Sequence
  Description of Artificial Sequence: Synthetic oligonucleotide
gcagctcagaccaccaagcacaagtgg

SEQ ID NO: 3463 - DNA, 27 bp, Artificial Sequence
  Description of Artificial Sequence: Synthetic oligonucleotide
cagctcagaccaccaagcacaagtggg

SEQ ID NO: 3464 - DNA, 28 bp, Artificial Sequence
  Description of Artificial Sequence: Synthetic oligonucleotide
agctcagaccaccaagcacaagtgggag

SEQ ID NO: 3465 - DNA, 27 bp, Artificial Sequence
  Description of Artificial Sequence: Synthetic oligonucleotide
gctcagaccaccaagcacaagtgggag

SEQ ID NO: 3466 - DNA, 27 bp, Artificial Sequence
  Description of Artificial Sequence: Synthetic oligonucleotide
ctcagaccaccaagcacaagtgggagg

SEQ ID NO: 3467 - DNA, 27 bp, Artificial Sequence
  Description of Artificial Sequence: Synthetic oligonucleotide
tcagaccaccaagcacaagtgggaggc

SEQ ID NO: 3468 - DNA, 26 bp, Artificial Sequence
  Description of Artificial Sequence: Synthetic oligonucleotide
cagaccaccaagcacaagtgggaggc

SEQ ID NO: 3469 - DNA, 26 bp, Artificial Sequence
  Description of Artificial Sequence: Synthetic oligonucleotide
agaccaccaagcacaagtgggaggcg

SEQ ID NO: 3470 - DNA, 25 bp, Artificial Sequence
  Description of Artificial Sequence: Synthetic oligonucleotide
gaccaccaagcacaagtgggaggcg

SEQ ID NO: 3471 - DNA, 25 bp, Artificial Sequence
  Description of Artificial Sequence: Synthetic oligonucleotide
accaccaagcacaagtgggaggcgg

SEQ ID NO: 3472 - DNA, 24 bp, Artificial Sequence
  Description of Artificial Sequence: Synthetic oligonucleotide
ccaccaagcacaagtgggaggcgg

SEQ ID NO: 3473 - DNA, 24 bp, Artificial Sequence
  Description of Artificial Sequence: Synthetic oligonucleotide
caccaagcacaagtgggaggcggc

SEQ ID NO: 3474 - DNA, 24 bp, Artificial Sequence
  Description of Artificial Sequence: Synthetic oligonucleotide
accaagcacaagtgggaggcggcc

SEQ ID NO: 3475 - DNA, 23 bp, Artificial Sequence
  Description of Artificial Sequence: Synthetic oligonucleotide
ccaagcacaagtgggaggcggcc

SEQ ID NO: 3476 - DNA, 25 bp, Artificial Sequence
  Description of Artificial Sequence: Synthetic oligonucleotide
caagcacaagtgggaggcggcccat

SEQ ID NO: 3477 - DNA, 26 bp, Artificial Sequence
  Description of Artificial Sequence: Synthetic oligonucleotide
aagcacaagtgggaggcggcccatgt

SEQ ID NO: 3478 - DNA, 25 bp, Artificial Sequence
  Description of Artificial Sequence: Synthetic oligonucleotide
agcacaagtgggaggcggcccatgt

SEQ ID NO: 3479 - DNA, 24 bp, Artificial Sequence
  Description of Artificial Sequence: Synthetic oligonucleotide
gcacaagtgggaggcggcccatgt

SEQ ID NO: 3480 - DNA, 24 bp, Artificial Sequence
  Description of Artificial Sequence: Synthetic oligonucleotide
cacaagtgggaggcggcccatgtg

SEQ ID NO: 3481 - DNA, 24 bp, Artificial Sequence
  Description of Artificial Sequence: Synthetic oligonucleotide
acaagtgggaggcggcccatgtgg

SEQ ID NO: 3482 - DNA, 23 bp, Artificial Sequence
  Description of Artificial Sequence: Synthetic oligonucleotide
gcggcccatgtggcggagcagtt

SEQ ID NO: 3483 - DNA, 24 bp, Artificial Sequence
  Description of Artificial Sequence: Synthetic oligonucleotide
cggcccatgtggcggagcagttga

SEQ ID NO: 3484 - DNA, 25 bp, Artificial Sequence
  Description of Artificial Sequence: Synthetic oligonucleotide
ggcccatgtggcggagcagttgaga

SEQ ID NO: 3485 - DNA, 25 bp, Artificial Sequence
  Description of Artificial Sequence: Synthetic oligonucleotide
gcccatgtggcggagcagttgagag

SEQ ID NO: 3486 - DNA, 25 bp, Artificial Sequence
  Description of Artificial Sequence: Synthetic oligonucleotide
cccatgtggcggagcagttgagagc

SEQ ID NO: 3487 - DNA, 27 bp, Artificial Sequence
  Description of Artificial Sequence: Synthetic oligonucleotide
ccatgtggcggagcagttgagagccta

SEQ ID NO: 3488 - DNA, 27 bp, Artificial Sequence
  Description of Artificial Sequence: Synthetic oligonucleotide
catgtggcggagcagttgagagcctac

SEQ ID NO: 3489 - DNA, 27 bp, Artificial Sequence
  Description of Artificial Sequence: Synthetic oligonucleotide
atgtggcggagcagttgagagcctacc

SEQ ID NO: 3490 - DNA, 27 bp, Artificial Sequence
  Description of Artificial Sequence: Synthetic oligonucleotide
tgtggcggagcagttgagagcctacct

SEQ ID NO: 3491 - DNA, 26 bp, Artificial Sequence
  Description of Artificial Sequence: Synthetic oligonucleotide
gtggcggagcagttgagagcctacct

SEQ ID NO: 3492 - DNA, 26 bp, Artificial Sequence
  Description of Artificial Sequence: Synthetic oligonucleotide
tggcggagcagttgagagcctacctg

SEQ ID NO: 3493 - DNA, 27 bp, Artificial Sequence
  Description of Artificial Sequence: Synthetic oligonucleotide
agcagttgagagcctacctggagggca

SEQ ID NO: 3494 - DNA, 26 bp, Artificial Sequence
  Description of Artificial Sequence: Synthetic oligonucleotide
gcagttgagagcctacctggagggca

SEQ ID NO: 3495 - DNA, 26 bp, Artificial Sequence
  Description of Artificial Sequence: Synthetic oligonucleotide
cagttgagagcctacctggagggcac

SEQ ID NO: 3496 - DNA, 27 bp, Artificial Sequence
  Description of Artificial Sequence: Synthetic oligonucleotide
agttgagagcctacctggagggcacgt

SEQ ID NO: 3497 - DNA, 26 bp, Artificial Sequence
  Description of Artificial Sequence: Synthetic oligonucleotide
gttgagagcctacctggagggcacgt

SEQ ID NO: 3498 - DNA, 26 bp, Artificial Sequence
  Description of Artificial Sequence: Synthetic oligonucleotide
ttgagagcctacctggagggcacgtg

SEQ ID NO: 3499 - DNA, 25 bp, Artificial Sequence
  Description of Artificial Sequence: Synthetic oligonucleotide
tgagagcctacctggagggcacgtg

SEQ ID NO: 3500 - DNA, 25 bp, Artificial Sequence
  Description of Artificial Sequence: Synthetic oligonucleotide
tacctggagggcacgtgcgtggagt

SEQ ID NO: 3501 - DNA, 24 bp, Artificial Sequence
  Description of Artificial Sequence: Synthetic oligonucleotide
acctggagggcacgtgcgtggagt

SEQ ID NO: 3502 - DNA, 23 bp, Artificial Sequence
  Description of Artificial Sequence: Synthetic oligonucleotide
cctggagggcacgtgcgtggagt

SEQ ID NO: 3503 - DNA, 23 bp, Artificial Sequence
  Description of Artificial Sequence: Synthetic oligonucleotide
ctggagggcacgtgcgtggagtg

SEQ ID NO: 3504 - DNA, 23 bp, Artificial Sequence
  Description of Artificial Sequence: Synthetic oligonucleotide
tggagggcacgtgcgtggagtgg

SEQ ID NO: 3505 - DNA, 22 bp, Artificial Sequence
  Description of Artificial Sequence: Synthetic oligonucleotide
ggagggcacgtgcgtggagtgg

SEQ ID NO: 3506 - DNA, 23 bp, Artificial Sequence
  Description of Artificial Sequence: Synthetic oligonucleotide
gagggcacgtgcgtggagtggct

SEQ ID NO: 3507 - DNA, 23 bp, Artificial Sequence
  Description of Artificial Sequence: Synthetic oligonucleotide
agggcacgtgcgtggagtggctc

SEQ ID NO: 3508 - DNA, 22 bp, Artificial Sequence
  Description of Artificial Sequence: Synthetic oligonucleotide
gggcacgtgcgtggagtggctc

SEQ ID NO: 3509 - DNA, 22 bp, Artificial Sequence
  Description of Artificial Sequence: Synthetic oligonucleotide
ggcacgtgcgtggagtggctcc

SEQ ID NO: 3510 - DNA, 22 bp, Artificial Sequence
  Description of Artificial Sequence: Synthetic oligonucleotide
gcacgtgcgtggagtggctccg

SEQ ID NO: 3511 - DNA, 23 bp, Artificial Sequence
  Description of Artificial Sequence: Synthetic oligonucleotide
cacgtgcgtggagtggctccgca

SEQ ID NO: 3512 - DNA, 26 bp, Artificial Sequence
  Description of Artificial Sequence: Synthetic oligonucleotide
acgtgcgtggagtggctccgcagata

SEQ ID NO: 3513 - DNA, 25 bp, Artificial Sequence
  Description of Artificial Sequence: Synthetic oligonucleotide
cgtgcgtggagtggctccgcagata

SEQ ID NO: 3514 - DNA, 25 bp, Artificial Sequence
  Description of Artificial Sequence: Synthetic oligonucleotide
gtgcgtggagtggctccgcagatac

SEQ ID NO: 3515 - DNA, 26 bp, Artificial Sequence
  Description of Artificial Sequence: Synthetic oligonucleotide
tgcgtggagtggctccgcagatacct

SEQ ID NO: 3516 - DNA, 25 bp, Artificial Sequence
  Description of Artificial Sequence: Synthetic oligonucleotide
gcgtggagtggctccgcagatacct

SEQ ID NO: 3517 - DNA, 25 bp, Artificial Sequence
  Description of Artificial Sequence: Synthetic oligonucleotide
cgtggagtggctccgcagatacctg

SEQ ID NO: 3518 - DNA, 26 bp, Artificial Sequence
  Description of Artificial Sequence: Synthetic oligonucleotide
gtggagtggctccgcagatacctgga

SEQ ID NO: 3519 - DNA, 27 bp, Artificial Sequence
  Description of Artificial Sequence: Synthetic oligonucleotide
tggagtggctccgcagatacctggaga

SEQ ID NO: 3520 - DNA, 27 bp, Artificial Sequence
  Description of Artificial Sequence: Synthetic oligonucleotide
ggagtggctccgcagatacctggagaa

SEQ ID NO: 3521 - DNA, 27 bp, Artificial Sequence
  Description of Artificial Sequence: Synthetic oligonucleotide
gagtggctccgcagatacctggagaac

SEQ ID NO: 3522 - DNA, 27 bp, Artificial Sequence
  Description of Artificial Sequence: Synthetic oligonucleotide
agtggctccgcagatacctggagaacg

SEQ ID NO: 3523 - DNA, 26 bp, Artificial Sequence
  Description of Artificial Sequence: Synthetic oligonucleotide
gtggctccgcagatacctggagaacg

SEQ ID NO: 3524 - DNA, 26 bp, Artificial Sequence
  Description of Artificial Sequence: Synthetic oligonucleotide
tggctccgcagatacctggagaacgg

SEQ ID NO: 3525 - DNA, 22 bp, Artificial Sequence
  Description of Artificial Sequence: Synthetic oligonucleotide
gagacgctgcagcgcacggacg

SEQ ID NO: 3526 - DNA, 22 bp, Artificial Sequence
  Description of Artificial Sequence: Synthetic oligonucleotide
agacgctgcagcgcacggacgc

SEQ ID NO: 3527 - DNA, 21 bp, Artificial Sequence
  Description of Artificial Sequence: Synthetic oligonucleotide
gacgctgcagcgcacggacgc

SEQ ID NO: 3528 - DNA, 21 bp, Artificial Sequence
  Description of Artificial Sequence: Synthetic oligonucleotide
acgctgcagcgcacggacgcc

SEQ ID NO: 3529 - DNA, 20 bp, Artificial Sequence
  Description of Artificial Sequence: Synthetic oligonucleotide
cgctgcagcgcacggacgcc

SEQ ID NO: 3530 - DNA, 20 bp, Artificial Sequence
  Description of Artificial Sequence: Synthetic oligonucleotide
gctgcagcgcacggacgccc

SEQ ID NO: 3531 - DNA, 20 bp, Artificial Sequence
  Description of Artificial Sequence: Synthetic oligonucleotide
ctgcagcgcacggacgcccc

SEQ ID NO: 3532 - DNA, 24 bp, Artificial Sequence
  Description of Artificial Sequence: Synthetic oligonucleotide
tgcagcgcacggacgcccccaaaa

SEQ ID NO: 3533 - DNA, 23 bp, Artificial Sequence
  Description of Artificial Sequence: Synthetic oligonucleotide
gcagcgcacggacgcccccaaaa

SEQ ID NO: 3534 - DNA, 23 bp, Artificial Sequence
  Description of Artificial Sequence: Synthetic oligonucleotide
cagcgcacggacgcccccaaaac

SEQ ID NO: 3535 - DNA, 23 bp, Artificial Sequence
  Description of Artificial Sequence: Synthetic oligonucleotide
agcgcacggacgcccccaaaacg

SEQ ID NO: 3536 - DNA, 22 bp, Artificial Sequence
  Description of Artificial Sequence: Synthetic oligonucleotide
gcgcacggacgcccccaaaacg

SEQ ID NO: 3537 - DNA, 26 bp, Artificial Sequence
  Description of Artificial Sequence: Synthetic oligonucleotide
cgcacggacgcccccaaaacgcatat

SEQ ID NO: 3538 - DNA, 27 bp, Artificial Sequence
  Description of Artificial Sequence: Synthetic oligonucleotide
gcacggacgcccccaaaacgcatatga

SEQ ID NO: 3539 - DNA, 27 bp, Artificial Sequence
  Description of Artificial Sequence: Synthetic oligonucleotide
cacggacgcccccaaaacgcatatgac

SEQ ID NO: 3540 - DNA, 28 bp, Artificial Sequence
  Description of Artificial Sequence: Synthetic oligonucleotide
acggacgcccccaaaacgcatatgactc

SEQ ID NO: 3541 - DNA, 27 bp, Artificial Sequence
  Description of Artificial Sequence: Synthetic oligonucleotide
cggacgcccccaaaacgcatatgactc

SEQ ID NO: 3542 - DNA, 28 bp, Artificial Sequence
  Description of Artificial Sequence: Synthetic oligonucleotide
ggacgcccccaaaacgcatatgactcac

SEQ ID NO: 3543 - DNA, 28 bp, Artificial Sequence
  Description of Artificial Sequence: Synthetic oligonucleotide
gacgcccccaaaacgcatatgactcacc

SEQ ID NO: 3544 - DNA, 29 bp, Artificial Sequence
  Description of Artificial Sequence: Synthetic oligonucleotide
acgcccccaaaacgcatatgactcaccac

SEQ ID NO: 3545 - DNA, 28 bp, Artificial Sequence
  Description of Artificial Sequence: Synthetic oligonucleotide
cgcccccaaaacgcatatgactcaccac

SEQ ID NO: 3546 - DNA, 28 bp, Artificial Sequence
  Description of Artificial Sequence: Synthetic oligonucleotide
gcccccaaaacgcatatgactcaccacg

SEQ ID NO: 3547 - DNA, 28 bp, Artificial Sequence
  Description of Artificial Sequence: Synthetic oligonucleotide
cccccaaaacgcatatgactcaccacgc

SEQ ID NO: 3548 - DNA, 29 bp, Artificial Sequence
  Description of Artificial Sequence: Synthetic oligonucleotide
ccccaaaacgcatatgactcaccacgctg

SEQ ID NO: 3549 - DNA, 30 bp, Artificial Sequence
  Description of Artificial Sequence: Synthetic oligonucleotide
cccaaaacgcatatgactcaccacgctgtc

SEQ ID NO: 3550 - DNA, 31 bp, Artificial Sequence
  Description of Artificial Sequence: Synthetic oligonucleotide
ccaaaacgcatatgactcaccacgctgtctc

SEQ ID NO: 3551 - DNA, 32 bp, Artificial Sequence
  Description of Artificial Sequence: Synthetic oligonucleotide
caaaacgcatatgactcaccacgctgtctctg

SEQ ID NO: 3552 - DNA, 33 bp, Artificial Sequence
  Description of Artificial Sequence: Synthetic oligonucleotide
aaaacgcatatgactcaccacgctgtctctgac

SEQ ID NO: 3553 - DNA, 32 bp, Artificial Sequence
  Description of Artificial Sequence: Synthetic oligonucleotide
aaacgcatatgactcaccacgctgtctctgac

SEQ ID NO: 3554 - DNA, 31 bp, Artificial Sequence
  Description of Artificial Sequence: Synthetic oligonucleotide
aacgcatatgactcaccacgctgtctctgac

SEQ ID NO: 3555 - DNA, 30 bp, Artificial Sequence
  Description of Artificial Sequence: Synthetic oligonucleotide
acgcatatgactcaccacgctgtctctgac

SEQ ID NO: 3556 - DNA, 29 bp, Artificial Sequence
  Description of Artificial Sequence: Synthetic oligonucleotide
cgcatatgactcaccacgctgtctctgac

SEQ ID NO: 3557 - DNA, 29 bp, Artificial Sequence
  Description of Artificial Sequence: Synthetic oligonucleotide
gcatatgactcaccacgctgtctctgacc

SEQ ID NO: 3558 - DNA, 31 bp, Artificial Sequence
  Description of Artificial Sequence: Synthetic oligonucleotide
catatgactcaccacgctgtctctgaccatg

SEQ ID NO: 3559 - DNA, 33 bp, Artificial Sequence
  Description of Artificial Sequence: Synthetic oligonucleotide
atatgactcaccacgctgtctctgaccatgaag

SEQ ID NO: 3560 - DNA, 32 bp, Artificial Sequence
  Description of Artificial Sequence: Synthetic oligonucleotide
tatgactcaccacgctgtctctgaccatgaag

SEQ ID NO: 3561 - DNA, 31 bp, Artificial Sequence
  Description of Artificial Sequence: Synthetic oligonucleotide
atgactcaccacgctgtctctgaccatgaag

SEQ ID NO: 3562 - DNA, 30 bp, Artificial Sequence
  Description of Artificial Sequence: Synthetic oligonucleotide
tgactcaccacgctgtctctgaccatgaag

SEQ ID NO: 3563 - DNA, 29 bp, Artificial Sequence
  Description of Artificial Sequence: Synthetic oligonucleotide
gactcaccacgctgtctctgaccatgaag

SEQ ID NO: 3564 - DNA, 29 bp, Artificial Sequence
  Description of Artificial Sequence: Synthetic oligonucleotide
actcaccacgctgtctctgaccatgaagc

SEQ ID NO: 3565 - DNA, 28 bp, Artificial Sequence
  Description of Artificial Sequence: Synthetic oligonucleotide
ctcaccacgctgtctctgaccatgaagc

SEQ ID NO: 3566 - DNA, 28 bp, Artificial Sequence
  Description of Artificial Sequence: Synthetic oligonucleotide
tcaccacgctgtctctgaccatgaagcc

SEQ ID NO: 3567 - DNA, 27 bp, Artificial Sequence
  Description of Artificial Sequence: Synthetic oligonucleotide
caccacgctgtctctgaccatgaagcc

SEQ ID NO: 3568 - DNA, 28 bp, Artificial Sequence
  Description of Artificial Sequence: Synthetic oligonucleotide
accacgctgtctctgaccatgaagccac

SEQ ID NO: 3569 - DNA, 27 bp, Artificial Sequence
  Description of Artificial Sequence: Synthetic oligonucleotide
ccacgctgtctctgaccatgaagccac

SEQ ID NO: 3570 - DNA, 27 bp, Artificial Sequence
  Description of Artificial Sequence: Synthetic oligonucleotide
cacgctgtctctgaccatgaagccacc

SEQ ID NO: 3571 - DNA, 27 bp, Artificial Sequence
  Description of Artificial Sequence: Synthetic oligonucleotide
acgctgtctctgaccatgaagccaccc

SEQ ID NO: 3572 - DNA, 27 bp, Artificial Sequence
  Description of Artificial Sequence: Synthetic oligonucleotide
cgctgtctctgaccatgaagccaccct

SEQ ID NO: 3573 - DNA, 27 bp, Artificial Sequence
  Description of Artificial Sequence: Synthetic oligonucleotide
gctgtctctgaccatgaagccaccctg

SEQ ID NO: 3574 - DNA, 28 bp, Artificial Sequence
  Description of Artificial Sequence: Synthetic oligonucleotide
ctgtctctgaccatgaagccaccctgag

SEQ ID NO: 3575 - DNA, 28 bp, Artificial Sequence
  Description of Artificial Sequence: Synthetic oligonucleotide
tgtctctgaccatgaagccaccctgagg

SEQ ID NO: 3576 - DNA, 27 bp, Artificial Sequence
  Description of Artificial Sequence: Synthetic oligonucleotide
gtctctgaccatgaagccaccctgagg

SEQ ID NO: 3577 - DNA, 28 bp, Artificial Sequence
  Description of Artificial Sequence: Synthetic oligonucleotide
tctctgaccatgaagccaccctgaggtg

SEQ ID NO: 3578 - DNA, 27 bp, Artificial Sequence
  Description of Artificial Sequence: Synthetic oligonucleotide
ctctgaccatgaagccaccctgaggtg

SEQ ID NO: 3579 - DNA, 27 bp, Artificial Sequence
  Description of Artificial Sequence: Synthetic oligonucleotide
tctgaccatgaagccaccctgaggtgc

SEQ ID NO: 3580 - DNA, 27 bp, Artificial Sequence
  Description of Artificial Sequence: Synthetic oligonucleotide
ctgaccatgaagccaccctgaggtgct

SEQ ID NO: 3581 - DNA, 27 bp, Artificial Sequence
  Description of Artificial Sequence: Synthetic oligonucleotide
tgaccatgaagccaccctgaggtgctg

SEQ ID NO: 3582 - DNA, 26 bp, Artificial Sequence
  Description of Artificial Sequence: Synthetic oligonucleotide
gaccatgaagccaccctgaggtgctg

SEQ ID NO: 3583 - DNA, 26 bp, Artificial Sequence
  Description of Artificial Sequence: Synthetic oligonucleotide
accatgaagccaccctgaggtgctgg

SEQ ID NO: 3584 - DNA, 25 bp, Artificial Sequence
  Description of Artificial Sequence: Synthetic oligonucleotide
ccatgaagccaccctgaggtgctgg

SEQ ID NO: 3585 - DNA, 25 bp, Artificial Sequence
  Description of Artificial Sequence: Synthetic oligonucleotide
catgaagccaccctgaggtgctggg

SEQ ID NO: 3586 - DNA, 25 bp, Artificial Sequence
  Description of Artificial Sequence: Synthetic oligonucleotide
atgaagccaccctgaggtgctgggc

SEQ ID NO: 3587 - DNA, 24 bp, Artificial Sequence
  Description of Artificial Sequence: Synthetic oligonucleotide
tgaagccaccctgaggtgctgggc

SEQ ID NO: 3588 - DNA, 23 bp, Artificial Sequence
  Description of Artificial Sequence: Synthetic oligonucleotide
gaagccaccctgaggtgctgggc

SEQ ID NO: 3589 - DNA, 23 bp, Artificial Sequence
  Description of Artificial Sequence: Synthetic oligonucleotide
aagccaccctgaggtgctgggcc

SEQ ID NO: 3590 - DNA, 22 bp, Artificial Sequence
  Description of Artificial Sequence: Synthetic oligonucleotide
agccaccctgaggtgctgggcc

SEQ ID NO: 3591 - DNA, 23 bp, Artificial Sequence
  Description of Artificial Sequence: Synthetic oligonucleotide
caccctgaggtgctgggccctga

SEQ ID NO: 3592 - DNA, 23 bp, Artificial Sequence
  Description of Artificial Sequence: Synthetic oligonucleotide
accctgaggtgctgggccctgag

SEQ ID NO: 3593 - DNA, 22 bp, Artificial Sequence
  Description of Artificial Sequence: Synthetic oligonucleotide
ccctgaggtgctgggccctgag

SEQ ID NO: 3594 - DNA, 24 bp, Artificial Sequence
  Description of Artificial Sequence: Synthetic oligonucleotide
cctgaggtgctgggccctgagctt

SEQ ID NO: 3595 - DNA, 26 bp, Artificial Sequence
  Description of Artificial Sequence: Synthetic oligonucleotide
ctgaggtgctgggccctgagcttcta

SEQ ID NO: 3596 - DNA, 26 bp, Artificial Sequence
  Description of Artificial Sequence: Synthetic oligonucleotide
tgaggtgctgggccctgagcttctac

SEQ ID NO: 3597 - DNA, 25 bp, Artificial Sequence
  Description of Artificial Sequence: Synthetic oligonucleotide
gaggtgctgggccctgagcttctac

SEQ ID NO: 3598 - DNA, 25 bp, Artificial Sequence
  Description of Artificial Sequence: Synthetic oligonucleotide
aggtgctgggccctgagcttctacc

SEQ ID NO: 3599 - DNA, 24 bp, Artificial Sequence
  Description of Artificial Sequence: Synthetic oligonucleotide
ggtgctgggccctgagcttctacc

SEQ ID NO: 3600 - DNA, 25 bp, Artificial Sequence
  Description of Artificial Sequence: Synthetic oligonucleotide
gtgctgggccctgagcttctaccct

SEQ ID NO: 3601 - DNA, 25 bp, Artificial Sequence
  Description of Artificial Sequence: Synthetic oligonucleotide
tgctgggccctgagcttctaccctg

SEQ ID NO: 3602 - DNA, 24 bp, Artificial Sequence
  Description of Artificial Sequence: Synthetic oligonucleotide
gctgggccctgagcttctaccctg

SEQ ID NO: 3603 - DNA, 24 bp, Artificial Sequence
  Description of Artificial Sequence: Synthetic oligonucleotide
ctgggccctgagcttctaccctgc

SEQ ID NO: 3604 - DNA, 24 bp, Artificial Sequence
  Description of Artificial Sequence: Synthetic oligonucleotide
tgggccctgagcttctaccctgcg

SEQ ID NO: 3605 - DNA, 23 bp, Artificial Sequence
  Description of Artificial Sequence: Synthetic oligonucleotide
gggccctgagcttctaccctgcg

SEQ ID NO: 3606 - DNA, 24 bp, Artificial Sequence
  Description of Artificial Sequence: Synthetic oligonucleotide
ggccctgagcttctaccctgcgga

SEQ ID NO: 3607 - DNA, 26 bp, Artificial Sequence
  Description of Artificial Sequence: Synthetic oligonucleotide
gccctgagcttctaccctgcggagat

SEQ ID NO: 3608 - DNA, 27 bp, Artificial Sequence
  Description of Artificial Sequence: Synthetic oligonucleotide
ccctgagcttctaccctgcggagatca

SEQ ID NO: 3609 - DNA, 27 bp, Artificial Sequence
  Description of Artificial Sequence: Synthetic oligonucleotide
cctgagcttctaccctgcggagatcac

SEQ ID NO: 3610 - DNA, 28 bp, Artificial Sequence
  Description of Artificial Sequence: Synthetic oligonucleotide
ctgagcttctaccctgcggagatcacac

SEQ ID NO: 3611 - DNA, 29 bp, Artificial Sequence
  Description of Artificial Sequence: Synthetic oligonucleotide
tgagcttctaccctgcggagatcacactg

SEQ ID NO: 3612 - DNA, 28 bp, Artificial Sequence
  Description of Artificial Sequence: Synthetic oligonucleotide
gagcttctaccctgcggagatcacactg

SEQ ID NO: 3613 - DNA, 29 bp, Artificial Sequence
  Description of Artificial Sequence: Synthetic oligonucleotide
agcttctaccctgcggagatcacactgac

SEQ ID NO: 3614 - DNA, 25 bp, Artificial Sequence
  Description of Artificial Sequence: Synthetic oligonucleotide
cggctgtggtggtgccttctggaca

SEQ ID NO: 3615 - DNA, 25 bp, Artificial Sequence
  Description of Artificial Sequence: Synthetic oligonucleotide
ggctgtggtggtgccttctggacag

SEQ ID NO: 3616 - DNA, 26 bp, Artificial Sequence
  Description of Artificial Sequence: Synthetic oligonucleotide
gctgtggtggtgccttctggacagga

SEQ ID NO: 3617 - DNA, 26 bp, Artificial Sequence
  Description of Artificial Sequence: Synthetic oligonucleotide
ctgtggtggtgccttctggacaggag

SEQ ID NO: 3618 - DNA, 27 bp, Artificial Sequence
  Description of Artificial Sequence: Synthetic oligonucleotide
tgtggtggtgccttctggacaggagca

SEQ ID NO: 3619 - DNA, 26 bp, Artificial Sequence
  Description of Artificial Sequence: Synthetic oligonucleotide
gtggtggtgccttctggacaggagca

SEQ ID NO: 3620 - DNA, 27 bp, Artificial Sequence
  Description of Artificial Sequence: Synthetic oligonucleotide
tggtggtgccttctggacaggagcaga

SEQ ID NO: 3621 - DNA, 26 bp, Artificial Sequence
  Description of Artificial Sequence: Synthetic oligonucleotide
ggtggtgccttctggacaggagcaga

SEQ ID NO: 3622 - DNA, 27 bp, Artificial Sequence
  Description of Artificial Sequence: Synthetic oligonucleotide
gtggtgccttctggacaggagcagaga

SEQ ID NO: 3623 - DNA, 29 bp, Artificial Sequence
  Description of Artificial Sequence: Synthetic oligonucleotide
tggtgccttctggacaggagcagagatac

SEQ ID NO: 3624 - DNA, 28 bp, Artificial Sequence
  Description of Artificial Sequence: Synthetic oligonucleotide
ggtgccttctggacaggagcagagatac

SEQ ID NO: 3625 - DNA, 29 bp, Artificial Sequence
  Description of Artificial Sequence: Synthetic oligonucleotide
gtgccttctggacaggagcagagatacac

SEQ ID NO: 3626 - DNA, 29 bp, Artificial Sequence
  Description of Artificial Sequence: Synthetic oligonucleotide
tgccttctggacaggagcagagatacacc

SEQ ID NO: 3627 - DNA, 28 bp, Artificial Sequence
  Description of Artificial Sequence: Synthetic oligonucleotide
gccttctggacaggagcagagatacacc

SEQ ID NO: 3628 - DNA, 29 bp, Artificial Sequence
  Description of Artificial Sequence: Synthetic oligonucleotide
ccttctggacaggagcagagatacacctg

SEQ ID NO: 3629 - DNA, 29 bp, Artificial Sequence
  Description of Artificial Sequence: Synthetic oligonucleotide
cttctggacaggagcagagatacacctgc

SEQ ID NO: 3630 - DNA, 29 bp, Artificial Sequence
  Description of Artificial Sequence: Synthetic oligonucleotide
ttctggacaggagcagagatacacctgcc

SEQ ID NO: 3631 - DNA, 28 bp, Artificial Sequence
  Description of Artificial Sequence: Synthetic oligonucleotide
tctggacaggagcagagatacacctgcc

SEQ ID NO: 3632 - DNA, 27 bp, Artificial Sequence
  Description of Artificial Sequence: Synthetic oligonucleotide
ctggacaggagcagagatacacctgcc

SEQ ID NO: 3633 - DNA, 29 bp, Artificial Sequence
  Description of Artificial Sequence: Synthetic oligonucleotide
tggacaggagcagagatacacctgccatg

SEQ ID NO: 3634 - DNA, 28 bp, Artificial Sequence
  Description of Artificial Sequence: Synthetic oligonucleotide
ggacaggagcagagatacacctgccatg

SEQ ID NO: 3635 - DNA, 29 bp, Artificial Sequence
  Description of Artificial Sequence: Synthetic oligonucleotide
gacaggagcagagatacacctgccatgtg

SEQ ID NO: 3636 - DNA, 29 bp, Artificial Sequence
  Description of Artificial Sequence: Synthetic oligonucleotide
acaggagcagagatacacctgccatgtgc

SEQ ID NO: 3637 - DNA, 28 bp, Artificial Sequence
  Description of Artificial Sequence: Synthetic oligonucleotide
caggagcagagatacacctgccatgtgc

SEQ ID NO: 3638 - DNA, 31 bp, Artificial Sequence
  Description of Artificial Sequence: Synthetic oligonucleotide
atacacctgccatgtgcagcatgagggtttg

SEQ ID NO: 3639 - DNA, 30 bp, Artificial Sequence
  Description of Artificial Sequence: Synthetic oligonucleotide
tacacctgccatgtgcagcatgagggtttg

SEQ ID NO: 3640 - DNA, 29 bp, Artificial Sequence
  Description of Artificial Sequence: Synthetic oligonucleotide
acacctgccatgtgcagcatgagggtttg

SEQ ID NO: 3641 - DNA, 28 bp, Artificial Sequence
  Description of Artificial Sequence: Synthetic oligonucleotide
cacctgccatgtgcagcatgagggtttg

SEQ ID NO: 3642 - DNA, 28 bp, Artificial Sequence
  Description of Artificial Sequence: Synthetic oligonucleotide
acctgccatgtgcagcatgagggtttgc

SEQ ID NO: 3643 - DNA, 27 bp, Artificial Sequence
  Description of Artificial Sequence: Synthetic oligonucleotide
cctgccatgtgcagcatgagggtttgc

SEQ ID NO: 3644 - DNA, 27 bp, Artificial Sequence
  Description of Artificial Sequence: Synthetic oligonucleotide
ctgccatgtgcagcatgagggtttgcc

SEQ ID NO: 3645 - DNA, 27 bp, Artificial Sequence
  Description of Artificial Sequence: Synthetic oligonucleotide
tgccatgtgcagcatgagggtttgccc

SEQ ID NO: 3646 - DNA, 27 bp, Artificial Sequence
  Description of Artificial Sequence: Synthetic oligonucleotide
gccatgtgcagcatgagggtttgccca

SEQ ID NO: 3647 - DNA, 28 bp, Artificial Sequence
  Description of Artificial Sequence: Synthetic oligonucleotide
ccatgtgcagcatgagggtttgcccaag

SEQ ID NO: 3648 - DNA, 28 bp, Artificial Sequence
  Description of Artificial Sequence: Synthetic oligonucleotide
catgtgcagcatgagggtttgcccaagc

SEQ ID NO: 3649 - DNA, 28 bp, Artificial Sequence
  Description of Artificial Sequence: Synthetic oligonucleotide
atgtgcagcatgagggtttgcccaagcc

SEQ ID NO: 3650 - DNA, 27 bp, Artificial Sequence
  Description of Artificial Sequence: Synthetic oligonucleotide
tgtgcagcatgagggtttgcccaagcc

SEQ ID NO: 3651 - DNA, 26 bp, Artificial Sequence
  Description of Artificial Sequence: Synthetic oligonucleotide
gtgcagcatgagggtttgcccaagcc

SEQ ID NO: 3652 - DNA, 26 bp, Artificial Sequence
  Description of Artificial Sequence: Synthetic oligonucleotide
tgcagcatgagggtttgcccaagccc

SEQ ID NO: 3653 - DNA, 25 bp, Artificial Sequence
  Description of Artificial Sequence: Synthetic oligonucleotide
gcagcatgagggtttgcccaagccc

SEQ ID NO: 3654 - DNA, 26 bp, Artificial Sequence
  Description of Artificial Sequence: Synthetic oligonucleotide
cagcatgagggtttgcccaagcccct

SEQ ID NO: 3655 - DNA, 27 bp, Artificial Sequence
  Description of Artificial Sequence: Synthetic oligonucleotide
agcatgagggtttgcccaagcccctca

SEQ ID NO: 3656 - DNA, 26 bp, Artificial Sequence
  Description of Artificial Sequence: Synthetic oligonucleotide
gcatgagggtttgcccaagcccctca

SEQ ID NO: 3657 - DNA, 26 bp, Artificial Sequence
  Description of Artificial Sequence: Synthetic oligonucleotide
catgagggtttgcccaagcccctcac

SEQ ID NO: 3658 - DNA, 26 bp, Artificial Sequence
  Description of Artificial Sequence: Synthetic oligonucleotide
atgagggtttgcccaagcccctcacc

SEQ ID NO: 3659 - DNA, 25 bp, Artificial Sequence
  Description of Artificial Sequence: Synthetic oligonucleotide
tgagggtttgcccaagcccctcacc

SEQ ID NO: 3660 - DNA, 24 bp, Artificial Sequence
  Description of Artificial Sequence: Synthetic oligonucleotide
gagggtttgcccaagcccctcacc

SEQ ID NO: 3661 - DNA, 25 bp, Artificial Sequence
  Description of Artificial Sequence: Synthetic oligonucleotide
agggtttgcccaagcccctcaccct

SEQ ID NO: 3662 - DNA, 24 bp, Artificial Sequence
  Description of Artificial Sequence: Synthetic oligonucleotide
gggtttgcccaagcccctcaccct

SEQ ID NO: 3663 - DNA, 25 bp, Artificial Sequence
  Description of Artificial Sequence: Synthetic oligonucleotide
ggtttgcccaagcccctcaccctga

SEQ ID NO: 3664 - DNA, 27 bp, Artificial Sequence
  Description of Artificial Sequence: Synthetic oligonucleotide
gtttgcccaagcccctcaccctgagat

SEQ ID NO: 3665 - DNA, 27 bp, Artificial Sequence
  Description of Artificial Sequence: Synthetic oligonucleotide
tttgcccaagcccctcaccctgagatg

SEQ ID NO: 3666 - DNA, 26 bp, Artificial Sequence
  Description of Artificial Sequence: Synthetic oligonucleotide
ttgcccaagcccctcaccctgagatg

SEQ ID NO: 3667 - DNA, 25 bp, Artificial Sequence
  Description of Artificial Sequence: Synthetic oligonucleotide
aagcccctcaccctgagatgggagc

SEQ ID NO: 3668 - DNA, 24 bp, Artificial Sequence
  Description of Artificial Sequence: Synthetic oligonucleotide
agcccctcaccctgagatgggagc

SEQ ID NO: 3669 - DNA, 23 bp, Artificial Sequence
  Description of Artificial Sequence: Synthetic oligonucleotide
gcccctcaccctgagatgggagc

SEQ ID NO: 3670 - DNA, 23 bp, Artificial Sequence
  Description of Artificial Sequence: Synthetic oligonucleotide
cccctcaccctgagatgggagcc

SEQ ID NO: 3671 - DNA, 24 bp, Artificial Sequence
  Description of Artificial Sequence: Synthetic oligonucleotide
ccctcaccctgagatgggagccgt

SEQ ID NO: 3672 - DNA, 26 bp, Artificial Sequence
  Description of Artificial Sequence: Synthetic oligonucleotide
cctcaccctgagatgggagccgtctt

SEQ ID NO: 3673 - DNA, 26 bp, Artificial Sequence
  Description of Artificial Sequence: Synthetic oligonucleotide
ctcaccctgagatgggagccgtcttc

SEQ ID NO: 3674 - DNA, 26 bp, Artificial Sequence
  Description of Artificial Sequence: Synthetic oligonucleotide
tcaccctgagatgggagccgtcttcc

SEQ ID NO: 3675 - DNA, 25 bp, Artificial Sequence
  Description of Artificial Sequence: Synthetic oligonucleotide
caccctgagatgggagccgtcttcc

SEQ ID NO: 3676 - DNA, 26 bp, Artificial Sequence
  Description of Artificial Sequence: Synthetic oligonucleotide
accctgagatgggagccgtcttccca

SEQ ID NO: 3677 - DNA, 25 bp, Artificial Sequence
  Description of Artificial Sequence: Synthetic oligonucleotide
ccctgagatgggagccgtcttccca

SEQ ID NO: 3678 - DNA, 25 bp, Artificial Sequence
  Description of Artificial Sequence: Synthetic oligonucleotide
cctgagatgggagccgtcttcccag

SEQ ID NO: 3679 - DNA, 25 bp, Artificial Sequence
  Description of Artificial Sequence: Synthetic oligonucleotide
ctgagatgggagccgtcttcccagc

SEQ ID NO: 3680 - DNA, 25 bp, Artificial Sequence
  Description of Artificial Sequence: Synthetic oligonucleotide
tgagatgggagccgtcttcccagcc

SEQ ID NO: 3681 - DNA, 24 bp, Artificial Sequence
  Description of Artificial Sequence: Synthetic oligonucleotide
gagatgggagccgtcttcccagcc

SEQ ID NO: 3682 - DNA, 25 bp, Artificial Sequence
  Description of Artificial Sequence: Synthetic oligonucleotide
agatgggagccgtcttcccagccca

SEQ ID NO: 3683 - DNA, 24 bp, Artificial Sequence
  Description of Artificial Sequence: Synthetic oligonucleotide
gatgggagccgtcttcccagccca

SEQ ID NO: 3684 - DNA, 24 bp, Artificial Sequence
  Description of Artificial Sequence: Synthetic oligonucleotide
atgggagccgtcttcccagcccac

SEQ ID NO: 3685 - DNA, 23 bp, Artificial Sequence
  Description of Artificial Sequence: Synthetic oligonucleotide
tgggagccgtcttcccagcccac

SEQ ID NO: 3686 - DNA, 22 bp, Artificial Sequence
  Description of Artificial Sequence: Synthetic oligonucleotide
gggagccgtcttcccagcccac

SEQ ID NO: 3687 - DNA, 24 bp, Artificial Sequence
  Description of Artificial Sequence: Synthetic oligonucleotide
ggagccgtcttcccagcccaccat

SEQ ID NO: 3688 - DNA, 24 bp, Artificial Sequence
  Description of Artificial Sequence: Synthetic oligonucleotide
gagccgtcttcccagcccaccatc

SEQ ID NO: 3689 - DNA, 24 bp, Artificial Sequence
  Description of Artificial Sequence: Synthetic oligonucleotide
agccgtcttcccagcccaccatcc

SEQ ID NO: 3690 - DNA, 23 bp, Artificial Sequence
  Description of Artificial Sequence: Synthetic oligonucleotide
gccgtcttcccagcccaccatcc

SEQ ID NO: 3691 - DNA, 23 bp, Artificial Sequence
  Description of Artificial Sequence: Synthetic oligonucleotide
ccgtcttcccagcccaccatccc

SEQ ID NO: 3692 - DNA, 25 bp, Artificial Sequence
  Description of Artificial Sequence: Synthetic oligonucleotide
cgtcttcccagcccaccatccccat

SEQ ID NO: 3693 - DNA, 30 bp, Artificial Sequence
  Description of Artificial Sequence: Synthetic oligonucleotide
tgggcatcattgctggcctggttctctttg

SEQ ID NO: 3694 - DNA, 29 bp, Artificial Sequence
  Description of Artificial Sequence: Synthetic oligonucleotide
gggcatcattgctggcctggttctctttg

SEQ ID NO: 3695 - DNA, 29 bp, Artificial Sequence
  Description of Artificial Sequence: Synthetic oligonucleotide
ggcatcattgctggcctggttctctttgg

SEQ ID NO: 3696 - DNA, 30 bp, Artificial Sequence
  Description of Artificial Sequence: Synthetic oligonucleotide
gcatcattgctggcctggttctctttggag

SEQ ID NO: 3697 - DNA, 30 bp, Artificial Sequence
  Description of Artificial Sequence: Synthetic oligonucleotide
catcattgctggcctggttctctttggagc

SEQ ID NO: 3698 - DNA, 31 bp, Artificial Sequence
  Description of Artificial Sequence: Synthetic oligonucleotide
atcattgctggcctggttctctttggagctg

SEQ ID NO: 3699 - DNA, 30 bp, Artificial Sequence
  Description of Artificial Sequence: Synthetic oligonucleotide
tcattgctggcctggttctctttggagctg

SEQ ID NO: 3700 - DNA, 29 bp, Artificial Sequence
  Description of Artificial Sequence: Synthetic oligonucleotide
cattgctggcctggttctctttggagctg

SEQ ID NO: 3701 - DNA, 30 bp, Artificial Sequence
  Description of Artificial Sequence: Synthetic oligonucleotide
attgctggcctggttctctttggagctgtg

SEQ ID NO: 3702 - DNA, 29 bp, Artificial Sequence
  Description of Artificial Sequence: Synthetic oligonucleotide
ttgctggcctggttctctttggagctgtg

SEQ ID NO: 3703 - DNA, 28 bp, Artificial Sequence
  Description of Artificial Sequence: Synthetic oligonucleotide
tgctggcctggttctctttggagctgtg

SEQ ID NO: 3704 - DNA, 27 bp, Artificial Sequence
  Description of Artificial Sequence: Synthetic oligonucleotide
gctggcctggttctctttggagctgtg

SEQ ID NO: 3705 - DNA, 29 bp, Artificial Sequence
  Description of Artificial Sequence: Synthetic oligonucleotide
ctggcctggttctctttggagctgtgatc

SEQ ID NO: 3706 - DNA, 30 bp, Artificial Sequence
  Description of Artificial Sequence: Synthetic oligonucleotide
tggcctggttctctttggagctgtgatcac

SEQ ID NO: 3707 - DNA, 29 bp, Artificial Sequence
  Description of Artificial Sequence: Synthetic oligonucleotide
ggcctggttctctttggagctgtgatcac

SEQ ID NO: 3708 - DNA, 30 bp, Artificial Sequence
  Description of Artificial Sequence: Synthetic oligonucleotide
gcctggttctctttggagctgtgatcactg

SEQ ID NO: 3709 - DNA, 30 bp, Artificial Sequence
  Description of Artificial Sequence: Synthetic oligonucleotide
cctggttctctttggagctgtgatcactgg

SEQ ID NO: 3710 - DNA, 31 bp, Artificial Sequence
  Description of Artificial Sequence: Synthetic oligonucleotide
ctggttctctttggagctgtgatcactggag

SEQ ID NO: 3711 - DNA, 31 bp, Artificial Sequence
  Description of Artificial Sequence: Synthetic oligonucleotide
tggttctctttggagctgtgatcactggagc

SEQ ID NO: 3712 - DNA, 30 bp, Artificial Sequence
  Description of Artificial Sequence: Synthetic oligonucleotide
ggttctctttggagctgtgatcactggagc

SEQ ID NO: 3713 - DNA, 31 bp, Artificial Sequence
  Description of Artificial Sequence: Synthetic oligonucleotide
gttctctttggagctgtgatcactggagctg

SEQ ID NO: 3714 - DNA, 32 bp, Artificial Sequence
  Description of Artificial Sequence: Synthetic oligonucleotide
ttctctttggagctgtgatcactggagctgtg

SEQ ID NO: 3715 - DNA, 31 bp, Artificial Sequence
  Description of Artificial Sequence: Synthetic oligonucleotide
tctctttggagctgtgatcactggagctgtg

SEQ ID NO: 3716 - DNA, 30 bp, Artificial Sequence
  Description of Artificial Sequence: Synthetic oligonucleotide
ctctttggagctgtgatcactggagctgtg

SEQ ID NO: 3717 - DNA, 30 bp, Artificial Sequence
  Description of Artificial Sequence: Synthetic oligonucleotide
tctttggagctgtgatcactggagctgtgg

SEQ ID NO: 3718 - DNA, 29 bp, Artificial Sequence
  Description of Artificial Sequence: Synthetic oligonucleotide
ctttggagctgtgatcactggagctgtgg

SEQ ID NO: 3719 - DNA, 30 bp, Artificial Sequence
  Description of Artificial Sequence: Synthetic oligonucleotide
tttggagctgtgatcactggagctgtggtc

SEQ ID NO: 3720 - DNA, 31 bp, Artificial Sequence
  Description of Artificial Sequence: Synthetic oligonucleotide
gaggaagagctcagatagaaaaggagggagc

SEQ ID NO: 3721 - DNA, 33 bp, Artificial Sequence
  Description of Artificial Sequence: Synthetic oligonucleotide
aggaagagctcagatagaaaaggagggagctac

SEQ ID NO: 3722 - DNA, 32 bp, Artificial Sequence
  Description of Artificial Sequence: Synthetic oligonucleotide
ggaagagctcagatagaaaaggagggagctac

SEQ ID NO: 3723 - DNA, 33 bp, Artificial Sequence
  Description of Artificial Sequence: Synthetic oligonucleotide
gaagagctcagatagaaaaggagggagctactc

SEQ ID NO: 3724 - DNA, 34 bp, Artificial Sequence
  Description of Artificial Sequence: Synthetic oligonucleotide
aagagctcagatagaaaaggagggagctactctc

SEQ ID NO: 3725 - DNA, 33 bp, Artificial Sequence
  Description of Artificial Sequence: Synthetic oligonucleotide
agagctcagatagaaaaggagggagctactctc

SEQ ID NO: 3726 - DNA, 32 bp, Artificial Sequence
  Description of Artificial Sequence: Synthetic oligonucleotide
gagctcagatagaaaaggagggagctactctc

SEQ ID NO: 3727 - DNA, 33 bp, Artificial Sequence
  Description of Artificial Sequence: Synthetic oligonucleotide
agctcagatagaaaaggagggagctactctcag

SEQ ID NO: 3728 - DNA, 32 bp, Artificial Sequence
  Description of Artificial Sequence: Synthetic oligonucleotide
gctcagatagaaaaggagggagctactctcag

SEQ ID NO: 3729 - DNA, 32 bp, Artificial Sequence
  Description of Artificial Sequence: Synthetic oligonucleotide
ctcagatagaaaaggagggagctactctcagg

SEQ ID NO: 3730 - DNA, 32 bp, Artificial Sequence
  Description of Artificial Sequence: Synthetic oligonucleotide
tcagatagaaaaggagggagctactctcaggc

SEQ ID NO: 3731 - DNA, 31 bp, Artificial Sequence
  Description of Artificial Sequence: Synthetic oligonucleotide
cagatagaaaaggagggagctactctcaggc

SEQ ID NO: 3732 - DNA, 32 bp, Artificial Sequence
  Description of Artificial Sequence: Synthetic oligonucleotide
agatagaaaaggagggagctactctcaggctg

SEQ ID NO: 3733 - DNA, 31 bp, Artificial Sequence
  Description of Artificial Sequence: Synthetic oligonucleotide
gatagaaaaggagggagctactctcaggctg

SEQ ID NO: 3734 - DNA, 31 bp, Artificial Sequence
  Description of Artificial Sequence: Synthetic oligonucleotide
atagaaaaggagggagctactctcaggctgc

SEQ ID NO: 3735 - DNA, 30 bp, Artificial Sequence
  Description of Artificial Sequence: Synthetic oligonucleotide
tagaaaaggagggagctactctcaggctgc

SEQ ID NO: 3736 - DNA, 29 bp, Artificial Sequence
  Description of Artificial Sequence: Synthetic oligonucleotide
agaaaaggagggagctactctcaggctgc

SEQ ID NO: 3737 - DNA, 28 bp, Artificial Sequence
  Description of Artificial Sequence: Synthetic oligonucleotide
gaaaaggagggagctactctcaggctgc

SEQ ID NO: 3738 - DNA, 30 bp, Artificial Sequence
  Description of Artificial Sequence: Synthetic oligonucleotide
aaaaggagggagctactctcaggctgcaag

SEQ ID NO: 3739 - DNA, 29 bp, Artificial Sequence
  Description of Artificial Sequence: Synthetic oligonucleotide
aaaggagggagctactctcaggctgcaag

SEQ ID NO: 3740 - DNA, 28 bp, Artificial Sequence
  Description of Artificial Sequence: Synthetic oligonucleotide
aaggagggagctactctcaggctgcaag

SEQ ID NO: 3741 - DNA, 27 bp, Artificial Sequence
  Description of Artificial Sequence: Synthetic oligonucleotide
aggagggagctactctcaggctgcaag

SEQ ID NO: 3742 - DNA, 26 bp, Artificial Sequence
  Description of Artificial Sequence: Synthetic oligonucleotide
ggagggagctactctcaggctgcaag

SEQ ID NO: 3743 - DNA, 27 bp, Artificial Sequence
  Description of Artificial Sequence: Synthetic oligonucleotide
gagggagctactctcaggctgcaagca

SEQ ID NO: 3744 - DNA, 27 bp, Artificial Sequence
  Description of Artificial Sequence: Synthetic oligonucleotide
agggagctactctcaggctgcaagcag

SEQ ID NO: 3745 - DNA, 27 bp, Artificial Sequence
  Description of Artificial Sequence: Synthetic oligonucleotide
gggagctactctcaggctgcaagcagt

SEQ ID NO: 3746 - DNA, 27 bp, Artificial Sequence
  Description of Artificial Sequence: Synthetic oligonucleotide
ggagctactctcaggctgcaagcagtg

SEQ ID NO: 3747 - DNA, 28 bp, Artificial Sequence
  Description of Artificial Sequence: Synthetic oligonucleotide
gagctactctcaggctgcaagcagtgac

SEQ ID NO: 3748 - DNA, 29 bp, Artificial Sequence
  Description of Artificial Sequence: Synthetic oligonucleotide
agctactctcaggctgcaagcagtgacag

SEQ ID NO: 3749 - DNA, 28 bp, Artificial Sequence
  Description of Artificial Sequence: Synthetic oligonucleotide
gctactctcaggctgcaagcagtgacag

SEQ ID NO: 3750 - DNA, 29 bp, Artificial Sequence
  Description of Artificial Sequence: Synthetic oligonucleotide
ctactctcaggctgcaagcagtgacagtg

SEQ ID NO: 3751 - DNA, 29 bp, Artificial Sequence
  Description of Artificial Sequence: Synthetic oligonucleotide
tactctcaggctgcaagcagtgacagtgc

SEQ ID NO: 3752 - DNA, 28 bp, Artificial Sequence
  Description of Artificial Sequence: Synthetic oligonucleotide
actctcaggctgcaagcagtgacagtgc

SEQ ID NO: 3753 - DNA, 27 bp, Artificial Sequence
  Description of Artificial Sequence: Synthetic oligonucleotide
ctctcaggctgcaagcagtgacagtgc

SEQ ID NO: 3754 - DNA, 27 bp, Artificial Sequence
  Description of Artificial Sequence: Synthetic oligonucleotide
tctcaggctgcaagcagtgacagtgcc

SEQ ID NO: 3755 - DNA, 30 bp, Artificial Sequence
  Description of Artificial Sequence: Synthetic oligonucleotide
ggaaagtgaaggcccactcacagactcatc

SEQ ID NO: 3756 - DNA, 30 bp, Artificial Sequence
  Description of Artificial Sequence: Synthetic oligonucleotide
gaaagtgaaggcccactcacagactcatcg

SEQ ID NO: 3757 - DNA, 31 bp, Artificial Sequence
  Description of Artificial Sequence: Synthetic oligonucleotide
aaagtgaaggcccactcacagactcatcgag

SEQ ID NO: 3758 - DNA, 30 bp, Artificial Sequence
  Description of Artificial Sequence: Synthetic oligonucleotide
aagtgaaggcccactcacagactcatcgag

SEQ ID NO: 3759 - DNA, 29 bp, Artificial Sequence
  Description of Artificial Sequence: Synthetic oligonucleotide
agtgaaggcccactcacagactcatcgag

SEQ ID NO: 3760 - DNA, 28 bp, Artificial Sequence
  Description of Artificial Sequence: Synthetic oligonucleotide
gtgaaggcccactcacagactcatcgag

SEQ ID NO: 3761 - DNA, 29 bp, Artificial Sequence
  Description of Artificial Sequence: Synthetic oligonucleotide
tgaaggcccactcacagactcatcgagtg

SEQ ID NO: 3762 - DNA, 28 bp, Artificial Sequence
  Description of Artificial Sequence: Synthetic oligonucleotide
gaaggcccactcacagactcatcgagtg

SEQ ID NO: 3763 - DNA, 28 bp, Artificial Sequence
  Description of Artificial Sequence: Synthetic oligonucleotide
aaggcccactcacagactcatcgagtgg

SEQ ID NO: 3764 - DNA, 27 bp, Artificial Sequence
  Description of Artificial Sequence: Synthetic oligonucleotide
aggcccactcacagactcatcgagtgg

SEQ ID NO: 3765 - DNA, 27 bp, Artificial Sequence
  Description of Artificial Sequence: Synthetic oligonucleotide
ggcccactcacagactcatcgagtgga

SEQ ID NO: 3766 - DNA, 27 bp, Artificial Sequence
  Description of Artificial Sequence: Synthetic oligonucleotide
gcccactcacagactcatcgagtggac

SEQ ID NO: 3767 - DNA, 27 bp, Artificial Sequence
  Description of Artificial Sequence: Synthetic oligonucleotide
cccactcacagactcatcgagtggacc

SEQ ID NO: 3768 - DNA, 28 bp, Artificial Sequence
  Description of Artificial Sequence: Synthetic oligonucleotide
ccactcacagactcatcgagtggacctg

SEQ ID NO: 3769 - DNA, 28 bp, Artificial Sequence
  Description of Artificial Sequence: Synthetic oligonucleotide
cactcacagactcatcgagtggacctgg

SEQ ID NO: 3770 - DNA, 28 bp, Artificial Sequence
  Description of Artificial Sequence: Synthetic oligonucleotide
actcacagactcatcgagtggacctggg

SEQ ID NO: 3771 - DNA, 27 bp, Artificial Sequence
  Description of Artificial Sequence: Synthetic oligonucleotide
ctcacagactcatcgagtggacctggg

SEQ ID NO: 3772 - DNA, 27 bp, Artificial Sequence
  Description of Artificial Sequence: Synthetic oligonucleotide
tcacagactcatcgagtggacctgggg

SEQ ID NO: 3773 - DNA, 27 bp, Artificial Sequence
  Description of Artificial Sequence: Synthetic oligonucleotide
cacagactcatcgagtggacctgggga

SEQ ID NO: 3774 - DNA, 27 bp, Artificial Sequence
  Description of Artificial Sequence: Synthetic oligonucleotide
acagactcatcgagtggacctggggac

SEQ ID NO: 3775 - DNA, 26 bp, Artificial Sequence
  Description of Artificial Sequence: Synthetic oligonucleotide
cagactcatcgagtggacctggggac

SEQ ID NO: 3776 - DNA, 26 bp, Artificial Sequence
  Description of Artificial Sequence: Synthetic oligonucleotide
agactcatcgagtggacctggggacc

SEQ ID NO: 3777 - DNA, 25 bp, Artificial Sequence
  Description of Artificial Sequence: Synthetic oligonucleotide
gactcatcgagtggacctggggacc

SEQ ID NO: 3778 - DNA, 26 bp, Artificial Sequence
  Description of Artificial Sequence: Synthetic oligonucleotide
actcatcgagtggacctggggaccct

SEQ ID NO: 3779 - DNA, 25 bp, Artificial Sequence
  Description of Artificial Sequence: Synthetic oligonucleotide
ctcatcgagtggacctggggaccct

SEQ ID NO: 3780 - DNA, 25 bp, Artificial Sequence
  Description of Artificial Sequence: Synthetic oligonucleotide
tcatcgagtggacctggggaccctg

SEQ ID NO: 3781 - DNA, 24 bp, Artificial Sequence
  Description of Artificial Sequence: Synthetic oligonucleotide
catcgagtggacctggggaccctg

SEQ ID NO: 3782 - DNA, 24 bp, Artificial Sequence
  Description of Artificial Sequence: Synthetic oligonucleotide
atcgagtggacctggggaccctgc

SEQ ID NO: 3783 - DNA, 23 bp, Artificial Sequence
  Description of Artificial Sequence: Synthetic oligonucleotide
tcgagtggacctggggaccctgc

SEQ ID NO: 3784 - DNA, 27 bp, Artificial Sequence
  Description of Artificial Sequence: Synthetic oligonucleotide
aaagaggacctgcgctcttggaccgca

SEQ ID NO: 3785 - DNA, 26 bp, Artificial Sequence
  Description of Artificial Sequence: Synthetic oligonucleotide
aagaggacctgcgctcttggaccgca

SEQ ID NO: 3786 - DNA, 25 bp, Artificial Sequence
  Description of Artificial Sequence: Synthetic oligonucleotide
agaggacctgcgctcttggaccgca

SEQ ID NO: 3787 - DNA, 25 bp, Artificial Sequence
  Description of Artificial Sequence: Synthetic oligonucleotide
accgcagcggacatggcagctcaga

SEQ ID NO: 3788 - DNA, 24 bp, Artificial Sequence
  Description of Artificial Sequence: Synthetic oligonucleotide
ccgcagcggacatggcagctcaga

SEQ ID NO: 3789 - DNA, 24 bp, Artificial Sequence
  Description of Artificial Sequence: Synthetic oligonucleotide
cgcagcggacatggcagctcagac

SEQ ID NO: 3790 - DNA, 25 bp, Artificial Sequence
  Description of Artificial Sequence: Synthetic oligonucleotide
gcagcggacatggcagctcagacca

SEQ ID NO: 3791 - DNA, 25 bp, Artificial Sequence
  Description of Artificial Sequence: Synthetic oligonucleotide
cagcggacatggcagctcagaccac

SEQ ID NO: 3792 - DNA, 27 bp, Artificial Sequence
  Description of Artificial Sequence: Synthetic oligonucleotide
agcggacatggcagctcagaccaccaa

SEQ ID NO: 3793 - DNA, 31 bp, Artificial Sequence
  Description of Artificial Sequence: Synthetic oligonucleotide
gacggcaaggattacatcgccctgaaagaag

SEQ ID NO: 3794 - DNA, 32 bp, Artificial Sequence
  Description of Artificial Sequence: Synthetic oligonucleotide
acggcaaggattacatcgccctgaaagaagac

SEQ ID NO: 3795 - DNA, 31 bp, Artificial Sequence
  Description of Artificial Sequence: Synthetic oligonucleotide
cggcaaggattacatcgccctgaaagaagac

SEQ ID NO: 3796 - DNA, 31 bp, Artificial Sequence
  Description of Artificial Sequence: Synthetic oligonucleotide
ggcaaggattacatcgccctgaaagaagacc

SEQ ID NO: 3797 - DNA, 32 bp, Artificial Sequence
  Description of Artificial Sequence: Synthetic oligonucleotide
gcaaggattacatcgccctgaaagaagacctg

SEQ ID NO: 3798 - DNA, 32 bp, Artificial Sequence
  Description of Artificial Sequence: Synthetic oligonucleotide
caaggattacatcgccctgaaagaagacctgc

SEQ ID NO: 3799 - DNA, 32 bp, Artificial Sequence
  Description of Artificial Sequence: Synthetic oligonucleotide
aaggattacatcgccctgaaagaagacctgcg

SEQ ID NO: 3800 - DNA, 31 bp, Artificial Sequence
  Description of Artificial Sequence: Synthetic oligonucleotide
aggattacatcgccctgaaagaagacctgcg

SEQ ID NO: 3801 - DNA, 30 bp, Artificial Sequence
  Description of Artificial Sequence: Synthetic oligonucleotide
ggattacatcgccctgaaagaagacctgcg

SEQ ID NO: 3802 - DNA, 30 bp, Artificial Sequence
  Description of Artificial Sequence: Synthetic oligonucleotide
gattacatcgccctgaaagaagacctgcgc

SEQ ID NO: 3803 - DNA, 31 bp, Artificial Sequence
  Description of Artificial Sequence: Synthetic oligonucleotide
attacatcgccctgaaagaagacctgcgctc

SEQ ID NO: 3804 - DNA, 30 bp, Artificial Sequence
  Description of Artificial Sequence: Synthetic oligonucleotide
ttacatcgccctgaaagaagacctgcgctc

SEQ ID NO: 3805 - DNA, 29 bp, Artificial Sequence
  Description of Artificial Sequence: Synthetic oligonucleotide
tacatcgccctgaaagaagacctgcgctc

SEQ ID NO: 3806 - DNA, 28 bp, Artificial Sequence
  Description of Artificial Sequence: Synthetic oligonucleotide
acatcgccctgaaagaagacctgcgctc

SEQ ID NO: 3807 - DNA, 27 bp, Artificial Sequence
  Description of Artificial Sequence: Synthetic oligonucleotide
catcgccctgaaagaagacctgcgctc

SEQ ID NO: 3808 - DNA, 29 bp, Artificial Sequence
  Description of Artificial Sequence: Synthetic oligonucleotide
atcgccctgaaagaagacctgcgctcttg

SEQ ID NO: 3809 - DNA, 28 bp, Artificial Sequence
  Description of Artificial Sequence: Synthetic oligonucleotide
tcgccctgaaagaagacctgcgctcttg

SEQ ID NO: 3810 - DNA, 27 bp, Artificial Sequence
  Description of Artificial Sequence: Synthetic oligonucleotide
cgccctgaaagaagacctgcgctcttg

SEQ ID NO: 3811 - DNA, 27 bp, Artificial Sequence
  Description of Artificial Sequence: Synthetic oligonucleotide
gccctgaaagaagacctgcgctcttgg

SEQ ID NO: 3812 - DNA, 28 bp, Artificial Sequence
  Description of Artificial Sequence: Synthetic oligonucleotide
ccctgaaagaagacctgcgctcttggac

SEQ ID NO: 3813 - DNA, 28 bp, Artificial Sequence
  Description of Artificial Sequence: Synthetic oligonucleotide
cctgaaagaagacctgcgctcttggacc

SEQ ID NO: 3814 - DNA, 28 bp, Artificial Sequence
  Description of Artificial Sequence: Synthetic oligonucleotide
ctgaaagaagacctgcgctcttggaccg

SEQ ID NO: 3815 - DNA, 28 bp, Artificial Sequence
  Description of Artificial Sequence: Synthetic oligonucleotide
tgaaagaagacctgcgctcttggaccgc

SEQ ID NO: 3816 - DNA, 27 bp, Artificial Sequence
  Description of Artificial Sequence: Synthetic oligonucleotide
gaaagaagacctgcgctcttggaccgc

SEQ ID NO: 3817 - DNA, 27 bp, Artificial Sequence
  Description of Artificial Sequence: Synthetic oligonucleotide
aaagaagacctgcgctcttggaccgcg

SEQ ID NO: 3818 - DNA, 26 bp, Artificial Sequence
  Description of Artificial Sequence: Synthetic oligonucleotide
aagaagacctgcgctcttggaccgcg

SEQ ID NO: 3819 - DNA, 25 bp, Artificial Sequence
  Description of Artificial Sequence: Synthetic oligonucleotide
agaagacctgcgctcttggaccgcg

SEQ ID NO: 3820 - DNA, 24 bp, Artificial Sequence
  Description of Artificial Sequence: Synthetic oligonucleotide
gaagacctgcgctcttggaccgcg

SEQ ID NO: 3821 - DNA, 24 bp, Artificial Sequence
  Description of Artificial Sequence: Synthetic oligonucleotide
aagacctgcgctcttggaccgcgg

SEQ ID NO: 3822 - DNA, 23 bp, Artificial Sequence
  Description of Artificial Sequence: Synthetic oligonucleotide
agacctgcgctcttggaccgcgg

SEQ ID NO: 3823 - DNA, 24 bp, Artificial Sequence
  Description of Artificial Sequence: Synthetic oligonucleotide
cgacgtggggtcggactggcgatt

SEQ ID NO: 3824 - DNA, 24 bp, Artificial Sequence
  Description of Artificial Sequence: Synthetic oligonucleotide
gacgtggggtcggactggcgattc

SEQ ID NO: 3825 - DNA, 25 bp, Artificial Sequence
  Description of Artificial Sequence: Synthetic oligonucleotide
acgtggggtcggactggcgattcct

SEQ ID NO: 3826 - DNA, 24 bp, Artificial Sequence
  Description of Artificial Sequence: Synthetic oligonucleotide
cgtggggtcggactggcgattcct

SEQ ID NO: 3827 - DNA, 24 bp, Artificial Sequence
  Description of Artificial Sequence: Synthetic oligonucleotide
gtggggtcggactggcgattcctc

SEQ ID NO: 3828 - DNA, 24 bp, Artificial Sequence
  Description of Artificial Sequence: Synthetic oligonucleotide
tggggtcggactggcgattcctcc

SEQ ID NO: 3829 - DNA, 23 bp, Artificial Sequence
  Description of Artificial Sequence: Synthetic oligonucleotide
ggggtcggactggcgattcctcc

SEQ ID NO: 3830 - DNA, 23 bp, Artificial Sequence
  Description of Artificial Sequence: Synthetic oligonucleotide
gggtcggactggcgattcctccg

SEQ ID NO: 3831 - DNA, 23 bp, Artificial Sequence
  Description of Artificial Sequence: Synthetic oligonucleotide
ggtcggactggcgattcctccgc

SEQ ID NO: 3832 - DNA, 23 bp, Artificial Sequence
  Description of Artificial Sequence: Synthetic oligonucleotide
gtcggactggcgattcctccgcg

SEQ ID NO: 3833 - DNA, 23 bp, Artificial Sequence
  Description of Artificial Sequence: Synthetic oligonucleotide
tcggactggcgattcctccgcgg

SEQ ID NO: 3834 - DNA, 22 bp, Artificial Sequence
  Description of Artificial Sequence: Synthetic oligonucleotide
cggactggcgattcctccgcgg

SEQ ID NO: 3835 - DNA, 24 bp, Artificial Sequence
  Description of Artificial Sequence: Synthetic oligonucleotide
ggactggcgattcctccgcgggta

SEQ ID NO: 3836 - DNA, 24 bp, Artificial Sequence
  Description of Artificial Sequence: Synthetic oligonucleotide
gactggcgattcctccgcgggtac

SEQ ID NO: 3837 - DNA, 25 bp, Artificial Sequence
  Description of Artificial Sequence: Synthetic oligonucleotide
actggcgattcctccgcgggtacca

SEQ ID NO: 3838 - DNA, 24 bp, Artificial Sequence
  Description of Artificial Sequence: Synthetic oligonucleotide
ctggcgattcctccgcgggtacca

SEQ ID NO: 3839 - DNA, 24 bp, Artificial Sequence
  Description of Artificial Sequence: Synthetic oligonucleotide
tggcgattcctccgcgggtaccac

SEQ ID NO: 3840 - DNA, 23 bp, Artificial Sequence
  Description of Artificial Sequence: Synthetic oligonucleotide
ggcgattcctccgcgggtaccac

SEQ ID NO: 3841 - DNA, 24 bp, Artificial Sequence
  Description of Artificial Sequence: Synthetic oligonucleotide
gcgattcctccgcgggtaccacca

SEQ ID NO: 3842 - DNA, 26 bp, Artificial Sequence
  Description of Artificial Sequence: Synthetic oligonucleotide
cgattcctccgcgggtaccaccagta

SEQ ID NO: 3843 - DNA, 26 bp, Artificial Sequence
  Description of Artificial Sequence: Synthetic oligonucleotide
gattcctccgcgggtaccaccagtac

SEQ ID NO: 3844 - DNA, 26 bp, Artificial Sequence
  Description of Artificial Sequence: Synthetic oligonucleotide
attcctccgcgggtaccaccagtacg

SEQ ID NO: 3845 - DNA, 20 bp, Artificial Sequence
  Description of Artificial Sequence: Synthetic oligonucleotide
gtgtcccggcccggccgtgt

SEQ ID NO: 3846 - DNA, 20 bp, Artificial Sequence
  Description of Artificial Sequence: Synthetic oligonucleotide
tgtcccggcccggccgtggt

SEQ ID NO: 3847 - DNA, 20 bp, Artificial Sequence
  Description of Artificial Sequence: Synthetic oligonucleotide
gtcccggcccggccgtggtt

SEQ ID NO: 3848 - DNA, 20 bp, Artificial Sequence
  Description of Artificial Sequence: Synthetic oligonucleotide
tcccggcccggccgtgggtt

SEQ ID NO: 3849 - DNA, 20 bp, Artificial Sequence
  Description of Artificial Sequence: Synthetic oligonucleotide
cccggcccggccgtgggttt

SEQ ID NO: 3850 - DNA, 20 bp, Artificial Sequence
  Description of Artificial Sequence: Synthetic oligonucleotide
ccggcccggccgtggggatt

SEQ ID NO: 3851 - DNA, 20 bp, Artificial Sequence
  Description of Artificial Sequence: Synthetic oligonucleotide
cggcccggccgtggggagtt

SEQ ID NO: 3852 - DNA, 20 bp, Artificial Sequence
  Description of Artificial Sequence: Synthetic oligonucleotide
ggcccggccgtggggagctt

SEQ ID NO: 3853 - DNA, 20 bp, Artificial Sequence
  Description of Artificial Sequence: Synthetic oligonucleotide
gcccggccgtggggagcctt

SEQ ID NO: 3854 - DNA, 20 bp, Artificial Sequence
  Description of Artificial Sequence: Synthetic oligonucleotide
cccggccgtggggagccctt

SEQ ID NO: 3855 - DNA, 20 bp, Artificial Sequence
  Description of Artificial Sequence: Synthetic oligonucleotide
ccggccgtggggagcccctt

SEQ ID NO: 3856 - DNA, 20 bp, Artificial Sequence
  Description of Artificial Sequence: Synthetic oligonucleotide
cggccgtggggagccccgtt

SEQ ID NO: 3857 - DNA, 20 bp, Artificial Sequence
  Description of Artificial Sequence: Synthetic oligonucleotide
ggccgtggggagccccgctt

SEQ ID NO: 3858 - DNA, 22 bp, Artificial Sequence
  Description of Artificial Sequence: Synthetic oligonucleotide
gccgtggggagccccgcttcat

SEQ ID NO: 3859 - DNA, 22 bp, Artificial Sequence
  Description of Artificial Sequence: Synthetic oligonucleotide
ccgtggggagccccgcttcatc

SEQ ID NO: 3860 - DNA, 22 bp, Artificial Sequence
  Description of Artificial Sequence: Synthetic oligonucleotide
cgtggggagccccgcttcatcg

SEQ ID NO: 3861 - DNA, 23 bp, Artificial Sequence
  Description of Artificial Sequence: Synthetic oligonucleotide
gtggggagccccgcttcatcgca

SEQ ID NO: 3862 - DNA, 24 bp, Artificial Sequence
  Description of Artificial Sequence: Synthetic oligonucleotide
tggggagccccgcttcatcgcagt

SEQ ID NO: 3863 - DNA, 26 bp, Artificial Sequence
  Description of Artificial Sequence: Synthetic oligonucleotide
atggggaggaccagacccaggacaca

SEQ ID NO: 3864 - DNA, 25 bp, Artificial Sequence
  Description of Artificial Sequence: Synthetic oligonucleotide
tggggaggaccagacccaggacaca

SEQ ID NO: 3865 - DNA, 24 bp, Artificial Sequence
  Description of Artificial Sequence: Synthetic oligonucleotide
ggggaggaccagacccaggacaca

SEQ ID NO: 3866 - DNA, 25 bp, Artificial Sequence
  Description of Artificial Sequence: Synthetic oligonucleotide
gggaggaccagacccaggacacaga

SEQ ID NO: 3867 - DNA, 25 bp, Artificial Sequence
  Description of Artificial Sequence: Synthetic oligonucleotide
ggaggaccagacccaggacacagag

SEQ ID NO: 3868 - DNA, 26 bp, Artificial Sequence
  Description of Artificial Sequence: Synthetic oligonucleotide
gaggaccagacccaggacacagagct

SEQ ID NO: 3869 - DNA, 26 bp, Artificial Sequence
  Description of Artificial Sequence: Synthetic oligonucleotide
aggaccagacccaggacacagagctc

SEQ ID NO: 3870 - DNA, 25 bp, Artificial Sequence
  Description of Artificial Sequence: Synthetic oligonucleotide
ggaccagacccaggacacagagctc

SEQ ID NO: 3871 - DNA, 26 bp, Artificial Sequence
  Description of Artificial Sequence: Synthetic oligonucleotide
gaccagacccaggacacagagctcgt

SEQ ID NO: 3872 - DNA, 26 bp, Artificial Sequence
  Description of Artificial Sequence: Synthetic oligonucleotide
accagacccaggacacagagctcgtg

SEQ ID NO: 3873 - DNA, 25 bp, Artificial Sequence
  Description of Artificial Sequence: Synthetic oligonucleotide
ccagacccaggacacagagctcgtg

SEQ ID NO: 3874 - DNA, 26 bp, Artificial Sequence
  Description of Artificial Sequence: Synthetic oligonucleotide
cagacccaggacacagagctcgtgga

SEQ ID NO: 3875 - DNA, 27 bp, Artificial Sequence
  Description of Artificial Sequence: Synthetic oligonucleotide
agacccaggacacagagctcgtggaga

SEQ ID NO: 3876 - DNA, 26 bp, Artificial Sequence
  Description of Artificial Sequence: Synthetic oligonucleotide
gacccaggacacagagctcgtggaga

SEQ ID NO: 3877 - DNA, 26 bp, Artificial Sequence
  Description of Artificial Sequence: Synthetic oligonucleotide
acccaggacacagagctcgtggagac

SEQ ID NO: 3878 - DNA, 25 bp, Artificial Sequence
  Description of Artificial Sequence: Synthetic oligonucleotide
cccaggacacagagctcgtggagac

SEQ ID NO: 3879 - DNA, 26 bp, Artificial Sequence
  Description of Artificial Sequence: Synthetic oligonucleotide
ccaggacacagagctcgtggagacca

SEQ ID NO: 3880 - DNA, 26 bp, Artificial Sequence
  Description of Artificial Sequence: Synthetic oligonucleotide
caggacacagagctcgtggagaccag

SEQ ID NO: 3881 - DNA, 26 bp, Artificial Sequence
  Description of Artificial Sequence: Synthetic oligonucleotide
aggacacagagctcgtggagaccagg

SEQ ID NO: 3882 - DNA, 25 bp, Artificial Sequence
  Description of Artificial Sequence: Synthetic oligonucleotide
ggacacagagctcgtggagaccagg

SEQ ID NO: 3883 - DNA, 25 bp, Artificial Sequence
  Description of Artificial Sequence: Synthetic oligonucleotide
gacacagagctcgtggagaccaggc

SEQ ID NO: 3884 - DNA, 26 bp, Artificial Sequence
  Description of Artificial Sequence: Synthetic oligonucleotide
acacagagctcgtggagaccaggcct

SEQ ID NO: 3885 - DNA, 25 bp, Artificial Sequence
  Description of Artificial Sequence: Synthetic oligonucleotide
cacagagctcgtggagaccaggcct

SEQ ID NO: 3886 - DNA, 25 bp, Artificial Sequence
  Description of Artificial Sequence: Synthetic oligonucleotide
acagagctcgtggagaccaggcctg

SEQ ID NO: 3887 - DNA, 24 bp, Artificial Sequence
  Description of Artificial Sequence: Synthetic oligonucleotide
cagagctcgtggagaccaggcctg

SEQ ID NO: 3888 - DNA, 25 bp, Artificial Sequence
  Description of Artificial Sequence: Synthetic oligonucleotide
agagctcgtggagaccaggcctgca

SEQ ID NO: 3889 - DNA, 25 bp, Artificial Sequence
  Description of Artificial Sequence: Synthetic oligonucleotide
gctactacaaccagagcgaggccgg

SEQ ID NO: 3890 - DNA, 26 bp, Artificial Sequence
  Description of Artificial Sequence: Synthetic oligonucleotide
ctactacaaccagagcgaggccgggt

SEQ ID NO: 3891 - DNA, 27 bp, Artificial Sequence
  Description of Artificial Sequence: Synthetic oligonucleotide
tactacaaccagagcgaggccgggtct

SEQ ID NO: 3892 - DNA, 26 bp, Artificial Sequence
  Description of Artificial Sequence: Synthetic oligonucleotide
actacaaccagagcgaggccgggtct

SEQ ID NO: 3893 - DNA, 25 bp, Artificial Sequence
  Description of Artificial Sequence: Synthetic oligonucleotide
ctacaaccagagcgaggccgggtct

SEQ ID NO: 3894 - DNA, 26 bp, Artificial Sequence
  Description of Artificial Sequence: Synthetic oligonucleotide
tacaaccagagcgaggccgggtctca

SEQ ID NO: 3895 - DNA, 25 bp, Artificial Sequence
  Description of Artificial Sequence: Synthetic oligonucleotide
acaaccagagcgaggccgggtctca

SEQ ID NO: 3896 - DNA, 24 bp, Artificial Sequence
  Description of Artificial Sequence: Synthetic oligonucleotide
caaccagagcgaggccgggtctca

SEQ ID NO: 3897 - DNA, 25 bp, Artificial Sequence
  Description of Artificial Sequence: Synthetic oligonucleotide
aaccagagcgaggccgggtctcaca

SEQ ID NO: 3898 - DNA, 24 bp, Artificial Sequence
  Description of Artificial Sequence: Synthetic oligonucleotide
accagagcgaggccgggtctcaca

SEQ ID NO: 3899 - DNA, 23 bp, Artificial Sequence
  Description of Artificial Sequence: Synthetic oligonucleotide
ccagagcgaggccgggtctcaca

SEQ ID NO: 3900 - DNA, 23 bp, Artificial Sequence
  Description of Artificial Sequence: Synthetic oligonucleotide
cagagcgaggccgggtctcacac

SEQ ID NO: 3901 - DNA, 23 bp, Artificial Sequence
  Description of Artificial Sequence: Synthetic oligonucleotide
agagcgaggccgggtctcacacc

SEQ ID NO: 3902 - DNA, 22 bp, Artificial Sequence
  Description of Artificial Sequence: Synthetic oligonucleotide
gagcgaggccgggtctcacacc

SEQ ID NO: 3903 - DNA, 23 bp, Artificial Sequence
  Description of Artificial Sequence: Synthetic oligonucleotide
agcgaggccgggtctcacaccgt

SEQ ID NO: 3904 - DNA, 22 bp, Artificial Sequence
  Description of Artificial Sequence: Synthetic oligonucleotide
gcgaggccgggtctcacaccgt

SEQ ID NO: 3905 - DNA, 22 bp, Artificial Sequence
  Description of Artificial Sequence: Synthetic oligonucleotide
cgaggccgggtctcacaccgtc

SEQ ID NO: 3906 - DNA, 23 bp, Artificial Sequence
  Description of Artificial Sequence: Synthetic oligonucleotide
gaggccgggtctcacaccgtcca

SEQ ID NO: 3907 - DNA, 24 bp, Artificial Sequence
  Description of Artificial Sequence: Synthetic oligonucleotide
aggccgggtctcacaccgtccaga

SEQ ID NO: 3908 - DNA, 23 bp, Artificial Sequence
  Description of Artificial Sequence: Synthetic oligonucleotide
ggccgggtctcacaccgtccaga

SEQ ID NO: 3909 - DNA, 23 bp, Artificial Sequence
  Description of Artificial Sequence: Synthetic oligonucleotide
gccgggtctcacaccgtccagag

SEQ ID NO: 3910 - DNA, 25 bp, Artificial Sequence
  Description of Artificial Sequence: Synthetic oligonucleotide
ccgggtctcacaccgtccagaggat

SEQ ID NO: 3911 - DNA, 27 bp, Artificial Sequence
  Description of Artificial Sequence: Synthetic oligonucleotide
cgggtctcacaccgtccagaggatgta

SEQ ID NO: 3912 - DNA, 28 bp, Artificial Sequence
  Description of Artificial Sequence: Synthetic oligonucleotide
gggtctcacaccgtccagaggatgtatg

SEQ ID NO: 3913 - DNA, 28 bp, Artificial Sequence
  Description of Artificial Sequence: Synthetic oligonucleotide
ggtctcacaccgtccagaggatgtatgg

SEQ ID NO: 3914 - DNA, 28 bp, Artificial Sequence
  Description of Artificial Sequence: Synthetic oligonucleotide
gtctcacaccgtccagaggatgtatggc

SEQ ID NO: 3915 - DNA, 25 bp, Artificial Sequence
  Description of Artificial Sequence: Synthetic oligonucleotide
gaaggagacgctgcagcgcacggat

SEQ ID NO: 3916 - DNA, 25 bp, Artificial Sequence
  Description of Artificial Sequence: Synthetic oligonucleotide
aaggagacgctgcagcgcacggatg

SEQ ID NO: 3917 - DNA, 24 bp, Artificial Sequence
  Description of Artificial Sequence: Synthetic oligonucleotide
aggagacgctgcagcgcacggatg

SEQ ID NO: 3918 - DNA, 23 bp, Artificial Sequence
  Description of Artificial Sequence: Synthetic oligonucleotide
ggagacgctgcagcgcacggatg

SEQ ID NO: 3919 - DNA, 23 bp, Artificial Sequence
  Description of Artificial Sequence: Synthetic oligonucleotide
gagacgctgcagcgcacggatgc

SEQ ID NO: 3920 - DNA, 23 bp, Artificial Sequence
  Description of Artificial Sequence: Synthetic oligonucleotide
agacgctgcagcgcacggatgcc

SEQ ID NO: 3921 - DNA, 22 bp, Artificial Sequence
  Description of Artificial Sequence: Synthetic oligonucleotide
gacgctgcagcgcacggatgcc

SEQ ID NO: 3922 - DNA, 22 bp, Artificial Sequence
  Description of Artificial Sequence: Synthetic oligonucleotide
acgctgcagcgcacggatgccc

SEQ ID NO: 3923 - DNA, 21 bp, Artificial Sequence
  Description of Artificial Sequence: Synthetic oligonucleotide
cgctgcagcgcacggatgccc

SEQ ID NO: 3924 - DNA, 21 bp, Artificial Sequence
  Description of Artificial Sequence: Synthetic oligonucleotide
gctgcagcgcacggatgcccc

SEQ ID NO: 3925 - DNA, 25 bp, Artificial Sequence
  Description of Artificial Sequence: Synthetic oligonucleotide
ctgcagcgcacggatgcccccaaaa

SEQ ID NO: 3926 - DNA, 25 bp, Artificial Sequence
  Description of Artificial Sequence: Synthetic oligonucleotide
tgcagcgcacggatgcccccaaaac

SEQ ID NO: 3927 - DNA, 24 bp, Artificial Sequence
  Description of Artificial Sequence: Synthetic oligonucleotide
gcagcgcacggatgcccccaaaac

SEQ ID NO: 3928 - DNA, 24 bp, Artificial Sequence
  Description of Artificial Sequence: Synthetic oligonucleotide
cagcgcacggatgcccccaaaacg

SEQ ID NO: 3929 - DNA, 27 bp, Artificial Sequence
  Description of Artificial Sequence: Synthetic oligonucleotide
agcgcacggatgcccccaaaacgcata

SEQ ID NO: 3930 - DNA, 27 bp, Artificial Sequence
  Description of Artificial Sequence: Synthetic oligonucleotide
gcgcacggatgcccccaaaacgcatat

SEQ ID NO: 3931 - DNA, 27 bp, Artificial Sequence
  Description of Artificial Sequence: Synthetic oligonucleotide
cgcacggatgcccccaaaacgcatatg

SEQ ID NO: 3932 - DNA, 28 bp, Artificial Sequence
  Description of Artificial Sequence: Synthetic oligonucleotide
gcacggatgcccccaaaacgcatatgac

SEQ ID NO: 3933 - DNA, 29 bp, Artificial Sequence
  Description of Artificial Sequence: Synthetic oligonucleotide
cacggatgcccccaaaacgcatatgactc

SEQ ID NO: 3934 - DNA, 30 bp, Artificial Sequence
  Description of Artificial Sequence: Synthetic oligonucleotide
acggatgcccccaaaacgcatatgactcac

SEQ ID NO: 3935 - DNA, 29 bp, Artificial Sequence
  Description of Artificial Sequence: Synthetic oligonucleotide
cggatgcccccaaaacgcatatgactcac

SEQ ID NO: 3936 - DNA, 29 bp, Artificial Sequence
  Description of Artificial Sequence: Synthetic oligonucleotide
ggatgcccccaaaacgcatatgactcacc

SEQ ID NO: 3937 - DNA, 30 bp, Artificial Sequence
  Description of Artificial Sequence: Synthetic oligonucleotide
gatgcccccaaaacgcatatgactcaccac

SEQ ID NO: 3938 - DNA, 30 bp, Artificial Sequence
  Description of Artificial Sequence: Synthetic oligonucleotide
atgcccccaaaacgcatatgactcaccacg

SEQ ID NO: 3939 - DNA, 29 bp, Artificial Sequence
  Description of Artificial Sequence: Synthetic oligonucleotide
tgcccccaaaacgcatatgactcaccacg

SEQ ID NO: 3940 - DNA, 20 bp, Artificial Sequence
  Description of Artificial Sequence: Synthetic oligonucleotide
tcccggcccggccgcggatt

SEQ ID NO: 3941 - DNA, 20 bp, Artificial Sequence
  Description of Artificial Sequence: Synthetic oligonucleotide
cccggcccggccgcggattt

SEQ ID NO: 3942 - DNA, 20 bp, Artificial Sequence
  Description of Artificial Sequence: Synthetic oligonucleotide
ccggcccggccgcggagatt

SEQ ID NO: 3943 - DNA, 20 bp, Artificial Sequence
  Description of Artificial Sequence: Synthetic oligonucleotide
cggcccggccgcggagagtt

SEQ ID NO: 3944 - DNA, 20 bp, Artificial Sequence
  Description of Artificial Sequence: Synthetic oligonucleotide
ggcccggccgcggagagctt

SEQ ID NO: 3945 - DNA, 20 bp, Artificial Sequence
  Description of Artificial Sequence: Synthetic oligonucleotide
gcccggccgcggagagcctt

SEQ ID NO: 3946 - DNA, 20 bp, Artificial Sequence
  Description of Artificial Sequence: Synthetic oligonucleotide
cccggccgcggagagccctt

SEQ ID NO: 3947 - DNA, 20 bp, Artificial Sequence
  Description of Artificial Sequence: Synthetic oligonucleotide
ccggccgcggagagcccctt

SEQ ID NO: 3948 - DNA, 20 bp, Artificial Sequence
  Description of Artificial Sequence: Synthetic oligonucleotide
cggccgcggagagccccgtt

SEQ ID NO: 3949 - DNA, 20 bp, Artificial Sequence
  Description of Artificial Sequence: Synthetic oligonucleotide
ggccgcggagagccccgctt

SEQ ID NO: 3950 - DNA, 22 bp, Artificial Sequence
  Description of Artificial Sequence: Synthetic oligonucleotide
gccgcggagagccccgcttcat

SEQ ID NO: 3951 - DNA, 22 bp, Artificial Sequence
  Description of Artificial Sequence: Synthetic oligonucleotide
ccgcggagagccccgcttcatc

SEQ ID NO: 3952 - DNA, 22 bp, Artificial Sequence
  Description of Artificial Sequence: Synthetic oligonucleotide
cgcggagagccccgcttcatcg

SEQ ID NO: 3953 - DNA, 23 bp, Artificial Sequence
  Description of Artificial Sequence: Synthetic oligonucleotide
gcggagagccccgcttcatcgca

SEQ ID NO: 3954 - DNA, 24 bp, Artificial Sequence
  Description of Artificial Sequence: Synthetic oligonucleotide
cggagagccccgcttcatcgcagt

SEQ ID NO: 3955 - DNA, 27 bp, Artificial Sequence
  Description of Artificial Sequence: Synthetic oligonucleotide
agggtccggagtattgggacggggaaa

SEQ ID NO: 3956 - DNA, 26 bp, Artificial Sequence
  Description of Artificial Sequence: Synthetic oligonucleotide
gggtccggagtattgggacggggaaa

SEQ ID NO: 3957 - DNA, 27 bp, Artificial Sequence
  Description of Artificial Sequence: Synthetic oligonucleotide
ggtccggagtattgggacggggaaaca

SEQ ID NO: 3958 - DNA, 27 bp, Artificial Sequence
  Description of Artificial Sequence: Synthetic oligonucleotide
gtccggagtattgggacggggaaacac

SEQ ID NO: 3959 - DNA, 27 bp, Artificial Sequence
  Description of Artificial Sequence: Synthetic oligonucleotide
tccggagtattgggacggggaaacacg

SEQ ID NO: 3960 - DNA, 26 bp, Artificial Sequence
  Description of Artificial Sequence: Synthetic oligonucleotide
ccggagtattgggacggggaaacacg

SEQ ID NO: 3961 - DNA, 27 bp, Artificial Sequence
  Description of Artificial Sequence: Synthetic oligonucleotide
cggagtattgggacggggaaacacgga

SEQ ID NO: 3962 - DNA, 29 bp, Artificial Sequence
  Description of Artificial Sequence: Synthetic oligonucleotide
ggagtattgggacggggaaacacggaaag

SEQ ID NO: 3963 - DNA, 30 bp, Artificial Sequence
  Description of Artificial Sequence: Synthetic oligonucleotide
gagtattgggacggggaaacacggaaagtg

SEQ ID NO: 3964 - DNA, 32 bp, Artificial Sequence
  Description of Artificial Sequence: Synthetic oligonucleotide
agtattgggacggggaaacacggaaagtgaag

SEQ ID NO: 3965 - DNA, 31 bp, Artificial Sequence
  Description of Artificial Sequence: Synthetic oligonucleotide
gtattgggacggggaaacacggaaagtgaag

SEQ ID NO: 3966 - DNA, 31 bp, Artificial Sequence
  Description of Artificial Sequence: Synthetic oligonucleotide
tattgggacggggaaacacggaaagtgaagg

SEQ ID NO: 3967 - DNA, 30 bp, Artificial Sequence
  Description of Artificial Sequence: Synthetic oligonucleotide
attgggacggggaaacacggaaagtgaagg

SEQ ID NO: 3968 - DNA, 29 bp, Artificial Sequence
  Description of Artificial Sequence: Synthetic oligonucleotide
ttgggacggggaaacacggaaagtgaagg

SEQ ID NO: 3969 - DNA, 28 bp, Artificial Sequence
  Description of Artificial Sequence: Synthetic oligonucleotide
tgggacggggaaacacggaaagtgaagg

SEQ ID NO: 3970 - DNA, 27 bp, Artificial Sequence
  Description of Artificial Sequence: Synthetic oligonucleotide
gggacggggaaacacggaaagtgaagg

SEQ ID NO: 3971 - DNA, 27 bp, Artificial Sequence
  Description of Artificial Sequence: Synthetic oligonucleotide
ggacggggaaacacggaaagtgaaggc

SEQ ID NO: 3972 - DNA, 27 bp, Artificial Sequence
  Description of Artificial Sequence: Synthetic oligonucleotide
gacggggaaacacggaaagtgaaggcc

SEQ ID NO: 3973 - DNA, 27 bp, Artificial Sequence
  Description of Artificial Sequence: Synthetic oligonucleotide
acggggaaacacggaaagtgaaggccc

SEQ ID NO: 3974 - DNA, 27 bp, Artificial Sequence
  Description of Artificial Sequence: Synthetic oligonucleotide
cggggaaacacggaaagtgaaggccca

SEQ ID NO: 3975 - DNA, 27 bp, Artificial Sequence
  Description of Artificial Sequence: Synthetic oligonucleotide
ggggaaacacggaaagtgaaggcccac

SEQ ID NO: 3976 - DNA, 28 bp, Artificial Sequence
  Description of Artificial Sequence: Synthetic oligonucleotide
gggaaacacggaaagtgaaggcccactc

SEQ ID NO: 3977 - DNA, 29 bp, Artificial Sequence
  Description of Artificial Sequence: Synthetic oligonucleotide
ggaaacacggaaagtgaaggcccactcac

SEQ ID NO: 3978 - DNA, 30 bp, Artificial Sequence
  Description of Artificial Sequence: Synthetic oligonucleotide
gaaacacggaaagtgaaggcccactcacag

SEQ ID NO: 3979 - DNA, 31 bp, Artificial Sequence
  Description of Artificial Sequence: Synthetic oligonucleotide
aaacacggaaagtgaaggcccactcacagac

SEQ ID NO: 3980 - DNA, 30 bp, Artificial Sequence
  Description of Artificial Sequence: Synthetic oligonucleotide
aacacggaaagtgaaggcccactcacagac

SEQ ID NO: 3981 - DNA, 25 bp, Artificial Sequence
  Description of Artificial Sequence: Synthetic oligonucleotide
ctgggccctgagcttctaccctgca

SEQ ID NO: 3982 - DNA, 26 bp, Artificial Sequence
  Description of Artificial Sequence: Synthetic oligonucleotide
tgggccctgagcttctaccctgcaga

SEQ ID NO: 3983 - DNA, 25 bp, Artificial Sequence
  Description of Artificial Sequence: Synthetic oligonucleotide
gggccctgagcttctaccctgcaga

SEQ ID NO: 3984 - DNA, 27 bp, Artificial Sequence
  Description of Artificial Sequence: Synthetic oligonucleotide
ggccctgagcttctaccctgcagagat

SEQ ID NO: 3985 - DNA, 27 bp, Artificial Sequence
  Description of Artificial Sequence: Synthetic oligonucleotide
gccctgagcttctaccctgcagagatc

SEQ ID NO: 3986 - DNA, 28 bp, Artificial Sequence
  Description of Artificial Sequence: Synthetic oligonucleotide
ccctgagcttctaccctgcagagatcac

SEQ ID NO: 3987 - DNA, 29 bp, Artificial Sequence
  Description of Artificial Sequence: Synthetic oligonucleotide
cctgagcttctaccctgcagagatcacac

SEQ ID NO: 3988 - DNA, 30 bp, Artificial Sequence
  Description of Artificial Sequence: Synthetic oligonucleotide
ctgagcttctaccctgcagagatcacactg

SEQ ID NO: 3989 - DNA, 31 bp, Artificial Sequence
  Description of Artificial Sequence: Synthetic oligonucleotide
tgagcttctaccctgcagagatcacactgac

SEQ ID NO: 3990 - DNA, 30 bp, Artificial Sequence
  Description of Artificial Sequence: Synthetic oligonucleotide
gagcttctaccctgcagagatcacactgac

SEQ ID NO: 3991 - DNA, 30 bp, Artificial Sequence
  Description of Artificial Sequence: Synthetic oligonucleotide
agcttctaccctgcagagatcacactgacc

SEQ ID NO: 3992 - DNA, 29 bp, Artificial Sequence
  Description of Artificial Sequence: Synthetic oligonucleotide
gcttctaccctgcagagatcacactgacc

SEQ ID NO: 3993 - DNA, 30 bp, Artificial Sequence
  Description of Artificial Sequence: Synthetic oligonucleotide
cttctaccctgcagagatcacactgacctg

SEQ ID NO: 3994 - DNA, 30 bp, Artificial Sequence
  Description of Artificial Sequence: Synthetic oligonucleotide
ttctaccctgcagagatcacactgacctgg

SEQ ID NO: 3995 - DNA, 29 bp, Artificial Sequence
  Description of Artificial Sequence: Synthetic oligonucleotide
tctaccctgcagagatcacactgacctgg

SEQ ID NO: 3996 - DNA, 28 bp, Artificial Sequence
  Description of Artificial Sequence: Synthetic oligonucleotide
ctaccctgcagagatcacactgacctgg

SEQ ID NO: 3997 - DNA, 28 bp, Artificial Sequence
  Description of Artificial Sequence: Synthetic oligonucleotide
taccctgcagagatcacactgacctggc

SEQ ID NO: 3998 - DNA, 27 bp, Artificial Sequence
  Description of Artificial Sequence: Synthetic oligonucleotide
accctgcagagatcacactgacctggc

SEQ ID NO: 3999 - DNA, 27 bp, Artificial Sequence
  Description of Artificial Sequence: Synthetic oligonucleotide
ccctgcagagatcacactgacctggca

SEQ ID NO: 4000 - DNA, 27 bp, Artificial Sequence
  Description of Artificial Sequence: Synthetic oligonucleotide
cctgcagagatcacactgacctggcag

SEQ ID NO: 4001 - DNA, 27 bp, Artificial Sequence
  Description of Artificial Sequence: Synthetic oligonucleotide
ctgcagagatcacactgacctggcagc

SEQ ID NO: 4002 - DNA, 27 bp, Artificial Sequence
  Description of Artificial Sequence: Synthetic oligonucleotide
tgcagagatcacactgacctggcagcg

SEQ ID NO: 4003 - DNA, 26 bp, Artificial Sequence
  Description of Artificial Sequence: Synthetic oligonucleotide
gcagagatcacactgacctggcagcg

SEQ ID NO: 4004 - DNA, 26 bp, Artificial Sequence
  Description of Artificial Sequence: Synthetic oligonucleotide
cagagatcacactgacctggcagcgg

SEQ ID NO: 4005 - DNA, 27 bp, Artificial Sequence
  Description of Artificial Sequence: Synthetic oligonucleotide
agagatcacactgacctggcagcggga

SEQ ID NO: 4006 - DNA, 26 bp, Artificial Sequence
  Description of Artificial Sequence: Synthetic oligonucleotide
gggatggaaccttccagaagtgggcc

SEQ ID NO: 4007 - DNA, 26 bp, Artificial Sequence
  Description of Artificial Sequence: Synthetic oligonucleotide
ggatggaaccttccagaagtgggccg

SEQ ID NO: 4008 - DNA, 27 bp, Artificial Sequence
  Description of Artificial Sequence: Synthetic oligonucleotide
gatggaaccttccagaagtgggccgct

SEQ ID NO: 4009 - DNA, 27 bp, Artificial Sequence
  Description of Artificial Sequence: Synthetic oligonucleotide
atggaaccttccagaagtgggccgctg

SEQ ID NO: 4010 - DNA, 27 bp, Artificial Sequence
  Description of Artificial Sequence: Synthetic oligonucleotide
tggaaccttccagaagtgggccgctgt

SEQ ID NO: 4011 - DNA, 26 bp, Artificial Sequence
  Description of Artificial Sequence: Synthetic oligonucleotide
ggaaccttccagaagtgggccgctgt

SEQ ID NO: 4012 - DNA, 26 bp, Artificial Sequence
  Description of Artificial Sequence: Synthetic oligonucleotide
gaaccttccagaagtgggccgctgtg

SEQ ID NO: 4013 - DNA, 27 bp, Artificial Sequence
  Description of Artificial Sequence: Synthetic oligonucleotide
aaccttccagaagtgggccgctgtggt

SEQ ID NO: 4014 - DNA, 26 bp, Artificial Sequence
  Description of Artificial Sequence: Synthetic oligonucleotide
accttccagaagtgggccgctgtggt

SEQ ID NO: 4015 - DNA, 25 bp, Artificial Sequence
  Description of Artificial Sequence: Synthetic oligonucleotide
ccttccagaagtgggccgctgtggt

SEQ ID NO: 4016 - DNA, 25 bp, Artificial Sequence
  Description of Artificial Sequence: Synthetic oligonucleotide
cttccagaagtgggccgctgtggtg

SEQ ID NO: 4017 - DNA, 26 bp, Artificial Sequence
  Description of Artificial Sequence: Synthetic oligonucleotide
ttccagaagtgggccgctgtggtggt

SEQ ID NO: 4018 - DNA, 25 bp, Artificial Sequence
  Description of Artificial Sequence: Synthetic oligonucleotide
tccagaagtgggccgctgtggtggt

SEQ ID NO: 4019 - DNA, 24 bp, Artificial Sequence
  Description of Artificial Sequence: Synthetic oligonucleotide
ccagaagtgggccgctgtggtggt

SEQ ID NO: 4020 - DNA, 24 bp, Artificial Sequence
  Description of Artificial Sequence: Synthetic oligonucleotide
cagaagtgggccgctgtggtggtg

SEQ ID NO: 4021 - DNA, 24 bp, Artificial Sequence
  Description of Artificial Sequence: Synthetic oligonucleotide
agaagtgggccgctgtggtggtgc

SEQ ID NO: 4022 - DNA, 23 bp, Artificial Sequence
  Description of Artificial Sequence: Synthetic oligonucleotide
gaagtgggccgctgtggtggtgc

SEQ ID NO: 4023 - DNA, 25 bp, Artificial Sequence
  Description of Artificial Sequence: Synthetic oligonucleotide
aagtgggccgctgtggtggtgcctt

SEQ ID NO: 4024 - DNA, 24 bp, Artificial Sequence
  Description of Artificial Sequence: Synthetic oligonucleotide
agtgggccgctgtggtggtgcctt

SEQ ID NO: 4025 - DNA, 23 bp, Artificial Sequence
  Description of Artificial Sequence: Synthetic oligonucleotide
gtgggccgctgtggtggtgcctt

SEQ ID NO: 4026 - DNA, 24 bp, Artificial Sequence
  Description of Artificial Sequence: Synthetic oligonucleotide
tgggccgctgtggtggtgccttct

SEQ ID NO: 4027 - DNA, 23 bp, Artificial Sequence
  Description of Artificial Sequence: Synthetic oligonucleotide
gggccgctgtggtggtgccttct

SEQ ID NO: 4028 - DNA, 23 bp, Artificial Sequence
  Description of Artificial Sequence: Synthetic oligonucleotide
ggccgctgtggtggtgccttctg

SEQ ID NO: 4029 - DNA, 24 bp, Artificial Sequence
  Description of Artificial Sequence: Synthetic oligonucleotide
gccgctgtggtggtgccttctgga

SEQ ID NO: 4030 - DNA, 25 bp, Artificial Sequence
  Description of Artificial Sequence: Synthetic oligonucleotide
ccgctgtggtggtgccttctggaca

SEQ ID NO: 4031 - DNA, 25 bp, Artificial Sequence
  Description of Artificial Sequence: Synthetic oligonucleotide
cgctgtggtggtgccttctggacag

SEQ ID NO: 4032 - DNA, 24 bp, Artificial Sequence
  Description of Artificial Sequence: Synthetic oligonucleotide
aggaggggccggagtattgggacg

SEQ ID NO: 4033 - DNA, 23 bp, Artificial Sequence
  Description of Artificial Sequence: Synthetic oligonucleotide
ggaggggccggagtattgggacg

SEQ ID NO: 4034 - DNA, 23 bp, Artificial Sequence
  Description of Artificial Sequence: Synthetic oligonucleotide
gaggggccggagtattgggacgg

SEQ ID NO: 4035 - DNA, 23 bp, Artificial Sequence
  Description of Artificial Sequence: Synthetic oligonucleotide
aggggccggagtattgggacggg

SEQ ID NO: 4036 - DNA, 22 bp, Artificial Sequence
  Description of Artificial Sequence: Synthetic oligonucleotide
ggggccggagtattgggacggg

SEQ ID NO: 4037 - DNA, 23 bp, Artificial Sequence
  Description of Artificial Sequence: Synthetic oligonucleotide
gggccggagtattgggacgggga

SEQ ID NO: 4038 - DNA, 24 bp, Artificial Sequence
  Description of Artificial Sequence: Synthetic oligonucleotide
ggccggagtattgggacggggaga

SEQ ID NO: 4039 - DNA, 25 bp, Artificial Sequence
  Description of Artificial Sequence: Synthetic oligonucleotide
gccggagtattgggacggggagaca

SEQ ID NO: 4040 - DNA, 25 bp, Artificial Sequence
  Description of Artificial Sequence: Synthetic oligonucleotide
aaggagacgctgcagcgcactgacg

SEQ ID NO: 4041 - DNA, 24 bp, Artificial Sequence
  Description of Artificial Sequence: Synthetic oligonucleotide
aggagacgctgcagcgcactgacg

SEQ ID NO: 4042 - DNA, 23 bp, Artificial Sequence
  Description of Artificial Sequence: Synthetic oligonucleotide
ggagacgctgcagcgcactgacg

SEQ ID NO: 4043 - DNA, 23 bp, Artificial Sequence
  Description of Artificial Sequence: Synthetic oligonucleotide
gagacgctgcagcgcactgacgc

SEQ ID NO: 4044 - DNA, 23 bp, Artificial Sequence
  Description of Artificial Sequence: Synthetic oligonucleotide
agacgctgcagcgcactgacgcc

SEQ ID NO: 4045 - DNA, 22 bp, Artificial Sequence
  Description of Artificial Sequence: Synthetic oligonucleotide
gacgctgcagcgcactgacgcc

SEQ ID NO: 4046 - DNA, 22 bp, Artificial Sequence
  Description of Artificial Sequence: Synthetic oligonucleotide
acgctgcagcgcactgacgccc

SEQ ID NO: 4047 - DNA, 21 bp, Artificial Sequence
  Description of Artificial Sequence: Synthetic oligonucleotide
cgctgcagcgcactgacgccc

SEQ ID NO: 4048 - DNA, 21 bp, Artificial Sequence
  Description of Artificial Sequence: Synthetic oligonucleotide
gctgcagcgcactgacgcccc

SEQ ID NO: 4049 - DNA, 25 bp, Artificial Sequence
  Description of Artificial Sequence: Synthetic oligonucleotide
ctgcagcgcactgacgcccccaaaa

SEQ ID NO: 4050 - DNA, 25 bp, Artificial Sequence
  Description of Artificial Sequence: Synthetic oligonucleotide
tgcagcgcactgacgcccccaaaac

SEQ ID NO: 4051 - DNA, 24 bp, Artificial Sequence
  Description of Artificial Sequence: Synthetic oligonucleotide
gcagcgcactgacgcccccaaaac

SEQ ID NO: 4052 - DNA, 24 bp, Artificial Sequence
  Description of Artificial Sequence: Synthetic oligonucleotide
cagcgcactgacgcccccaaaacg

SEQ ID NO: 4053 - DNA, 27 bp, Artificial Sequence
  Description of Artificial Sequence: Synthetic oligonucleotide
agcgcactgacgcccccaaaacgcata

SEQ ID NO: 4054 - DNA, 27 bp, Artificial Sequence
  Description of Artificial Sequence: Synthetic oligonucleotide
gcgcactgacgcccccaaaacgcatat

SEQ ID NO: 4055 - DNA, 27 bp, Artificial Sequence
  Description of Artificial Sequence: Synthetic oligonucleotide
cgcactgacgcccccaaaacgcatatg

SEQ ID NO: 4056 - DNA, 28 bp, Artificial Sequence
  Description of Artificial Sequence: Synthetic oligonucleotide
gcactgacgcccccaaaacgcatatgac

SEQ ID NO: 4057 - DNA, 29 bp, Artificial Sequence
  Description of Artificial Sequence: Synthetic oligonucleotide
cactgacgcccccaaaacgcatatgactc

SEQ ID NO: 4058 - DNA, 30 bp, Artificial Sequence
  Description of Artificial Sequence: Synthetic oligonucleotide
actgacgcccccaaaacgcatatgactcac

SEQ ID NO: 4059 - DNA, 29 bp, Artificial Sequence
  Description of Artificial Sequence: Synthetic oligonucleotide
ctgacgcccccaaaacgcatatgactcac

SEQ ID NO: 4060 - DNA, 29 bp, Artificial Sequence
  Description of Artificial Sequence: Synthetic oligonucleotide
tgacgcccccaaaacgcatatgactcacc

SEQ ID NO: 4061 - DNA, 23 bp, Artificial Sequence
  Description of Artificial Sequence: Synthetic oligonucleotide
gggagccccgcttcatcgcagtc

SEQ ID NO: 4062 - DNA, 23 bp, Artificial Sequence
  Description of Artificial Sequence: Synthetic oligonucleotide
ggagccccgcttcatcgcagtcg

SEQ ID NO: 4063 - DNA, 23 bp, Artificial Sequence
  Description of Artificial Sequence: Synthetic oligonucleotide
gagccccgcttcatcgcagtcgg

SEQ ID NO: 4064 - DNA, 25 bp, Artificial Sequence
  Description of Artificial Sequence: Synthetic oligonucleotide
agccccgcttcatcgcagtcggcta

SEQ ID NO: 4065 - DNA, 24 bp, Artificial Sequence
  Description of Artificial Sequence: Synthetic oligonucleotide
gccccgcttcatcgcagtcggcta

SEQ ID NO: 4066 - DNA, 24 bp, Artificial Sequence
  Description of Artificial Sequence: Synthetic oligonucleotide
ccccgcttcatcgcagtcggctac

SEQ ID NO: 4067 - DNA, 25 bp, Artificial Sequence
  Description of Artificial Sequence: Synthetic oligonucleotide
cccgcttcatcgcagtcggctacgt

SEQ ID NO: 4068 - DNA, 25 bp, Artificial Sequence
  Description of Artificial Sequence: Synthetic oligonucleotide
ccgcttcatcgcagtcggctacgtg

SEQ ID NO: 4069 - DNA, 26 bp, Artificial Sequence
  Description of Artificial Sequence: Synthetic oligonucleotide
cgcttcatcgcagtcggctacgtgga

SEQ ID NO: 4070 - DNA, 26 bp, Artificial Sequence
  Description of Artificial Sequence: Synthetic oligonucleotide
gcttcatcgcagtcggctacgtggac

SEQ ID NO: 4071 - DNA, 27 bp, Artificial Sequence
  Description of Artificial Sequence: Synthetic oligonucleotide
cttcatcgcagtcggctacgtggacga

SEQ ID NO: 4072 - DNA, 27 bp, Artificial Sequence
  Description of Artificial Sequence: Synthetic oligonucleotide
ttcatcgcagtcggctacgtggacgac

SEQ ID NO: 4073 - DNA, 27 bp, Artificial Sequence
  Description of Artificial Sequence: Synthetic oligonucleotide
tcatcgcagtcggctacgtggacgaca

SEQ ID NO: 4074 - DNA, 26 bp, Artificial Sequence
  Description of Artificial Sequence: Synthetic oligonucleotide
catcgcagtcggctacgtggacgaca

SEQ ID NO: 4075 - DNA, 26 bp, Artificial Sequence
  Description of Artificial Sequence: Synthetic oligonucleotide
atcgcagtcggctacgtggacgacac

SEQ ID NO: 4076 - DNA, 25 bp, Artificial Sequence
  Description of Artificial Sequence: Synthetic oligonucleotide
tcgcagtcggctacgtggacgacac

SEQ ID NO: 4077 - DNA, 24 bp, Artificial Sequence
  Description of Artificial Sequence: Synthetic oligonucleotide
cgcagtcggctacgtggacgacac

SEQ ID NO: 4078 - DNA, 24 bp, Artificial Sequence
  Description of Artificial Sequence: Synthetic oligonucleotide
gcagtcggctacgtggacgacacg

SEQ ID NO: 4079 - DNA, 25 bp, Artificial Sequence
  Description of Artificial Sequence: Synthetic oligonucleotide
cagtcggctacgtggacgacacgca

SEQ ID NO: 4080 - DNA, 27 bp, Artificial Sequence
  Description of Artificial Sequence: Synthetic oligonucleotide
agtcggctacgtggacgacacgcagtt

SEQ ID NO: 4081 - DNA, 26 bp, Artificial Sequence
  Description of Artificial Sequence: Synthetic oligonucleotide
gtcggctacgtggacgacacgcagtt

SEQ ID NO: 4082 - DNA, 26 bp, Artificial Sequence
  Description of Artificial Sequence: Synthetic oligonucleotide
tcggctacgtggacgacacgcagttc

SEQ ID NO: 4083 - DNA, 25 bp, Artificial Sequence
  Description of Artificial Sequence: Synthetic oligonucleotide
cggctacgtggacgacacgcagttc

SEQ ID NO: 4084 - DNA, 28 bp, Artificial Sequence
  Description of Artificial Sequence: Synthetic oligonucleotide
cacgctgtctctgaccatgaagccactc

SEQ ID NO: 4085 - DNA, 29 bp, Artificial Sequence
  Description of Artificial Sequence: Synthetic oligonucleotide
acgctgtctctgaccatgaagccactctg

SEQ ID NO: 4086 - DNA, 28 bp, Artificial Sequence
  Description of Artificial Sequence: Synthetic oligonucleotide
cgctgtctctgaccatgaagccactctg

SEQ ID NO: 4087 - DNA, 29 bp, Artificial Sequence
  Description of Artificial Sequence: Synthetic oligonucleotide
gctgtctctgaccatgaagccactctgag

SEQ ID NO: 4088 - DNA, 29 bp, Artificial Sequence
  Description of Artificial Sequence: Synthetic oligonucleotide
ctgtctctgaccatgaagccactctgagg

SEQ ID NO: 4089 - DNA, 30 bp, Artificial Sequence
  Description of Artificial Sequence: Synthetic oligonucleotide
tgtctctgaccatgaagccactctgaggtg

SEQ ID NO: 4090 - DNA, 29 bp, Artificial Sequence
  Description of Artificial Sequence: Synthetic oligonucleotide
gtctctgaccatgaagccactctgaggtg

SEQ ID NO: 4091 - DNA, 29 bp, Artificial Sequence
  Description of Artificial Sequence: Synthetic oligonucleotide
tctctgaccatgaagccactctgaggtgc

SEQ ID NO: 4092 - DNA, 28 bp, Artificial Sequence
  Description of Artificial Sequence: Synthetic oligonucleotide
ctctgaccatgaagccactctgaggtgc

SEQ ID NO: 4093 - DNA, 29 bp, Artificial Sequence
  Description of Artificial Sequence: Synthetic oligonucleotide
tctgaccatgaagccactctgaggtgctg

SEQ ID NO: 4094 - DNA, 28 bp, Artificial Sequence
  Description of Artificial Sequence: Synthetic oligonucleotide
ctgaccatgaagccactctgaggtgctg

SEQ ID NO: 4095 - DNA, 28 bp, Artificial Sequence
  Description of Artificial Sequence: Synthetic oligonucleotide
tgaccatgaagccactctgaggtgctgg

SEQ ID NO: 4096 - DNA, 27 bp, Artificial Sequence
  Description of Artificial Sequence: Synthetic oligonucleotide
gaccatgaagccactctgaggtgctgg

SEQ ID NO: 4097 - DNA, 27 bp, Artificial Sequence
  Description of Artificial Sequence: Synthetic oligonucleotide
accatgaagccactctgaggtgctggg

SEQ ID NO: 4098 - DNA, 26 bp, Artificial Sequence
  Description of Artificial Sequence: Synthetic oligonucleotide
ccatgaagccactctgaggtgctggg

SEQ ID NO: 4099 - DNA, 26 bp, Artificial Sequence
  Description of Artificial Sequence: Synthetic oligonucleotide
catgaagccactctgaggtgctgggc

SEQ ID NO: 4100 - DNA, 26 bp, Artificial Sequence
  Description of Artificial Sequence: Synthetic oligonucleotide
atgaagccactctgaggtgctgggcc

SEQ ID NO: 4101 - DNA, 25 bp, Artificial Sequence
  Description of Artificial Sequence: Synthetic oligonucleotide
tgaagccactctgaggtgctgggcc

SEQ ID NO: 4102 - DNA, 24 bp, Artificial Sequence
  Description of Artificial Sequence: Synthetic oligonucleotide
gaagccactctgaggtgctgggcc

SEQ ID NO: 4103 - DNA, 25 bp, Artificial Sequence
  Description of Artificial Sequence: Synthetic oligonucleotide
aagccactctgaggtgctgggccct

SEQ ID NO: 4104 - DNA, 24 bp, Artificial Sequence
  Description of Artificial Sequence: Synthetic oligonucleotide
agccactctgaggtgctgggccct

SEQ ID NO: 4105 - DNA, 23 bp, Artificial Sequence
  Description of Artificial Sequence: Synthetic oligonucleotide
gccactctgaggtgctgggccct

SEQ ID NO: 4106 - DNA, 24 bp, Artificial Sequence
  Description of Artificial Sequence: Synthetic oligonucleotide
ccactctgaggtgctgggccctga

SEQ ID NO: 4107 - DNA, 24 bp, Artificial Sequence
  Description of Artificial Sequence: Synthetic oligonucleotide
cactctgaggtgctgggccctgag

SEQ ID NO: 4108 - DNA, 26 bp, Artificial Sequence
  Description of Artificial Sequence: Synthetic oligonucleotide
actctgaggtgctgggccctgagctt

SEQ ID NO: 4109 - DNA, 25 bp, Artificial Sequence
  Description of Artificial Sequence: Synthetic oligonucleotide
ctctgaggtgctgggccctgagctt

SEQ ID NO: 4110 - DNA, 27 bp, Artificial Sequence
  Description of Artificial Sequence: Synthetic oligonucleotide
tctgaggtgctgggccctgagcttcta

SEQ ID NO: 4111 - DNA, 22 bp, Artificial Sequence
  Description of Artificial Sequence: Synthetic oligonucleotide
cggcccatgtggcggagcagct

SEQ ID NO: 4112 - DNA, 23 bp, Artificial Sequence
  Description of Artificial Sequence: Synthetic oligonucleotide
ggcccatgtggcggagcagctga

SEQ ID NO: 4113 - DNA, 24 bp, Artificial Sequence
  Description of Artificial Sequence: Synthetic oligonucleotide
gcccatgtggcggagcagctgaga

SEQ ID NO: 4114 - DNA, 24 bp, Artificial Sequence
  Description of Artificial Sequence: Synthetic oligonucleotide
cccatgtggcggagcagctgagag

SEQ ID NO: 4115 - DNA, 24 bp, Artificial Sequence
  Description of Artificial Sequence: Synthetic oligonucleotide
ccatgtggcggagcagctgagagc

SEQ ID NO: 4116 - DNA, 26 bp, Artificial Sequence
  Description of Artificial Sequence: Synthetic oligonucleotide
catgtggcggagcagctgagagccta

SEQ ID NO: 4117 - DNA, 26 bp, Artificial Sequence
  Description of Artificial Sequence: Synthetic oligonucleotide
atgtggcggagcagctgagagcctac

SEQ ID NO: 4118 - DNA, 25 bp, Artificial Sequence
  Description of Artificial Sequence: Synthetic oligonucleotide
tgtggcggagcagctgagagcctac

SEQ ID NO: 4119 - DNA, 24 bp, Artificial Sequence
  Description of Artificial Sequence: Synthetic oligonucleotide
gtggcggagcagctgagagcctac

SEQ ID NO: 4120 - DNA, 25 bp, Artificial Sequence
  Description of Artificial Sequence: Synthetic oligonucleotide
tggcggagcagctgagagcctacct

SEQ ID NO: 4121 - DNA, 24 bp, Artificial Sequence
  Description of Artificial Sequence: Synthetic oligonucleotide
ggcggagcagctgagagcctacct

SEQ ID NO: 4122 - DNA, 24 bp, Artificial Sequence
  Description of Artificial Sequence: Synthetic oligonucleotide
gcggagcagctgagagcctacctg

SEQ ID NO: 4123 - DNA, 25 bp, Artificial Sequence
  Description of Artificial Sequence: Synthetic oligonucleotide
cggagcagctgagagcctacctgga

SEQ ID NO: 4124 - DNA, 25 bp, Artificial Sequence
  Description of Artificial Sequence: Synthetic oligonucleotide
ggagcagctgagagcctacctggag

SEQ ID NO: 4125 - DNA, 25 bp, Artificial Sequence
  Description of Artificial Sequence: Synthetic oligonucleotide
gagcagctgagagcctacctggagg

SEQ ID NO: 4126 - DNA, 25 bp, Artificial Sequence
  Description of Artificial Sequence: Synthetic oligonucleotide
agcagctgagagcctacctggaggg

SEQ ID NO: 4127 - DNA, 24 bp, Artificial Sequence
  Description of Artificial Sequence: Synthetic oligonucleotide
gcagctgagagcctacctggaggg

SEQ ID NO: 4128 - DNA, 25 bp, Artificial Sequence
  Description of Artificial Sequence: Synthetic oligonucleotide
cagctgagagcctacctggagggca

SEQ ID NO: 4129 - DNA, 25 bp, Artificial Sequence
  Description of Artificial Sequence: Synthetic oligonucleotide
agctgagagcctacctggagggcac

SEQ ID NO: 4130 - DNA, 24 bp, Artificial Sequence
  Description of Artificial Sequence: Synthetic oligonucleotide
gctgagagcctacctggagggcac

SEQ ID NO: 4131 - DNA, 25 bp, Artificial Sequence
  Description of Artificial Sequence: Synthetic oligonucleotide
ctgagagcctacctggagggcacgt

SEQ ID NO: 4132 - DNA, 35 bp, Artificial Sequence
  Description of Artificial Sequence: Synthetic oligonucleotide
tcactccatgaggtatttcttcacatccgtgtctc

SEQ ID NO: 4133 - DNA, 34 bp, Artificial Sequence
  Description of Artificial Sequence: Synthetic oligonucleotide
cactccatgaggtatttcttcacatccgtgtctc

SEQ ID NO: 4134 - DNA, 34 bp, Artificial Sequence
  Description of Artificial Sequence: Synthetic oligonucleotide
actccatgaggtatttcttcacatccgtgtctcg

SEQ ID NO: 4135 - DNA, 33 bp, Artificial Sequence
  Description of Artificial Sequence: Synthetic oligonucleotide
ctccatgaggtatttcttcacatccgtgtctcg

SEQ ID NO: 4136 - DNA, 33 bp, Artificial Sequence
  Description of Artificial Sequence: Synthetic oligonucleotide
tccatgaggtatttcttcacatccgtgtctcgg

SEQ ID NO: 4137 - DNA, 32 bp, Artificial Sequence
  Description of Artificial Sequence: Synthetic oligonucleotide
ccatgaggtatttcttcacatccgtgtctcgg

SEQ ID NO: 4138 - DNA, 32 bp, Artificial Sequence
  Description of Artificial Sequence: Synthetic oligonucleotide
catgaggtatttcttcacatccgtgtctcggc

SEQ ID NO: 4139 - DNA, 32 bp, Artificial Sequence
  Description of Artificial Sequence: Synthetic oligonucleotide
atgaggtatttcttcacatccgtgtctcggcc

SEQ ID NO: 4140 - DNA, 31 bp, Artificial Sequence
  Description of Artificial Sequence: Synthetic oligonucleotide
tgaggtatttcttcacatccgtgtctcggcc

SEQ ID NO: 4141 - DNA, 30 bp, Artificial Sequence
  Description of Artificial Sequence: Synthetic oligonucleotide
gaggtatttcttcacatccgtgtctcggcc

SEQ ID NO: 4142 - DNA, 30 bp, Artificial Sequence
  Description of Artificial Sequence: Synthetic oligonucleotide
aggtatttcttcacatccgtgtctcggccc

SEQ ID NO: 4143 - DNA, 29 bp, Artificial Sequence
  Description of Artificial Sequence: Synthetic oligonucleotide
ggtatttcttcacatccgtgtctcggccc

SEQ ID NO: 4144 - DNA, 29 bp, Artificial Sequence
  Description of Artificial Sequence: Synthetic oligonucleotide
gtatttcttcacatccgtgtctcggcccg

SEQ ID NO: 4145 - DNA, 29 bp, Artificial Sequence
  Description of Artificial Sequence: Synthetic oligonucleotide
tatttcttcacatccgtgtctcggcccgg

SEQ ID NO: 4146 - DNA, 28 bp, Artificial Sequence
  Description of Artificial Sequence: Synthetic oligonucleotide
atttcttcacatccgtgtctcggcccgg

SEQ ID NO: 4147 - DNA, 27 bp, Artificial Sequence
  Description of Artificial Sequence: Synthetic oligonucleotide
tttcttcacatccgtgtctcggcccgg

SEQ ID NO: 4148 - DNA, 26 bp, Artificial Sequence
  Description of Artificial Sequence: Synthetic oligonucleotide
ttcttcacatccgtgtctcggcccgg

SEQ ID NO: 4149 - DNA, 25 bp, Artificial Sequence
  Description of Artificial Sequence: Synthetic oligonucleotide
tcttcacatccgtgtctcggcccgg

SEQ ID NO: 4150 - DNA, 24 bp, Artificial Sequence
  Description of Artificial Sequence: Synthetic oligonucleotide
cttcacatccgtgtctcggcccgg

SEQ ID NO: 4151 - DNA, 24 bp, Artificial Sequence
  Description of Artificial Sequence: Synthetic oligonucleotide
ttcacatccgtgtctcggcccggc

SEQ ID NO: 4152 - DNA, 23 bp, Artificial Sequence
  Description of Artificial Sequence: Synthetic oligonucleotide
tcacatccgtgtctcggcccggc

SEQ ID NO: 4153 - DNA, 22 bp, Artificial Sequence
  Description of Artificial Sequence: Synthetic oligonucleotide
cacatccgtgtctcggcccggc

SEQ ID NO: 4154 - DNA, 22 bp, Artificial Sequence
  Description of Artificial Sequence: Synthetic oligonucleotide
acatccgtgtctcggcccggcc

SEQ ID NO: 4155 - DNA, 21 bp, Artificial Sequence
  Description of Artificial Sequence: Synthetic oligonucleotide
catccgtgtctcggcccggcc

SEQ ID NO: 4156 - DNA, 21 bp, Artificial Sequence
  Description of Artificial Sequence: Synthetic oligonucleotide
atccgtgtctcggcccggccg

SEQ ID NO: 4157 - DNA, 20 bp, Artificial Sequence
  Description of Artificial Sequence: Synthetic oligonucleotide
tccgtgtctcggcccggccg

SEQ ID NO: 4158 - DNA, 20 bp, Artificial Sequence
  Description of Artificial Sequence: Synthetic oligonucleotide
ccgtgtctcggcccggccgt

SEQ ID NO: 4159 - DNA, 20 bp, Artificial Sequence
  Description of Artificial Sequence: Synthetic oligonucleotide
cgtgtctcggcccggccgct

SEQ ID NO: 4160 - DNA, 20 bp, Artificial Sequence
  Description of Artificial Sequence: Synthetic oligonucleotide
gtgtctcggcccggccgcgt

SEQ ID NO: 4161 - DNA, 20 bp, Artificial Sequence
  Description of Artificial Sequence: Synthetic oligonucleotide
tgtctcggcccggccgcggt

SEQ ID NO: 4162 - DNA, 20 bp, Artificial Sequence
  Description of Artificial Sequence: Synthetic oligonucleotide
gtctcggcccggccgcggtt

SEQ ID NO: 4163 - DNA, 20 bp, Artificial Sequence
  Description of Artificial Sequence: Synthetic oligonucleotide
tctcggcccggccgcgggtt

SEQ ID NO: 4164 - DNA, 20 bp, Artificial Sequence
  Description of Artificial Sequence: Synthetic oligonucleotide
ctcggcccggccgcgggttt

SEQ ID NO: 4165 - DNA, 20 bp, Artificial Sequence
  Description of Artificial Sequence: Synthetic oligonucleotide
tcggcccggccgcggggatt

SEQ ID NO: 4166 - DNA, 27 bp, Artificial Sequence
  Description of Artificial Sequence: Synthetic oligonucleotide
aggatgtatggctgcgacgtggggtca

SEQ ID NO: 4167 - DNA, 26 bp, Artificial Sequence
  Description of Artificial Sequence: Synthetic oligonucleotide
ggatgtatggctgcgacgtggggtca

SEQ ID NO: 4168 - DNA, 27 bp, Artificial Sequence
  Description of Artificial Sequence: Synthetic oligonucleotide
gatgtatggctgcgacgtggggtcaga

SEQ ID NO: 4169 - DNA, 27 bp, Artificial Sequence
  Description of Artificial Sequence: Synthetic oligonucleotide
atgtatggctgcgacgtggggtcagac

SEQ ID NO: 4170 - DNA, 27 bp, Artificial Sequence
  Description of Artificial Sequence: Synthetic oligonucleotide
tgtatggctgcgacgtggggtcagact

SEQ ID NO: 4171 - DNA, 26 bp, Artificial Sequence
  Description of Artificial Sequence: Synthetic oligonucleotide
gtatggctgcgacgtggggtcagact

SEQ ID NO: 4172 - DNA, 26 bp, Artificial Sequence
  Description of Artificial Sequence: Synthetic oligonucleotide
tatggctgcgacgtggggtcagactg

SEQ ID NO: 4173 - DNA, 25 bp, Artificial Sequence
  Description of Artificial Sequence: Synthetic oligonucleotide
atggctgcgacgtggggtcagactg

SEQ ID NO: 4174 - DNA, 24 bp, Artificial Sequence
  Description of Artificial Sequence: Synthetic oligonucleotide
tggctgcgacgtggggtcagactg

SEQ ID NO: 4175 - DNA, 23 bp, Artificial Sequence
  Description of Artificial Sequence: Synthetic oligonucleotide
ggctgcgacgtggggtcagactg

SEQ ID NO: 4176 - DNA, 23 bp, Artificial Sequence
  Description of Artificial Sequence: Synthetic oligonucleotide
gctgcgacgtggggtcagactgg

SEQ ID NO: 4177 - DNA, 23 bp, Artificial Sequence
  Description of Artificial Sequence: Synthetic oligonucleotide
ctgcgacgtggggtcagactggc

SEQ ID NO: 4178 - DNA, 23 bp, Artificial Sequence
  Description of Artificial Sequence: Synthetic oligonucleotide
tgcgacgtggggtcagactggcg

SEQ ID NO: 4179 - DNA, 22 bp, Artificial Sequence
  Description of Artificial Sequence: Synthetic oligonucleotide
gcgacgtggggtcagactggcg

SEQ ID NO: 4180 - DNA, 24 bp, Artificial Sequence
  Description of Artificial Sequence: Synthetic oligonucleotide
cgacgtggggtcagactggcgctt

SEQ ID NO: 4181 - DNA, 24 bp, Artificial Sequence
  Description of Artificial Sequence: Synthetic oligonucleotide
gacgtggggtcagactggcgcttc

SEQ ID NO: 4182 - DNA, 25 bp, Artificial Sequence
  Description of Artificial Sequence: Synthetic oligonucleotide
acgtggggtcagactggcgcttcct

SEQ ID NO: 4183 - DNA, 24 bp, Artificial Sequence
  Description of Artificial Sequence: Synthetic oligonucleotide
cgtggggtcagactggcgcttcct

SEQ ID NO: 4184 - DNA, 24 bp, Artificial Sequence
  Description of Artificial Sequence: Synthetic oligonucleotide
gtggggtcagactggcgcttcctc

SEQ ID NO: 4185 - DNA, 24 bp, Artificial Sequence
  Description of Artificial Sequence: Synthetic oligonucleotide
tggggtcagactggcgcttcctcc

SEQ ID NO: 4186 - DNA, 23 bp, Artificial Sequence
  Description of Artificial Sequence: Synthetic oligonucleotide
ggggtcagactggcgcttcctcc

SEQ ID NO: 4187 - DNA, 23 bp, Artificial Sequence
  Description of Artificial Sequence: Synthetic oligonucleotide
gggtcagactggcgcttcctccg

SEQ ID NO: 4188 - DNA, 23 bp, Artificial Sequence
  Description of Artificial Sequence: Synthetic oligonucleotide
ggtcagactggcgcttcctccgc

SEQ ID NO: 4189 - DNA, 23 bp, Artificial Sequence
  Description of Artificial Sequence: Synthetic oligonucleotide
gtcagactggcgcttcctccgcg

SEQ ID NO: 4190 - DNA, 23 bp, Artificial Sequence
  Description of Artificial Sequence: Synthetic oligonucleotide
tcagactggcgcttcctccgcgg

SEQ ID NO: 4191 - DNA, 22 bp, Artificial Sequence
  Description of Artificial Sequence: Synthetic oligonucleotide
cagactggcgcttcctccgcgg

SEQ ID NO: 4192 - DNA, 24 bp, Artificial Sequence
  Description of Artificial Sequence: Synthetic oligonucleotide
agactggcgcttcctccgcgggta

SEQ ID NO: 4193 - DNA, 25 bp, Artificial Sequence
  Description of Artificial Sequence: Synthetic oligonucleotide
gatgtatggctgcgacgtggggtcc

SEQ ID NO: 4194 - DNA, 26 bp, Artificial Sequence
  Description of Artificial Sequence: Synthetic oligonucleotide
atgtatggctgcgacgtggggtccga

SEQ ID NO: 4195 - DNA, 25 bp, Artificial Sequence
  Description of Artificial Sequence: Synthetic oligonucleotide
tgtatggctgcgacgtggggtccga

SEQ ID NO: 4196 - DNA, 24 bp, Artificial Sequence
  Description of Artificial Sequence: Synthetic oligonucleotide
gtatggctgcgacgtggggtccga

SEQ ID NO: 4197 - DNA, 25 bp, Artificial Sequence
  Description of Artificial Sequence: Synthetic oligonucleotide
tatggctgcgacgtggggtccgact

SEQ ID NO: 4198 - DNA, 24 bp, Artificial Sequence
  Description of Artificial Sequence: Synthetic oligonucleotide
atggctgcgacgtggggtccgact

SEQ ID NO: 4199 - DNA, 23 bp, Artificial Sequence
  Description of Artificial Sequence: Synthetic oligonucleotide
tggctgcgacgtggggtccgact

SEQ ID NO: 4200 - DNA, 22 bp, Artificial Sequence
  Description of Artificial Sequence: Synthetic oligonucleotide
ggctgcgacgtggggtccgact

SEQ ID NO: 4201 - DNA, 22 bp, Artificial Sequence
  Description of Artificial Sequence: Synthetic oligonucleotide
gctgcgacgtggggtccgactg

SEQ ID NO: 4202 - DNA, 22 bp, Artificial Sequence
  Description of Artificial Sequence: Synthetic oligonucleotide
ctgcgacgtggggtccgactgg

SEQ ID NO: 4203 - DNA, 22 bp, Artificial Sequence
  Description of Artificial Sequence: Synthetic oligonucleotide
tgcgacgtggggtccgactggc

SEQ ID NO: 4204 - DNA, 21 bp, Artificial Sequence
  Description of Artificial Sequence: Synthetic oligonucleotide
gcgacgtggggtccgactggc

SEQ ID NO: 4205 - DNA, 21 bp, Artificial Sequence
  Description of Artificial Sequence: Synthetic oligonucleotide
cgacgtggggtccgactggcg

SEQ ID NO: 4206 - DNA, 23 bp, Artificial Sequence
  Description of Artificial Sequence: Synthetic oligonucleotide
gacgtggggtccgactggcgctt

SEQ ID NO: 4207 - DNA, 23 bp, Artificial Sequence
  Description of Artificial Sequence: Synthetic oligonucleotide
acgtggggtccgactggcgcttc

SEQ ID NO: 4208 - DNA, 22 bp, Artificial Sequence
  Description of Artificial Sequence: Synthetic oligonucleotide
cgtggggtccgactggcgcttc

SEQ ID NO: 4209 - DNA, 23 bp, Artificial Sequence
  Description of Artificial Sequence: Synthetic oligonucleotide
gtggggtccgactggcgcttcct

SEQ ID NO: 4210 - DNA, 23 bp, Artificial Sequence
  Description of Artificial Sequence: Synthetic oligonucleotide
tggggtccgactggcgcttcctc

SEQ ID NO: 4211 - DNA, 22 bp, Artificial Sequence
  Description of Artificial Sequence: Synthetic oligonucleotide
ggggtccgactggcgcttcctc

SEQ ID NO: 4212 - DNA, 22 bp, Artificial Sequence
  Description of Artificial Sequence: Synthetic oligonucleotide
gggtccgactggcgcttcctcc

SEQ ID NO: 4213 - DNA, 22 bp, Artificial Sequence
  Description of Artificial Sequence: Synthetic oligonucleotide
ggtccgactggcgcttcctccg

SEQ ID NO: 4214 - DNA, 22 bp, Artificial Sequence
  Description of Artificial Sequence: Synthetic oligonucleotide
gtccgactggcgcttcctccgc

SEQ ID NO: 4215 - DNA, 22 bp, Artificial Sequence
  Description of Artificial Sequence: Synthetic oligonucleotide
tccgactggcgcttcctccgcg

SEQ ID NO: 4216 - DNA, 21 bp, Artificial Sequence
  Description of Artificial Sequence: Synthetic oligonucleotide
ccgactggcgcttcctccgcg

SEQ ID NO: 4217 - DNA, 21 bp, Artificial Sequence
  Description of Artificial Sequence: Synthetic oligonucleotide
cgactggcgcttcctccgcgg

SEQ ID NO: 4218 - DNA, 22 bp, Artificial Sequence
  Description of Artificial Sequence: Synthetic oligonucleotide
aggatggagccgcgggcgccat

SEQ ID NO: 4219 - DNA, 21 bp, Artificial Sequence
  Description of Artificial Sequence: Synthetic oligonucleotide
ggatggagccgcgggcgccat

SEQ ID NO: 4220 - DNA, 21 bp, Artificial Sequence
  Description of Artificial Sequence: Synthetic oligonucleotide
gatggagccgcgggcgccatg

SEQ ID NO: 4221 - DNA, 24 bp, Artificial Sequence
  Description of Artificial Sequence: Synthetic oligonucleotide
atggagccgcgggcgccatggata

SEQ ID NO: 4222 - DNA, 23 bp, Artificial Sequence
  Description of Artificial Sequence: Synthetic oligonucleotide
tggagccgcgggcgccatggata

SEQ ID NO: 4223 - DNA, 22 bp, Artificial Sequence
  Description of Artificial Sequence: Synthetic oligonucleotide
ggagccgcgggcgccatggata

SEQ ID NO: 4224 - DNA, 23 bp, Artificial Sequence
  Description of Artificial Sequence: Synthetic oligonucleotide
gagccgcgggcgccatggataga

SEQ ID NO: 4225 - DNA, 23 bp, Artificial Sequence
  Description of Artificial Sequence: Synthetic oligonucleotide
agccgcgggcgccatggatagag

SEQ ID NO: 4226 - DNA, 22 bp, Artificial Sequence
  Description of Artificial Sequence: Synthetic oligonucleotide
gccgcgggcgccatggatagag

SEQ ID NO: 4227 - DNA, 23 bp, Artificial Sequence
  Description of Artificial Sequence: Synthetic oligonucleotide
ccgcgggcgccatggatagagca

SEQ ID NO: 4228 - DNA, 23 bp, Artificial Sequence
  Description of Artificial Sequence: Synthetic oligonucleotide
cgcgggcgccatggatagagcag

SEQ ID NO: 4229 - DNA, 24 bp, Artificial Sequence
  Description of Artificial Sequence: Synthetic oligonucleotide
gcgggcgccatggatagagcagga

SEQ ID NO: 4230 - DNA, 24 bp, Artificial Sequence
  Description of Artificial Sequence: Synthetic oligonucleotide
cgggcgccatggatagagcaggag

SEQ ID NO: 4231 - DNA, 24 bp, Artificial Sequence
  Description of Artificial Sequence: Synthetic oligonucleotide
gggcgccatggatagagcaggagg

SEQ ID NO: 4232 - DNA, 25 bp, Artificial Sequence
  Description of Artificial Sequence: Synthetic oligonucleotide
ggcgccatggatagagcaggagggt

SEQ ID NO: 4233 - DNA, 25 bp, Artificial Sequence
  Description of Artificial Sequence: Synthetic oligonucleotide
gcgccatggatagagcaggagggtc

SEQ ID NO: 4234 - DNA, 25 bp, Artificial Sequence
  Description of Artificial Sequence: Synthetic oligonucleotide
cgccatggatagagcaggagggtcc

SEQ ID NO: 4235 - DNA, 25 bp, Artificial Sequence
  Description of Artificial Sequence: Synthetic oligonucleotide
gccatggatagagcaggagggtccg

SEQ ID NO: 4236 - DNA, 26 bp, Artificial Sequence
  Description of Artificial Sequence: Synthetic oligonucleotide
ccatggatagagcaggagggtccgga

SEQ ID NO: 4237 - DNA, 27 bp, Artificial Sequence
  Description of Artificial Sequence: Synthetic oligonucleotide
catggatagagcaggagggtccggagt

SEQ ID NO: 4238 - DNA, 30 bp, Artificial Sequence
  Description of Artificial Sequence: Synthetic oligonucleotide
atggatagagcaggagggtccggagtattg

SEQ ID NO: 4239 - DNA, 27 bp, Artificial Sequence
  Description of Artificial Sequence: Synthetic oligonucleotide
cagaccaccaagcacaagtgggaggca

SEQ ID NO: 4240 - DNA, 27 bp, Artificial Sequence
  Description of Artificial Sequence: Synthetic oligonucleotide
agaccaccaagcacaagtgggaggcag

SEQ ID NO: 4241 - DNA, 26 bp, Artificial Sequence
  Description of Artificial Sequence: Synthetic oligonucleotide
gaccaccaagcacaagtgggaggcag

SEQ ID NO: 4242 - DNA, 26 bp, Artificial Sequence
  Description of Artificial Sequence: Synthetic oligonucleotide
accaccaagcacaagtgggaggcagc

SEQ ID NO: 4243 - DNA, 25 bp, Artificial Sequence
  Description of Artificial Sequence: Synthetic oligonucleotide
ccaccaagcacaagtgggaggcagc

SEQ ID NO: 4244 - DNA, 25 bp, Artificial Sequence
  Description of Artificial Sequence: Synthetic oligonucleotide
caccaagcacaagtgggaggcagcc

SEQ ID NO: 4245 - DNA, 27 bp, Artificial Sequence
  Description of Artificial Sequence: Synthetic oligonucleotide
accaagcacaagtgggaggcagcccat

SEQ ID NO: 4246 - DNA, 26 bp, Artificial Sequence
  Description of Artificial Sequence: Synthetic oligonucleotide
ccaagcacaagtgggaggcagcccat

SEQ ID NO: 4247 - DNA, 27 bp, Artificial Sequence
  Description of Artificial Sequence: Synthetic oligonucleotide
caagcacaagtgggaggcagcccatgt

SEQ ID NO: 4248 - DNA, 27 bp, Artificial Sequence
  Description of Artificial Sequence: Synthetic oligonucleotide
aagcacaagtgggaggcagcccatgtg

SEQ ID NO: 4249 - DNA, 26 bp, Artificial Sequence
  Description of Artificial Sequence: Synthetic oligonucleotide
agcacaagtgggaggcagcccatgtg

SEQ ID NO: 4250 - DNA, 25 bp, Artificial Sequence
  Description of Artificial Sequence: Synthetic oligonucleotide
gcacaagtgggaggcagcccatgtg

SEQ ID NO: 4251 - DNA, 25 bp, Artificial Sequence
  Description of Artificial Sequence: Synthetic oligonucleotide
cacaagtgggaggcagcccatgtgg

SEQ ID NO: 4252 - DNA, 25 bp, Artificial Sequence
  Description of Artificial Sequence: Synthetic oligonucleotide
acaagtgggaggcagcccatgtggc

SEQ ID NO: 4253 - DNA, 24 bp, Artificial Sequence
  Description of Artificial Sequence: Synthetic oligonucleotide
caagtgggaggcagcccatgtggc

SEQ ID NO: 4254 - DNA, 24 bp, Artificial Sequence
  Description of Artificial Sequence: Synthetic oligonucleotide
aagtgggaggcagcccatgtggcg

SEQ ID NO: 4255 - DNA, 23 bp, Artificial Sequence
  Description of Artificial Sequence: Synthetic oligonucleotide
agtgggaggcagcccatgtggcg

SEQ ID NO: 4256 - DNA, 22 bp, Artificial Sequence
  Description of Artificial Sequence: Synthetic oligonucleotide
gtgggaggcagcccatgtggcg

SEQ ID NO: 4257 - DNA, 23 bp, Artificial Sequence
  Description of Artificial Sequence: Synthetic oligonucleotide
tgggaggcagcccatgtggcgga

SEQ ID NO: 4258 - DNA, 22 bp, Artificial Sequence
  Description of Artificial Sequence: Synthetic oligonucleotide
gggaggcagcccatgtggcgga

SEQ ID NO: 4259 - DNA, 22 bp, Artificial Sequence
  Description of Artificial Sequence: Synthetic oligonucleotide
ggaggcagcccatgtggcggag

SEQ ID NO: 4260 - DNA, 23 bp, Artificial Sequence
  Description of Artificial Sequence: Synthetic oligonucleotide
gaggcagcccatgtggcggagca

SEQ ID NO: 4261 - DNA, 25 bp, Artificial Sequence
  Description of Artificial Sequence: Synthetic oligonucleotide
aggcagcccatgtggcggagcagtt

SEQ ID NO: 4262 - DNA, 24 bp, Artificial Sequence
  Description of Artificial Sequence: Synthetic oligonucleotide
ggcagcccatgtggcggagcagtt

SEQ ID NO: 4263 - DNA, 25 bp, Artificial Sequence
  Description of Artificial Sequence: Synthetic oligonucleotide
gcagcccatgtggcggagcagttga

SEQ ID NO: 4264 - DNA, 26 bp, Artificial Sequence
  Description of Artificial Sequence: Synthetic oligonucleotide
cagcccatgtggcggagcagttgaga

SEQ ID NO: 4265 - DNA, 26 bp, Artificial Sequence
  Description of Artificial Sequence: Synthetic oligonucleotide
agcccatgtggcggagcagttgagag

SEQ ID NO: 4266 - DNA, 28 bp, Artificial Sequence
  Description of Artificial Sequence: Synthetic oligonucleotide
cagatacctggagaacgggaaggagacc

SEQ ID NO: 4267 - DNA, 28 bp, Artificial Sequence
  Description of Artificial Sequence: Synthetic oligonucleotide
agatacctggagaacgggaaggagaccc

SEQ ID NO: 4268 - DNA, 27 bp, Artificial Sequence
  Description of Artificial Sequence: Synthetic oligonucleotide
gatacctggagaacgggaaggagaccc

SEQ ID NO: 4269 - DNA, 28 bp, Artificial Sequence
  Description of Artificial Sequence: Synthetic oligonucleotide
atacctggagaacgggaaggagaccctg

SEQ ID NO: 4270 - DNA, 27 bp, Artificial Sequence
  Description of Artificial Sequence: Synthetic oligonucleotide
tacctggagaacgggaaggagaccctg

SEQ ID NO: 4271 - DNA, 26 bp, Artificial Sequence
  Description of Artificial Sequence: Synthetic oligonucleotide
acctggagaacgggaaggagaccctg

SEQ ID NO: 4272 - DNA, 25 bp, Artificial Sequence
  Description of Artificial Sequence: Synthetic oligonucleotide
cctggagaacgggaaggagaccctg

SEQ ID NO: 4273 - DNA, 26 bp, Artificial Sequence
  Description of Artificial Sequence: Synthetic oligonucleotide
ctggagaacgggaaggagaccctgca

SEQ ID NO: 4274 - DNA, 26 bp, Artificial Sequence
  Description of Artificial Sequence: Synthetic oligonucleotide
tggagaacgggaaggagaccctgcag

SEQ ID NO: 4275 - DNA, 25 bp, Artificial Sequence
  Description of Artificial Sequence: Synthetic oligonucleotide
ggagaacgggaaggagaccctgcag

SEQ ID NO: 4276 - DNA, 25 bp, Artificial Sequence
  Description of Artificial Sequence: Synthetic oligonucleotide
gagaacgggaaggagaccctgcagc

SEQ ID NO: 4277 - DNA, 25 bp, Artificial Sequence
  Description of Artificial Sequence: Synthetic oligonucleotide
agaacgggaaggagaccctgcagcg

SEQ ID NO: 4278 - DNA, 24 bp, Artificial Sequence
  Description of Artificial Sequence: Synthetic oligonucleotide
gaacgggaaggagaccctgcagcg

SEQ ID NO: 4279 - DNA, 25 bp, Artificial Sequence
  Description of Artificial Sequence: Synthetic oligonucleotide
aacgggaaggagaccctgcagcgca

SEQ ID NO: 4280 - DNA, 24 bp, Artificial Sequence
  Description of Artificial Sequence: Synthetic oligonucleotide
acgggaaggagaccctgcagcgca

SEQ ID NO: 4281 - DNA, 23 bp, Artificial Sequence
  Description of Artificial Sequence: Synthetic oligonucleotide
cgggaaggagaccctgcagcgca

SEQ ID NO: 4282 - DNA, 23 bp, Artificial Sequence
  Description of Artificial Sequence: Synthetic oligonucleotide
gggaaggagaccctgcagcgcac

SEQ ID NO: 4283 - DNA, 23 bp, Artificial Sequence
  Description of Artificial Sequence: Synthetic oligonucleotide
ggaaggagaccctgcagcgcacg

SEQ ID NO: 4284 - DNA, 23 bp, Artificial Sequence
  Description of Artificial Sequence: Synthetic oligonucleotide
gaaggagaccctgcagcgcacgg

SEQ ID NO: 4285 - DNA, 29 bp, Artificial Sequence
  Description of Artificial Sequence: Synthetic oligonucleotide
gtatttcttcacatccgtgtcccggcctg

SEQ ID NO: 4286 - DNA, 29 bp, Artificial Sequence
  Description of Artificial Sequence: Synthetic oligonucleotide
tatttcttcacatccgtgtcccggcctgg

SEQ ID NO: 4287 - DNA, 28 bp, Artificial Sequence
  Description of Artificial Sequence: Synthetic oligonucleotide
atttcttcacatccgtgtcccggcctgg

SEQ ID NO: 4288 - DNA, 27 bp, Artificial Sequence
  Description of Artificial Sequence: Synthetic oligonucleotide
tttcttcacatccgtgtcccggcctgg

SEQ ID NO: 4289 - DNA, 26 bp, Artificial Sequence
  Description of Artificial Sequence: Synthetic oligonucleotide
ttcttcacatccgtgtcccggcctgg

SEQ ID NO: 4290 - DNA, 25 bp, Artificial Sequence
  Description of Artificial Sequence: Synthetic oligonucleotide
tcttcacatccgtgtcccggcctgg

SEQ ID NO: 4291 - DNA, 24 bp, Artificial Sequence
  Description of Artificial Sequence: Synthetic oligonucleotide
cttcacatccgtgtcccggcctgg

SEQ ID NO: 4292 - DNA, 24 bp, Artificial Sequence
  Description of Artificial Sequence: Synthetic oligonucleotide
ttcacatccgtgtcccggcctggc

SEQ ID NO: 4293 - DNA, 23 bp, Artificial Sequence
  Description of Artificial Sequence: Synthetic oligonucleotide
tcacatccgtgtcccggcctggc

SEQ ID NO: 4294 - DNA, 22 bp, Artificial Sequence
  Description of Artificial Sequence: Synthetic oligonucleotide
cacatccgtgtcccggcctggc

SEQ ID NO: 4295 - DNA, 22 bp, Artificial Sequence
  Description of Artificial Sequence: Synthetic oligonucleotide
acatccgtgtcccggcctggcc

SEQ ID NO: 4296 - DNA, 21 bp, Artificial Sequence
  Description of Artificial Sequence: Synthetic oligonucleotide
catccgtgtcccggcctggcc

SEQ ID NO: 4297 - DNA, 21 bp, Artificial Sequence
  Description of Artificial Sequence: Synthetic oligonucleotide
atccgtgtcccggcctggccg

SEQ ID NO: 4298 - DNA, 20 bp, Artificial Sequence
  Description of Artificial Sequence: Synthetic oligonucleotide
tccgtgtcccggcctggccg

SEQ ID NO: 4299 - DNA, 20 bp, Artificial Sequence
  Description of Artificial Sequence: Synthetic oligonucleotide
ccgtgtcccggcctggccgt

SEQ ID NO: 4300 - DNA, 20 bp, Artificial Sequence
  Description of Artificial Sequence: Synthetic oligonucleotide
cgtgtcccggcctggccgct

SEQ ID NO: 4301 - DNA, 20 bp, Artificial Sequence
  Description of Artificial Sequence: Synthetic oligonucleotide
gtgtcccggcctggccgcgt

SEQ ID NO: 4302 - DNA, 20 bp, Artificial Sequence
  Description of Artificial Sequence: Synthetic oligonucleotide
tgtcccggcctggccgcggt

SEQ ID NO: 4303 - DNA, 20 bp, Artificial Sequence
  Description of Artificial Sequence: Synthetic oligonucleotide
gtcccggcctggccgcggtt

SEQ ID NO: 4304 - DNA, 20 bp, Artificial Sequence
  Description of Artificial Sequence: Synthetic oligonucleotide
tcccggcctggccgcgggtt

SEQ ID NO: 4305 - DNA, 20 bp, Artificial Sequence
  Description of Artificial Sequence: Synthetic oligonucleotide
cccggcctggccgcgggttt

SEQ ID NO: 4306 - DNA, 20 bp, Artificial Sequence
  Description of Artificial Sequence: Synthetic oligonucleotide
ccggcctggccgcggggatt

SEQ ID NO: 4307 - DNA, 20 bp, Artificial Sequence
  Description of Artificial Sequence: Synthetic oligonucleotide
cggcctggccgcggggagtt

SEQ ID NO: 4308 - DNA, 20 bp, Artificial Sequence
  Description of Artificial Sequence: Synthetic oligonucleotide
ggcctggccgcggggagctt

SEQ ID NO: 4309 - DNA, 20 bp, Artificial Sequence
  Description of Artificial Sequence: Synthetic oligonucleotide
gcctggccgcggggagcctt

SEQ ID NO: 4310 - DNA, 20 bp, Artificial Sequence
  Description of Artificial Sequence: Synthetic oligonucleotide
cctggccgcggggagccctt

SEQ ID NO: 4311 - DNA, 20 bp, Artificial Sequence
  Description of Artificial Sequence: Synthetic oligonucleotide
ctggccgcggggagcccctt

SEQ ID NO: 4312 - DNA, 20 bp, Artificial Sequence
  Description of Artificial Sequence: Synthetic oligonucleotide
tggccgcggggagccccgtt

SEQ ID NO: 4313 - DNA, 23 bp, Artificial Sequence
  Description of Artificial Sequence: Synthetic oligonucleotide
gactggcgcttcctccgcggcta

SEQ ID NO: 4314 - DNA, 23 bp, Artificial Sequence
  Description of Artificial Sequence: Synthetic oligonucleotide
actggcgcttcctccgcggctac

SEQ ID NO: 4315 - DNA, 22 bp, Artificial Sequence
  Description of Artificial Sequence: Synthetic oligonucleotide
ctggcgcttcctccgcggctac

SEQ ID NO: 4316 - DNA, 23 bp, Artificial Sequence
  Description of Artificial Sequence: Synthetic oligonucleotide
tggcgcttcctccgcggctacca

SEQ ID NO: 4317 - DNA, 22 bp, Artificial Sequence
  Description of Artificial Sequence: Synthetic oligonucleotide
ggcgcttcctccgcggctacca

SEQ ID NO: 4318 - DNA, 22 bp, Artificial Sequence
  Description of Artificial Sequence: Synthetic oligonucleotide
gcgcttcctccgcggctaccac

SEQ ID NO: 4319 - DNA, 23 bp, Artificial Sequence
  Description of Artificial Sequence: Synthetic oligonucleotide
cgcttcctccgcggctaccacca

SEQ ID NO: 4320 - DNA, 25 bp, Artificial Sequence
  Description of Artificial Sequence: Synthetic oligonucleotide
gcttcctccgcggctaccaccagta

SEQ ID NO: 4321 - DNA, 25 bp, Artificial Sequence
  Description of Artificial Sequence: Synthetic oligonucleotide
cttcctccgcggctaccaccagtac

SEQ ID NO: 4322 - DNA, 25 bp, Artificial Sequence
  Description of Artificial Sequence: Synthetic oligonucleotide
ttcctccgcggctaccaccagtacg

SEQ ID NO: 4323 - DNA, 24 bp, Artificial Sequence
  Description of Artificial Sequence: Synthetic oligonucleotide
tcctccgcggctaccaccagtacg

SEQ ID NO: 4324 - DNA, 23 bp, Artificial Sequence
  Description of Artificial Sequence: Synthetic oligonucleotide
cctccgcggctaccaccagtacg

SEQ ID NO: 4325 - DNA, 23 bp, Artificial Sequence
  Description of Artificial Sequence: Synthetic oligonucleotide
ctccgcggctaccaccagtacgc

SEQ ID NO: 4326 - DNA, 25 bp, Artificial Sequence
  Description of Artificial Sequence: Synthetic oligonucleotide
tccgcggctaccaccagtacgccta

SEQ ID NO: 4327 - DNA, 24 bp, Artificial Sequence
  Description of Artificial Sequence: Synthetic oligonucleotide
ccgcggctaccaccagtacgccta

SEQ ID NO: 4328 - DNA, 24 bp, Artificial Sequence
  Description of Artificial Sequence: Synthetic oligonucleotide
cgcggctaccaccagtacgcctac

SEQ ID NO: 4329 - DNA, 25 bp, Artificial Sequence
  Description of Artificial Sequence: Synthetic oligonucleotide
gcggctaccaccagtacgcctacga

SEQ ID NO: 4330 - DNA, 25 bp, Artificial Sequence
  Description of Artificial Sequence: Synthetic oligonucleotide
cggctaccaccagtacgcctacgac

SEQ ID NO: 4331 - DNA, 25 bp, Artificial Sequence
  Description of Artificial Sequence: Synthetic oligonucleotide
ggctaccaccagtacgcctacgacg

SEQ ID NO: 4332 - DNA, 25 bp, Artificial Sequence
  Description of Artificial Sequence: Synthetic oligonucleotide
gctaccaccagtacgcctacgacgg

SEQ ID NO: 4333 - DNA, 27 bp, Artificial Sequence
  Description of Artificial Sequence: Synthetic oligonucleotide
ctaccaccagtacgcctacgacggcaa

SEQ ID NO: 4334 - DNA, 27 bp, Artificial Sequence
  Description of Artificial Sequence: Synthetic oligonucleotide
gagtattgggacggggagacacggaag

SEQ ID NO: 4335 - DNA, 27 bp, Artificial Sequence
  Description of Artificial Sequence: Synthetic oligonucleotide
agtattgggacggggagacacggaagg

SEQ ID NO: 4336 - DNA, 27 bp, Artificial Sequence
  Description of Artificial Sequence: Synthetic oligonucleotide
gtattgggacggggagacacggaaggt

SEQ ID NO: 4337 - DNA, 27 bp, Artificial Sequence
  Description of Artificial Sequence: Synthetic oligonucleotide
tattgggacggggagacacggaaggtg

SEQ ID NO: 4338 - DNA, 27 bp, Artificial Sequence
  Description of Artificial Sequence: Synthetic oligonucleotide
attgggacggggagacacggaaggtga

SEQ ID NO: 4339 - DNA, 27 bp, Artificial Sequence
  Description of Artificial Sequence: Synthetic oligonucleotide
ttgggacggggagacacggaaggtgaa

SEQ ID NO: 4340 - DNA, 26 bp, Artificial Sequence
  Description of Artificial Sequence: Synthetic oligonucleotide
tgggacggggagacacggaaggtgaa

SEQ ID NO: 4341 - DNA, 25 bp, Artificial Sequence
  Description of Artificial Sequence: Synthetic oligonucleotide
gggacggggagacacggaaggtgaa

SEQ ID NO: 4342 - DNA, 25 bp, Artificial Sequence
  Description of Artificial Sequence: Synthetic oligonucleotide
ggacggggagacacggaaggtgaag

SEQ ID NO: 4343 - DNA, 25 bp, Artificial Sequence
  Description of Artificial Sequence: Synthetic oligonucleotide
gacggggagacacggaaggtgaagg

SEQ ID NO: 4344 - DNA, 25 bp, Artificial Sequence
  Description of Artificial Sequence: Synthetic oligonucleotide
acggggagacacggaaggtgaaggc

SEQ ID NO: 4345 - DNA, 24 bp, Artificial Sequence
  Description of Artificial Sequence: Synthetic oligonucleotide
cggggagacacggaaggtgaaggc

SEQ ID NO: 4346 - DNA, 24 bp, Artificial Sequence
  Description of Artificial Sequence: Synthetic oligonucleotide
ggggagacacggaaggtgaaggcc

SEQ ID NO: 4347 - DNA, 25 bp, Artificial Sequence
  Description of Artificial Sequence: Synthetic oligonucleotide
gggagacacggaaggtgaaggccca

SEQ ID NO: 4348 - DNA, 26 bp, Artificial Sequence
  Description of Artificial Sequence: Synthetic oligonucleotide
ggagacacggaaggtgaaggcccact

SEQ ID NO: 4349 - DNA, 27 bp, Artificial Sequence
  Description of Artificial Sequence: Synthetic oligonucleotide
gagacacggaaggtgaaggcccactca

SEQ ID NO: 4350 - DNA, 27 bp, Artificial Sequence
  Description of Artificial Sequence: Synthetic oligonucleotide
agacacggaaggtgaaggcccactcac

SEQ ID NO: 4351 - DNA, 27 bp, Artificial Sequence
  Description of Artificial Sequence: Synthetic oligonucleotide
gacacggaaggtgaaggcccactcaca

SEQ ID NO: 4352 - DNA, 27 bp, Artificial Sequence
  Description of Artificial Sequence: Synthetic oligonucleotide
acacggaaggtgaaggcccactcacag

SEQ ID NO: 4353 - DNA, 27 bp, Artificial Sequence
  Description of Artificial Sequence: Synthetic oligonucleotide
cacggaaggtgaaggcccactcacaga

SEQ ID NO: 4354 - DNA, 27 bp, Artificial Sequence
  Description of Artificial Sequence: Synthetic oligonucleotide
acggaaggtgaaggcccactcacagac

SEQ ID NO: 4355 - DNA, 27 bp, Artificial Sequence
  Description of Artificial Sequence: Synthetic oligonucleotide
cggaaggtgaaggcccactcacagact

SEQ ID NO: 4356 - DNA, 27 bp, Artificial Sequence
  Description of Artificial Sequence: Synthetic oligonucleotide
ggaaggtgaaggcccactcacagactc

SEQ ID NO: 4357 - DNA, 28 bp, Artificial Sequence
  Description of Artificial Sequence: Synthetic oligonucleotide
gaaggtgaaggcccactcacagactcac

SEQ ID NO: 4358 - DNA, 28 bp, Artificial Sequence
  Description of Artificial Sequence: Synthetic oligonucleotide
aaggtgaaggcccactcacagactcacc

SEQ ID NO: 4359 - DNA, 27 bp, Artificial Sequence
  Description of Artificial Sequence: Synthetic oligonucleotide
aggtgaaggcccactcacagactcacc

SEQ ID NO: 4360 - DNA, 26 bp, Artificial Sequence
  Description of Artificial Sequence: Synthetic oligonucleotide
ggtgaaggcccactcacagactcacc

SEQ ID NO: 4361 - DNA, 26 bp, Artificial Sequence
  Description of Artificial Sequence: Synthetic oligonucleotide
agaccaccaagcacaagtgggaggcc

SEQ ID NO: 4362 - DNA, 25 bp, Artificial Sequence
  Description of Artificial Sequence: Synthetic oligonucleotide
gaccaccaagcacaagtgggaggcc

SEQ ID NO: 4363 - DNA, 25 bp, Artificial Sequence
  Description of Artificial Sequence: Synthetic oligonucleotide
accaccaagcacaagtgggaggccg

SEQ ID NO: 4364 - DNA, 24 bp, Artificial Sequence
  Description of Artificial Sequence: Synthetic oligonucleotide
ccaccaagcacaagtgggaggccg

SEQ ID NO: 4365 - DNA, 24 bp, Artificial Sequence
  Description of Artificial Sequence: Synthetic oligonucleotide
caccaagcacaagtgggaggccgc

SEQ ID NO: 4366 - DNA, 24 bp, Artificial Sequence
  Description of Artificial Sequence: Synthetic oligonucleotide
accaagcacaagtgggaggccgcc

SEQ ID NO: 4367 - DNA, 23 bp, Artificial Sequence
  Description of Artificial Sequence: Synthetic oligonucleotide
ccaagcacaagtgggaggccgcc

SEQ ID NO: 4368 - DNA, 25 bp, Artificial Sequence
  Description of Artificial Sequence: Synthetic oligonucleotide
caagcacaagtgggaggccgcccat

SEQ ID NO: 4369 - DNA, 26 bp, Artificial Sequence
  Description of Artificial Sequence: Synthetic oligonucleotide
aagcacaagtgggaggccgcccatgt

SEQ ID NO: 4370 - DNA, 25 bp, Artificial Sequence
  Description of Artificial Sequence: Synthetic oligonucleotide
agcacaagtgggaggccgcccatgt

SEQ ID NO: 4371 - DNA, 24 bp, Artificial Sequence
  Description of Artificial Sequence: Synthetic oligonucleotide
gcacaagtgggaggccgcccatgt

SEQ ID NO: 4372 - DNA, 24 bp, Artificial Sequence
  Description of Artificial Sequence: Synthetic oligonucleotide
cacaagtgggaggccgcccatgtg

SEQ ID NO: 4373 - DNA, 24 bp, Artificial Sequence
  Description of Artificial Sequence: Synthetic oligonucleotide
acaagtgggaggccgcccatgtgg

SEQ ID NO: 4374 - DNA, 23 bp, Artificial Sequence
  Description of Artificial Sequence: Synthetic oligonucleotide
caagtgggaggccgcccatgtgg

SEQ ID NO: 4375 - DNA, 23 bp, Artificial Sequence
  Description of Artificial Sequence: Synthetic oligonucleotide
aagtgggaggccgcccatgtggc

SEQ ID NO: 4376 - DNA, 22 bp, Artificial Sequence
  Description of Artificial Sequence: Synthetic oligonucleotide
agtgggaggccgcccatgtggc

SEQ ID NO: 4377 - DNA, 21 bp, Artificial Sequence
  Description of Artificial Sequence: Synthetic oligonucleotide
gtgggaggccgcccatgtggc

SEQ ID NO: 4378 - DNA, 21 bp, Artificial Sequence
  Description of Artificial Sequence: Synthetic oligonucleotide
tgggaggccgcccatgtggcg

SEQ ID NO: 4379 - DNA, 20 bp, Artificial Sequence
  Description of Artificial Sequence: Synthetic oligonucleotide
gggaggccgcccatgtggcg

SEQ ID NO: 4380 - DNA, 21 bp, Artificial Sequence
  Description of Artificial Sequence: Synthetic oligonucleotide
ggaggccgcccatgtggcgga

SEQ ID NO: 4381 - DNA, 21 bp, Artificial Sequence
  Description of Artificial Sequence: Synthetic oligonucleotide
gaggccgcccatgtggcggag

SEQ ID NO: 4382 - DNA, 22 bp, Artificial Sequence
  Description of Artificial Sequence: Synthetic oligonucleotide
aggccgcccatgtggcggagca

SEQ ID NO: 4383 - DNA, 21 bp, Artificial Sequence
  Description of Artificial Sequence: Synthetic oligonucleotide
ggccgcccatgtggcggagca

SEQ ID NO: 4384 - DNA, 23 bp, Artificial Sequence
  Description of Artificial Sequence: Synthetic oligonucleotide
gccgcccatgtggcggagcagtt

SEQ ID NO: 4385 - DNA, 24 bp, Artificial Sequence
  Description of Artificial Sequence: Synthetic oligonucleotide
ccgcccatgtggcggagcagttga

SEQ ID NO: 4386 - DNA, 25 bp, Artificial Sequence
  Description of Artificial Sequence: Synthetic oligonucleotide
cgcccatgtggcggagcagttgaga

SEQ ID NO: 4387 - DNA, 22 bp, Artificial Sequence
  Description of Artificial Sequence: Synthetic oligonucleotide
ccgcggggagccccgcttcatt

SEQ ID NO: 4388 - DNA, 22 bp, Artificial Sequence
  Description of Artificial Sequence: Synthetic oligonucleotide
cgcggggagccccgcttcattg

SEQ ID NO: 4389 - DNA, 23 bp, Artificial Sequence
  Description of Artificial Sequence: Synthetic oligonucleotide
gcggggagccccgcttcattgca

SEQ ID NO: 4390 - DNA, 24 bp, Artificial Sequence
  Description of Artificial Sequence: Synthetic oligonucleotide
cggggagccccgcttcattgcagt

SEQ ID NO: 4391 - DNA, 24 bp, Artificial Sequence
  Description of Artificial Sequence: Synthetic oligonucleotide
ggggagccccgcttcattgcagtg

SEQ ID NO: 4392 - DNA, 24 bp, Artificial Sequence
  Description of Artificial Sequence: Synthetic oligonucleotide
gggagccccgcttcattgcagtgg

SEQ ID NO: 4393 - DNA, 24 bp, Artificial Sequence
  Description of Artificial Sequence: Synthetic oligonucleotide
ggagccccgcttcattgcagtggg

SEQ ID NO: 4394 - DNA, 26 bp, Artificial Sequence
  Description of Artificial Sequence: Synthetic oligonucleotide
gagccccgcttcattgcagtgggcta

SEQ ID NO: 4395 - DNA, 26 bp, Artificial Sequence
  Description of Artificial Sequence: Synthetic oligonucleotide
agccccgcttcattgcagtgggctac

SEQ ID NO: 4396 - DNA, 25 bp, Artificial Sequence
  Description of Artificial Sequence: Synthetic oligonucleotide
gccccgcttcattgcagtgggctac

SEQ ID NO: 4397 - DNA, 26 bp, Artificial Sequence
  Description of Artificial Sequence: Synthetic oligonucleotide
ccccgcttcattgcagtgggctacgt

SEQ ID NO: 4398 - DNA, 26 bp, Artificial Sequence
  Description of Artificial Sequence: Synthetic oligonucleotide
cccgcttcattgcagtgggctacgtg

SEQ ID NO: 4399 - DNA, 27 bp, Artificial Sequence
  Description of Artificial Sequence: Synthetic oligonucleotide
ccgcttcattgcagtgggctacgtgga

SEQ ID NO: 4400 - DNA, 27 bp, Artificial Sequence
  Description of Artificial Sequence: Synthetic oligonucleotide
cgcttcattgcagtgggctacgtggac

SEQ ID NO: 4401 - DNA, 27 bp, Artificial Sequence
  Description of Artificial Sequence: Synthetic oligonucleotide
gcttcattgcagtgggctacgtggacg

SEQ ID NO: 4402 - DNA, 28 bp, Artificial Sequence
  Description of Artificial Sequence: Synthetic oligonucleotide
cttcattgcagtgggctacgtggacgac

SEQ ID NO: 4403 - DNA, 29 bp, Artificial Sequence
  Description of Artificial Sequence: Synthetic oligonucleotide
ttcattgcagtgggctacgtggacgacac

SEQ ID NO: 4404 - DNA, 28 bp, Artificial Sequence
  Description of Artificial Sequence: Synthetic oligonucleotide
tcattgcagtgggctacgtggacgacac

SEQ ID NO: 4405 - DNA, 27 bp, Artificial Sequence
  Description of Artificial Sequence: Synthetic oligonucleotide
cattgcagtgggctacgtggacgacac

SEQ ID NO: 4406 - DNA, 27 bp, Artificial Sequence
  Description of Artificial Sequence: Synthetic oligonucleotide
attgcagtgggctacgtggacgacacg

SEQ ID NO: 4407 - DNA, 26 bp, Artificial Sequence
  Description of Artificial Sequence: Synthetic oligonucleotide
ttgcagtgggctacgtggacgacacg

SEQ ID NO: 4408 - DNA, 25 bp, Artificial Sequence
  Description of Artificial Sequence: Synthetic oligonucleotide
tgcagtgggctacgtggacgacacg

SEQ ID NO: 4409 - DNA, 23 bp, Artificial Sequence
  Description of Artificial Sequence: Synthetic oligonucleotide
ggtcggactggcgcttcctccgt

SEQ ID NO: 4410 - DNA, 23 bp, Artificial Sequence
  Description of Artificial Sequence: Synthetic oligonucleotide
gtcggactggcgcttcctccgtg

SEQ ID NO: 4411 - DNA, 23 bp, Artificial Sequence
  Description of Artificial Sequence: Synthetic oligonucleotide
tcggactggcgcttcctccgtgg

SEQ ID NO: 4412 - DNA, 22 bp, Artificial Sequence
  Description of Artificial Sequence: Synthetic oligonucleotide
cggactggcgcttcctccgtgg

SEQ ID NO: 4413 - DNA, 24 bp, Artificial Sequence
  Description of Artificial Sequence: Synthetic oligonucleotide
ggactggcgcttcctccgtgggta

SEQ ID NO: 4414 - DNA, 24 bp, Artificial Sequence
  Description of Artificial Sequence: Synthetic oligonucleotide
gactggcgcttcctccgtgggtac

SEQ ID NO: 4415 - DNA, 25 bp, Artificial Sequence
  Description of Artificial Sequence: Synthetic oligonucleotide
actggcgcttcctccgtgggtacca

SEQ ID NO: 4416 - DNA, 24 bp, Artificial Sequence
  Description of Artificial Sequence: Synthetic oligonucleotide
ctggcgcttcctccgtgggtacca

SEQ ID NO: 4417 - DNA, 24 bp, Artificial Sequence
  Description of Artificial Sequence: Synthetic oligonucleotide
tggcgcttcctccgtgggtaccac

SEQ ID NO: 4418 - DNA, 23 bp, Artificial Sequence
  Description of Artificial Sequence: Synthetic oligonucleotide
ggcgcttcctccgtgggtaccac

SEQ ID NO: 4419 - DNA, 24 bp, Artificial Sequence
  Description of Artificial Sequence: Synthetic oligonucleotide
gcgcttcctccgtgggtaccacca

SEQ ID NO: 4420 - DNA, 26 bp, Artificial Sequence
  Description of Artificial Sequence: Synthetic oligonucleotide
cgcttcctccgtgggtaccaccagta

SEQ ID NO: 4421 - DNA, 26 bp, Artificial Sequence
  Description of Artificial Sequence: Synthetic oligonucleotide
gcttcctccgtgggtaccaccagtac

SEQ ID NO: 4422 - DNA, 26 bp, Artificial Sequence
  Description of Artificial Sequence: Synthetic oligonucleotide
cttcctccgtgggtaccaccagtacg

SEQ ID NO: 4423 - DNA, 26 bp, Artificial Sequence
  Description of Artificial Sequence: Synthetic oligonucleotide
ttcctccgtgggtaccaccagtacgc

SEQ ID NO: 4424 - DNA, 25 bp, Artificial Sequence
  Description of Artificial Sequence: Synthetic oligonucleotide
tcctccgtgggtaccaccagtacgc

SEQ ID NO: 4425 - DNA, 24 bp, Artificial Sequence
  Description of Artificial Sequence: Synthetic oligonucleotide
cctccgtgggtaccaccagtacgc

SEQ ID NO: 4426 - DNA, 26 bp, Artificial Sequence
  Description of Artificial Sequence: Synthetic oligonucleotide
ctccgtgggtaccaccagtacgccta

SEQ ID NO: 4427 - DNA, 26 bp, Artificial Sequence
  Description of Artificial Sequence: Synthetic oligonucleotide
tccgtgggtaccaccagtacgcctac

SEQ ID NO: 4428 - DNA, 25 bp, Artificial Sequence
  Description of Artificial Sequence: Synthetic oligonucleotide
ccgtgggtaccaccagtacgcctac

SEQ ID NO: 4429 - DNA, 26 bp, Artificial Sequence
  Description of Artificial Sequence: Synthetic oligonucleotide
cgtgggtaccaccagtacgcctacga

SEQ ID NO: 4430 - DNA, 26 bp, Artificial Sequence
  Description of Artificial Sequence: Synthetic oligonucleotide
gtgggtaccaccagtacgcctacgac

SEQ ID NO: 4431 - DNA, 26 bp, Artificial Sequence
  Description of Artificial Sequence: Synthetic oligonucleotide
tgggtaccaccagtacgcctacgacg

SEQ ID NO: 4432 - DNA, 27 bp, Artificial Sequence
  Description of Artificial Sequence: Synthetic oligonucleotide
cagaggatgtatggctgcgacgtggga

SEQ ID NO: 4433 - DNA, 28 bp, Artificial Sequence
  Description of Artificial Sequence: Synthetic oligonucleotide
agaggatgtatggctgcgacgtgggatc

SEQ ID NO: 4434 - DNA, 27 bp, Artificial Sequence
  Description of Artificial Sequence: Synthetic oligonucleotide
gaggatgtatggctgcgacgtgggatc

SEQ ID NO: 4435 - DNA, 27 bp, Artificial Sequence
  Description of Artificial Sequence: Synthetic oligonucleotide
aggatgtatggctgcgacgtgggatcg

SEQ ID NO: 4436 - DNA, 26 bp, Artificial Sequence
  Description of Artificial Sequence: Synthetic oligonucleotide
ggatgtatggctgcgacgtgggatcg

SEQ ID NO: 4437 - DNA, 27 bp, Artificial Sequence
  Description of Artificial Sequence: Synthetic oligonucleotide
gatgtatggctgcgacgtgggatcgga

SEQ ID NO: 4438 - DNA, 27 bp, Artificial Sequence
  Description of Artificial Sequence: Synthetic oligonucleotide
atgtatggctgcgacgtgggatcggac

SEQ ID NO: 4439 - DNA, 27 bp, Artificial Sequence
  Description of Artificial Sequence: Synthetic oligonucleotide
tgtatggctgcgacgtgggatcggact

SEQ ID NO: 4440 - DNA, 26 bp, Artificial Sequence
  Description of Artificial Sequence: Synthetic oligonucleotide
gtatggctgcgacgtgggatcggact

SEQ ID NO: 4441 - DNA, 26 bp, Artificial Sequence
  Description of Artificial Sequence: Synthetic oligonucleotide
tatggctgcgacgtgggatcggactg

SEQ ID NO: 4442 - DNA, 25 bp, Artificial Sequence
  Description of Artificial Sequence: Synthetic oligonucleotide
atggctgcgacgtgggatcggactg

SEQ ID NO: 4443 - DNA, 24 bp, Artificial Sequence
  Description of Artificial Sequence: Synthetic oligonucleotide
tggctgcgacgtgggatcggactg

SEQ ID NO: 4444 - DNA, 23 bp, Artificial Sequence
  Description of Artificial Sequence: Synthetic oligonucleotide
ggctgcgacgtgggatcggactg

SEQ ID NO: 4445 - DNA, 23 bp, Artificial Sequence
  Description of Artificial Sequence: Synthetic oligonucleotide
gctgcgacgtgggatcggactgg

SEQ ID NO: 4446 - DNA, 23 bp, Artificial Sequence
  Description of Artificial Sequence: Synthetic oligonucleotide
ctgcgacgtgggatcggactggc

SEQ ID NO: 4447 - DNA, 23 bp, Artificial Sequence
  Description of Artificial Sequence: Synthetic oligonucleotide
tgcgacgtgggatcggactggcg

SEQ ID NO: 4448 - DNA, 22 bp, Artificial Sequence
  Description of Artificial Sequence: Synthetic oligonucleotide
gcgacgtgggatcggactggcg

SEQ ID NO: 4449 - DNA, 24 bp, Artificial Sequence
  Description of Artificial Sequence: Synthetic oligonucleotide
cgacgtgggatcggactggcgctt

SEQ ID NO: 4450 - DNA, 24 bp, Artificial Sequence
  Description of Artificial Sequence: Synthetic oligonucleotide
gacgtgggatcggactggcgcttc

SEQ ID NO: 4451 - DNA, 25 bp, Artificial Sequence
  Description of Artificial Sequence: Synthetic oligonucleotide
acgtgggatcggactggcgcttcct

SEQ ID NO: 4452 - DNA, 24 bp, Artificial Sequence
  Description of Artificial Sequence: Synthetic oligonucleotide
cgtgggatcggactggcgcttcct

SEQ ID NO: 4453 - DNA, 24 bp, Artificial Sequence
  Description of Artificial Sequence: Synthetic oligonucleotide
gtgggatcggactggcgcttcctc

SEQ ID NO: 4454 - DNA, 24 bp, Artificial Sequence
  Description of Artificial Sequence: Synthetic oligonucleotide
tgggatcggactggcgcttcctcc

SEQ ID NO: 4455 - DNA, 23 bp, Artificial Sequence
  Description of Artificial Sequence: Synthetic oligonucleotide
gggatcggactggcgcttcctcc

SEQ ID NO: 4456 - DNA, 23 bp, Artificial Sequence
  Description of Artificial Sequence: Synthetic oligonucleotide
ggatcggactggcgcttcctccg

SEQ ID NO: 4457 - DNA, 23 bp, Artificial Sequence
  Description of Artificial Sequence: Synthetic oligonucleotide
gatcggactggcgcttcctccgc

SEQ ID NO: 4458 - DNA, 23 bp, Artificial Sequence
  Description of Artificial Sequence: Synthetic oligonucleotide
atcggactggcgcttcctccgcg

SEQ ID NO: 4459 - DNA, 23 bp, Artificial Sequence
  Description of Artificial Sequence: Synthetic oligonucleotide
tcttggaccgcggcggacatggc

SEQ ID NO: 4460 - DNA, 22 bp, Artificial Sequence
  Description of Artificial Sequence: Synthetic oligonucleotide
cttggaccgcggcggacatggc

SEQ ID NO: 4461 - DNA, 22 bp, Artificial Sequence
  Description of Artificial Sequence: Synthetic oligonucleotide
ttggaccgcggcggacatggcg

SEQ ID NO: 4462 - DNA, 21 bp, Artificial Sequence
  Description of Artificial Sequence: Synthetic oligonucleotide
tggaccgcggcggacatggcg

SEQ ID NO: 4463 - DNA, 20 bp, Artificial Sequence
  Description of Artificial Sequence: Synthetic oligonucleotide
ggaccgcggcggacatggcg

SEQ ID NO: 4464 - DNA, 20 bp, Artificial Sequence
  Description of Artificial Sequence: Synthetic oligonucleotide
gaccgcggcggacatggcgg

SEQ ID NO: 4465 - DNA, 21 bp, Artificial Sequence
  Description of Artificial Sequence: Synthetic oligonucleotide
accgcggcggacatggcggct

SEQ ID NO: 4466 - DNA, 20 bp, Artificial Sequence
  Description of Artificial Sequence: Synthetic oligonucleotide
ccgcggcggacatggcggct

SEQ ID NO: 4467 - DNA, 21 bp, Artificial Sequence
  Description of Artificial Sequence: Synthetic oligonucleotide
cgcggcggacatggcggctca

SEQ ID NO: 4468 - DNA, 22 bp, Artificial Sequence
  Description of Artificial Sequence: Synthetic oligonucleotide
gcggcggacatggcggctcaga

SEQ ID NO: 4469 - DNA, 22 bp, Artificial Sequence
  Description of Artificial Sequence: Synthetic oligonucleotide
cggcggacatggcggctcagac

SEQ ID NO: 4470 - DNA, 23 bp, Artificial Sequence
  Description of Artificial Sequence: Synthetic oligonucleotide
ggcggacatggcggctcagacca

SEQ ID NO: 4471 - DNA, 23 bp, Artificial Sequence
  Description of Artificial Sequence: Synthetic oligonucleotide
gcggacatggcggctcagaccac

SEQ ID NO: 4472 - DNA, 25 bp, Artificial Sequence
  Description of Artificial Sequence: Synthetic oligonucleotide
cggacatggcggctcagaccaccaa

SEQ ID NO: 4473 - DNA, 25 bp, Artificial Sequence
  Description of Artificial Sequence: Synthetic oligonucleotide
ggacatggcggctcagaccaccaag

SEQ ID NO: 4474 - DNA, 26 bp, Artificial Sequence
  Description of Artificial Sequence: Synthetic oligonucleotide
gacatggcggctcagaccaccaagca

SEQ ID NO: 4475 - DNA, 27 bp, Artificial Sequence
  Description of Artificial Sequence: Synthetic oligonucleotide
acatggcggctcagaccaccaagcaca

SEQ ID NO: 4476 - DNA, 27 bp, Artificial Sequence
  Description of Artificial Sequence: Synthetic oligonucleotide
catggcggctcagaccaccaagcacaa

SEQ ID NO: 4477 - DNA, 27 bp, Artificial Sequence
  Description of Artificial Sequence: Synthetic oligonucleotide
atggcggctcagaccaccaagcacaag

SEQ ID NO: 4478 - DNA, 27 bp, Artificial Sequence
  Description of Artificial Sequence: Synthetic oligonucleotide
tggcggctcagaccaccaagcacaagt

SEQ ID NO: 4479 - DNA, 26 bp, Artificial Sequence
  Description of Artificial Sequence: Synthetic oligonucleotide
ggcggctcagaccaccaagcacaagt

SEQ ID NO: 4480 - DNA, 26 bp, Artificial Sequence
  Description of Artificial Sequence: Synthetic oligonucleotide
gcggctcagaccaccaagcacaagtg

SEQ ID NO: 4481 - DNA, 26 bp, Artificial Sequence
  Description of Artificial Sequence: Synthetic oligonucleotide
cggctcagaccaccaagcacaagtgg

SEQ ID NO: 4482 - DNA, 27 bp, Artificial Sequence
  Description of Artificial Sequence: Synthetic oligonucleotide
ggctcagaccaccaagcacaagtggga

SEQ ID NO: 4483 - DNA, 31 bp, Artificial Sequence
  Description of Artificial Sequence: Synthetic oligonucleotide
ggcaaggattacatcgccctgaaagaggatc

SEQ ID NO: 4484 - DNA, 32 bp, Artificial Sequence
  Description of Artificial Sequence: Synthetic oligonucleotide
gcaaggattacatcgccctgaaagaggatctg

SEQ ID NO: 4485 - DNA, 32 bp, Artificial Sequence
  Description of Artificial Sequence: Synthetic oligonucleotide
caaggattacatcgccctgaaagaggatctgc

SEQ ID NO: 4486 - DNA, 32 bp, Artificial Sequence
  Description of Artificial Sequence: Synthetic oligonucleotide
aaggattacatcgccctgaaagaggatctgcg

SEQ ID NO: 4487 - DNA, 31 bp, Artificial Sequence
  Description of Artificial Sequence: Synthetic oligonucleotide
aggattacatcgccctgaaagaggatctgcg

SEQ ID NO: 4488 - DNA, 30 bp, Artificial Sequence
  Description of Artificial Sequence: Synthetic oligonucleotide
ggattacatcgccctgaaagaggatctgcg

SEQ ID NO: 4489 - DNA, 30 bp, Artificial Sequence
  Description of Artificial Sequence: Synthetic oligonucleotide
gattacatcgccctgaaagaggatctgcgc

SEQ ID NO: 4490 - DNA, 31 bp, Artificial Sequence
  Description of Artificial Sequence: Synthetic oligonucleotide
attacatcgccctgaaagaggatctgcgctc

SEQ ID NO: 4491 - DNA, 30 bp, Artificial Sequence
  Description of Artificial Sequence: Synthetic oligonucleotide
ttacatcgccctgaaagaggatctgcgctc

SEQ ID NO: 4492 - DNA, 29 bp, Artificial Sequence
  Description of Artificial Sequence: Synthetic oligonucleotide
tacatcgccctgaaagaggatctgcgctc

SEQ ID NO: 4493 - DNA, 28 bp, Artificial Sequence
  Description of Artificial Sequence: Synthetic oligonucleotide
acatcgccctgaaagaggatctgcgctc

SEQ ID NO: 4494 - DNA, 27 bp, Artificial Sequence
  Description of Artificial Sequence: Synthetic oligonucleotide
catcgccctgaaagaggatctgcgctc

SEQ ID NO: 4495 - DNA, 29 bp, Artificial Sequence
  Description of Artificial Sequence: Synthetic oligonucleotide
atcgccctgaaagaggatctgcgctcttg

SEQ ID NO: 4496 - DNA, 28 bp, Artificial Sequence
  Description of Artificial Sequence: Synthetic oligonucleotide
tcgccctgaaagaggatctgcgctcttg

SEQ ID NO: 4497 - DNA, 27 bp, Artificial Sequence
  Description of Artificial Sequence: Synthetic oligonucleotide
cgccctgaaagaggatctgcgctcttg

SEQ ID NO: 4498 - DNA, 27 bp, Artificial Sequence
  Description of Artificial Sequence: Synthetic oligonucleotide
gccctgaaagaggatctgcgctcttgg

SEQ ID NO: 4499 - DNA, 28 bp, Artificial Sequence
  Description of Artificial Sequence: Synthetic oligonucleotide
ccctgaaagaggatctgcgctcttggac

SEQ ID NO: 4500 - DNA, 28 bp, Artificial Sequence
  Description of Artificial Sequence: Synthetic oligonucleotide
cctgaaagaggatctgcgctcttggacc

SEQ ID NO: 4501 - DNA, 28 bp, Artificial Sequence
  Description of Artificial Sequence: Synthetic oligonucleotide
ctgaaagaggatctgcgctcttggaccg

SEQ ID NO: 4502 - DNA, 28 bp, Artificial Sequence
  Description of Artificial Sequence: Synthetic oligonucleotide
tgaaagaggatctgcgctcttggaccgc

SEQ ID NO: 4503 - DNA, 27 bp, Artificial Sequence
  Description of Artificial Sequence: Synthetic oligonucleotide
gaaagaggatctgcgctcttggaccgc

SEQ ID NO: 4504 - DNA, 27 bp, Artificial Sequence
  Description of Artificial Sequence: Synthetic oligonucleotide
aaagaggatctgcgctcttggaccgcg

SEQ ID NO: 4505 - DNA, 26 bp, Artificial Sequence
  Description of Artificial Sequence: Synthetic oligonucleotide
aagaggatctgcgctcttggaccgcg

SEQ ID NO: 4506 - DNA, 25 bp, Artificial Sequence
  Description of Artificial Sequence: Synthetic oligonucleotide
agaggatctgcgctcttggaccgcg

SEQ ID NO: 4507 - DNA, 24 bp, Artificial Sequence
  Description of Artificial Sequence: Synthetic oligonucleotide
gaggatctgcgctcttggaccgcg

SEQ ID NO: 4508 - DNA, 24 bp, Artificial Sequence
  Description of Artificial Sequence: Synthetic oligonucleotide
aggatctgcgctcttggaccgcgg

SEQ ID NO: 4509 - DNA, 23 bp, Artificial Sequence
  Description of Artificial Sequence: Synthetic oligonucleotide
ggatctgcgctcttggaccgcgg

SEQ ID NO: 4510 - DNA, 23 bp, Artificial Sequence
  Description of Artificial Sequence: Synthetic oligonucleotide
gatctgcgctcttggaccgcggc

SEQ ID NO: 4511 - DNA, 23 bp, Artificial Sequence
  Description of Artificial Sequence: Synthetic oligonucleotide
atctgcgctcttggaccgcggcg

SEQ ID NO: 4512 - DNA, 22 bp, Artificial Sequence
  Description of Artificial Sequence: Synthetic oligonucleotide
tctgcgctcttggaccgcggcg

SEQ ID NO: 4513 - DNA, 35 bp, Artificial Sequence
  Description of Artificial Sequence: Synthetic oligonucleotide
gctctcattccatgaggtatttcttcacatccgtg

SEQ ID NO: 4514 - DNA, 36 bp, Artificial Sequence
  Description of Artificial Sequence: Synthetic oligonucleotide
ctctcattccatgaggtatttcttcacatccgtgtc

SEQ ID NO: 4515 - DNA, 36 bp, Artificial Sequence
  Description of Artificial Sequence: Synthetic oligonucleotide
tctcattccatgaggtatttcttcacatccgtgtcc

SEQ ID NO: 4516 - DNA, 35 bp, Artificial Sequence
  Description of Artificial Sequence: Synthetic oligonucleotide
ctcattccatgaggtatttcttcacatccgtgtcc

SEQ ID NO: 4517 - DNA, 35 bp, Artificial Sequence
  Description of Artificial Sequence: Synthetic oligonucleotide
tcattccatgaggtatttcttcacatccgtgtccc

SEQ ID NO: 4518 - DNA, 34 bp, Artificial Sequence
  Description of Artificial Sequence: Synthetic oligonucleotide
cattccatgaggtatttcttcacatccgtgtccc

SEQ ID NO: 4519 - DNA, 34 bp, Artificial Sequence
  Description of Artificial Sequence: Synthetic oligonucleotide
attccatgaggtatttcttcacatccgtgtcccg

SEQ ID NO: 4520 - DNA, 33 bp, Artificial Sequence
  Description of Artificial Sequence: Synthetic oligonucleotide
ttccatgaggtatttcttcacatccgtgtcccg

SEQ ID NO: 4521 - DNA, 25 bp, Artificial Sequence
  Description of Artificial Sequence: Synthetic oligonucleotide
cggctactacaaccagagcgaggcg

SEQ ID NO: 4522 - DNA, 25 bp, Artificial Sequence
  Description of Artificial Sequence: Synthetic oligonucleotide
ggctactacaaccagagcgaggcgg

SEQ ID NO: 4523 - DNA, 27 bp, Artificial Sequence
  Description of Artificial Sequence: Synthetic oligonucleotide
gctactacaaccagagcgaggcgggtt

SEQ ID NO: 4524 - DNA, 27 bp, Artificial Sequence
  Description of Artificial Sequence: Synthetic oligonucleotide
ctactacaaccagagcgaggcgggttc

SEQ ID NO: 4525 - DNA, 28 bp, Artificial Sequence
  Description of Artificial Sequence: Synthetic oligonucleotide
tactacaaccagagcgaggcgggttctc

SEQ ID NO: 4526 - DNA, 27 bp, Artificial Sequence
  Description of Artificial Sequence: Synthetic oligonucleotide
actacaaccagagcgaggcgggttctc

SEQ ID NO: 4527 - DNA, 27 bp, Artificial Sequence
  Description of Artificial Sequence: Synthetic oligonucleotide
ctacaaccagagcgaggcgggttctca

SEQ ID NO: 4528 - DNA, 27 bp, Artificial Sequence
  Description of Artificial Sequence: Synthetic oligonucleotide
tacaaccagagcgaggcgggttctcac

SEQ ID NO: 4529 - DNA, 27 bp, Artificial Sequence
  Description of Artificial Sequence: Synthetic oligonucleotide
acaaccagagcgaggcgggttctcaca

SEQ ID NO: 4530 - DNA, 26 bp, Artificial Sequence
  Description of Artificial Sequence: Synthetic oligonucleotide
caaccagagcgaggcgggttctcaca

SEQ ID NO: 4531 - DNA, 26 bp, Artificial Sequence
  Description of Artificial Sequence: Synthetic oligonucleotide
aaccagagcgaggcgggttctcacac

SEQ ID NO: 4532 - DNA, 25 bp, Artificial Sequence
  Description of Artificial Sequence: Synthetic oligonucleotide
accagagcgaggcgggttctcacac

SEQ ID NO: 4533 - DNA, 24 bp, Artificial Sequence
  Description of Artificial Sequence: Synthetic oligonucleotide
ccagagcgaggcgggttctcacac

SEQ ID NO: 4534 - DNA, 24 bp, Artificial Sequence
  Description of Artificial Sequence: Synthetic oligonucleotide
cagagcgaggcgggttctcacacc

SEQ ID NO: 4535 - DNA, 25 bp, Artificial Sequence
  Description of Artificial Sequence: Synthetic oligonucleotide
agagcgaggcgggttctcacaccgt

SEQ ID NO: 4536 - DNA, 24 bp, Artificial Sequence
  Description of Artificial Sequence: Synthetic oligonucleotide
gagcgaggcgggttctcacaccgt

SEQ ID NO: 4537 - DNA, 24 bp, Artificial Sequence
  Description of Artificial Sequence: Synthetic oligonucleotide
agcgaggcgggttctcacaccgtc

SEQ ID NO: 4538 - DNA, 23 bp, Artificial Sequence
  Description of Artificial Sequence: Synthetic oligonucleotide
gcgaggcgggttctcacaccgtc

SEQ ID NO: 4539 - DNA, 24 bp, Artificial Sequence
  Description of Artificial Sequence: Synthetic oligonucleotide
cgaggcgggttctcacaccgtcca

SEQ ID NO: 4540 - DNA, 25 bp, Artificial Sequence
  Description of Artificial Sequence: Synthetic oligonucleotide
gaggcgggttctcacaccgtccaga

SEQ ID NO: 4541 - DNA, 25 bp, Artificial Sequence
  Description of Artificial Sequence: Synthetic oligonucleotide
aggcgggttctcacaccgtccagag

SEQ ID NO: 4542 - DNA, 24 bp, Artificial Sequence
  Description of Artificial Sequence: Synthetic oligonucleotide
ggcgggttctcacaccgtccagag

SEQ ID NO: 4543 - DNA, 26 bp, Artificial Sequence
  Description of Artificial Sequence: Synthetic oligonucleotide
gcgggttctcacaccgtccagaggat

SEQ ID NO: 4544 - DNA, 27 bp, Artificial Sequence
  Description of Artificial Sequence: Synthetic oligonucleotide
cgggttctcacaccgtccagaggatgt

SEQ ID NO: 4545 - DNA, 29 bp, Artificial Sequence
  Description of Artificial Sequence: Synthetic oligonucleotide
gggttctcacaccgtccagaggatgtatg

SEQ ID NO: 4546 - DNA, 22 bp, Artificial Sequence
  Description of Artificial Sequence: Synthetic oligonucleotide
ccgcggggagccccgcttcata

SEQ ID NO: 4547 - DNA, 22 bp, Artificial Sequence
  Description of Artificial Sequence: Synthetic oligonucleotide
cgcggggagccccgcttcatag

SEQ ID NO: 4548 - DNA, 23 bp, Artificial Sequence
  Description of Artificial Sequence: Synthetic oligonucleotide
gcggggagccccgcttcatagca

SEQ ID NO: 4549 - DNA, 24 bp, Artificial Sequence
  Description of Artificial Sequence: Synthetic oligonucleotide
cggggagccccgcttcatagcagt

SEQ ID NO: 4550 - DNA, 24 bp, Artificial Sequence
  Description of Artificial Sequence: Synthetic oligonucleotide
ggggagccccgcttcatagcagtg

SEQ ID NO: 4551 - DNA, 24 bp, Artificial Sequence
  Description of Artificial Sequence: Synthetic oligonucleotide
gggagccccgcttcatagcagtgg

SEQ ID NO: 4552 - DNA, 24 bp, Artificial Sequence
  Description of Artificial Sequence: Synthetic oligonucleotide
ggagccccgcttcatagcagtggg

SEQ ID NO: 4553 - DNA, 26 bp, Artificial Sequence
  Description of Artificial Sequence: Synthetic oligonucleotide
gagccccgcttcatagcagtgggcta

SEQ ID NO: 4554 - DNA, 26 bp, Artificial Sequence
  Description of Artificial Sequence: Synthetic oligonucleotide
agccccgcttcatagcagtgggctac

SEQ ID NO: 4555 - DNA, 25 bp, Artificial Sequence
  Description of Artificial Sequence: Synthetic oligonucleotide
gccccgcttcatagcagtgggctac

SEQ ID NO: 4556 - DNA, 26 bp, Artificial Sequence
  Description of Artificial Sequence: Synthetic oligonucleotide
ccccgcttcatagcagtgggctacgt

SEQ ID NO: 4557 - DNA, 26 bp, Artificial Sequence
  Description of Artificial Sequence: Synthetic oligonucleotide
cccgcttcatagcagtgggctacgtg

SEQ ID NO: 4558 - DNA, 27 bp, Artificial Sequence
  Description of Artificial Sequence: Synthetic oligonucleotide
ccgcttcatagcagtgggctacgtgga

SEQ ID NO: 4559 - DNA, 27 bp, Artificial Sequence
  Description of Artificial Sequence: Synthetic oligonucleotide
cgcttcatagcagtgggctacgtggac

SEQ ID NO: 4560 - DNA, 27 bp, Artificial Sequence
  Description of Artificial Sequence: Synthetic oligonucleotide
gcttcatagcagtgggctacgtggacg

SEQ ID NO: 4561 - DNA, 28 bp, Artificial Sequence
  Description of Artificial Sequence: Synthetic oligonucleotide
cttcatagcagtgggctacgtggacgac

SEQ ID NO: 4562 - DNA, 29 bp, Artificial Sequence
  Description of Artificial Sequence: Synthetic oligonucleotide
ttcatagcagtgggctacgtggacgacac

SEQ ID NO: 4563 - DNA, 28 bp, Artificial Sequence
  Description of Artificial Sequence: Synthetic oligonucleotide
tcatagcagtgggctacgtggacgacac

SEQ ID NO: 4564 - DNA, 27 bp, Artificial Sequence
  Description of Artificial Sequence: Synthetic oligonucleotide
catagcagtgggctacgtggacgacac

SEQ ID NO: 4565 - DNA, 27 bp, Artificial Sequence
  Description of Artificial Sequence: Synthetic oligonucleotide
atagcagtgggctacgtggacgacacg

SEQ ID NO: 4566 - DNA, 26 bp, Artificial Sequence
  Description of Artificial Sequence: Synthetic oligonucleotide
tagcagtgggctacgtggacgacacg

SEQ ID NO: 4567 - DNA, 25 bp, Artificial Sequence
  Description of Artificial Sequence: Synthetic oligonucleotide
agcagtgggctacgtggacgacacg

SEQ ID NO: 4568 - DNA, 23 bp, Artificial Sequence
  Description of Artificial Sequence: Synthetic oligonucleotide
cgccgcggacatggcagctcaga

SEQ ID NO: 4569 - DNA, 23 bp, Artificial Sequence
  Description of Artificial Sequence: Synthetic oligonucleotide
gccgcggacatggcagctcagac

SEQ ID NO: 4570 - DNA, 24 bp, Artificial Sequence
  Description of Artificial Sequence: Synthetic oligonucleotide
ccgcggacatggcagctcagacca

SEQ ID NO: 4571 - DNA, 24 bp, Artificial Sequence
  Description of Artificial Sequence: Synthetic oligonucleotide
cgcggacatggcagctcagaccac

SEQ ID NO: 4572 - DNA, 27 bp, Artificial Sequence
  Description of Artificial Sequence: Synthetic oligonucleotide
gtggcggagcagttgagagcctaccta

SEQ ID NO: 4573 - DNA, 27 bp, Artificial Sequence
  Description of Artificial Sequence: Synthetic oligonucleotide
tggcggagcagttgagagcctacctag

SEQ ID NO: 4574 - DNA, 27 bp, Artificial Sequence
  Description of Artificial Sequence: Synthetic oligonucleotide
ggcggagcagttgagagcctacctaga

SEQ ID NO: 4575 - DNA, 27 bp, Artificial Sequence
  Description of Artificial Sequence: Synthetic oligonucleotide
gcggagcagttgagagcctacctagag

SEQ ID NO: 4576 - DNA, 27 bp, Artificial Sequence
  Description of Artificial Sequence: Synthetic oligonucleotide
cggagcagttgagagcctacctagagg

SEQ ID NO: 4577 - DNA, 27 bp, Artificial Sequence
  Description of Artificial Sequence: Synthetic oligonucleotide
ggagcagttgagagcctacctagaggg

SEQ ID NO: 4578 - DNA, 27 bp, Artificial Sequence
  Description of Artificial Sequence: Synthetic oligonucleotide
gagcagttgagagcctacctagagggc

SEQ ID NO: 4579 - DNA, 28 bp, Artificial Sequence
  Description of Artificial Sequence: Synthetic oligonucleotide
agcagttgagagcctacctagagggcac

SEQ ID NO: 4580 - DNA, 27 bp, Artificial Sequence
  Description of Artificial Sequence: Synthetic oligonucleotide
gcagttgagagcctacctagagggcac

SEQ ID NO: 4581 - DNA, 27 bp, Artificial Sequence
  Description of Artificial Sequence: Synthetic oligonucleotide
cagttgagagcctacctagagggcacg

SEQ ID NO: 4582 - DNA, 28 bp, Artificial Sequence
  Description of Artificial Sequence: Synthetic oligonucleotide
agttgagagcctacctagagggcacgtg

SEQ ID NO: 4583 - DNA, 27 bp, Artificial Sequence
  Description of Artificial Sequence: Synthetic oligonucleotide
gttgagagcctacctagagggcacgtg

SEQ ID NO: 4584 - DNA, 27 bp, Artificial Sequence
  Description of Artificial Sequence: Synthetic oligonucleotide
ttgagagcctacctagagggcacgtgc

SEQ ID NO: 4585 - DNA, 26 bp, Artificial Sequence
  Description of Artificial Sequence: Synthetic oligonucleotide
tgagagcctacctagagggcacgtgc

SEQ ID NO: 4586 - DNA, 25 bp, Artificial Sequence
  Description of Artificial Sequence: Synthetic oligonucleotide
gagagcctacctagagggcacgtgc

SEQ ID NO: 4587 - DNA, 26 bp, Artificial Sequence
  Description of Artificial Sequence: Synthetic oligonucleotide
agagcctacctagagggcacgtgcgt

SEQ ID NO: 4588 - DNA, 25 bp, Artificial Sequence
  Description of Artificial Sequence: Synthetic oligonucleotide
gagcctacctagagggcacgtgcgt

SEQ ID NO: 4589 - DNA, 25 bp, Artificial Sequence
  Description of Artificial Sequence: Synthetic oligonucleotide
agcctacctagagggcacgtgcgtg

SEQ ID NO: 4590 - DNA, 24 bp, Artificial Sequence
  Description of Artificial Sequence: Synthetic oligonucleotide
gcctacctagagggcacgtgcgtg

SEQ ID NO: 4591 - DNA, 25 bp, Artificial Sequence
  Description of Artificial Sequence: Synthetic oligonucleotide
cctacctagagggcacgtgcgtgga

SEQ ID NO: 4592 - DNA, 26 bp, Artificial Sequence
  Description of Artificial Sequence: Synthetic oligonucleotide
ctacctagagggcacgtgcgtggagt

SEQ ID NO: 4593 - DNA, 26 bp, Artificial Sequence
  Description of Artificial Sequence: Synthetic oligonucleotide
tacctagagggcacgtgcgtggagtg

SEQ ID NO: 4594 - DNA, 25 bp, Artificial Sequence
  Description of Artificial Sequence: Synthetic oligonucleotide
acctagagggcacgtgcgtggagtg

SEQ ID NO: 4595 - DNA, 24 bp, Artificial Sequence
  Description of Artificial Sequence: Synthetic oligonucleotide
cctagagggcacgtgcgtggagtg

SEQ ID NO: 4596 - DNA, 24 bp, Artificial Sequence
  Description of Artificial Sequence: Synthetic oligonucleotide
ctagagggcacgtgcgtggagtgg

SEQ ID NO: 4597 - DNA, 25 bp, Artificial Sequence
  Description of Artificial Sequence: Synthetic oligonucleotide
tagagggcacgtgcgtggagtggct

SEQ ID NO: 4598 - DNA, 24 bp, Artificial Sequence
  Description of Artificial Sequence: Synthetic oligonucleotide
agagggcacgtgcgtggagtggct

SEQ ID NO: 4599 - DNA, 35 bp, Artificial Sequence
  Description of Artificial Sequence: Synthetic oligonucleotide
gctctcactccatgaggtatttcttcacatctgtg

SEQ ID NO: 4600 - DNA, 36 bp, Artificial Sequence
  Description of Artificial Sequence: Synthetic oligonucleotide
ctctcactccatgaggtatttcttcacatctgtgtc

SEQ ID NO: 4601 - DNA, 36 bp, Artificial Sequence
  Description of Artificial Sequence: Synthetic oligonucleotide
tctcactccatgaggtatttcttcacatctgtgtcc

SEQ ID NO: 4602 - DNA, 35 bp, Artificial Sequence
  Description of Artificial Sequence: Synthetic oligonucleotide
ctcactccatgaggtatttcttcacatctgtgtcc

SEQ ID NO: 4603 - DNA, 35 bp, Artificial Sequence
  Description of Artificial Sequence: Synthetic oligonucleotide
tcactccatgaggtatttcttcacatctgtgtccc

SEQ ID NO: 4604 - DNA, 34 bp, Artificial Sequence
  Description of Artificial Sequence: Synthetic oligonucleotide
cactccatgaggtatttcttcacatctgtgtccc

SEQ ID NO: 4605 - DNA, 34 bp, Artificial Sequence
  Description of Artificial Sequence: Synthetic oligonucleotide
actccatgaggtatttcttcacatctgtgtcccg

SEQ ID NO: 4606 - DNA, 33 bp, Artificial Sequence
  Description of Artificial Sequence: Synthetic oligonucleotide
ctccatgaggtatttcttcacatctgtgtcccg

SEQ ID NO: 4607 - DNA, 33 bp, Artificial Sequence
  Description of Artificial Sequence: Synthetic oligonucleotide
tccatgaggtatttcttcacatctgtgtcccgg

SEQ ID NO: 4608 - DNA, 32 bp, Artificial Sequence
  Description of Artificial Sequence: Synthetic oligonucleotide
ccatgaggtatttcttcacatctgtgtcccgg

SEQ ID NO: 4609 - DNA, 32 bp, Artificial Sequence
  Description of Artificial Sequence: Synthetic oligonucleotide
catgaggtatttcttcacatctgtgtcccggc

SEQ ID NO: 4610 - DNA, 32 bp, Artificial Sequence
  Description of Artificial Sequence: Synthetic oligonucleotide
atgaggtatttcttcacatctgtgtcccggcc

SEQ ID NO: 4611 - DNA, 31 bp, Artificial Sequence
  Description of Artificial Sequence: Synthetic oligonucleotide
tgaggtatttcttcacatctgtgtcccggcc

SEQ ID NO: 4612 - DNA, 30 bp, Artificial Sequence
  Description of Artificial Sequence: Synthetic oligonucleotide
gaggtatttcttcacatctgtgtcccggcc

SEQ ID NO: 4613 - DNA, 30 bp, Artificial Sequence
  Description of Artificial Sequence: Synthetic oligonucleotide
aggtatttcttcacatctgtgtcccggccc

SEQ ID NO: 4614 - DNA, 29 bp, Artificial Sequence
  Description of Artificial Sequence: Synthetic oligonucleotide
ggtatttcttcacatctgtgtcccggccc

SEQ ID NO: 4615 - DNA, 29 bp, Artificial Sequence
  Description of Artificial Sequence: Synthetic oligonucleotide
gtatttcttcacatctgtgtcccggcccg

SEQ ID NO: 4616 - DNA, 29 bp, Artificial Sequence
  Description of Artificial Sequence: Synthetic oligonucleotide
tatttcttcacatctgtgtcccggcccgg

SEQ ID NO: 4617 - DNA, 28 bp, Artificial Sequence
  Description of Artificial Sequence: Synthetic oligonucleotide
atttcttcacatctgtgtcccggcccgg

SEQ ID NO: 4618 - DNA, 27 bp, Artificial Sequence
  Description of Artificial Sequence: Synthetic oligonucleotide
tttcttcacatctgtgtcccggcccgg

SEQ ID NO: 4619 - DNA, 26 bp, Artificial Sequence
  Description of Artificial Sequence: Synthetic oligonucleotide
ttcttcacatctgtgtcccggcccgg

SEQ ID NO: 4620 - DNA, 25 bp, Artificial Sequence
  Description of Artificial Sequence: Synthetic oligonucleotide
tcttcacatctgtgtcccggcccgg

SEQ ID NO: 4621 - DNA, 24 bp, Artificial Sequence
  Description of Artificial Sequence: Synthetic oligonucleotide
cttcacatctgtgtcccggcccgg

SEQ ID NO: 4622 - DNA, 24 bp, Artificial Sequence
  Description of Artificial Sequence: Synthetic oligonucleotide
ttcacatctgtgtcccggcccggc

SEQ ID NO: 4623 - DNA, 23 bp, Artificial Sequence
  Description of Artificial Sequence: Synthetic oligonucleotide
tcacatctgtgtcccggcccggc

SEQ ID NO: 4624 - DNA, 22 bp, Artificial Sequence
  Description of Artificial Sequence: Synthetic oligonucleotide
cacatctgtgtcccggcccggc

SEQ ID NO: 4625 - DNA, 22 bp, Artificial Sequence
  Description of Artificial Sequence: Synthetic oligonucleotide
acatctgtgtcccggcccggcc

SEQ ID NO: 4626 - DNA, 21 bp, Artificial Sequence
  Description of Artificial Sequence: Synthetic oligonucleotide
catctgtgtcccggcccggcc

SEQ ID NO: 4627 - DNA, 21 bp, Artificial Sequence
  Description of Artificial Sequence: Synthetic oligonucleotide
atctgtgtcccggcccggccg

SEQ ID NO: 4628 - DNA, 20 bp, Artificial Sequence
  Description of Artificial Sequence: Synthetic oligonucleotide
tctgtgtcccggcccggccg

SEQ ID NO: 4629 - DNA, 20 bp, Artificial Sequence
  Description of Artificial Sequence: Synthetic oligonucleotide
ctgtgtcccggcccggccgt

SEQ ID NO: 4630 - DNA, 20 bp, Artificial Sequence
  Description of Artificial Sequence: Synthetic oligonucleotide
tgtgtcccggcccggccgct

SEQ ID NO: 4631 - DNA, 23 bp, Artificial Sequence
  Description of Artificial Sequence: Synthetic oligonucleotide
cgagccagaggatggagccgcga

SEQ ID NO: 4632 - DNA, 23 bp, Artificial Sequence
  Description of Artificial Sequence: Synthetic oligonucleotide
gagccagaggatggagccgcgag

SEQ ID NO: 4633 - DNA, 23 bp, Artificial Sequence
  Description of Artificial Sequence: Synthetic oligonucleotide
agccagaggatggagccgcgagc

SEQ ID NO: 4634 - DNA, 22 bp, Artificial Sequence
  Description of Artificial Sequence: Synthetic oligonucleotide
gccagaggatggagccgcgagc

SEQ ID NO: 4635 - DNA, 22 bp, Artificial Sequence
  Description of Artificial Sequence: Synthetic oligonucleotide
ccagaggatggagccgcgagcg

SEQ ID NO: 4636 - DNA, 22 bp, Artificial Sequence
  Description of Artificial Sequence: Synthetic oligonucleotide
cagaggatggagccgcgagcgc

SEQ ID NO: 4637 - DNA, 22 bp, Artificial Sequence
  Description of Artificial Sequence: Synthetic oligonucleotide
agaggatggagccgcgagcgcc

SEQ ID NO: 4638 - DNA, 21 bp, Artificial Sequence
  Description of Artificial Sequence: Synthetic oligonucleotide
gaggatggagccgcgagcgcc

SEQ ID NO: 4639 - DNA, 22 bp, Artificial Sequence
  Description of Artificial Sequence: Synthetic oligonucleotide
aggatggagccgcgagcgccgt

SEQ ID NO: 4640 - DNA, 21 bp, Artificial Sequence
  Description of Artificial Sequence: Synthetic oligonucleotide
ggatggagccgcgagcgccgt

SEQ ID NO: 4641 - DNA, 21 bp, Artificial Sequence
  Description of Artificial Sequence: Synthetic oligonucleotide
gatggagccgcgagcgccgtg

SEQ ID NO: 4642 - DNA, 24 bp, Artificial Sequence
  Description of Artificial Sequence: Synthetic oligonucleotide
atggagccgcgagcgccgtggata

SEQ ID NO: 4643 - DNA, 23 bp, Artificial Sequence
  Description of Artificial Sequence: Synthetic oligonucleotide
tggagccgcgagcgccgtggata

SEQ ID NO: 4644 - DNA, 22 bp, Artificial Sequence
  Description of Artificial Sequence: Synthetic oligonucleotide
ggagccgcgagcgccgtggata

SEQ ID NO: 4645 - DNA, 23 bp, Artificial Sequence
  Description of Artificial Sequence: Synthetic oligonucleotide
gagccgcgagcgccgtggataga

SEQ ID NO: 4646 - DNA, 23 bp, Artificial Sequence
  Description of Artificial Sequence: Synthetic oligonucleotide
agccgcgagcgccgtggatagag

SEQ ID NO: 4647 - DNA, 22 bp, Artificial Sequence
  Description of Artificial Sequence: Synthetic oligonucleotide
gccgcgagcgccgtggatagag

SEQ ID NO: 4648 - DNA, 23 bp, Artificial Sequence
  Description of Artificial Sequence: Synthetic oligonucleotide
ccgcgagcgccgtggatagagca

SEQ ID NO: 4649 - DNA, 23 bp, Artificial Sequence
  Description of Artificial Sequence: Synthetic oligonucleotide
cgcgagcgccgtggatagagcag

SEQ ID NO: 4650 - DNA, 24 bp, Artificial Sequence
  Description of Artificial Sequence: Synthetic oligonucleotide
gcgagcgccgtggatagagcagga

SEQ ID NO: 4651 - DNA, 24 bp, Artificial Sequence
  Description of Artificial Sequence: Synthetic oligonucleotide
cgagcgccgtggatagagcaggag

SEQ ID NO: 4652 - DNA, 24 bp, Artificial Sequence
  Description of Artificial Sequence: Synthetic oligonucleotide
gagcgccgtggatagagcaggagg

SEQ ID NO: 4653 - DNA, 25 bp, Artificial Sequence
  Description of Artificial Sequence: Synthetic oligonucleotide
agcgccgtggatagagcaggagggt

SEQ ID NO: 4654 - DNA, 27 bp, Artificial Sequence
  Description of Artificial Sequence: Synthetic oligonucleotide
gtgggctacgtggacgacacgcagttt

SEQ ID NO: 4655 - DNA, 27 bp, Artificial Sequence
  Description of Artificial Sequence: Synthetic oligonucleotide
tgggctacgtggacgacacgcagtttg

SEQ ID NO: 4656 - DNA, 27 bp, Artificial Sequence
  Description of Artificial Sequence: Synthetic oligonucleotide
gggctacgtggacgacacgcagtttgt

SEQ ID NO: 4657 - DNA, 27 bp, Artificial Sequence
  Description of Artificial Sequence: Synthetic oligonucleotide
ggctacgtggacgacacgcagtttgtg

SEQ ID NO: 4658 - DNA, 27 bp, Artificial Sequence
  Description of Artificial Sequence: Synthetic oligonucleotide
gctacgtggacgacacgcagtttgtgc

SEQ ID NO: 4659 - DNA, 27 bp, Artificial Sequence
  Description of Artificial Sequence: Synthetic oligonucleotide
ctacgtggacgacacgcagtttgtgcg

SEQ ID NO: 4660 - DNA, 27 bp, Artificial Sequence
  Description of Artificial Sequence: Synthetic oligonucleotide
tacgtggacgacacgcagtttgtgcgg

SEQ ID NO: 4661 - DNA, 27 bp, Artificial Sequence
  Description of Artificial Sequence: Synthetic oligonucleotide
acgtggacgacacgcagtttgtgcggt

SEQ ID NO: 4662 - DNA, 27 bp, Artificial Sequence
  Description of Artificial Sequence: Synthetic oligonucleotide
cgtggacgacacgcagtttgtgcggtt

SEQ ID NO: 4663 - DNA, 27 bp, Artificial Sequence
  Description of Artificial Sequence: Synthetic oligonucleotide
gtggacgacacgcagtttgtgcggttc

SEQ ID NO: 4664 - DNA, 27 bp, Artificial Sequence
  Description of Artificial Sequence: Synthetic oligonucleotide
tggacgacacgcagtttgtgcggttcg

SEQ ID NO: 4665 - DNA, 27 bp, Artificial Sequence
  Description of Artificial Sequence: Synthetic oligonucleotide
ggacgacacgcagtttgtgcggttcga

SEQ ID NO: 4666 - DNA, 27 bp, Artificial Sequence
  Description of Artificial Sequence: Synthetic oligonucleotide
gacgacacgcagtttgtgcggttcgac

SEQ ID NO: 4667 - DNA, 28 bp, Artificial Sequence
  Description of Artificial Sequence: Synthetic oligonucleotide
acgacacgcagtttgtgcggttcgacag

SEQ ID NO: 4668 - DNA, 27 bp, Artificial Sequence
  Description of Artificial Sequence: Synthetic oligonucleotide
cgacacgcagtttgtgcggttcgacag

SEQ ID NO: 4669 - DNA, 27 bp, Artificial Sequence
  Description of Artificial Sequence: Synthetic oligonucleotide
gacacgcagtttgtgcggttcgacagc

SEQ ID NO: 4670 - DNA, 27 bp, Artificial Sequence
  Description of Artificial Sequence: Synthetic oligonucleotide
acacgcagtttgtgcggttcgacagcg

SEQ ID NO: 4671 - DNA, 27 bp, Artificial Sequence
  Description of Artificial Sequence: Synthetic oligonucleotide
cacgcagtttgtgcggttcgacagcga

SEQ ID NO: 4672 - DNA, 27 bp, Artificial Sequence
  Description of Artificial Sequence: Synthetic oligonucleotide
acgcagtttgtgcggttcgacagcgac

SEQ ID NO: 4673 - DNA, 26 bp, Artificial Sequence
  Description of Artificial Sequence: Synthetic oligonucleotide
cgcagtttgtgcggttcgacagcgac

SEQ ID NO: 4674 - DNA, 26 bp, Artificial Sequence
  Description of Artificial Sequence: Synthetic oligonucleotide
gcagtttgtgcggttcgacagcgacg

SEQ ID NO: 4675 - DNA, 26 bp, Artificial Sequence
  Description of Artificial Sequence: Synthetic oligonucleotide
cagtttgtgcggttcgacagcgacgc

SEQ ID NO: 4676 - DNA, 26 bp, Artificial Sequence
  Description of Artificial Sequence: Synthetic oligonucleotide
agtttgtgcggttcgacagcgacgcc

SEQ ID NO: 4677 - DNA, 25 bp, Artificial Sequence
  Description of Artificial Sequence: Synthetic oligonucleotide
gtttgtgcggttcgacagcgacgcc

SEQ ID NO: 4678 - DNA, 25 bp, Artificial Sequence
  Description of Artificial Sequence: Synthetic oligonucleotide
tttgtgcggttcgacagcgacgccg

SEQ ID NO: 4679 - DNA, 24 bp, Artificial Sequence
  Description of Artificial Sequence: Synthetic oligonucleotide
ttgtgcggttcgacagcgacgccg

SEQ ID NO: 4680 - DNA, 23 bp, Artificial Sequence
  Description of Artificial Sequence: Synthetic oligonucleotide
tgtgcggttcgacagcgacgccg

SEQ ID NO: 4681 - DNA, 25 bp, Artificial Sequence
  Description of Artificial Sequence: Synthetic oligonucleotide
agcctacctggagggcacgtgcgta

SEQ ID NO: 4682 - DNA, 24 bp, Artificial Sequence
  Description of Artificial Sequence: Synthetic oligonucleotide
gcctacctggagggcacgtgcgta

SEQ ID NO: 4683 - DNA, 25 bp, Artificial Sequence
  Description of Artificial Sequence: Synthetic oligonucleotide
cctacctggagggcacgtgcgtaga

SEQ ID NO: 4684 - DNA, 26 bp, Artificial Sequence
  Description of Artificial Sequence: Synthetic oligonucleotide
ctacctggagggcacgtgcgtagagt

SEQ ID NO: 4685 - DNA, 26 bp, Artificial Sequence
  Description of Artificial Sequence: Synthetic oligonucleotide
tacctggagggcacgtgcgtagagtg

SEQ ID NO: 4686 - DNA, 25 bp, Artificial Sequence
  Description of Artificial Sequence: Synthetic oligonucleotide
acctggagggcacgtgcgtagagtg

SEQ ID NO: 4687 - DNA, 24 bp, Artificial Sequence
  Description of Artificial Sequence: Synthetic oligonucleotide
cctggagggcacgtgcgtagagtg

SEQ ID NO: 4688 - DNA, 24 bp, Artificial Sequence
  Description of Artificial Sequence: Synthetic oligonucleotide
ctggagggcacgtgcgtagagtgg

SEQ ID NO: 4689 - DNA, 25 bp, Artificial Sequence
  Description of Artificial Sequence: Synthetic oligonucleotide
tggagggcacgtgcgtagagtggct

SEQ ID NO: 4690 - DNA, 24 bp, Artificial Sequence
  Description of Artificial Sequence: Synthetic oligonucleotide
ggagggcacgtgcgtagagtggct

SEQ ID NO: 4691 - DNA, 24 bp, Artificial Sequence
  Description of Artificial Sequence: Synthetic oligonucleotide
gagggcacgtgcgtagagtggctc

SEQ ID NO: 4692 - DNA, 24 bp, Artificial Sequence
  Description of Artificial Sequence: Synthetic oligonucleotide
agggcacgtgcgtagagtggctcc

SEQ ID NO: 4693 - DNA, 23 bp, Artificial Sequence
  Description of Artificial Sequence: Synthetic oligonucleotide
gggcacgtgcgtagagtggctcc

SEQ ID NO: 4694 - DNA, 23 bp, Artificial Sequence
  Description of Artificial Sequence: Synthetic oligonucleotide
ggcacgtgcgtagagtggctccg

SEQ ID NO: 4695 - DNA, 24 bp, Artificial Sequence
  Description of Artificial Sequence: Synthetic oligonucleotide
gcacgtgcgtagagtggctccgca

SEQ ID NO: 4696 - DNA, 27 bp, Artificial Sequence
  Description of Artificial Sequence: Synthetic oligonucleotide
cacgtgcgtagagtggctccgcagata

SEQ ID NO: 4697 - DNA, 27 bp, Artificial Sequence
  Description of Artificial Sequence: Synthetic oligonucleotide
acgtgcgtagagtggctccgcagatac

SEQ ID NO: 4698 - DNA, 26 bp, Artificial Sequence
  Description of Artificial Sequence: Synthetic oligonucleotide
cgtgcgtagagtggctccgcagatac

SEQ ID NO: 4699 - DNA, 27 bp, Artificial Sequence
  Description of Artificial Sequence: Synthetic oligonucleotide
gtgcgtagagtggctccgcagatacct

SEQ ID NO: 4700 - DNA, 27 bp, Artificial Sequence
  Description of Artificial Sequence: Synthetic oligonucleotide
tgcgtagagtggctccgcagatacctg

SEQ ID NO: 4701 - DNA, 26 bp, Artificial Sequence
  Description of Artificial Sequence: Synthetic oligonucleotide
gcgtagagtggctccgcagatacctg

SEQ ID NO: 4702 - DNA, 27 bp, Artificial Sequence
  Description of Artificial Sequence: Synthetic oligonucleotide
cgtagagtggctccgcagatacctgga

SEQ ID NO: 4703 - DNA, 27 bp, Artificial Sequence
  Description of Artificial Sequence: Synthetic oligonucleotide
gtagagtggctccgcagatacctggag

SEQ ID NO: 4704 - DNA, 29 bp, Artificial Sequence
  Description of Artificial Sequence: Synthetic oligonucleotide
tagagtggctccgcagatacctggagaac

SEQ ID NO: 4705 - DNA, 28 bp, Artificial Sequence
  Description of Artificial Sequence: Synthetic oligonucleotide
agagtggctccgcagatacctggagaac

SEQ ID NO: 4706 - DNA, 28 bp, Artificial Sequence
  Description of Artificial Sequence: Synthetic oligonucleotide
ctccgcagatacctggagaacgggaaag

SEQ ID NO: 4707 - DNA, 29 bp, Artificial Sequence
  Description of Artificial Sequence: Synthetic oligonucleotide
tccgcagatacctggagaacgggaaagag

SEQ ID NO: 4708 - DNA, 28 bp, Artificial Sequence
  Description of Artificial Sequence: Synthetic oligonucleotide
ccgcagatacctggagaacgggaaagag

SEQ ID NO: 4709 - DNA, 29 bp, Artificial Sequence
  Description of Artificial Sequence: Synthetic oligonucleotide
cgcagatacctggagaacgggaaagagac

SEQ ID NO: 4710 - DNA, 29 bp, Artificial Sequence
  Description of Artificial Sequence: Synthetic oligonucleotide
gcagatacctggagaacgggaaagagacg

SEQ ID NO: 4711 - DNA, 29 bp, Artificial Sequence
  Description of Artificial Sequence: Synthetic oligonucleotide
cagatacctggagaacgggaaagagacgc

SEQ ID NO: 4712 - DNA, 30 bp, Artificial Sequence
  Description of Artificial Sequence: Synthetic oligonucleotide
agatacctggagaacgggaaagagacgctg

SEQ ID NO: 4713 - DNA, 29 bp, Artificial Sequence
  Description of Artificial Sequence: Synthetic oligonucleotide
gatacctggagaacgggaaagagacgctg

SEQ ID NO: 4714 - DNA, 29 bp, Artificial Sequence
  Description of Artificial Sequence: Synthetic oligonucleotide
atacctggagaacgggaaagagacgctgc

SEQ ID NO: 4715 - DNA, 28 bp, Artificial Sequence
  Description of Artificial Sequence: Synthetic oligonucleotide
tacctggagaacgggaaagagacgctgc

SEQ ID NO: 4716 - DNA, 27 bp, Artificial Sequence
  Description of Artificial Sequence: Synthetic oligonucleotide
acctggagaacgggaaagagacgctgc

SEQ ID NO: 4717 - DNA, 27 bp, Artificial Sequence
  Description of Artificial Sequence: Synthetic oligonucleotide
cctggagaacgggaaagagacgctgca

SEQ ID NO: 4718 - DNA, 27 bp, Artificial Sequence
  Description of Artificial Sequence: Synthetic oligonucleotide
ctggagaacgggaaagagacgctgcag

SEQ ID NO: 4719 - DNA, 27 bp, Artificial Sequence
  Description of Artificial Sequence: Synthetic oligonucleotide
tggagaacgggaaagagacgctgcagc

SEQ ID NO: 4720 - DNA, 26 bp, Artificial Sequence
  Description of Artificial Sequence: Synthetic oligonucleotide
ggagaacgggaaagagacgctgcagc

SEQ ID NO: 4721 - DNA, 26 bp, Artificial Sequence
  Description of Artificial Sequence: Synthetic oligonucleotide
gagaacgggaaagagacgctgcagcg

SEQ ID NO: 4722 - DNA, 27 bp, Artificial Sequence
  Description of Artificial Sequence: Synthetic oligonucleotide
agaacgggaaagagacgctgcagcgca

SEQ ID NO: 4723 - DNA, 26 bp, Artificial Sequence
  Description of Artificial Sequence: Synthetic oligonucleotide
gaacgggaaagagacgctgcagcgca

SEQ ID NO: 4724 - DNA, 26 bp, Artificial Sequence
  Description of Artificial Sequence: Synthetic oligonucleotide
aacgggaaagagacgctgcagcgcac

SEQ ID NO: 4725 - DNA, 25 bp, Artificial Sequence
  Description of Artificial Sequence: Synthetic oligonucleotide
acgggaaagagacgctgcagcgcac

SEQ ID NO: 4726 - DNA, 24 bp, Artificial Sequence
  Description of Artificial Sequence: Synthetic oligonucleotide
cgggaaagagacgctgcagcgcac

SEQ ID NO: 4727 - DNA, 24 bp, Artificial Sequence
  Description of Artificial Sequence: Synthetic oligonucleotide
gggaaagagacgctgcagcgcacg

SEQ ID NO: 4728 - DNA, 25 bp, Artificial Sequence
  Description of Artificial Sequence: Synthetic oligonucleotide
ggaaagagacgctgcagcgcacgga

SEQ ID NO: 4729 - DNA, 25 bp, Artificial Sequence
  Description of Artificial Sequence: Synthetic oligonucleotide
gaaagagacgctgcagcgcacggac

SEQ ID NO: 4730 - DNA, 25 bp, Artificial Sequence
  Description of Artificial Sequence: Synthetic oligonucleotide
aaagagacgctgcagcgcacggacg

SEQ ID NO: 4731 - DNA, 24 bp, Artificial Sequence
  Description of Artificial Sequence: Synthetic oligonucleotide
aagagacgctgcagcgcacggacg

SEQ ID NO: 4732 - DNA, 23 bp, Artificial Sequence
  Description of Artificial Sequence: Synthetic oligonucleotide
agagacgctgcagcgcacggacg

SEQ ID NO: 4733 - DNA, 31 bp, Artificial Sequence
  Description of Artificial Sequence: Synthetic oligonucleotide
tgccttctggacaggagcagagatacacttg

SEQ ID NO: 4734 - DNA, 30 bp, Artificial Sequence
  Description of Artificial Sequence: Synthetic oligonucleotide
gccttctggacaggagcagagatacacttg

SEQ ID NO: 4735 - DNA, 30 bp, Artificial Sequence
  Description of Artificial Sequence: Synthetic oligonucleotide
ccttctggacaggagcagagatacacttgc

SEQ ID NO: 4736 - DNA, 30 bp, Artificial Sequence
  Description of Artificial Sequence: Synthetic oligonucleotide
cttctggacaggagcagagatacacttgcc

SEQ ID NO: 4737 - DNA, 32 bp, Artificial Sequence
  Description of Artificial Sequence: Synthetic oligonucleotide
ttctggacaggagcagagatacacttgccatg

SEQ ID NO: 4738 - DNA, 31 bp, Artificial Sequence
  Description of Artificial Sequence: Synthetic oligonucleotide
tctggacaggagcagagatacacttgccatg

SEQ ID NO: 4739 - DNA, 30 bp, Artificial Sequence
  Description of Artificial Sequence: Synthetic oligonucleotide
ctggacaggagcagagatacacttgccatg

SEQ ID NO: 4740 - DNA, 31 bp, Artificial Sequence
  Description of Artificial Sequence: Synthetic oligonucleotide
tggacaggagcagagatacacttgccatgtg

SEQ ID NO: 4741 - DNA, 30 bp, Artificial Sequence
  Description of Artificial Sequence: Synthetic oligonucleotide
ggacaggagcagagatacacttgccatgtg

SEQ ID NO: 4742 - DNA, 30 bp, Artificial Sequence
  Description of Artificial Sequence: Synthetic oligonucleotide
gacaggagcagagatacacttgccatgtgc

SEQ ID NO: 4743 - DNA, 31 bp, Artificial Sequence
  Description of Artificial Sequence: Synthetic oligonucleotide
acaggagcagagatacacttgccatgtgcag

SEQ ID NO: 4744 - DNA, 30 bp, Artificial Sequence
  Description of Artificial Sequence: Synthetic oligonucleotide
caggagcagagatacacttgccatgtgcag

SEQ ID NO: 4745 - DNA, 30 bp, Artificial Sequence
  Description of Artificial Sequence: Synthetic oligonucleotide
aggagcagagatacacttgccatgtgcagc

SEQ ID NO: 4746 - DNA, 29 bp, Artificial Sequence
  Description of Artificial Sequence: Synthetic oligonucleotide
ggagcagagatacacttgccatgtgcagc

SEQ ID NO: 4747 - DNA, 31 bp, Artificial Sequence
  Description of Artificial Sequence: Synthetic oligonucleotide
gagcagagatacacttgccatgtgcagcatg

SEQ ID NO: 4748 - DNA, 32 bp, Artificial Sequence
  Description of Artificial Sequence: Synthetic oligonucleotide
agcagagatacacttgccatgtgcagcatgag

SEQ ID NO: 4749 - DNA, 31 bp, Artificial Sequence
  Description of Artificial Sequence: Synthetic oligonucleotide
gcagagatacacttgccatgtgcagcatgag

SEQ ID NO: 4750 - DNA, 31 bp, Artificial Sequence
  Description of Artificial Sequence: Synthetic oligonucleotide
cagagatacacttgccatgtgcagcatgagg

SEQ ID NO: 4751 - DNA, 31 bp, Artificial Sequence
  Description of Artificial Sequence: Synthetic oligonucleotide
agagatacacttgccatgtgcagcatgaggg

SEQ ID NO: 4752 - DNA, 30 bp, Artificial Sequence
  Description of Artificial Sequence: Synthetic oligonucleotide
gagatacacttgccatgtgcagcatgaggg

SEQ ID NO: 4753 - DNA, 33 bp, Artificial Sequence
  Description of Artificial Sequence: Synthetic oligonucleotide
agatacacttgccatgtgcagcatgagggtttg

SEQ ID NO: 4754 - DNA, 32 bp, Artificial Sequence
  Description of Artificial Sequence: Synthetic oligonucleotide
gatacacttgccatgtgcagcatgagggtttg

SEQ ID NO: 4755 - DNA, 32 bp, Artificial Sequence
  Description of Artificial Sequence: Synthetic oligonucleotide
atacacttgccatgtgcagcatgagggtttgc

SEQ ID NO: 4756 - DNA, 31 bp, Artificial Sequence
  Description of Artificial Sequence: Synthetic oligonucleotide
tacacttgccatgtgcagcatgagggtttgc

SEQ ID NO: 4757 - DNA, 30 bp, Artificial Sequence
  Description of Artificial Sequence: Synthetic oligonucleotide
acacttgccatgtgcagcatgagggtttgc

SEQ ID NO: 4758 - DNA, 29 bp, Artificial Sequence
  Description of Artificial Sequence: Synthetic oligonucleotide
cacttgccatgtgcagcatgagggtttgc

SEQ ID NO: 4759 - DNA, 29 bp, Artificial Sequence
  Description of Artificial Sequence: Synthetic oligonucleotide
acttgccatgtgcagcatgagggtttgcc

SEQ ID NO: 4760 - DNA, 28 bp, Artificial Sequence
  Description of Artificial Sequence: Synthetic oligonucleotide
cttgccatgtgcagcatgagggtttgcc

SEQ ID NO: 4761 - DNA, 28 bp, Artificial Sequence
  Description of Artificial Sequence: Synthetic oligonucleotide
ttgccatgtgcagcatgagggtttgccc

SEQ ID NO: 4762 - DNA, 27 bp, Artificial Sequence
  Description of Artificial Sequence: Synthetic oligonucleotide
gcccactcacagactcaccgagtggat

SEQ ID NO: 4763 - DNA, 27 bp, Artificial Sequence
  Description of Artificial Sequence: Synthetic oligonucleotide
cccactcacagactcaccgagtggatc

SEQ ID NO: 4764 - DNA, 28 bp, Artificial Sequence
  Description of Artificial Sequence: Synthetic oligonucleotide
ccactcacagactcaccgagtggatctg

SEQ ID NO: 4765 - DNA, 28 bp, Artificial Sequence
  Description of Artificial Sequence: Synthetic oligonucleotide
cactcacagactcaccgagtggatctgg

SEQ ID NO: 4766 - DNA, 28 bp, Artificial Sequence
  Description of Artificial Sequence: Synthetic oligonucleotide
actcacagactcaccgagtggatctggg

SEQ ID NO: 4767 - DNA, 27 bp, Artificial Sequence
  Description of Artificial Sequence: Synthetic oligonucleotide
ctcacagactcaccgagtggatctggg

SEQ ID NO: 4768 - DNA, 27 bp, Artificial Sequence
  Description of Artificial Sequence: Synthetic oligonucleotide
tcacagactcaccgagtggatctgggg

SEQ ID NO: 4769 - DNA, 27 bp, Artificial Sequence
  Description of Artificial Sequence: Synthetic oligonucleotide
cacagactcaccgagtggatctgggga

SEQ ID NO: 4770 - DNA, 27 bp, Artificial Sequence
  Description of Artificial Sequence: Synthetic oligonucleotide
acagactcaccgagtggatctggggac

SEQ ID NO: 4771 - DNA, 26 bp, Artificial Sequence
  Description of Artificial Sequence: Synthetic oligonucleotide
cagactcaccgagtggatctggggac

SEQ ID NO: 4772 - DNA, 26 bp, Artificial Sequence
  Description of Artificial Sequence: Synthetic oligonucleotide
agactcaccgagtggatctggggacc

SEQ ID NO: 4773 - DNA, 25 bp, Artificial Sequence
  Description of Artificial Sequence: Synthetic oligonucleotide
gactcaccgagtggatctggggacc

SEQ ID NO: 4774 - DNA, 26 bp, Artificial Sequence
  Description of Artificial Sequence: Synthetic oligonucleotide
actcaccgagtggatctggggaccct

SEQ ID NO: 4775 - DNA, 25 bp, Artificial Sequence
  Description of Artificial Sequence: Synthetic oligonucleotide
ctcaccgagtggatctggggaccct

SEQ ID NO: 4776 - DNA, 25 bp, Artificial Sequence
  Description of Artificial Sequence: Synthetic oligonucleotide
tcaccgagtggatctggggaccctg

SEQ ID NO: 4777 - DNA, 24 bp, Artificial Sequence
  Description of Artificial Sequence: Synthetic oligonucleotide
caccgagtggatctggggaccctg

SEQ ID NO: 4778 - DNA, 24 bp, Artificial Sequence
  Description of Artificial Sequence: Synthetic oligonucleotide
accgagtggatctggggaccctgc

SEQ ID NO: 4779 - DNA, 23 bp, Artificial Sequence
  Description of Artificial Sequence: Synthetic oligonucleotide
ccgagtggatctggggaccctgc

SEQ ID NO: 4780 - DNA, 23 bp, Artificial Sequence
  Description of Artificial Sequence: Synthetic oligonucleotide
cgagtggatctggggaccctgcg

SEQ ID NO: 4781 - DNA, 23 bp, Artificial Sequence
  Description of Artificial Sequence: Synthetic oligonucleotide
gagtggatctggggaccctgcgc

SEQ ID NO: 4782 - DNA, 23 bp, Artificial Sequence
  Description of Artificial Sequence: Synthetic oligonucleotide
agtggatctggggaccctgcgcg

SEQ ID NO: 4783 - DNA, 22 bp, Artificial Sequence
  Description of Artificial Sequence: Synthetic oligonucleotide
gtggatctggggaccctgcgcg

SEQ ID NO: 4784 - DNA, 22 bp, Artificial Sequence
  Description of Artificial Sequence: Synthetic oligonucleotide
tggatctggggaccctgcgcgg

SEQ ID NO: 4785 - DNA, 21 bp, Artificial Sequence
  Description of Artificial Sequence: Synthetic oligonucleotide
ggatctggggaccctgcgcgg

SEQ ID NO: 4786 - DNA, 23 bp, Artificial Sequence
  Description of Artificial Sequence: Synthetic oligonucleotide
gatctggggaccctgcgcggcta

SEQ ID NO: 4787 - DNA, 27 bp, Artificial Sequence
  Description of Artificial Sequence: Synthetic oligonucleotide
ctgaggtgctgggccctgagcttctat

SEQ ID NO: 4788 - DNA, 27 bp, Artificial Sequence
  Description of Artificial Sequence: Synthetic oligonucleotide
tgaggtgctgggccctgagcttctatc

SEQ ID NO: 4789 - DNA, 26 bp, Artificial Sequence
  Description of Artificial Sequence: Synthetic oligonucleotide
gaggtgctgggccctgagcttctatc

SEQ ID NO: 4790 - DNA, 27 bp, Artificial Sequence
  Description of Artificial Sequence: Synthetic oligonucleotide
aggtgctgggccctgagcttctatcct

SEQ ID NO: 4791 - DNA, 26 bp, Artificial Sequence
  Description of Artificial Sequence: Synthetic oligonucleotide
ggtgctgggccctgagcttctatcct

SEQ ID NO: 4792 - DNA, 26 bp, Artificial Sequence
  Description of Artificial Sequence: Synthetic oligonucleotide
gtgctgggccctgagcttctatcctg

SEQ ID NO: 4793 - DNA, 26 bp, Artificial Sequence
  Description of Artificial Sequence: Synthetic oligonucleotide
tgctgggccctgagcttctatcctgc

SEQ ID NO: 4794 - DNA, 25 bp, Artificial Sequence
  Description of Artificial Sequence: Synthetic oligonucleotide
gctgggccctgagcttctatcctgc

SEQ ID NO: 4795 - DNA, 25 bp, Artificial Sequence
  Description of Artificial Sequence: Synthetic oligonucleotide
ctgggccctgagcttctatcctgcg

SEQ ID NO: 4796 - DNA, 26 bp, Artificial Sequence
  Description of Artificial Sequence: Synthetic oligonucleotide
tgggccctgagcttctatcctgcgga

SEQ ID NO: 4797 - DNA, 25 bp, Artificial Sequence
  Description of Artificial Sequence: Synthetic oligonucleotide
gggccctgagcttctatcctgcgga

SEQ ID NO: 4798 - DNA, 27 bp, Artificial Sequence
  Description of Artificial Sequence: Synthetic oligonucleotide
ggccctgagcttctatcctgcggagat

SEQ ID NO: 4799 - DNA, 27 bp, Artificial Sequence
  Description of Artificial Sequence: Synthetic oligonucleotide
gccctgagcttctatcctgcggagatc

SEQ ID NO: 4800 - DNA, 28 bp, Artificial Sequence
  Description of Artificial Sequence: Synthetic oligonucleotide
ccctgagcttctatcctgcggagatcac

SEQ ID NO: 4801 - DNA, 29 bp, Artificial Sequence
  Description of Artificial Sequence: Synthetic oligonucleotide
cctgagcttctatcctgcggagatcacac

SEQ ID NO: 4802 - DNA, 30 bp, Artificial Sequence
  Description of Artificial Sequence: Synthetic oligonucleotide
ctgagcttctatcctgcggagatcacactg

SEQ ID NO: 4803 - DNA, 31 bp, Artificial Sequence
  Description of Artificial Sequence: Synthetic oligonucleotide
tgagcttctatcctgcggagatcacactgac

SEQ ID NO: 4804 - DNA, 30 bp, Artificial Sequence
  Description of Artificial Sequence: Synthetic oligonucleotide
gagcttctatcctgcggagatcacactgac

SEQ ID NO: 4805 - DNA, 30 bp, Artificial Sequence
  Description of Artificial Sequence: Synthetic oligonucleotide
agcttctatcctgcggagatcacactgacc

SEQ ID NO: 4806 - DNA, 29 bp, Artificial Sequence
  Description of Artificial Sequence: Synthetic oligonucleotide
gcttctatcctgcggagatcacactgacc

SEQ ID NO: 4807 - DNA, 30 bp, Artificial Sequence
  Description of Artificial Sequence: Synthetic oligonucleotide
cttctatcctgcggagatcacactgacctg

SEQ ID NO: 4808 - DNA, 30 bp, Artificial Sequence
  Description of Artificial Sequence: Synthetic oligonucleotide
ttctatcctgcggagatcacactgacctgg

SEQ ID NO: 4809 - DNA, 29 bp, Artificial Sequence
  Description of Artificial Sequence: Synthetic oligonucleotide
tctatcctgcggagatcacactgacctgg

SEQ ID NO: 4810 - DNA, 28 bp, Artificial Sequence
  Description of Artificial Sequence: Synthetic oligonucleotide
ctatcctgcggagatcacactgacctgg

SEQ ID NO: 4811 - DNA, 28 bp, Artificial Sequence
  Description of Artificial Sequence: Synthetic oligonucleotide
tatcctgcggagatcacactgacctggc

SEQ ID NO: 4812 - DNA, 27 bp, Artificial Sequence
  Description of Artificial Sequence: Synthetic oligonucleotide
atcctgcggagatcacactgacctggc

SEQ ID NO: 4813 - DNA, 27 bp, Artificial Sequence
  Description of Artificial Sequence: Synthetic oligonucleotide
tcctgcggagatcacactgacctggca

SEQ ID NO: 4814 - DNA, 22 bp, Artificial Sequence
  Description of Artificial Sequence: Synthetic oligonucleotide
ttcgacagcgacgccgcgagcc

SEQ ID NO: 4815 - DNA, 21 bp, Artificial Sequence
  Description of Artificial Sequence: Synthetic oligonucleotide
tcgacagcgacgccgcgagcc

SEQ ID NO: 4816 - DNA, 20 bp, Artificial Sequence
  Description of Artificial Sequence: Synthetic oligonucleotide
cgacagcgacgccgcgagcc

SEQ ID NO: 4817 - DNA, 20 bp, Artificial Sequence
  Description of Artificial Sequence: Synthetic oligonucleotide
gacagcgacgccgcgagccg

SEQ ID NO: 4818 - DNA, 21 bp, Artificial Sequence
  Description of Artificial Sequence: Synthetic oligonucleotide
acagcgacgccgcgagccgga

SEQ ID NO: 4819 - DNA, 20 bp, Artificial Sequence
  Description of Artificial Sequence: Synthetic oligonucleotide
cagcgacgccgcgagccgga

SEQ ID NO: 4820 - DNA, 20 bp, Artificial Sequence
  Description of Artificial Sequence: Synthetic oligonucleotide
agcgacgccgcgagccggag

SEQ ID NO: 4821 - DNA, 20 bp, Artificial Sequence
  Description of Artificial Sequence: Synthetic oligonucleotide
gcgacgccgcgagccggagt

SEQ ID NO: 4822 - DNA, 21 bp, Artificial Sequence
  Description of Artificial Sequence: Synthetic oligonucleotide
cgacgccgcgagccggaggat

SEQ ID NO: 4823 - DNA, 21 bp, Artificial Sequence
  Description of Artificial Sequence: Synthetic oligonucleotide
gacgccgcgagccggaggatg

SEQ ID NO: 4824 - DNA, 22 bp, Artificial Sequence
  Description of Artificial Sequence: Synthetic oligonucleotide
acgccgcgagccggaggatgga

SEQ ID NO: 4825 - DNA, 21 bp, Artificial Sequence
  Description of Artificial Sequence: Synthetic oligonucleotide
cgccgcgagccggaggatgga

SEQ ID NO: 4826 - DNA, 21 bp, Artificial Sequence
  Description of Artificial Sequence: Synthetic oligonucleotide
gccgcgagccggaggatggag

SEQ ID NO: 4827 - DNA, 21 bp, Artificial Sequence
  Description of Artificial Sequence: Synthetic oligonucleotide
ccgcgagccggaggatggagc

SEQ ID NO: 4828 - DNA, 21 bp, Artificial Sequence
  Description of Artificial Sequence: Synthetic oligonucleotide
cgcgagccggaggatggagcc

SEQ ID NO: 4829 - DNA, 21 bp, Artificial Sequence
  Description of Artificial Sequence: Synthetic oligonucleotide
gcgagccggaggatggagccg

SEQ ID NO: 4830 - DNA, 21 bp, Artificial Sequence
  Description of Artificial Sequence: Synthetic oligonucleotide
cgagccggaggatggagccgc

SEQ ID NO: 4831 - DNA, 21 bp, Artificial Sequence
  Description of Artificial Sequence: Synthetic oligonucleotide
gagccggaggatggagccgcg

SEQ ID NO: 4832 - DNA, 21 bp, Artificial Sequence
  Description of Artificial Sequence: Synthetic oligonucleotide
agccggaggatggagccgcgg

SEQ ID NO: 4833 - DNA, 20 bp, Artificial Sequence
  Description of Artificial Sequence: Synthetic oligonucleotide
gccggaggatggagccgcgg

SEQ ID NO: 4834 - DNA, 20 bp, Artificial Sequence
  Description of Artificial Sequence: Synthetic oligonucleotide
ccggaggatggagccgcggg

SEQ ID NO: 4835 - DNA, 20 bp, Artificial Sequence
  Description of Artificial Sequence: Synthetic oligonucleotide
cggaggatggagccgcgggc

SEQ ID NO: 4836 - DNA, 20 bp, Artificial Sequence
  Description of Artificial Sequence: Synthetic oligonucleotide
ggaggatggagccgcgggcg

SEQ ID NO: 4837 - DNA, 25 bp, Artificial Sequence
  Description of Artificial Sequence: Synthetic oligonucleotide
agagcgaggccggttctcacaccct

SEQ ID NO: 4838 - DNA, 24 bp, Artificial Sequence
  Description of Artificial Sequence: Synthetic oligonucleotide
gagcgaggccggttctcacaccct

SEQ ID NO: 4839 - DNA, 24 bp, Artificial Sequence
  Description of Artificial Sequence: Synthetic oligonucleotide
agcgaggccggttctcacaccctc

SEQ ID NO: 4840 - DNA, 23 bp, Artificial Sequence
  Description of Artificial Sequence: Synthetic oligonucleotide
gcgaggccggttctcacaccctc

SEQ ID NO: 4841 - DNA, 24 bp, Artificial Sequence
  Description of Artificial Sequence: Synthetic oligonucleotide
cgaggccggttctcacaccctcca

SEQ ID NO: 4842 - DNA, 25 bp, Artificial Sequence
  Description of Artificial Sequence: Synthetic oligonucleotide
gaggccggttctcacaccctccaga

SEQ ID NO: 4843 - DNA, 25 bp, Artificial Sequence
  Description of Artificial Sequence: Synthetic oligonucleotide
aggccggttctcacaccctccagag

SEQ ID NO: 4844 - DNA, 24 bp, Artificial Sequence
  Description of Artificial Sequence: Synthetic oligonucleotide
ggccggttctcacaccctccagag

SEQ ID NO: 4845 - DNA, 26 bp, Artificial Sequence
  Description of Artificial Sequence: Synthetic oligonucleotide
gccggttctcacaccctccagaggat

SEQ ID NO: 4846 - DNA, 27 bp, Artificial Sequence
  Description of Artificial Sequence: Synthetic oligonucleotide
ccggttctcacaccctccagaggatgt

SEQ ID NO: 4847 - DNA, 29 bp, Artificial Sequence
  Description of Artificial Sequence: Synthetic oligonucleotide
cggttctcacaccctccagaggatgtatg

SEQ ID NO: 4848 - DNA, 29 bp, Artificial Sequence
  Description of Artificial Sequence: Synthetic oligonucleotide
ggttctcacaccctccagaggatgtatgg

SEQ ID NO: 4849 - DNA, 29 bp, Artificial Sequence
  Description of Artificial Sequence: Synthetic oligonucleotide
gttctcacaccctccagaggatgtatggc

SEQ ID NO: 4850 - DNA, 30 bp, Artificial Sequence
  Description of Artificial Sequence: Synthetic oligonucleotide
ttctcacaccctccagaggatgtatggctg

SEQ ID NO: 4851 - DNA, 29 bp, Artificial Sequence
  Description of Artificial Sequence: Synthetic oligonucleotide
tctcacaccctccagaggatgtatggctg

SEQ ID NO: 4852 - DNA, 28 bp, Artificial Sequence
  Description of Artificial Sequence: Synthetic oligonucleotide
ctcacaccctccagaggatgtatggctg

SEQ ID NO: 4853 - DNA, 28 bp, Artificial Sequence
  Description of Artificial Sequence: Synthetic oligonucleotide
tcacaccctccagaggatgtatggctgc

SEQ ID NO: 4854 - DNA, 27 bp, Artificial Sequence
  Description of Artificial Sequence: Synthetic oligonucleotide
cacaccctccagaggatgtatggctgc

SEQ ID NO: 4855 - DNA, 27 bp, Artificial Sequence
  Description of Artificial Sequence: Synthetic oligonucleotide
acaccctccagaggatgtatggctgcg

SEQ ID NO: 4856 - DNA, 27 bp, Artificial Sequence
  Description of Artificial Sequence: Synthetic oligonucleotide
caccctccagaggatgtatggctgcga

SEQ ID NO: 4857 - DNA, 27 bp, Artificial Sequence
  Description of Artificial Sequence: Synthetic oligonucleotide
accctccagaggatgtatggctgcgac

SEQ ID NO: 4858 - DNA, 26 bp, Artificial Sequence
  Description of Artificial Sequence: Synthetic oligonucleotide
ccctccagaggatgtatggctgcgac

SEQ ID NO: 4859 - DNA, 27 bp, Artificial Sequence
  Description of Artificial Sequence: Synthetic oligonucleotide
cctccagaggatgtatggctgcgacgt

SEQ ID NO: 4860 - DNA, 27 bp, Artificial Sequence
  Description of Artificial Sequence: Synthetic oligonucleotide
ctccagaggatgtatggctgcgacgtg

SEQ ID NO: 4861 - DNA, 23 bp, Artificial Sequence
  Description of Artificial Sequence: Synthetic oligonucleotide
tggggtcggactggcgcttcctg

SEQ ID NO: 4862 - DNA, 22 bp, Artificial Sequence
  Description of Artificial Sequence: Synthetic oligonucleotide
ggggtcggactggcgcttcctg

SEQ ID NO: 4863 - DNA, 22 bp, Artificial Sequence
  Description of Artificial Sequence: Synthetic oligonucleotide
gggtcggactggcgcttcctgc

SEQ ID NO: 4864 - DNA, 22 bp, Artificial Sequence
  Description of Artificial Sequence: Synthetic oligonucleotide
ggtcggactggcgcttcctgcg

SEQ ID NO: 4865 - DNA, 22 bp, Artificial Sequence
  Description of Artificial Sequence: Synthetic oligonucleotide
gtcggactggcgcttcctgcgc

SEQ ID NO: 4866 - DNA, 22 bp, Artificial Sequence
  Description of Artificial Sequence: Synthetic oligonucleotide
tcggactggcgcttcctgcgcg

SEQ ID NO: 4867 - DNA, 21 bp, Artificial Sequence
  Description of Artificial Sequence: Synthetic oligonucleotide
cggactggcgcttcctgcgcg

SEQ ID NO: 4868 - DNA, 21 bp, Artificial Sequence
  Description of Artificial Sequence: Synthetic oligonucleotide
ggactggcgcttcctgcgcgg

SEQ ID NO: 4869 - DNA, 23 bp, Artificial Sequence
  Description of Artificial Sequence: Synthetic oligonucleotide
gactggcgcttcctgcgcgggta

SEQ ID NO: 4870 - DNA, 23 bp, Artificial Sequence
  Description of Artificial Sequence: Synthetic oligonucleotide
actggcgcttcctgcgcgggtac

SEQ ID NO: 4871 - DNA, 22 bp, Artificial Sequence
  Description of Artificial Sequence: Synthetic oligonucleotide
ctggcgcttcctgcgcgggtac

SEQ ID NO: 4872 - DNA, 23 bp, Artificial Sequence
  Description of Artificial Sequence: Synthetic oligonucleotide
tggcgcttcctgcgcgggtacca

SEQ ID NO: 4873 - DNA, 22 bp, Artificial Sequence
  Description of Artificial Sequence: Synthetic oligonucleotide
ggcgcttcctgcgcgggtacca

SEQ ID NO: 4874 - DNA, 22 bp, Artificial Sequence
  Description of Artificial Sequence: Synthetic oligonucleotide
gcgcttcctgcgcgggtaccac

SEQ ID NO: 4875 - DNA, 23 bp, Artificial Sequence
  Description of Artificial Sequence: Synthetic oligonucleotide
cgcttcctgcgcgggtaccacca

SEQ ID NO: 4876 - DNA, 25 bp, Artificial Sequence
  Description of Artificial Sequence: Synthetic oligonucleotide
gcttcctgcgcgggtaccaccagta

SEQ ID NO: 4877 - DNA, 25 bp, Artificial Sequence
  Description of Artificial Sequence: Synthetic oligonucleotide
cttcctgcgcgggtaccaccagtac

SEQ ID NO: 4878 - DNA, 25 bp, Artificial Sequence
  Description of Artificial Sequence: Synthetic oligonucleotide
ttcctgcgcgggtaccaccagtacg

SEQ ID NO: 4879 - DNA, 24 bp, Artificial Sequence
  Description of Artificial Sequence: Synthetic oligonucleotide
tcctgcgcgggtaccaccagtacg

SEQ ID NO: 4880 - DNA, 23 bp, Artificial Sequence
  Description of Artificial Sequence: Synthetic oligonucleotide
cctgcgcgggtaccaccagtacg

SEQ ID NO: 4881 - DNA, 23 bp, Artificial Sequence
  Description of Artificial Sequence: Synthetic oligonucleotide
ctgcgcgggtaccaccagtacgc

SEQ ID NO: 4882 - DNA, 25 bp, Artificial Sequence
  Description of Artificial Sequence: Synthetic oligonucleotide
tgcgcgggtaccaccagtacgccta

SEQ ID NO: 4883 - DNA, 24 bp, Artificial Sequence
  Description of Artificial Sequence: Synthetic oligonucleotide
gcgcgggtaccaccagtacgccta

SEQ ID NO: 4884 - DNA, 22 bp, Artificial Sequence
  Description of Artificial Sequence: Synthetic oligonucleotide
gcggcccatgtggcggagcagt

SEQ ID NO: 4885 - DNA, 22 bp, Artificial Sequence
  Description of Artificial Sequence: Synthetic oligonucleotide
cggcccatgtggcggagcagtg

SEQ ID NO: 4886 - DNA, 23 bp, Artificial Sequence
  Description of Artificial Sequence: Synthetic oligonucleotide
ggcccatgtggcggagcagtgga

SEQ ID NO: 4887 - DNA, 24 bp, Artificial Sequence
  Description of Artificial Sequence: Synthetic oligonucleotide
gcccatgtggcggagcagtggaga

SEQ ID NO: 4888 - DNA, 24 bp, Artificial Sequence
  Description of Artificial Sequence: Synthetic oligonucleotide
cccatgtggcggagcagtggagag

SEQ ID NO: 4889 - DNA, 24 bp, Artificial Sequence
  Description of Artificial Sequence: Synthetic oligonucleotide
ccatgtggcggagcagtggagagc

SEQ ID NO: 4890 - DNA, 26 bp, Artificial Sequence
  Description of Artificial Sequence: Synthetic oligonucleotide
catgtggcggagcagtggagagccta

SEQ ID NO: 4891 - DNA, 26 bp, Artificial Sequence
  Description of Artificial Sequence: Synthetic oligonucleotide
atgtggcggagcagtggagagcctac

SEQ ID NO: 4892 - DNA, 25 bp, Artificial Sequence
  Description of Artificial Sequence: Synthetic oligonucleotide
tgtggcggagcagtggagagcctac

SEQ ID NO: 4893 - DNA, 24 bp, Artificial Sequence
  Description of Artificial Sequence: Synthetic oligonucleotide
gtggcggagcagtggagagcctac

SEQ ID NO: 4894 - DNA, 25 bp, Artificial Sequence
  Description of Artificial Sequence: Synthetic oligonucleotide
tggcggagcagtggagagcctacct

SEQ ID NO: 4895 - DNA, 24 bp, Artificial Sequence
  Description of Artificial Sequence: Synthetic oligonucleotide
ggcggagcagtggagagcctacct

SEQ ID NO: 4896 - DNA, 24 bp, Artificial Sequence
  Description of Artificial Sequence: Synthetic oligonucleotide
gcggagcagtggagagcctacctg

SEQ ID NO: 4897 - DNA, 25 bp, Artificial Sequence
  Description of Artificial Sequence: Synthetic oligonucleotide
cggagcagtggagagcctacctgga

SEQ ID NO: 4898 - DNA, 25 bp, Artificial Sequence
  Description of Artificial Sequence: Synthetic oligonucleotide
ggagcagtggagagcctacctggag

SEQ ID NO: 4899 - DNA, 25 bp, Artificial Sequence
  Description of Artificial Sequence: Synthetic oligonucleotide
gagcagtggagagcctacctggagg

SEQ ID NO: 4900 - DNA, 25 bp, Artificial Sequence
  Description of Artificial Sequence: Synthetic oligonucleotide
agcagtggagagcctacctggaggg

SEQ ID NO: 4901 - DNA, 24 bp, Artificial Sequence
  Description of Artificial Sequence: Synthetic oligonucleotide
gcagtggagagcctacctggaggg

SEQ ID NO: 4902 - DNA, 25 bp, Artificial Sequence
  Description of Artificial Sequence: Synthetic oligonucleotide
cagtggagagcctacctggagggca

SEQ ID NO: 4903 - DNA, 25 bp, Artificial Sequence
  Description of Artificial Sequence: Synthetic oligonucleotide
agtggagagcctacctggagggcac

SEQ ID NO: 4904 - DNA, 24 bp, Artificial Sequence
  Description of Artificial Sequence: Synthetic oligonucleotide
gtggagagcctacctggagggcac

SEQ ID NO: 4905 - DNA, 25 bp, Artificial Sequence
  Description of Artificial Sequence: Synthetic oligonucleotide
tggagagcctacctggagggcacgt

SEQ ID NO: 4906 - DNA, 24 bp, Artificial Sequence
  Description of Artificial Sequence: Synthetic oligonucleotide
ggagagcctacctggagggcacgt

SEQ ID NO: 4907 - DNA, 28 bp, Artificial Sequence
  Description of Artificial Sequence: Synthetic oligonucleotide
ctcagaccaccaagcacaagtgggagac

SEQ ID NO: 4908 - DNA, 28 bp, Artificial Sequence
  Description of Artificial Sequence: Synthetic oligonucleotide
tcagaccaccaagcacaagtgggagacg

SEQ ID NO: 4909 - DNA, 27 bp, Artificial Sequence
  Description of Artificial Sequence: Synthetic oligonucleotide
cagaccaccaagcacaagtgggagacg

SEQ ID NO: 4910 - DNA, 27 bp, Artificial Sequence
  Description of Artificial Sequence: Synthetic oligonucleotide
agaccaccaagcacaagtgggagacgg

SEQ ID NO: 4911 - DNA, 26 bp, Artificial Sequence
  Description of Artificial Sequence: Synthetic oligonucleotide
gaccaccaagcacaagtgggagacgg

SEQ ID NO: 4912 - DNA, 26 bp, Artificial Sequence
  Description of Artificial Sequence: Synthetic oligonucleotide
accaccaagcacaagtgggagacggc

SEQ ID NO: 4913 - DNA, 25 bp, Artificial Sequence
  Description of Artificial Sequence: Synthetic oligonucleotide
ccaccaagcacaagtgggagacggc

SEQ ID NO: 4914 - DNA, 25 bp, Artificial Sequence
  Description of Artificial Sequence: Synthetic oligonucleotide
caccaagcacaagtgggagacggcc

SEQ ID NO: 4915 - DNA, 27 bp, Artificial Sequence
  Description of Artificial Sequence: Synthetic oligonucleotide
accaagcacaagtgggagacggcccat

SEQ ID NO: 4916 - DNA, 26 bp, Artificial Sequence
  Description of Artificial Sequence: Synthetic oligonucleotide
ccaagcacaagtgggagacggcccat

SEQ ID NO: 4917 - DNA, 27 bp, Artificial Sequence
  Description of Artificial Sequence: Synthetic oligonucleotide
caagcacaagtgggagacggcccatga

SEQ ID NO: 4918 - DNA, 27 bp, Artificial Sequence
  Description of Artificial Sequence: Synthetic oligonucleotide
aagcacaagtgggagacggcccatgag

SEQ ID NO: 4919 - DNA, 26 bp, Artificial Sequence
  Description of Artificial Sequence: Synthetic oligonucleotide
agcacaagtgggagacggcccatgag

SEQ ID NO: 4920 - DNA, 25 bp, Artificial Sequence
  Description of Artificial Sequence: Synthetic oligonucleotide
gcacaagtgggagacggcccatgag

SEQ ID NO: 4921 - DNA, 25 bp, Artificial Sequence
  Description of Artificial Sequence: Synthetic oligonucleotide
cacaagtgggagacggcccatgagg

SEQ ID NO: 4922 - DNA, 25 bp, Artificial Sequence
  Description of Artificial Sequence: Synthetic oligonucleotide
acaagtgggagacggcccatgaggc

SEQ ID NO: 4923 - DNA, 24 bp, Artificial Sequence
  Description of Artificial Sequence: Synthetic oligonucleotide
caagtgggagacggcccatgaggc

SEQ ID NO: 4924 - DNA, 24 bp, Artificial Sequence
  Description of Artificial Sequence: Synthetic oligonucleotide
aagtgggagacggcccatgaggcg

SEQ ID NO: 4925 - DNA, 23 bp, Artificial Sequence
  Description of Artificial Sequence: Synthetic oligonucleotide
agtgggagacggcccatgaggcg

SEQ ID NO: 4926 - DNA, 22 bp, Artificial Sequence
  Description of Artificial Sequence: Synthetic oligonucleotide
gtgggagacggcccatgaggcg

SEQ ID NO: 4927 - DNA, 23 bp, Artificial Sequence
  Description of Artificial Sequence: Synthetic oligonucleotide
tgggagacggcccatgaggcgga

SEQ ID NO: 4928 - DNA, 22 bp, Artificial Sequence
  Description of Artificial Sequence: Synthetic oligonucleotide
gggagacggcccatgaggcgga

SEQ ID NO: 4929 - DNA, 22 bp, Artificial Sequence
  Description of Artificial Sequence: Synthetic oligonucleotide
ggagacggcccatgaggcggag

SEQ ID NO: 4930 - DNA, 23 bp, Artificial Sequence
  Description of Artificial Sequence: Synthetic oligonucleotide
gagacggcccatgaggcggagca

SEQ ID NO: 4931 - DNA, 24 bp, Artificial Sequence
  Description of Artificial Sequence: Synthetic oligonucleotide
agacggcccatgaggcggagcagt

SEQ ID NO: 4932 - DNA, 23 bp, Artificial Sequence
  Description of Artificial Sequence: Synthetic oligonucleotide
gacggcccatgaggcggagcagt

SEQ ID NO: 4933 - DNA, 23 bp, Artificial Sequence
  Description of Artificial Sequence: Synthetic oligonucleotide
acggcccatgaggcggagcagtg

SEQ ID NO: 4934 - DNA, 22 bp, Artificial Sequence
  Description of Artificial Sequence: Synthetic oligonucleotide
cggcccatgaggcggagcagtg

SEQ ID NO: 4935 - DNA, 23 bp, Artificial Sequence
  Description of Artificial Sequence: Synthetic oligonucleotide
ggcccatgaggcggagcagtgga

SEQ ID NO: 4936 - DNA, 24 bp, Artificial Sequence
  Description of Artificial Sequence: Synthetic oligonucleotide
gcccatgaggcggagcagtggaga

SEQ ID NO: 4937 - DNA, 24 bp, Artificial Sequence
  Description of Artificial Sequence: Synthetic oligonucleotide
cccatgaggcggagcagtggagag

SEQ ID NO: 4938 - DNA, 24 bp, Artificial Sequence
  Description of Artificial Sequence: Synthetic oligonucleotide
ccatgaggcggagcagtggagagc

SEQ ID NO: 4939 - DNA, 26 bp, Artificial Sequence
  Description of Artificial Sequence: Synthetic oligonucleotide
catgaggcggagcagtggagagccta

SEQ ID NO: 4940 - DNA, 26 bp, Artificial Sequence
  Description of Artificial Sequence: Synthetic oligonucleotide
atgaggcggagcagtggagagcctac

SEQ ID NO: 4941 - DNA, 25 bp, Artificial Sequence
  Description of Artificial Sequence: Synthetic oligonucleotide
tgaggcggagcagtggagagcctac

SEQ ID NO: 4942 - DNA, 24 bp, Artificial Sequence
  Description of Artificial Sequence: Synthetic oligonucleotide
gaggcggagcagtggagagcctac

SEQ ID NO: 4943 - DNA, 25 bp, Artificial Sequence
  Description of Artificial Sequence: Synthetic oligonucleotide
aggcggagcagtggagagcctacct

SEQ ID NO: 4944 - DNA, 32 bp, Artificial Sequence
  Description of Artificial Sequence: Synthetic oligonucleotide
ctacgacggcaaggattacatcgccctaaaag

SEQ ID NO: 4945 - DNA, 33 bp, Artificial Sequence
  Description of Artificial Sequence: Synthetic oligonucleotide
tacgacggcaaggattacatcgccctaaaagag

SEQ ID NO: 4946 - DNA, 32 bp, Artificial Sequence
  Description of Artificial Sequence: Synthetic oligonucleotide
acgacggcaaggattacatcgccctaaaagag

SEQ ID NO: 4947 - DNA, 31 bp, Artificial Sequence
  Description of Artificial Sequence: Synthetic oligonucleotide
cgacggcaaggattacatcgccctaaaagag

SEQ ID NO: 4948 - DNA, 31 bp, Artificial Sequence
  Description of Artificial Sequence: Synthetic oligonucleotide
gacggcaaggattacatcgccctaaaagagg

SEQ ID NO: 4949 - DNA, 32 bp, Artificial Sequence
  Description of Artificial Sequence: Synthetic oligonucleotide
acggcaaggattacatcgccctaaaagaggac

SEQ ID NO: 4950 - DNA, 31 bp, Artificial Sequence
  Description of Artificial Sequence: Synthetic oligonucleotide
cggcaaggattacatcgccctaaaagaggac

SEQ ID NO: 4951 - DNA, 31 bp, Artificial Sequence
  Description of Artificial Sequence: Synthetic oligonucleotide
ggcaaggattacatcgccctaaaagaggacc

SEQ ID NO: 4952 - DNA, 32 bp, Artificial Sequence
  Description of Artificial Sequence: Synthetic oligonucleotide
gcaaggattacatcgccctaaaagaggacctg

SEQ ID NO: 4953 - DNA, 32 bp, Artificial Sequence
  Description of Artificial Sequence: Synthetic oligonucleotide
caaggattacatcgccctaaaagaggacctgc

SEQ ID NO: 4954 - DNA, 32 bp, Artificial Sequence
  Description of Artificial Sequence: Synthetic oligonucleotide
aaggattacatcgccctaaaagaggacctgcg

SEQ ID NO: 4955 - DNA, 31 bp, Artificial Sequence
  Description of Artificial Sequence: Synthetic oligonucleotide
aggattacatcgccctaaaagaggacctgcg

SEQ ID NO: 4956 - DNA, 30 bp, Artificial Sequence
  Description of Artificial Sequence: Synthetic oligonucleotide
ggattacatcgccctaaaagaggacctgcg

SEQ ID NO: 4957 - DNA, 30 bp, Artificial Sequence
  Description of Artificial Sequence: Synthetic oligonucleotide
gattacatcgccctaaaagaggacctgcgc

SEQ ID NO: 4958 - DNA, 31 bp, Artificial Sequence
  Description of Artificial Sequence: Synthetic oligonucleotide
attacatcgccctaaaagaggacctgcgctc

SEQ ID NO: 4959 - DNA, 30 bp, Artificial Sequence
  Description of Artificial Sequence: Synthetic oligonucleotide
ttacatcgccctaaaagaggacctgcgctc

SEQ ID NO: 4960 - DNA, 29 bp, Artificial Sequence
  Description of Artificial Sequence: Synthetic oligonucleotide
tacatcgccctaaaagaggacctgcgctc

SEQ ID NO: 4961 - DNA, 28 bp, Artificial Sequence
  Description of Artificial Sequence: Synthetic oligonucleotide
acatcgccctaaaagaggacctgcgctc

SEQ ID NO: 4962 - DNA, 27 bp, Artificial Sequence
  Description of Artificial Sequence: Synthetic oligonucleotide
catcgccctaaaagaggacctgcgctc

SEQ ID NO: 4963 - DNA, 29 bp, Artificial Sequence
  Description of Artificial Sequence: Synthetic oligonucleotide
atcgccctaaaagaggacctgcgctcttg

SEQ ID NO: 4964 - DNA, 28 bp, Artificial Sequence
  Description of Artificial Sequence: Synthetic oligonucleotide
tcgccctaaaagaggacctgcgctcttg

SEQ ID NO: 4965 - DNA, 27 bp, Artificial Sequence
  Description of Artificial Sequence: Synthetic oligonucleotide
cgccctaaaagaggacctgcgctcttg

SEQ ID NO: 4966 - DNA, 27 bp, Artificial Sequence
  Description of Artificial Sequence: Synthetic oligonucleotide
gccctaaaagaggacctgcgctcttgg

SEQ ID NO: 4967 - DNA, 28 bp, Artificial Sequence
  Description of Artificial Sequence: Synthetic oligonucleotide
ccctaaaagaggacctgcgctcttggac

SEQ ID NO: 4968 - DNA, 28 bp, Artificial Sequence
  Description of Artificial Sequence: Synthetic oligonucleotide
cctaaaagaggacctgcgctcttggacc

SEQ ID NO: 4969 - DNA, 28 bp, Artificial Sequence
  Description of Artificial Sequence: Synthetic oligonucleotide
ctaaaagaggacctgcgctcttggaccg

SEQ ID NO: 4970 - DNA, 28 bp, Artificial Sequence
  Description of Artificial Sequence: Synthetic oligonucleotide
taaaagaggacctgcgctcttggaccgc

SEQ ID NO: 4971 - DNA, 27 bp, Artificial Sequence
  Description of Artificial Sequence: Synthetic oligonucleotide
aaaagaggacctgcgctcttggaccgc

SEQ ID NO: 4972 - DNA, 26 bp, Artificial Sequence
  Description of Artificial Sequence: Synthetic oligonucleotide
gaggccggttctcacaccgtccagat

SEQ ID NO: 4973 - DNA, 27 bp, Artificial Sequence
  Description of Artificial Sequence: Synthetic oligonucleotide
aggccggttctcacaccgtccagatga

SEQ ID NO: 4974 - DNA, 27 bp, Artificial Sequence
  Description of Artificial Sequence: Synthetic oligonucleotide
ggccggttctcacaccgtccagatgat

SEQ ID NO: 4975 - DNA, 27 bp, Artificial Sequence
  Description of Artificial Sequence: Synthetic oligonucleotide
gccggttctcacaccgtccagatgatg

SEQ ID NO: 4976 - DNA, 30 bp, Artificial Sequence
  Description of Artificial Sequence: Synthetic oligonucleotide
ccggttctcacaccgtccagatgatgtatg

SEQ ID NO: 4977 - DNA, 30 bp, Artificial Sequence
  Description of Artificial Sequence: Synthetic oligonucleotide
cggttctcacaccgtccagatgatgtatgg

SEQ ID NO: 4978 - DNA, 30 bp, Artificial Sequence
  Description of Artificial Sequence: Synthetic oligonucleotide
ggttctcacaccgtccagatgatgtatggc

SEQ ID NO: 4979 - DNA, 31 bp, Artificial Sequence
  Description of Artificial Sequence: Synthetic oligonucleotide
gttctcacaccgtccagatgatgtatggctg

SEQ ID NO: 4980 - DNA, 31 bp, Artificial Sequence
  Description of Artificial Sequence: Synthetic oligonucleotide
ttctcacaccgtccagatgatgtatggctgc

SEQ ID NO: 4981 - DNA, 30 bp, Artificial Sequence
  Description of Artificial Sequence: Synthetic oligonucleotide
tctcacaccgtccagatgatgtatggctgc

SEQ ID NO: 4982 - DNA, 29 bp, Artificial Sequence
  Description of Artificial Sequence: Synthetic oligonucleotide
ctcacaccgtccagatgatgtatggctgc

SEQ ID NO: 4983 - DNA, 29 bp, Artificial Sequence
  Description of Artificial Sequence: Synthetic oligonucleotide
tcacaccgtccagatgatgtatggctgcg

SEQ ID NO: 4984 - DNA, 28 bp, Artificial Sequence
  Description of Artificial Sequence: Synthetic oligonucleotide
cacaccgtccagatgatgtatggctgcg

SEQ ID NO: 4985 - DNA, 29 bp, Artificial Sequence
  Description of Artificial Sequence: Synthetic oligonucleotide
acaccgtccagatgatgtatggctgcgac

SEQ ID NO: 4986 - DNA, 28 bp, Artificial Sequence
  Description of Artificial Sequence: Synthetic oligonucleotide
caccgtccagatgatgtatggctgcgac

SEQ ID NO: 4987 - DNA, 28 bp, Artificial Sequence
  Description of Artificial Sequence: Synthetic oligonucleotide
accgtccagatgatgtatggctgcgacg

SEQ ID NO: 4988 - DNA, 27 bp, Artificial Sequence
  Description of Artificial Sequence: Synthetic oligonucleotide
ccgtccagatgatgtatggctgcgacg

SEQ ID NO: 4989 - DNA, 28 bp, Artificial Sequence
  Description of Artificial Sequence: Synthetic oligonucleotide
cgtccagatgatgtatggctgcgacgtg

SEQ ID NO: 4990 - DNA, 28 bp, Artificial Sequence
  Description of Artificial Sequence: Synthetic oligonucleotide
gtccagatgatgtatggctgcgacgtgg

SEQ ID NO: 4991 - DNA, 28 bp, Artificial Sequence
  Description of Artificial Sequence: Synthetic oligonucleotide
agatgatgtatggctgcgacgtggggtc

SEQ ID NO: 4992 - DNA, 27 bp, Artificial Sequence
  Description of Artificial Sequence: Synthetic oligonucleotide
gatgatgtatggctgcgacgtggggtc

SEQ ID NO: 4993 - DNA, 27 bp, Artificial Sequence
  Description of Artificial Sequence: Synthetic oligonucleotide
atgatgtatggctgcgacgtggggtcg

SEQ ID NO: 4994 - DNA, 26 bp, Artificial Sequence
  Description of Artificial Sequence: Synthetic oligonucleotide
tgatgtatggctgcgacgtggggtcg

SEQ ID NO: 4995 - DNA, 30 bp, Artificial Sequence
  Description of Artificial Sequence: Synthetic oligonucleotide
gcgggctctcactccatgaggtatttctac

SEQ ID NO: 4996 - DNA, 31 bp, Artificial Sequence
  Description of Artificial Sequence: Synthetic oligonucleotide
cgggctctcactccatgaggtatttctacac

SEQ ID NO: 4997 - DNA, 31 bp, Artificial Sequence
  Description of Artificial Sequence: Synthetic oligonucleotide
gggctctcactccatgaggtatttctacacc

SEQ ID NO: 4998 - DNA, 32 bp, Artificial Sequence
  Description of Artificial Sequence: Synthetic oligonucleotide
ggctctcactccatgaggtatttctacacctc

SEQ ID NO: 4999 - DNA, 32 bp, Artificial Sequence
  Description of Artificial Sequence: Synthetic oligonucleotide
gctctcactccatgaggtatttctacacctcc

SEQ ID NO: 5000 - DNA, 32 bp, Artificial Sequence
  Description of Artificial Sequence: Synthetic oligonucleotide
ctctcactccatgaggtatttctacacctccg

SEQ ID NO: 5001 - DNA, 33 bp, Artificial Sequence
  Description of Artificial Sequence: Synthetic oligonucleotide
tctcactccatgaggtatttctacacctccgtg

SEQ ID NO: 5002 - DNA, 32 bp, Artificial Sequence
  Description of Artificial Sequence: Synthetic oligonucleotide
ctcactccatgaggtatttctacacctccgtg

SEQ ID NO: 5003 - DNA, 33 bp, Artificial Sequence
  Description of Artificial Sequence: Synthetic oligonucleotide
tcactccatgaggtatttctacacctccgtgtc

SEQ ID NO: 5004 - DNA, 27 bp, Artificial Sequence
  Description of Artificial Sequence: Synthetic oligonucleotide
gtggagtggctccgcagatacctggaa

SEQ ID NO: 5005 - DNA, 29 bp, Artificial Sequence
  Description of Artificial Sequence: Synthetic oligonucleotide
tggagtggctccgcagatacctggaaaac

SEQ ID NO: 5006 - DNA, 28 bp, Artificial Sequence
  Description of Artificial Sequence: Synthetic oligonucleotide
ggagtggctccgcagatacctggaaaac

SEQ ID NO: 5007 - DNA, 28 bp, Artificial Sequence
  Description of Artificial Sequence: Synthetic oligonucleotide
gagtggctccgcagatacctggaaaacg

SEQ ID NO: 5008 - DNA, 28 bp, Artificial Sequence
  Description of Artificial Sequence: Synthetic oligonucleotide
agtggctccgcagatacctggaaaacgg

SEQ ID NO: 5009 - DNA, 27 bp, Artificial Sequence
  Description of Artificial Sequence: Synthetic oligonucleotide
gtggctccgcagatacctggaaaacgg

SEQ ID NO: 5010 - DNA, 27 bp, Artificial Sequence
  Description of Artificial Sequence: Synthetic oligonucleotide
tggctccgcagatacctggaaaacggg

SEQ ID NO: 5011 - DNA, 27 bp, Artificial Sequence
  Description of Artificial Sequence: Synthetic oligonucleotide
ggctccgcagatacctggaaaacggga

SEQ ID NO: 5012 - DNA, 28 bp, Artificial Sequence
  Description of Artificial Sequence: Synthetic oligonucleotide
gctccgcagatacctggaaaacgggaag

SEQ ID NO: 5013 - DNA, 28 bp, Artificial Sequence
  Description of Artificial Sequence: Synthetic oligonucleotide
ctccgcagatacctggaaaacgggaagg

SEQ ID NO: 5014 - DNA, 29 bp, Artificial Sequence
  Description of Artificial Sequence: Synthetic oligonucleotide
tccgcagatacctggaaaacgggaaggag

SEQ ID NO: 5015 - DNA, 28 bp, Artificial Sequence
  Description of Artificial Sequence: Synthetic oligonucleotide
ccgcagatacctggaaaacgggaaggag

SEQ ID NO: 5016 - DNA, 29 bp, Artificial Sequence
  Description of Artificial Sequence: Synthetic oligonucleotide
cgcagatacctggaaaacgggaaggagac

SEQ ID NO: 5017 - DNA, 29 bp, Artificial Sequence
  Description of Artificial Sequence: Synthetic oligonucleotide
gcagatacctggaaaacgggaaggagacg

SEQ ID NO: 5018 - DNA, 29 bp, Artificial Sequence
  Description of Artificial Sequence: Synthetic oligonucleotide
cagatacctggaaaacgggaaggagacgc

SEQ ID NO: 5019 - DNA, 30 bp, Artificial Sequence
  Description of Artificial Sequence: Synthetic oligonucleotide
agatacctggaaaacgggaaggagacgctg

SEQ ID NO: 5020 - DNA, 29 bp, Artificial Sequence
  Description of Artificial Sequence: Synthetic oligonucleotide
gatacctggaaaacgggaaggagacgctg

SEQ ID NO: 5021 - DNA, 29 bp, Artificial Sequence
  Description of Artificial Sequence: Synthetic oligonucleotide
atacctggaaaacgggaaggagacgctgc

SEQ ID NO: 5022 - DNA, 28 bp, Artificial Sequence
  Description of Artificial Sequence: Synthetic oligonucleotide
tacctggaaaacgggaaggagacgctgc

SEQ ID NO: 5023 - DNA, 27 bp, Artificial Sequence
  Description of Artificial Sequence: Synthetic oligonucleotide
acctggaaaacgggaaggagacgctgc

SEQ ID NO: 5024 - DNA, 27 bp, Artificial Sequence
  Description of Artificial Sequence: Synthetic oligonucleotide
cctggaaaacgggaaggagacgctgca

SEQ ID NO: 5025 - DNA, 27 bp, Artificial Sequence
  Description of Artificial Sequence: Synthetic oligonucleotide
ctggaaaacgggaaggagacgctgcag

SEQ ID NO: 5026 - DNA, 27 bp, Artificial Sequence
  Description of Artificial Sequence: Synthetic oligonucleotide
tggaaaacgggaaggagacgctgcagc

SEQ ID NO: 5027 - DNA, 26 bp, Artificial Sequence
  Description of Artificial Sequence: Synthetic oligonucleotide
ggaaaacgggaaggagacgctgcagc

SEQ ID NO: 5028 - DNA, 26 bp, Artificial Sequence
  Description of Artificial Sequence: Synthetic oligonucleotide
gaaaacgggaaggagacgctgcagcg

SEQ ID NO: 5029 - DNA, 27 bp, Artificial Sequence
  Description of Artificial Sequence: Synthetic oligonucleotide
aaaacgggaaggagacgctgcagcgca

SEQ ID NO: 5030 - DNA, 26 bp, Artificial Sequence
  Description of Artificial Sequence: Synthetic oligonucleotide
aaacgggaaggagacgctgcagcgca

SEQ ID NO: 5031 - DNA, 26 bp, Artificial Sequence
  Description of Artificial Sequence: Synthetic oligonucleotide
atcgccctgaaagaggacctgcgctc

SEQ ID NO: 5032 - DNA, 25 bp, Artificial Sequence
  Description of Artificial Sequence: Synthetic oligonucleotide
tcgccctgaaagaggacctgcgctc

SEQ ID NO: 5033 - DNA, 24 bp, Artificial Sequence
  Description of Artificial Sequence: Synthetic oligonucleotide
cgccctgaaagaggacctgcgctc

SEQ ID NO: 5034 - DNA, 25 bp, Artificial Sequence
  Description of Artificial Sequence: Synthetic oligonucleotide
gccctgaaagaggacctgcgctcct

SEQ ID NO: 5035 - DNA, 25 bp, Artificial Sequence
  Description of Artificial Sequence: Synthetic oligonucleotide
ccctgaaagaggacctgcgctcctg

SEQ ID NO: 5036 - DNA, 26 bp, Artificial Sequence
  Description of Artificial Sequence: Synthetic oligonucleotide
cctgaaagaggacctgcgctcctgga

SEQ ID NO: 5037 - DNA, 26 bp, Artificial Sequence
  Description of Artificial Sequence: Synthetic oligonucleotide
ctgaaagaggacctgcgctcctggac

SEQ ID NO: 5038 - DNA, 26 bp, Artificial Sequence
  Description of Artificial Sequence: Synthetic oligonucleotide
tgaaagaggacctgcgctcctggacc

SEQ ID NO: 5039 - DNA, 25 bp, Artificial Sequence
  Description of Artificial Sequence: Synthetic oligonucleotide
gaaagaggacctgcgctcctggacc

SEQ ID NO: 5040 - DNA, 25 bp, Artificial Sequence
  Description of Artificial Sequence: Synthetic oligonucleotide
aaagaggacctgcgctcctggaccg

SEQ ID NO: 5041 - DNA, 24 bp, Artificial Sequence
  Description of Artificial Sequence: Synthetic oligonucleotide
aagaggacctgcgctcctggaccg

SEQ ID NO: 5042 - DNA, 23 bp, Artificial Sequence
  Description of Artificial Sequence: Synthetic oligonucleotide
agaggacctgcgctcctggaccg

SEQ ID NO: 5043 - DNA, 22 bp, Artificial Sequence
  Description of Artificial Sequence: Synthetic oligonucleotide
gaggacctgcgctcctggaccg

SEQ ID NO: 5044 - DNA, 22 bp, Artificial Sequence
  Description of Artificial Sequence: Synthetic oligonucleotide
aggacctgcgctcctggaccgc

SEQ ID NO: 5045 - DNA, 21 bp, Artificial Sequence
  Description of Artificial Sequence: Synthetic oligonucleotide
ggacctgcgctcctggaccgc

SEQ ID NO: 5046 - DNA, 21 bp, Artificial Sequence
  Description of Artificial Sequence: Synthetic oligonucleotide
gacctgcgctcctggaccgcg

SEQ ID NO: 5047 - DNA, 21 bp, Artificial Sequence
  Description of Artificial Sequence: Synthetic oligonucleotide
acctgcgctcctggaccgcgg

SEQ ID NO: 5048 - DNA, 20 bp, Artificial Sequence
  Description of Artificial Sequence: Synthetic oligonucleotide
cctgcgctcctggaccgcgg

SEQ ID NO: 5049 - DNA, 20 bp, Artificial Sequence
  Description of Artificial Sequence: Synthetic oligonucleotide
ctgcgctcctggaccgcggc

SEQ ID NO: 5050 - DNA, 20 bp, Artificial Sequence
  Description of Artificial Sequence: Synthetic oligonucleotide
tgcgctcctggaccgcggcg

SEQ ID NO: 5051 - DNA, 20 bp, Artificial Sequence
  Description of Artificial Sequence: Synthetic oligonucleotide
gcgctcctggaccgcggcgt

SEQ ID NO: 5052 - DNA, 20 bp, Artificial Sequence
  Description of Artificial Sequence: Synthetic oligonucleotide
cgctcctggaccgcggcgga

SEQ ID NO: 5053 - DNA, 22 bp, Artificial Sequence
  Description of Artificial Sequence: Synthetic oligonucleotide
gctcctggaccgcggcggacat

SEQ ID NO: 5054 - DNA, 22 bp, Artificial Sequence
  Description of Artificial Sequence: Synthetic oligonucleotide
ctcctggaccgcggcggacatg

SEQ ID NO: 5055 - DNA, 22 bp, Artificial Sequence
  Description of Artificial Sequence: Synthetic oligonucleotide
tcctggaccgcggcggacatgg

SEQ ID NO: 5056 - DNA, 21 bp, Artificial Sequence
  Description of Artificial Sequence: Synthetic oligonucleotide
cctggaccgcggcggacatgg

SEQ ID NO: 5057 - DNA, 22 bp, Artificial Sequence
  Description of Artificial Sequence: Synthetic oligonucleotide
ctggaccgcggcggacatggca

SEQ ID NO: 5058 - DNA, 32 bp, Artificial Sequence
  Description of Artificial Sequence: Synthetic oligonucleotide
gctcccactccatgaggtatttctacacttcc

SEQ ID NO: 5059 - DNA, 32 bp, Artificial Sequence
  Description of Artificial Sequence: Synthetic oligonucleotide
ctcccactccatgaggtatttctacacttccg

SEQ ID NO: 5060 - DNA, 33 bp, Artificial Sequence
  Description of Artificial Sequence: Synthetic oligonucleotide
tcccactccatgaggtatttctacacttccgtg

SEQ ID NO: 5061 - DNA, 32 bp, Artificial Sequence
  Description of Artificial Sequence: Synthetic oligonucleotide
cccactccatgaggtatttctacacttccgtg

SEQ ID NO: 5062 - DNA, 33 bp, Artificial Sequence
  Description of Artificial Sequence: Synthetic oligonucleotide
ccactccatgaggtatttctacacttccgtgtc

SEQ ID NO: 5063 - DNA, 33 bp, Artificial Sequence
  Description of Artificial Sequence: Synthetic oligonucleotide
cactccatgaggtatttctacacttccgtgtcc

SEQ ID NO: 5064 - DNA, 33 bp, Artificial Sequence
  Description of Artificial Sequence: Synthetic oligonucleotide
actccatgaggtatttctacacttccgtgtccc

SEQ ID NO: 5065 - DNA, 32 bp, Artificial Sequence
  Description of Artificial Sequence: Synthetic oligonucleotide
ctccatgaggtatttctacacttccgtgtccc

SEQ ID NO: 5066 - DNA, 32 bp, Artificial Sequence
  Description of Artificial Sequence: Synthetic oligonucleotide
tccatgaggtatttctacacttccgtgtcccg

SEQ ID NO: 5067 - DNA, 31 bp, Artificial Sequence
  Description of Artificial Sequence: Synthetic oligonucleotide
ccatgaggtatttctacacttccgtgtcccg

SEQ ID NO: 5068 - DNA, 31 bp, Artificial Sequence
  Description of Artificial Sequence: Synthetic oligonucleotide
catgaggtatttctacacttccgtgtcccgg

SEQ ID NO: 5069 - DNA, 31 bp, Artificial Sequence
  Description of Artificial Sequence: Synthetic oligonucleotide
atgaggtatttctacacttccgtgtcccggc

SEQ ID NO: 5070 - DNA, 30 bp, Artificial Sequence
  Description of Artificial Sequence: Synthetic oligonucleotide
tgaggtatttctacacttccgtgtcccggc

SEQ ID NO: 5071 - DNA, 29 bp, Artificial Sequence
  Description of Artificial Sequence: Synthetic oligonucleotide
gaggtatttctacacttccgtgtcccggc

SEQ ID NO: 5072 - DNA, 29 bp, Artificial Sequence
  Description of Artificial Sequence: Synthetic oligonucleotide
aggtatttctacacttccgtgtcccggcc

SEQ ID NO: 5073 - DNA, 28 bp, Artificial Sequence
  Description of Artificial Sequence: Synthetic oligonucleotide
ggtatttctacacttccgtgtcccggcc

SEQ ID NO: 5074 - DNA, 28 bp, Artificial Sequence
  Description of Artificial Sequence: Synthetic oligonucleotide
gtatttctacacttccgtgtcccggccc

SEQ ID NO: 5075 - DNA, 28 bp, Artificial Sequence
  Description of Artificial Sequence: Synthetic oligonucleotide
tatttctacacttccgtgtcccggcccg

SEQ ID NO: 5076 - DNA, 27 bp, Artificial Sequence
  Description of Artificial Sequence: Synthetic oligonucleotide
atttctacacttccgtgtcccggcccg

SEQ ID NO: 5077 - DNA, 26 bp, Artificial Sequence
  Description of Artificial Sequence: Synthetic oligonucleotide
tttctacacttccgtgtcccggcccg

SEQ ID NO: 5078 - DNA, 25 bp, Artificial Sequence
  Description of Artificial Sequence: Synthetic oligonucleotide
ttctacacttccgtgtcccggcccg

SEQ ID NO: 5079 - DNA, 24 bp, Artificial Sequence
  Description of Artificial Sequence: Synthetic oligonucleotide
tctacacttccgtgtcccggcccg

SEQ ID NO: 5080 - DNA, 23 bp, Artificial Sequence
  Description of Artificial Sequence: Synthetic oligonucleotide
ctacacttccgtgtcccggcccg

SEQ ID NO: 5081 - DNA, 23 bp, Artificial Sequence
  Description of Artificial Sequence: Synthetic oligonucleotide
tacacttccgtgtcccggcccgg

SEQ ID NO: 5082 - DNA, 22 bp, Artificial Sequence
  Description of Artificial Sequence: Synthetic oligonucleotide
acacttccgtgtcccggcccgg

SEQ ID NO: 5083 - DNA, 21 bp, Artificial Sequence
  Description of Artificial Sequence: Synthetic oligonucleotide
cacttccgtgtcccggcccgg

SEQ ID NO: 5084 - DNA, 21 bp, Artificial Sequence
  Description of Artificial Sequence: Synthetic oligonucleotide
acttccgtgtcccggcccggc

SEQ ID NO: 5085 - DNA, 20 bp, Artificial Sequence
  Description of Artificial Sequence: Synthetic oligonucleotide
cttccgtgtcccggcccggc

SEQ ID NO: 5086 - DNA, 20 bp, Artificial Sequence
  Description of Artificial Sequence: Synthetic oligonucleotide
ttccgtgtcccggcccggcc

SEQ ID NO: 5087 - DNA, 23 bp, Artificial Sequence
  Description of Artificial Sequence: Synthetic oligonucleotide
acctgcgctcttggaccgcggca

SEQ ID NO: 5088 - DNA, 22 bp, Artificial Sequence
  Description of Artificial Sequence: Synthetic oligonucleotide
cctgcgctcttggaccgcggca

SEQ ID NO: 5089 - DNA, 23 bp, Artificial Sequence
  Description of Artificial Sequence: Synthetic oligonucleotide
ctgcgctcttggaccgcggcaga

SEQ ID NO: 5090 - DNA, 25 bp, Artificial Sequence
  Description of Artificial Sequence: Synthetic oligonucleotide
tgcgctcttggaccgcggcagacat

SEQ ID NO: 5091 - DNA, 24 bp, Artificial Sequence
  Description of Artificial Sequence: Synthetic oligonucleotide
gcgctcttggaccgcggcagacat

SEQ ID NO: 5092 - DNA, 24 bp, Artificial Sequence
  Description of Artificial Sequence: Synthetic oligonucleotide
cgctcttggaccgcggcagacatg

SEQ ID NO: 5093 - DNA, 24 bp, Artificial Sequence
  Description of Artificial Sequence: Synthetic oligonucleotide
gctcttggaccgcggcagacatgg

SEQ ID NO: 5094 - DNA, 25 bp, Artificial Sequence
  Description of Artificial Sequence: Synthetic oligonucleotide
ctcttggaccgcggcagacatggca

SEQ ID NO: 5095 - DNA, 25 bp, Artificial Sequence
  Description of Artificial Sequence: Synthetic oligonucleotide
tcttggaccgcggcagacatggcag

SEQ ID NO: 5096 - DNA, 24 bp, Artificial Sequence
  Description of Artificial Sequence: Synthetic oligonucleotide
cttggaccgcggcagacatggcag

SEQ ID NO: 5097 - DNA, 25 bp, Artificial Sequence
  Description of Artificial Sequence: Synthetic oligonucleotide
ttggaccgcggcagacatggcagct

SEQ ID NO: 5098 - DNA, 24 bp, Artificial Sequence
  Description of Artificial Sequence: Synthetic oligonucleotide
tggaccgcggcagacatggcagct

SEQ ID NO: 5099 - DNA, 23 bp, Artificial Sequence
  Description of Artificial Sequence: Synthetic oligonucleotide
ggaccgcggcagacatggcagct

SEQ ID NO: 5100 - DNA, 24 bp, Artificial Sequence
  Description of Artificial Sequence: Synthetic oligonucleotide
gaccgcggcagacatggcagctca

SEQ ID NO: 5101 - DNA, 25 bp, Artificial Sequence
  Description of Artificial Sequence: Synthetic oligonucleotide
accgcggcagacatggcagctcaga

SEQ ID NO: 5102 - DNA, 24 bp, Artificial Sequence
  Description of Artificial Sequence: Synthetic oligonucleotide
ccgcggcagacatggcagctcaga

SEQ ID NO: 5103 - DNA, 24 bp, Artificial Sequence
  Description of Artificial Sequence: Synthetic oligonucleotide
cgcggcagacatggcagctcagac

SEQ ID NO: 5104 - DNA, 25 bp, Artificial Sequence
  Description of Artificial Sequence: Synthetic oligonucleotide
gcggcagacatggcagctcagacca

SEQ ID NO: 5105 - DNA, 25 bp, Artificial Sequence
  Description of Artificial Sequence: Synthetic oligonucleotide
cggcagacatggcagctcagaccac

SEQ ID NO: 5106 - DNA, 27 bp, Artificial Sequence
  Description of Artificial Sequence: Synthetic oligonucleotide
ggcagacatggcagctcagaccaccaa

SEQ ID NO: 5107 - DNA, 27 bp, Artificial Sequence
  Description of Artificial Sequence: Synthetic oligonucleotide
gcagacatggcagctcagaccaccaag

SEQ ID NO: 5108 - DNA, 27 bp, Artificial Sequence
  Description of Artificial Sequence: Synthetic oligonucleotide
cagacatggcagctcagaccaccaagc

SEQ ID NO: 5109 - DNA, 28 bp, Artificial Sequence
  Description of Artificial Sequence: Synthetic oligonucleotide
agacatggcagctcagaccaccaagcac

SEQ ID NO: 5110 - DNA, 24 bp, Artificial Sequence
  Description of Artificial Sequence: Synthetic oligonucleotide
gtggggtcggactggcgcttcctt

SEQ ID NO: 5111 - DNA, 24 bp, Artificial Sequence
  Description of Artificial Sequence: Synthetic oligonucleotide
tggggtcggactggcgcttccttc

SEQ ID NO: 5112 - DNA, 23 bp, Artificial Sequence
  Description of Artificial Sequence: Synthetic oligonucleotide
ggggtcggactggcgcttccttc

SEQ ID NO: 5113 - DNA, 23 bp, Artificial Sequence
  Description of Artificial Sequence: Synthetic oligonucleotide
gggtcggactggcgcttccttcg

SEQ ID NO: 5114 - DNA, 23 bp, Artificial Sequence
  Description of Artificial Sequence: Synthetic oligonucleotide
ggtcggactggcgcttccttcgc

SEQ ID NO: 5115 - DNA, 23 bp, Artificial Sequence
  Description of Artificial Sequence: Synthetic oligonucleotide
gtcggactggcgcttccttcgcg

SEQ ID NO: 5116 - DNA, 23 bp, Artificial Sequence
  Description of Artificial Sequence: Synthetic oligonucleotide
tcggactggcgcttccttcgcgg

SEQ ID NO: 5117 - DNA, 22 bp, Artificial Sequence
  Description of Artificial Sequence: Synthetic oligonucleotide
cggactggcgcttccttcgcgg

SEQ ID NO: 5118 - DNA, 24 bp, Artificial Sequence
  Description of Artificial Sequence: Synthetic oligonucleotide
ggactggcgcttccttcgcgggta

SEQ ID NO: 5119 - DNA, 24 bp, Artificial Sequence
  Description of Artificial Sequence: Synthetic oligonucleotide
gactggcgcttccttcgcgggtac

SEQ ID NO: 5120 - DNA, 25 bp, Artificial Sequence
  Description of Artificial Sequence: Synthetic oligonucleotide
actggcgcttccttcgcgggtacca

SEQ ID NO: 5121 - DNA, 24 bp, Artificial Sequence
  Description of Artificial Sequence: Synthetic oligonucleotide
ctggcgcttccttcgcgggtacca

SEQ ID NO: 5122 - DNA, 24 bp, Artificial Sequence
  Description of Artificial Sequence: Synthetic oligonucleotide
tggcgcttccttcgcgggtaccac

SEQ ID NO: 5123 - DNA, 23 bp, Artificial Sequence
  Description of Artificial Sequence: Synthetic oligonucleotide
ggcgcttccttcgcgggtaccac

SEQ ID NO: 5124 - DNA, 24 bp, Artificial Sequence
  Description of Artificial Sequence: Synthetic oligonucleotide
gcgcttccttcgcgggtaccacca

SEQ ID NO: 5125 - DNA, 26 bp, Artificial Sequence
  Description of Artificial Sequence: Synthetic oligonucleotide
cgcttccttcgcgggtaccaccagta

SEQ ID NO: 5126 - DNA, 26 bp, Artificial Sequence
  Description of Artificial Sequence: Synthetic oligonucleotide
gcttccttcgcgggtaccaccagtac

SEQ ID NO: 5127 - DNA, 26 bp, Artificial Sequence
  Description of Artificial Sequence: Synthetic oligonucleotide
cttccttcgcgggtaccaccagtacg

SEQ ID NO: 5128 - DNA, 26 bp, Artificial Sequence
  Description of Artificial Sequence: Synthetic oligonucleotide
ttccttcgcgggtaccaccagtacgc

SEQ ID NO: 5129 - DNA, 25 bp, Artificial Sequence
  Description of Artificial Sequence: Synthetic oligonucleotide
tccttcgcgggtaccaccagtacgc

SEQ ID NO: 5130 - DNA, 24 bp, Artificial Sequence
  Description of Artificial Sequence: Synthetic oligonucleotide
ccttcgcgggtaccaccagtacgc

SEQ ID NO: 5131 - DNA, 26 bp, Artificial Sequence
  Description of Artificial Sequence: Synthetic oligonucleotide
cttcgcgggtaccaccagtacgccta

SEQ ID NO: 5132 - DNA, 26 bp, Artificial Sequence
  Description of Artificial Sequence: Synthetic oligonucleotide
ttcgcgggtaccaccagtacgcctac

SEQ ID NO: 5133 - DNA, 25 bp, Artificial Sequence
  Description of Artificial Sequence: Synthetic oligonucleotide
tcgcgggtaccaccagtacgcctac

SEQ ID NO: 5134 - DNA, 27 bp, Artificial Sequence
  Description of Artificial Sequence: Synthetic oligonucleotide
cggttctcacaccgtccagaggatgtg

SEQ ID NO: 5135 - DNA, 28 bp, Artificial Sequence
  Description of Artificial Sequence: Synthetic oligonucleotide
ggttctcacaccgtccagaggatgtgtg

SEQ ID NO: 5136 - DNA, 28 bp, Artificial Sequence
  Description of Artificial Sequence: Synthetic oligonucleotide
gttctcacaccgtccagaggatgtgtgg

SEQ ID NO: 5137 - DNA, 28 bp, Artificial Sequence
  Description of Artificial Sequence: Synthetic oligonucleotide
ttctcacaccgtccagaggatgtgtggc

SEQ ID NO: 5138 - DNA, 27 bp, Artificial Sequence
  Description of Artificial Sequence: Synthetic oligonucleotide
tctcacaccgtccagaggatgtgtggc

SEQ ID NO: 5139 - DNA, 27 bp, Artificial Sequence
  Description of Artificial Sequence: Synthetic oligonucleotide
ctcacaccgtccagaggatgtgtggct

SEQ ID NO: 5140 - DNA, 27 bp, Artificial Sequence
  Description of Artificial Sequence: Synthetic oligonucleotide
tcacaccgtccagaggatgtgtggctg

SEQ ID NO: 5141 - DNA, 26 bp, Artificial Sequence
  Description of Artificial Sequence: Synthetic oligonucleotide
cacaccgtccagaggatgtgtggctg

SEQ ID NO: 5142 - DNA, 26 bp, Artificial Sequence
  Description of Artificial Sequence: Synthetic oligonucleotide
acaccgtccagaggatgtgtggctgc

SEQ ID NO: 5143 - DNA, 25 bp, Artificial Sequence
  Description of Artificial Sequence: Synthetic oligonucleotide
caccgtccagaggatgtgtggctgc

SEQ ID NO: 5144 - DNA, 26 bp, Artificial Sequence
  Description of Artificial Sequence: Synthetic oligonucleotide
accgtccagaggatgtgtggctgcga

SEQ ID NO: 5145 - DNA, 25 bp, Artificial Sequence
  Description of Artificial Sequence: Synthetic oligonucleotide
ccgtccagaggatgtgtggctgcga

SEQ ID NO: 5146 - DNA, 25 bp, Artificial Sequence
  Description of Artificial Sequence: Synthetic oligonucleotide
cgtccagaggatgtgtggctgcgac

SEQ ID NO: 5147 - DNA, 26 bp, Artificial Sequence
  Description of Artificial Sequence: Synthetic oligonucleotide
gtccagaggatgtgtggctgcgacgt

SEQ ID NO: 5148 - DNA, 26 bp, Artificial Sequence
  Description of Artificial Sequence: Synthetic oligonucleotide
tccagaggatgtgtggctgcgacgtg

SEQ ID NO: 5149 - DNA, 25 bp, Artificial Sequence
  Description of Artificial Sequence: Synthetic oligonucleotide
ccagaggatgtgtggctgcgacgtg

SEQ ID NO: 5150 - DNA, 25 bp, Artificial Sequence
  Description of Artificial Sequence: Synthetic oligonucleotide
cagaggatgtgtggctgcgacgtgg

SEQ ID NO: 5151 - DNA, 25 bp, Artificial Sequence
  Description of Artificial Sequence: Synthetic oligonucleotide
agaggatgtgtggctgcgacgtggg

SEQ ID NO: 5152 - DNA, 24 bp, Artificial Sequence
  Description of Artificial Sequence: Synthetic oligonucleotide
gaggatgtgtggctgcgacgtggg

SEQ ID NO: 5153 - DNA, 25 bp, Artificial Sequence
  Description of Artificial Sequence: Synthetic oligonucleotide
aggatgtgtggctgcgacgtggggt

SEQ ID NO: 5154 - DNA, 24 bp, Artificial Sequence
  Description of Artificial Sequence: Synthetic oligonucleotide
ggatgtgtggctgcgacgtggggt

SEQ ID NO: 5155 - DNA, 24 bp, Artificial Sequence
  Description of Artificial Sequence: Synthetic oligonucleotide
gatgtgtggctgcgacgtggggtc

SEQ ID NO: 5156 - DNA, 24 bp, Artificial Sequence
  Description of Artificial Sequence: Synthetic oligonucleotide
atgtgtggctgcgacgtggggtcg

SEQ ID NO: 5157 - DNA, 23 bp, Artificial Sequence
  Description of Artificial Sequence: Synthetic oligonucleotide
tgtgtggctgcgacgtggggtcg

SEQ ID NO: 5158 - DNA, 22 bp, Artificial Sequence
  Description of Artificial Sequence: Synthetic oligonucleotide
gtgtggctgcgacgtggggtcg

SEQ ID NO: 5159 - DNA, 23 bp, Artificial Sequence
  Description of Artificial Sequence: Synthetic oligonucleotide
tgtggctgcgacgtggggtcgga

SEQ ID NO: 5160 - DNA, 22 bp, Artificial Sequence
  Description of Artificial Sequence: Synthetic oligonucleotide
gtggctgcgacgtggggtcgga

SEQ ID NO: 5161 - DNA, 28 bp, Artificial Sequence
  Description of Artificial Sequence: Synthetic oligonucleotide
gagtattgggacggggagacacggaatg

SEQ ID NO: 5162 - DNA, 29 bp, Artificial Sequence
  Description of Artificial Sequence: Synthetic oligonucleotide
agtattgggacggggagacacggaatgtg

SEQ ID NO: 5163 - DNA, 28 bp, Artificial Sequence
  Description of Artificial Sequence: Synthetic oligonucleotide
gtattgggacggggagacacggaatgtg

SEQ ID NO: 5164 - DNA, 30 bp, Artificial Sequence
  Description of Artificial Sequence: Synthetic oligonucleotide
tattgggacggggagacacggaatgtgaag

SEQ ID NO: 5165 - DNA, 29 bp, Artificial Sequence
  Description of Artificial Sequence: Synthetic oligonucleotide
attgggacggggagacacggaatgtgaag

SEQ ID NO: 5166 - DNA, 28 bp, Artificial Sequence
  Description of Artificial Sequence: Synthetic oligonucleotide
ttgggacggggagacacggaatgtgaag

SEQ ID NO: 5167 - DNA, 27 bp, Artificial Sequence
  Description of Artificial Sequence: Synthetic oligonucleotide
tgggacggggagacacggaatgtgaag

SEQ ID NO: 5168 - DNA, 26 bp, Artificial Sequence
  Description of Artificial Sequence: Synthetic oligonucleotide
gggacggggagacacggaatgtgaag

SEQ ID NO: 5169 - DNA, 26 bp, Artificial Sequence
  Description of Artificial Sequence: Synthetic oligonucleotide
ggacggggagacacggaatgtgaagg

SEQ ID NO: 5170 - DNA, 26 bp, Artificial Sequence
  Description of Artificial Sequence: Synthetic oligonucleotide
gacggggagacacggaatgtgaaggc

SEQ ID NO: 5171 - DNA, 26 bp, Artificial Sequence
  Description of Artificial Sequence: Synthetic oligonucleotide
acggggagacacggaatgtgaaggcc

SEQ ID NO: 5172 - DNA, 25 bp, Artificial Sequence
  Description of Artificial Sequence: Synthetic oligonucleotide
cggggagacacggaatgtgaaggcc

SEQ ID NO: 5173 - DNA, 26 bp, Artificial Sequence
  Description of Artificial Sequence: Synthetic oligonucleotide
ggggagacacggaatgtgaaggccca

SEQ ID NO: 5174 - DNA, 27 bp, Artificial Sequence
  Description of Artificial Sequence: Synthetic oligonucleotide
gggagacacggaatgtgaaggcccact

SEQ ID NO: 5175 - DNA, 29 bp, Artificial Sequence
  Description of Artificial Sequence: Synthetic oligonucleotide
acggaatgtgaaggcccactcacagactc

SEQ ID NO: 5176 - DNA, 28 bp, Artificial Sequence
  Description of Artificial Sequence: Synthetic oligonucleotide
cggaatgtgaaggcccactcacagactc

SEQ ID NO: 5177 - DNA, 29 bp, Artificial Sequence
  Description of Artificial Sequence: Synthetic oligonucleotide
ggaatgtgaaggcccactcacagactcac

SEQ ID NO: 5178 - DNA, 29 bp, Artificial Sequence
  Description of Artificial Sequence: Synthetic oligonucleotide
gaatgtgaaggcccactcacagactcacc

SEQ ID NO: 5179 - DNA, 29 bp, Artificial Sequence
  Description of Artificial Sequence: Synthetic oligonucleotide
aatgtgaaggcccactcacagactcaccg

SEQ ID NO: 5180 - DNA, 28 bp, Artificial Sequence
  Description of Artificial Sequence: Synthetic oligonucleotide
atgtgaaggcccactcacagactcaccg

SEQ ID NO: 5181 - DNA, 27 bp, Artificial Sequence
  Description of Artificial Sequence: Synthetic oligonucleotide
tgtgaaggcccactcacagactcaccg

SEQ ID NO: 5182 - DNA, 25 bp, Artificial Sequence
  Description of Artificial Sequence: Synthetic oligonucleotide
ggagctcgtggagaccaggcctgaa

SEQ ID NO: 5183 - DNA, 25 bp, Artificial Sequence
  Description of Artificial Sequence: Synthetic oligonucleotide
gagctcgtggagaccaggcctgaag

SEQ ID NO: 5184 - DNA, 25 bp, Artificial Sequence
  Description of Artificial Sequence: Synthetic oligonucleotide
agctcgtggagaccaggcctgaagg

SEQ ID NO: 5185 - DNA, 24 bp, Artificial Sequence
  Description of Artificial Sequence: Synthetic oligonucleotide
gctcgtggagaccaggcctgaagg

SEQ ID NO: 5186 - DNA, 24 bp, Artificial Sequence
  Description of Artificial Sequence: Synthetic oligonucleotide
ctcgtggagaccaggcctgaaggg

SEQ ID NO: 5187 - DNA, 26 bp, Artificial Sequence
  Description of Artificial Sequence: Synthetic oligonucleotide
tcgtggagaccaggcctgaaggggat

SEQ ID NO: 5188 - DNA, 25 bp, Artificial Sequence
  Description of Artificial Sequence: Synthetic oligonucleotide
cgtggagaccaggcctgaaggggat

SEQ ID NO: 5189 - DNA, 25 bp, Artificial Sequence
  Description of Artificial Sequence: Synthetic oligonucleotide
gtggagaccaggcctgaaggggatg

SEQ ID NO: 5190 - DNA, 27 bp, Artificial Sequence
  Description of Artificial Sequence: Synthetic oligonucleotide
tggagaccaggcctgaaggggatggaa

SEQ ID NO: 5191 - DNA, 26 bp, Artificial Sequence
  Description of Artificial Sequence: Synthetic oligonucleotide
ggagaccaggcctgaaggggatggaa

SEQ ID NO: 5192 - DNA, 26 bp, Artificial Sequence
  Description of Artificial Sequence: Synthetic oligonucleotide
gagaccaggcctgaaggggatggaac

SEQ ID NO: 5193 - DNA, 27 bp, Artificial Sequence
  Description of Artificial Sequence: Synthetic oligonucleotide
agaccaggcctgaaggggatggaacct

SEQ ID NO: 5194 - DNA, 27 bp, Artificial Sequence
  Description of Artificial Sequence: Synthetic oligonucleotide
gaccaggcctgaaggggatggaacctt

SEQ ID NO: 5195 - DNA, 27 bp, Artificial Sequence
  Description of Artificial Sequence: Synthetic oligonucleotide
accaggcctgaaggggatggaaccttc

SEQ ID NO: 5196 - DNA, 26 bp, Artificial Sequence
  Description of Artificial Sequence: Synthetic oligonucleotide
ccaggcctgaaggggatggaaccttc

SEQ ID NO: 5197 - DNA, 27 bp, Artificial Sequence
  Description of Artificial Sequence: Synthetic oligonucleotide
caggcctgaaggggatggaaccttcca

SEQ ID NO: 5198 - DNA, 27 bp, Artificial Sequence
  Description of Artificial Sequence: Synthetic oligonucleotide
aggcctgaaggggatggaaccttccag

SEQ ID NO: 5199 - DNA, 27 bp, Artificial Sequence
  Description of Artificial Sequence: Synthetic oligonucleotide
ggcctgaaggggatggaaccttccaga

SEQ ID NO: 5200 - DNA, 28 bp, Artificial Sequence
  Description of Artificial Sequence: Synthetic oligonucleotide
gcctgaaggggatggaaccttccagaag

SEQ ID NO: 5201 - DNA, 29 bp, Artificial Sequence
  Description of Artificial Sequence: Synthetic oligonucleotide
cctgaaggggatggaaccttccagaagtg

SEQ ID NO: 5202 - DNA, 29 bp, Artificial Sequence
  Description of Artificial Sequence: Synthetic oligonucleotide
ctgaaggggatggaaccttccagaagtgg

SEQ ID NO: 5203 - DNA, 29 bp, Artificial Sequence
  Description of Artificial Sequence: Synthetic oligonucleotide
tgaaggggatggaaccttccagaagtggg

SEQ ID NO: 5204 - DNA, 28 bp, Artificial Sequence
  Description of Artificial Sequence: Synthetic oligonucleotide
gaaggggatggaaccttccagaagtggg

SEQ ID NO: 5205 - DNA, 28 bp, Artificial Sequence
  Description of Artificial Sequence: Synthetic oligonucleotide
aaggggatggaaccttccagaagtgggc

SEQ ID NO: 5206 - DNA, 29 bp, Artificial Sequence
  Description of Artificial Sequence: Synthetic oligonucleotide
cggttctcacaccgtccagaggatgtttg

SEQ ID NO: 5207 - DNA, 29 bp, Artificial Sequence
  Description of Artificial Sequence: Synthetic oligonucleotide
ggttctcacaccgtccagaggatgtttgg

SEQ ID NO: 5208 - DNA, 29 bp, Artificial Sequence
  Description of Artificial Sequence: Synthetic oligonucleotide
gttctcacaccgtccagaggatgtttggc

SEQ ID NO: 5209 - DNA, 30 bp, Artificial Sequence
  Description of Artificial Sequence: Synthetic oligonucleotide
ttctcacaccgtccagaggatgtttggctg

SEQ ID NO: 5210 - DNA, 29 bp, Artificial Sequence
  Description of Artificial Sequence: Synthetic oligonucleotide
tctcacaccgtccagaggatgtttggctg

SEQ ID NO: 5211 - DNA, 28 bp, Artificial Sequence
  Description of Artificial Sequence: Synthetic oligonucleotide
ctcacaccgtccagaggatgtttggctg

SEQ ID NO: 5212 - DNA, 28 bp, Artificial Sequence
  Description of Artificial Sequence: Synthetic oligonucleotide
tcacaccgtccagaggatgtttggctgc

SEQ ID NO: 5213 - DNA, 27 bp, Artificial Sequence
  Description of Artificial Sequence: Synthetic oligonucleotide
cacaccgtccagaggatgtttggctgc

SEQ ID NO: 5214 - DNA, 27 bp, Artificial Sequence
  Description of Artificial Sequence: Synthetic oligonucleotide
acaccgtccagaggatgtttggctgcg

SEQ ID NO: 5215 - DNA, 27 bp, Artificial Sequence
  Description of Artificial Sequence: Synthetic oligonucleotide
caccgtccagaggatgtttggctgcga

SEQ ID NO: 5216 - DNA, 27 bp, Artificial Sequence
  Description of Artificial Sequence: Synthetic oligonucleotide
accgtccagaggatgtttggctgcgac

SEQ ID NO: 5217 - DNA, 26 bp, Artificial Sequence
  Description of Artificial Sequence: Synthetic oligonucleotide
ccgtccagaggatgtttggctgcgac

SEQ ID NO: 5218 - DNA, 27 bp, Artificial Sequence
  Description of Artificial Sequence: Synthetic oligonucleotide
cgtccagaggatgtttggctgcgacgt

SEQ ID NO: 5219 - DNA, 27 bp, Artificial Sequence
  Description of Artificial Sequence: Synthetic oligonucleotide
gtccagaggatgtttggctgcgacgtg

SEQ ID NO: 5220 - DNA, 27 bp, Artificial Sequence
  Description of Artificial Sequence: Synthetic oligonucleotide
tccagaggatgtttggctgcgacgtgg

SEQ ID NO: 5221 - DNA, 26 bp, Artificial Sequence
  Description of Artificial Sequence: Synthetic oligonucleotide
ccagaggatgtttggctgcgacgtgg

SEQ ID NO: 5222 - DNA, 26 bp, Artificial Sequence
  Description of Artificial Sequence: Synthetic oligonucleotide
cagaggatgtttggctgcgacgtggg

SEQ ID NO: 5223 - DNA, 27 bp, Artificial Sequence
  Description of Artificial Sequence: Synthetic oligonucleotide
agaggatgtttggctgcgacgtggggt

SEQ ID NO: 5224 - DNA, 26 bp, Artificial Sequence
  Description of Artificial Sequence: Synthetic oligonucleotide
gaggatgtttggctgcgacgtggggt

SEQ ID NO: 5225 - DNA, 26 bp, Artificial Sequence
  Description of Artificial Sequence: Synthetic oligonucleotide
aggatgtttggctgcgacgtggggtc

SEQ ID NO: 5226 - DNA, 25 bp, Artificial Sequence
  Description of Artificial Sequence: Synthetic oligonucleotide
ggatgtttggctgcgacgtggggtc

SEQ ID NO: 5227 - DNA, 25 bp, Artificial Sequence
  Description of Artificial Sequence: Synthetic oligonucleotide
gatgtttggctgcgacgtggggtcg

SEQ ID NO: 5228 - DNA, 26 bp, Artificial Sequence
  Description of Artificial Sequence: Synthetic oligonucleotide
atgtttggctgcgacgtggggtcgga

SEQ ID NO: 5229 - DNA, 25 bp, Artificial Sequence
  Description of Artificial Sequence: Synthetic oligonucleotide
tgtttggctgcgacgtggggtcgga

SEQ ID NO: 5230 - DNA, 24 bp, Artificial Sequence
  Description of Artificial Sequence: Synthetic oligonucleotide
gtttggctgcgacgtggggtcgga

SEQ ID NO: 5231 - DNA, 24 bp, Artificial Sequence
  Description of Artificial Sequence: Synthetic oligonucleotide
tttggctgcgacgtggggtcggac

SEQ ID NO: 5232 - DNA, 23 bp, Artificial Sequence
  Description of Artificial Sequence: Synthetic oligonucleotide
ttggctgcgacgtggggtcggac

SEQ ID NO: 5233 - DNA, 22 bp, Artificial Sequence
  Description of Artificial Sequence: Synthetic oligonucleotide
tggctgcgacgtggggtcggac

SEQ ID NO: 5234 - DNA, 21 bp, Artificial Sequence
  Description of Artificial Sequence: Synthetic oligonucleotide
ggctgcgacgtggggtcggac

SEQ ID NO: 5235 - DNA, 21 bp, Artificial Sequence
  Description of Artificial Sequence: Synthetic oligonucleotide
gctgcgacgtggggtcggacg

SEQ ID NO: 5236 - DNA, 21 bp, Artificial Sequence
  Description of Artificial Sequence: Synthetic oligonucleotide
ctgcgacgtggggtcggacgg

SEQ ID NO: 5237 - DNA, 21 bp, Artificial Sequence
  Description of Artificial Sequence: Synthetic oligonucleotide
tgcgacgtggggtcggacggg

SEQ ID NO: 5238 - DNA, 20 bp, Artificial Sequence
  Description of Artificial Sequence: Synthetic oligonucleotide
gcgacgtggggtcggacggg

SEQ ID NO: 5239 - DNA, 20 bp, Artificial Sequence
  Description of Artificial Sequence: Synthetic oligonucleotide
cgacgtggggtcggacgggc

SEQ ID NO: 5240 - DNA, 20 bp, Artificial Sequence
  Description of Artificial Sequence: Synthetic oligonucleotide
gacgtggggtcggacgggcg

SEQ ID NO: 5241 - DNA, 22 bp, Artificial Sequence
  Description of Artificial Sequence: Synthetic oligonucleotide
acgtggggtcggacgggcgctt

SEQ ID NO: 5242 - DNA, 21 bp, Artificial Sequence
  Description of Artificial Sequence: Synthetic oligonucleotide
cgtggggtcggacgggcgctt

SEQ ID NO: 5243 - DNA, 21 bp, Artificial Sequence
  Description of Artificial Sequence: Synthetic oligonucleotide
gtggggtcggacgggcgcttc

SEQ ID NO: 5244 - DNA, 22 bp, Artificial Sequence
  Description of Artificial Sequence: Synthetic oligonucleotide
tggggtcggacgggcgcttcct

SEQ ID NO: 5245 - DNA, 21 bp, Artificial Sequence
  Description of Artificial Sequence: Synthetic oligonucleotide
ggggtcggacgggcgcttcct

SEQ ID NO: 5246 - DNA, 21 bp, Artificial Sequence
  Description of Artificial Sequence: Synthetic oligonucleotide
gggtcggacgggcgcttcctc

SEQ ID NO: 5247 - DNA, 21 bp, Artificial Sequence
  Description of Artificial Sequence: Synthetic oligonucleotide
ggtcggacgggcgcttcctcc

SEQ ID NO: 5248 - DNA, 21 bp, Artificial Sequence
  Description of Artificial Sequence: Synthetic oligonucleotide
gtcggacgggcgcttcctccg

SEQ ID NO: 5249 - DNA, 21 bp, Artificial Sequence
  Description of Artificial Sequence: Synthetic oligonucleotide
tcggacgggcgcttcctccgc

SEQ ID NO: 5250 - DNA, 22 bp, Artificial Sequence
  Description of Artificial Sequence: Synthetic oligonucleotide
ctggagggccggtgcgtggagt

SEQ ID NO: 5251 - DNA, 22 bp, Artificial Sequence
  Description of Artificial Sequence: Synthetic oligonucleotide
tggagggccggtgcgtggagtg

SEQ ID NO: 5252 - DNA, 21 bp, Artificial Sequence
  Description of Artificial Sequence: Synthetic oligonucleotide
ggagggccggtgcgtggagtg

SEQ ID NO: 5253 - DNA, 21 bp, Artificial Sequence
  Description of Artificial Sequence: Synthetic oligonucleotide
gagggccggtgcgtggagtgg

SEQ ID NO: 5254 - DNA, 22 bp, Artificial Sequence
  Description of Artificial Sequence: Synthetic oligonucleotide
agggccggtgcgtggagtggct

SEQ ID NO: 5255 - DNA, 21 bp, Artificial Sequence
  Description of Artificial Sequence: Synthetic oligonucleotide
gggccggtgcgtggagtggct

SEQ ID NO: 5256 - DNA, 21 bp, Artificial Sequence
  Description of Artificial Sequence: Synthetic oligonucleotide
ggccggtgcgtggagtggctc

SEQ ID NO: 5257 - DNA, 21 bp, Artificial Sequence
  Description of Artificial Sequence: Synthetic oligonucleotide
gccggtgcgtggagtggctcc

SEQ ID NO: 5258 - DNA, 21 bp, Artificial Sequence
  Description of Artificial Sequence: Synthetic oligonucleotide
ccggtgcgtggagtggctccg

SEQ ID NO: 5259 - DNA, 22 bp, Artificial Sequence
  Description of Artificial Sequence: Synthetic oligonucleotide
cggtgcgtggagtggctccgca

SEQ ID NO: 5260 - DNA, 25 bp, Artificial Sequence
  Description of Artificial Sequence: Synthetic oligonucleotide
ggtgcgtggagtggctccgcagata

SEQ ID NO: 5261 - DNA, 27 bp, Artificial Sequence
  Description of Artificial Sequence: Synthetic oligonucleotide
caggagacacggaatgtgaaggcccag

SEQ ID NO: 5262 - DNA, 28 bp, Artificial Sequence
  Description of Artificial Sequence: Synthetic oligonucleotide
aggagacacggaatgtgaaggcccagtc

SEQ ID NO: 5263 - DNA, 27 bp, Artificial Sequence
  Description of Artificial Sequence: Synthetic oligonucleotide
ggagacacggaatgtgaaggcccagtc

SEQ ID NO: 5264 - DNA, 28 bp, Artificial Sequence
  Description of Artificial Sequence: Synthetic oligonucleotide
gagacacggaatgtgaaggcccagtcac

SEQ ID NO: 5265 - DNA, 29 bp, Artificial Sequence
  Description of Artificial Sequence: Synthetic oligonucleotide
agacacggaatgtgaaggcccagtcacag

SEQ ID NO: 5266 - DNA, 28 bp, Artificial Sequence
  Description of Artificial Sequence: Synthetic oligonucleotide
gacacggaatgtgaaggcccagtcacag

SEQ ID NO: 5267 - DNA, 29 bp, Artificial Sequence
  Description of Artificial Sequence: Synthetic oligonucleotide
acacggaatgtgaaggcccagtcacagac

SEQ ID NO: 5268 - DNA, 28 bp, Artificial Sequence
  Description of Artificial Sequence: Synthetic oligonucleotide
cacggaatgtgaaggcccagtcacagac

SEQ ID NO: 5269 - DNA, 29 bp, Artificial Sequence
  Description of Artificial Sequence: Synthetic oligonucleotide
acggaatgtgaaggcccagtcacagactc

SEQ ID NO: 5270 - DNA, 28 bp, Artificial Sequence
  Description of Artificial Sequence: Synthetic oligonucleotide
cggaatgtgaaggcccagtcacagactc

SEQ ID NO: 5271 - DNA, 29 bp, Artificial Sequence
  Description of Artificial Sequence: Synthetic oligonucleotide
ggaatgtgaaggcccagtcacagactcac

SEQ ID NO: 5272 - DNA, 29 bp, Artificial Sequence
  Description of Artificial Sequence: Synthetic oligonucleotide
gaatgtgaaggcccagtcacagactcacc

SEQ ID NO: 5273 - DNA, 29 bp, Artificial Sequence
  Description of Artificial Sequence: Synthetic oligonucleotide
aatgtgaaggcccagtcacagactcaccg

SEQ ID NO: 5274 - DNA, 28 bp, Artificial Sequence
  Description of Artificial Sequence: Synthetic oligonucleotide
atgtgaaggcccagtcacagactcaccg

SEQ ID NO: 5275 - DNA, 27 bp, Artificial Sequence
  Description of Artificial Sequence: Synthetic oligonucleotide
tgtgaaggcccagtcacagactcaccg

SEQ ID NO: 5276 - DNA, 27 bp, Artificial Sequence
  Description of Artificial Sequence: Synthetic oligonucleotide
gtgaaggcccagtcacagactcaccga

SEQ ID NO: 5277 - DNA, 27 bp, Artificial Sequence
  Description of Artificial Sequence: Synthetic oligonucleotide
tgaaggcccagtcacagactcaccgag

SEQ ID NO: 5278 - DNA, 27 bp, Artificial Sequence
  Description of Artificial Sequence: Synthetic oligonucleotide
gaaggcccagtcacagactcaccgagt

SEQ ID NO: 5279 - DNA, 27 bp, Artificial Sequence
  Description of Artificial Sequence: Synthetic oligonucleotide
aaggcccagtcacagactcaccgagtg

SEQ ID NO: 5280 - DNA, 26 bp, Artificial Sequence
  Description of Artificial Sequence: Synthetic oligonucleotide
aggcccagtcacagactcaccgagtg

SEQ ID NO: 5281 - DNA, 25 bp, Artificial Sequence
  Description of Artificial Sequence: Synthetic oligonucleotide
ggcccagtcacagactcaccgagtg

SEQ ID NO: 5282 - DNA, 26 bp, Artificial Sequence
  Description of Artificial Sequence: Synthetic oligonucleotide
gcccagtcacagactcaccgagtgga

SEQ ID NO: 5283 - DNA, 26 bp, Artificial Sequence
  Description of Artificial Sequence: Synthetic oligonucleotide
cccagtcacagactcaccgagtggac

SEQ ID NO: 5284 - DNA, 27 bp, Artificial Sequence
  Description of Artificial Sequence: Synthetic oligonucleotide
ccagtcacagactcaccgagtggacct

SEQ ID NO: 5285 - DNA, 27 bp, Artificial Sequence
  Description of Artificial Sequence: Synthetic oligonucleotide
cagtcacagactcaccgagtggacctg

SEQ ID NO: 5286 - DNA, 27 bp, Artificial Sequence
  Description of Artificial Sequence: Synthetic oligonucleotide
agtcacagactcaccgagtggacctgg

SEQ ID NO: 5287 - DNA, 26 bp, Artificial Sequence
  Description of Artificial Sequence: Synthetic oligonucleotide
gtcacagactcaccgagtggacctgg

SEQ ID NO: 5288 - DNA, 26 bp, Artificial Sequence
  Description of Artificial Sequence: Synthetic oligonucleotide
gagaccaggcctgcaggggatggaaa

SEQ ID NO: 5289 - DNA, 27 bp, Artificial Sequence
  Description of Artificial Sequence: Synthetic oligonucleotide
agaccaggcctgcaggggatggaaact

SEQ ID NO: 5290 - DNA, 27 bp, Artificial Sequence
  Description of Artificial Sequence: Synthetic oligonucleotide
gaccaggcctgcaggggatggaaactt

SEQ ID NO: 5291 - DNA, 27 bp, Artificial Sequence
  Description of Artificial Sequence: Synthetic oligonucleotide
accaggcctgcaggggatggaaacttc

SEQ ID NO: 5292 - DNA, 26 bp, Artificial Sequence
  Description of Artificial Sequence: Synthetic oligonucleotide
ccaggcctgcaggggatggaaacttc

SEQ ID NO: 5293 - DNA, 27 bp, Artificial Sequence
  Description of Artificial Sequence: Synthetic oligonucleotide
caggcctgcaggggatggaaacttcca

SEQ ID NO: 5294 - DNA, 27 bp, Artificial Sequence
  Description of Artificial Sequence: Synthetic oligonucleotide
aggcctgcaggggatggaaacttccag

SEQ ID NO: 5295 - DNA, 27 bp, Artificial Sequence
  Description of Artificial Sequence: Synthetic oligonucleotide
ggcctgcaggggatggaaacttccaga

SEQ ID NO: 5296 - DNA, 28 bp, Artificial Sequence
  Description of Artificial Sequence: Synthetic oligonucleotide
gcctgcaggggatggaaacttccagaag

SEQ ID NO: 5297 - DNA, 29 bp, Artificial Sequence
  Description of Artificial Sequence: Synthetic oligonucleotide
cctgcaggggatggaaacttccagaagtg

SEQ ID NO: 5298 - DNA, 29 bp, Artificial Sequence
  Description of Artificial Sequence: Synthetic oligonucleotide
ctgcaggggatggaaacttccagaagtgg

SEQ ID NO: 5299 - DNA, 29 bp, Artificial Sequence
  Description of Artificial Sequence: Synthetic oligonucleotide
tgcaggggatggaaacttccagaagtggg

SEQ ID NO: 5300 - DNA, 28 bp, Artificial Sequence
  Description of Artificial Sequence: Synthetic oligonucleotide
gcaggggatggaaacttccagaagtggg

SEQ ID NO: 5301 - DNA, 28 bp, Artificial Sequence
  Description of Artificial Sequence: Synthetic oligonucleotide
caggggatggaaacttccagaagtgggc

SEQ ID NO: 5302 - DNA, 28 bp, Artificial Sequence
  Description of Artificial Sequence: Synthetic oligonucleotide
aggggatggaaacttccagaagtgggcg

SEQ ID NO: 5303 - DNA, 27 bp, Artificial Sequence
  Description of Artificial Sequence: Synthetic oligonucleotide
ggggatggaaacttccagaagtgggcg

SEQ ID NO: 5304 - DNA, 27 bp, Artificial Sequence
  Description of Artificial Sequence: Synthetic oligonucleotide
gggatggaaacttccagaagtgggcgg

SEQ ID NO: 5305 - DNA, 27 bp, Artificial Sequence
  Description of Artificial Sequence: Synthetic oligonucleotide
ggatggaaacttccagaagtgggcggc

SEQ ID NO: 5306 - DNA, 28 bp, Artificial Sequence
  Description of Artificial Sequence: Synthetic oligonucleotide
gatggaaacttccagaagtgggcggctg

SEQ ID NO: 5307 - DNA, 29 bp, Artificial Sequence
  Description of Artificial Sequence: Synthetic oligonucleotide
atggaaacttccagaagtgggcggctgtg

SEQ ID NO: 5308 - DNA, 28 bp, Artificial Sequence
  Description of Artificial Sequence: Synthetic oligonucleotide
tggaaacttccagaagtgggcggctgtg

SEQ ID NO: 5309 - DNA, 27 bp, Artificial Sequence
  Description of Artificial Sequence: Synthetic oligonucleotide
ggaaacttccagaagtgggcggctgtg

SEQ ID NO: 5310 - DNA, 27 bp, Artificial Sequence
  Description of Artificial Sequence: Synthetic oligonucleotide
gaaacttccagaagtgggcggctgtgg

SEQ ID NO: 5311 - DNA, 28 bp, Artificial Sequence
  Description of Artificial Sequence: Synthetic oligonucleotide
aaacttccagaagtgggcggctgtggtg

SEQ ID NO: 5312 - DNA, 27 bp, Artificial Sequence
  Description of Artificial Sequence: Synthetic oligonucleotide
aacttccagaagtgggcggctgtggtg

SEQ ID NO: 5313 - DNA, 26 bp, Artificial Sequence
  Description of Artificial Sequence: Synthetic oligonucleotide
acttccagaagtgggcggctgtggtg

SEQ ID NO: 5314 - DNA, 23 bp, Artificial Sequence
  Description of Artificial Sequence: Synthetic oligonucleotide
cgtcttcccagcccaccatcccc

SEQ ID NO: 5315 - DNA, 24 bp, Artificial Sequence
  Description of Artificial Sequence: Synthetic oligonucleotide
gactggcgcttcctccgcgggtat

SEQ ID NO: 5316 - DNA, 25 bp, Artificial Sequence
  Description of Artificial Sequence: Synthetic oligonucleotide
actggcgcttcctccgcgggtatga

SEQ ID NO: 5317 - DNA, 24 bp, Artificial Sequence
  Description of Artificial Sequence: Synthetic oligonucleotide
ctggcgcttcctccgcgggtatga

SEQ ID NO: 5318 - DNA, 24 bp, Artificial Sequence
  Description of Artificial Sequence: Synthetic oligonucleotide
tggcgcttcctccgcgggtatgag

SEQ ID NO: 5319 - DNA, 23 bp, Artificial Sequence
  Description of Artificial Sequence: Synthetic oligonucleotide
ggcgcttcctccgcgggtatgag

SEQ ID NO: 5320 - DNA, 24 bp, Artificial Sequence
  Description of Artificial Sequence: Synthetic oligonucleotide
gcgcttcctccgcgggtatgagca

SEQ ID NO: 5321 - DNA, 27 bp, Artificial Sequence
  Description of Artificial Sequence: Synthetic oligonucleotide
cgcttcctccgcgggtatgagcagtat

SEQ ID NO: 5322 - DNA, 27 bp, Artificial Sequence
  Description of Artificial Sequence: Synthetic oligonucleotide
gcttcctccgcgggtatgagcagtatg

SEQ ID NO: 5323 - DNA, 27 bp, Artificial Sequence
  Description of Artificial Sequence: Synthetic oligonucleotide
cttcctccgcgggtatgagcagtatgc

SEQ ID NO: 5324 - DNA, 27 bp, Artificial Sequence
  Description of Artificial Sequence: Synthetic oligonucleotide
ttcctccgcgggtatgagcagtatgcc

SEQ ID NO: 5325 - DNA, 27 bp, Artificial Sequence
  Description of Artificial Sequence: Synthetic oligonucleotide
tcctccgcgggtatgagcagtatgcct

SEQ ID NO: 5326 - DNA, 27 bp, Artificial Sequence
  Description of Artificial Sequence: Synthetic oligonucleotide
cctccgcgggtatgagcagtatgccta

SEQ ID NO: 5327 - DNA, 27 bp, Artificial Sequence
  Description of Artificial Sequence: Synthetic oligonucleotide
ctccgcgggtatgagcagtatgcctac

SEQ ID NO: 5328 - DNA, 27 bp, Artificial Sequence
  Description of Artificial Sequence: Synthetic oligonucleotide
tccgcgggtatgagcagtatgcctacg

SEQ ID NO: 5329 - DNA, 27 bp, Artificial Sequence
  Description of Artificial Sequence: Synthetic oligonucleotide
ccgcgggtatgagcagtatgcctacga

SEQ ID NO: 5330 - DNA, 27 bp, Artificial Sequence
  Description of Artificial Sequence: Synthetic oligonucleotide
cgcgggtatgagcagtatgcctacgac

SEQ ID NO: 5331 - DNA, 27 bp, Artificial Sequence
  Description of Artificial Sequence: Synthetic oligonucleotide
gcgggtatgagcagtatgcctacgacg

SEQ ID NO: 5332 - DNA, 27 bp, Artificial Sequence
  Description of Artificial Sequence: Synthetic oligonucleotide
cgggtatgagcagtatgcctacgacgg

SEQ ID NO: 5333 - DNA, 27 bp, Artificial Sequence
  Description of Artificial Sequence: Synthetic oligonucleotide
gggtatgagcagtatgcctacgacggc

SEQ ID NO: 5334 - DNA, 29 bp, Artificial Sequence
  Description of Artificial Sequence: Synthetic oligonucleotide
ggtatgagcagtatgcctacgacggcaag

SEQ ID NO: 5335 - DNA, 29 bp, Artificial Sequence
  Description of Artificial Sequence: Synthetic oligonucleotide
gtatgagcagtatgcctacgacggcaagg

SEQ ID NO: 5336 - DNA, 33 bp, Artificial Sequence
  Description of Artificial Sequence: Synthetic oligonucleotide
tatgagcagtatgcctacgacggcaaggattac

SEQ ID NO: 5337 - DNA, 32 bp, Artificial Sequence
  Description of Artificial Sequence: Synthetic oligonucleotide
atgagcagtatgcctacgacggcaaggattac

SEQ ID NO: 5338 - DNA, 31 bp, Artificial Sequence
  Description of Artificial Sequence: Synthetic oligonucleotide
tgagcagtatgcctacgacggcaaggattac

SEQ ID NO: 5339 - DNA, 30 bp, Artificial Sequence
  Description of Artificial Sequence: Synthetic oligonucleotide
gagcagtatgcctacgacggcaaggattac

SEQ ID NO: 5340 - DNA, 32 bp, Artificial Sequence
  Description of Artificial Sequence: Synthetic oligonucleotide
agcagtatgcctacgacggcaaggattacatc

SEQ ID NO: 5341 - DNA, 31 bp, Artificial Sequence
  Description of Artificial Sequence: Synthetic oligonucleotide
gcagtatgcctacgacggcaaggattacatc

SEQ ID NO: 5342 - DNA, 31 bp, Artificial Sequence
  Description of Artificial Sequence: Synthetic oligonucleotide
cagtatgcctacgacggcaaggattacatcg

SEQ ID NO: 5343 - DNA, 31 bp, Artificial Sequence
  Description of Artificial Sequence: Synthetic oligonucleotide
agtatgcctacgacggcaaggattacatcgc

SEQ ID NO: 5344 - DNA, 30 bp, Artificial Sequence
  Description of Artificial Sequence: Synthetic oligonucleotide
gtatgcctacgacggcaaggattacatcgc

SEQ ID NO: 5345 - DNA, 30 bp, Artificial Sequence
  Description of Artificial Sequence: Synthetic oligonucleotide
tatgcctacgacggcaaggattacatcgcc

SEQ ID NO: 5346 - DNA, 29 bp, Artificial Sequence
  Description of Artificial Sequence: Synthetic oligonucleotide
atgcctacgacggcaaggattacatcgcc

SEQ ID NO: 5347 - DNA, 28 bp, Artificial Sequence
  Description of Artificial Sequence: Synthetic oligonucleotide
tgcctacgacggcaaggattacatcgcc

SEQ ID NO: 5348 - DNA, 25 bp, Artificial Sequence
  Description of Artificial Sequence: Synthetic oligonucleotide
acaagtgggaggcggcccatgtggt

SEQ ID NO: 5349 - DNA, 24 bp, Artificial Sequence
  Description of Artificial Sequence: Synthetic oligonucleotide
caagtgggaggcggcccatgtggt

SEQ ID NO: 5350 - DNA, 24 bp, Artificial Sequence
  Description of Artificial Sequence: Synthetic oligonucleotide
aagtgggaggcggcccatgtggtg

SEQ ID NO: 5351 - DNA, 23 bp, Artificial Sequence
  Description of Artificial Sequence: Synthetic oligonucleotide
agtgggaggcggcccatgtggtg

SEQ ID NO: 5352 - DNA, 22 bp, Artificial Sequence
  Description of Artificial Sequence: Synthetic oligonucleotide
gtgggaggcggcccatgtggtg

SEQ ID NO: 5353 - DNA, 23 bp, Artificial Sequence
  Description of Artificial Sequence: Synthetic oligonucleotide
tgggaggcggcccatgtggtgga

SEQ ID NO: 5354 - DNA, 22 bp, Artificial Sequence
  Description of Artificial Sequence: Synthetic oligonucleotide
gggaggcggcccatgtggtgga

SEQ ID NO: 5355 - DNA, 22 bp, Artificial Sequence
  Description of Artificial Sequence: Synthetic oligonucleotide
ggaggcggcccatgtggtggag

SEQ ID NO: 5356 - DNA, 23 bp, Artificial Sequence
  Description of Artificial Sequence: Synthetic oligonucleotide
gaggcggcccatgtggtggagca

SEQ ID NO: 5357 - DNA, 25 bp, Artificial Sequence
  Description of Artificial Sequence: Synthetic oligonucleotide
aggcggcccatgtggtggagcagtt

SEQ ID NO: 5358 - DNA, 24 bp, Artificial Sequence
  Description of Artificial Sequence: Synthetic oligonucleotide
ggcggcccatgtggtggagcagtt

SEQ ID NO: 5359 - DNA, 25 bp, Artificial Sequence
  Description of Artificial Sequence: Synthetic oligonucleotide
gcggcccatgtggtggagcagttga

SEQ ID NO: 5360 - DNA, 26 bp, Artificial Sequence
  Description of Artificial Sequence: Synthetic oligonucleotide
cggcccatgtggtggagcagttgaga

SEQ ID NO: 5361 - DNA, 26 bp, Artificial Sequence
  Description of Artificial Sequence: Synthetic oligonucleotide
ggcccatgtggtggagcagttgagag

SEQ ID NO: 5362 - DNA, 26 bp, Artificial Sequence
  Description of Artificial Sequence: Synthetic oligonucleotide
gcccatgtggtggagcagttgagagc

SEQ ID NO: 5363 - DNA, 27 bp, Artificial Sequence
  Description of Artificial Sequence: Synthetic oligonucleotide
cccatgtggtggagcagttgagagcct

SEQ ID NO: 5364 - DNA, 28 bp, Artificial Sequence
  Description of Artificial Sequence: Synthetic oligonucleotide
ccatgtggtggagcagttgagagcctac

SEQ ID NO: 5365 - DNA, 28 bp, Artificial Sequence
  Description of Artificial Sequence: Synthetic oligonucleotide
catgtggtggagcagttgagagcctacc

SEQ ID NO: 5366 - DNA, 29 bp, Artificial Sequence
  Description of Artificial Sequence: Synthetic oligonucleotide
atgtggtggagcagttgagagcctacctg

SEQ ID NO: 5367 - DNA, 28 bp, Artificial Sequence
  Description of Artificial Sequence: Synthetic oligonucleotide
tgtggtggagcagttgagagcctacctg

SEQ ID NO: 5368 - DNA, 27 bp, Artificial Sequence
  Description of Artificial Sequence: Synthetic oligonucleotide
gtggtggagcagttgagagcctacctg

SEQ ID NO: 5369 - DNA, 27 bp, Artificial Sequence
  Description of Artificial Sequence: Synthetic oligonucleotide
tggtggagcagttgagagcctacctgg

SEQ ID NO: 5370 - DNA, 27 bp, Artificial Sequence
  Description of Artificial Sequence: Synthetic oligonucleotide
ggtggagcagttgagagcctacctgga

SEQ ID NO: 5371 - DNA, 27 bp, Artificial Sequence
  Description of Artificial Sequence: Synthetic oligonucleotide
gtggagcagttgagagcctacctggag

SEQ ID NO: 5372 - DNA, 27 bp, Artificial Sequence
  Description of Artificial Sequence: Synthetic oligonucleotide
tggagcagttgagagcctacctggagg

SEQ ID NO: 5373 - DNA, 22 bp, Artificial Sequence
  Description of Artificial Sequence: Synthetic oligonucleotide
agaggatggagccgcgggcgct

SEQ ID NO: 5374 - DNA, 21 bp, Artificial Sequence
  Description of Artificial Sequence: Synthetic oligonucleotide
gaggatggagccgcgggcgct

SEQ ID NO: 5375 - DNA, 22 bp, Artificial Sequence
  Description of Artificial Sequence: Synthetic oligonucleotide
aggatggagccgcgggcgctgt

SEQ ID NO: 5376 - DNA, 21 bp, Artificial Sequence
  Description of Artificial Sequence: Synthetic oligonucleotide
ggatggagccgcgggcgctgt

SEQ ID NO: 5377 - DNA, 21 bp, Artificial Sequence
  Description of Artificial Sequence: Synthetic oligonucleotide
gatggagccgcgggcgctgtg

SEQ ID NO: 5378 - DNA, 24 bp, Artificial Sequence
  Description of Artificial Sequence: Synthetic oligonucleotide
atggagccgcgggcgctgtggata

SEQ ID NO: 5379 - DNA, 23 bp, Artificial Sequence
  Description of Artificial Sequence: Synthetic oligonucleotide
tggagccgcgggcgctgtggata

SEQ ID NO: 5380 - DNA, 22 bp, Artificial Sequence
  Description of Artificial Sequence: Synthetic oligonucleotide
ggagccgcgggcgctgtggata

SEQ ID NO: 5381 - DNA, 23 bp, Artificial Sequence
  Description of Artificial Sequence: Synthetic oligonucleotide
gagccgcgggcgctgtggataga

SEQ ID NO: 5382 - DNA, 23 bp, Artificial Sequence
  Description of Artificial Sequence: Synthetic oligonucleotide
agccgcgggcgctgtggatagag

SEQ ID NO: 5383 - DNA, 22 bp, Artificial Sequence
  Description of Artificial Sequence: Synthetic oligonucleotide
gccgcgggcgctgtggatagag

SEQ ID NO: 5384 - DNA, 23 bp, Artificial Sequence
  Description of Artificial Sequence: Synthetic oligonucleotide
ccgcgggcgctgtggatagagca

SEQ ID NO: 5385 - DNA, 23 bp, Artificial Sequence
  Description of Artificial Sequence: Synthetic oligonucleotide
cgcgggcgctgtggatagagcag

SEQ ID NO: 5386 - DNA, 24 bp, Artificial Sequence
  Description of Artificial Sequence: Synthetic oligonucleotide
gcgggcgctgtggatagagcagga

SEQ ID NO: 5387 - DNA, 24 bp, Artificial Sequence
  Description of Artificial Sequence: Synthetic oligonucleotide
cgggcgctgtggatagagcaggag

SEQ ID NO: 5388 - DNA, 24 bp, Artificial Sequence
  Description of Artificial Sequence: Synthetic oligonucleotide
gggcgctgtggatagagcaggagg

SEQ ID NO: 5389 - DNA, 25 bp, Artificial Sequence
  Description of Artificial Sequence: Synthetic oligonucleotide
ggcgctgtggatagagcaggagggt

SEQ ID NO: 5390 - DNA, 25 bp, Artificial Sequence
  Description of Artificial Sequence: Synthetic oligonucleotide
gcgctgtggatagagcaggagggtc

SEQ ID NO: 5391 - DNA, 25 bp, Artificial Sequence
  Description of Artificial Sequence: Synthetic oligonucleotide
cgctgtggatagagcaggagggtcc

SEQ ID NO: 5392 - DNA, 25 bp, Artificial Sequence
  Description of Artificial Sequence: Synthetic oligonucleotide
gctgtggatagagcaggagggtccg

SEQ ID NO: 5393 - DNA, 26 bp, Artificial Sequence
  Description of Artificial Sequence: Synthetic oligonucleotide
ctgtggatagagcaggagggtccgga

SEQ ID NO: 5394 - DNA, 27 bp, Artificial Sequence
  Description of Artificial Sequence: Synthetic oligonucleotide
tgtggatagagcaggagggtccggagt

SEQ ID NO: 5395 - DNA, 26 bp, Artificial Sequence
  Description of Artificial Sequence: Synthetic oligonucleotide
gaggccggttctcacaccctccagat

SEQ ID NO: 5396 - DNA, 27 bp, Artificial Sequence
  Description of Artificial Sequence: Synthetic oligonucleotide
aggccggttctcacaccctccagatga

SEQ ID NO: 5397 - DNA, 27 bp, Artificial Sequence
  Description of Artificial Sequence: Synthetic oligonucleotide
ggccggttctcacaccctccagatgat

SEQ ID NO: 5398 - DNA, 27 bp, Artificial Sequence
  Description of Artificial Sequence: Synthetic oligonucleotide
gccggttctcacaccctccagatgatg

SEQ ID NO: 5399 - DNA, 30 bp, Artificial Sequence
  Description of Artificial Sequence: Synthetic oligonucleotide
ccggttctcacaccctccagatgatgtttg

SEQ ID NO: 5400 - DNA, 30 bp, Artificial Sequence
  Description of Artificial Sequence: Synthetic oligonucleotide
cggttctcacaccctccagatgatgtttgg

SEQ ID NO: 5401 - DNA, 30 bp, Artificial Sequence
  Description of Artificial Sequence: Synthetic oligonucleotide
ggttctcacaccctccagatgatgtttggc

SEQ ID NO: 5402 - DNA, 31 bp, Artificial Sequence
  Description of Artificial Sequence: Synthetic oligonucleotide
gttctcacaccctccagatgatgtttggctg

SEQ ID NO: 5403 - DNA, 31 bp, Artificial Sequence
  Description of Artificial Sequence: Synthetic oligonucleotide
ttctcacaccctccagatgatgtttggctgc

SEQ ID NO: 5404 - DNA, 30 bp, Artificial Sequence
  Description of Artificial Sequence: Synthetic oligonucleotide
tctcacaccctccagatgatgtttggctgc

SEQ ID NO: 5405 - DNA, 29 bp, Artificial Sequence
  Description of Artificial Sequence: Synthetic oligonucleotide
ctcacaccctccagatgatgtttggctgc

SEQ ID NO: 5406 - DNA, 29 bp, Artificial Sequence
  Description of Artificial Sequence: Synthetic oligonucleotide
tcacaccctccagatgatgtttggctgcg

SEQ ID NO: 5407 - DNA, 28 bp, Artificial Sequence
  Description of Artificial Sequence: Synthetic oligonucleotide
cacaccctccagatgatgtttggctgcg

SEQ ID NO: 5408 - DNA, 29 bp, Artificial Sequence
  Description of Artificial Sequence: Synthetic oligonucleotide
acaccctccagatgatgtttggctgcgac

SEQ ID NO: 5409 - DNA, 28 bp, Artificial Sequence
  Description of Artificial Sequence: Synthetic oligonucleotide
caccctccagatgatgtttggctgcgac

SEQ ID NO: 5410 - DNA, 28 bp, Artificial Sequence
  Description of Artificial Sequence: Synthetic oligonucleotide
accctccagatgatgtttggctgcgacg

SEQ ID NO: 5411 - DNA, 27 bp, Artificial Sequence
  Description of Artificial Sequence: Synthetic oligonucleotide
ccctccagatgatgtttggctgcgacg

SEQ ID NO: 5412 - DNA, 28 bp, Artificial Sequence
  Description of Artificial Sequence: Synthetic oligonucleotide
cctccagatgatgtttggctgcgacgtg

SEQ ID NO: 5413 - DNA, 28 bp, Artificial Sequence
  Description of Artificial Sequence: Synthetic oligonucleotide
ctccagatgatgtttggctgcgacgtgg

SEQ ID NO: 5414 - DNA, 28 bp, Artificial Sequence
  Description of Artificial Sequence: Synthetic oligonucleotide
tccagatgatgtttggctgcgacgtggg

SEQ ID NO: 5415 - DNA, 27 bp, Artificial Sequence
  Description of Artificial Sequence: Synthetic oligonucleotide
ccagatgatgtttggctgcgacgtggg

SEQ ID NO: 5416 - DNA, 27 bp, Artificial Sequence
  Description of Artificial Sequence: Synthetic oligonucleotide
cagatgatgtttggctgcgacgtgggg

SEQ ID NO: 5417 - DNA, 28 bp, Artificial Sequence
  Description of Artificial Sequence: Synthetic oligonucleotide
agatgatgtttggctgcgacgtggggtc

SEQ ID NO: 5418 - DNA, 27 bp, Artificial Sequence
  Description of Artificial Sequence: Synthetic oligonucleotide
gatgatgtttggctgcgacgtggggtc

SEQ ID NO: 5419 - DNA, 27 bp, Artificial Sequence
  Description of Artificial Sequence: Synthetic oligonucleotide
atgatgtttggctgcgacgtggggtcg

SEQ ID NO: 5420 - DNA, 26 bp, Artificial Sequence
  Description of Artificial Sequence: Synthetic oligonucleotide
tgatgtttggctgcgacgtggggtcg

SEQ ID NO: 5421 - DNA, 25 bp, Artificial Sequence
  Description of Artificial Sequence: Synthetic oligonucleotide
tttggctgcgacgtggggtcggact

SEQ ID NO: 5422 - DNA, 24 bp, Artificial Sequence
  Description of Artificial Sequence: Synthetic oligonucleotide
ttggctgcgacgtggggtcggact

SEQ ID NO: 5423 - DNA, 34 bp, Artificial Sequence
  Description of Artificial Sequence: Synthetic oligonucleotide
actccatgaggtatttcttcacatccgtgtcctg

SEQ ID NO: 5424 - DNA, 33 bp, Artificial Sequence
  Description of Artificial Sequence: Synthetic oligonucleotide
ctccatgaggtatttcttcacatccgtgtcctg

SEQ ID NO: 5425 - DNA, 33 bp, Artificial Sequence
  Description of Artificial Sequence: Synthetic oligonucleotide
tccatgaggtatttcttcacatccgtgtcctgg

SEQ ID NO: 5426 - DNA, 32 bp, Artificial Sequence
  Description of Artificial Sequence: Synthetic oligonucleotide
ccatgaggtatttcttcacatccgtgtcctgg

SEQ ID NO: 5427 - DNA, 32 bp, Artificial Sequence
  Description of Artificial Sequence: Synthetic oligonucleotide
catgaggtatttcttcacatccgtgtcctggc

SEQ ID NO: 5428 - DNA, 32 bp, Artificial Sequence
  Description of Artificial Sequence: Synthetic oligonucleotide
atgaggtatttcttcacatccgtgtcctggcc

SEQ ID NO: 5429 - DNA, 31 bp, Artificial Sequence
  Description of Artificial Sequence: Synthetic oligonucleotide
tgaggtatttcttcacatccgtgtcctggcc

SEQ ID NO: 5430 - DNA, 30 bp, Artificial Sequence
  Description of Artificial Sequence: Synthetic oligonucleotide
gaggtatttcttcacatccgtgtcctggcc

SEQ ID NO: 5431 - DNA, 30 bp, Artificial Sequence
  Description of Artificial Sequence: Synthetic oligonucleotide
aggtatttcttcacatccgtgtcctggccc

SEQ ID NO: 5432 - DNA, 29 bp, Artificial Sequence
  Description of Artificial Sequence: Synthetic oligonucleotide
ggtatttcttcacatccgtgtcctggccc

SEQ ID NO: 5433 - DNA, 29 bp, Artificial Sequence
  Description of Artificial Sequence: Synthetic oligonucleotide
gtatttcttcacatccgtgtcctggcccg

SEQ ID NO: 5434 - DNA, 29 bp, Artificial Sequence
  Description of Artificial Sequence: Synthetic oligonucleotide
tatttcttcacatccgtgtcctggcccgg

SEQ ID NO: 5435 - DNA, 28 bp, Artificial Sequence
  Description of Artificial Sequence: Synthetic oligonucleotide
atttcttcacatccgtgtcctggcccgg

SEQ ID NO: 5436 - DNA, 27 bp, Artificial Sequence
  Description of Artificial Sequence: Synthetic oligonucleotide
tttcttcacatccgtgtcctggcccgg

SEQ ID NO: 5437 - DNA, 26 bp, Artificial Sequence
  Description of Artificial Sequence: Synthetic oligonucleotide
ttcttcacatccgtgtcctggcccgg

SEQ ID NO: 5438 - DNA, 25 bp, Artificial Sequence
  Description of Artificial Sequence: Synthetic oligonucleotide
tcttcacatccgtgtcctggcccgg

SEQ ID NO: 5439 - DNA, 24 bp, Artificial Sequence
  Description of Artificial Sequence: Synthetic oligonucleotide
cttcacatccgtgtcctggcccgg

SEQ ID NO: 5440 - DNA, 24 bp, Artificial Sequence
  Description of Artificial Sequence: Synthetic oligonucleotide
ttcacatccgtgtcctggcccggc

SEQ ID NO: 5441 - DNA, 23 bp, Artificial Sequence
  Description of Artificial Sequence: Synthetic oligonucleotide
tcacatccgtgtcctggcccggc

SEQ ID NO: 5442 - DNA, 22 bp, Artificial Sequence
  Description of Artificial Sequence: Synthetic oligonucleotide
cacatccgtgtcctggcccggc

SEQ ID NO: 5443 - DNA, 22 bp, Artificial Sequence
  Description of Artificial Sequence: Synthetic oligonucleotide
acatccgtgtcctggcccggcc

SEQ ID NO: 5444 - DNA, 21 bp, Artificial Sequence
  Description of Artificial Sequence: Synthetic oligonucleotide
catccgtgtcctggcccggcc

SEQ ID NO: 5445 - DNA, 21 bp, Artificial Sequence
  Description of Artificial Sequence: Synthetic oligonucleotide
atccgtgtcctggcccggccg

SEQ ID NO: 5446 - DNA, 20 bp, Artificial Sequence
  Description of Artificial Sequence: Synthetic oligonucleotide
tccgtgtcctggcccggccg

SEQ ID NO: 5447 - DNA, 20 bp, Artificial Sequence
  Description of Artificial Sequence: Synthetic oligonucleotide
ccgtgtcctggcccggccgt

SEQ ID NO: 5448 - DNA, 20 bp, Artificial Sequence
  Description of Artificial Sequence: Synthetic oligonucleotide
cgtgtcctggcccggccgct

SEQ ID NO: 5449 - DNA, 20 bp, Artificial Sequence
  Description of Artificial Sequence: Synthetic oligonucleotide
gtgtcctggcccggccgcgt

SEQ ID NO: 5450 - DNA, 20 bp, Artificial Sequence
  Description of Artificial Sequence: Synthetic oligonucleotide
tgtcctggcccggccgcggt

SEQ ID NO: 5451 - DNA, 20 bp, Artificial Sequence
  Description of Artificial Sequence: Synthetic oligonucleotide
gtcctggcccggccgcggtt

SEQ ID NO: 5452 - DNA, 20 bp, Artificial Sequence
  Description of Artificial Sequence: Synthetic oligonucleotide
tcctggcccggccgcgggtt

SEQ ID NO: 5453 - DNA, 20 bp, Artificial Sequence
  Description of Artificial Sequence: Synthetic oligonucleotide
cctggcccggccgcgggttt

SEQ ID NO: 5454 - DNA, 20 bp, Artificial Sequence
  Description of Artificial Sequence: Synthetic oligonucleotide
ctggcccggccgcggggatt

SEQ ID NO: 5455 - DNA, 20 bp, Artificial Sequence
  Description of Artificial Sequence: Synthetic oligonucleotide
tggcccggccgcggggagtt

SEQ ID NO: 5456 - DNA, 31 bp, Artificial Sequence
  Description of Artificial Sequence: Synthetic oligonucleotide
acacggaaagtgaaggcccactcacagattg

SEQ ID NO: 5457 - DNA, 30 bp, Artificial Sequence
  Description of Artificial Sequence: Synthetic oligonucleotide
cacggaaagtgaaggcccactcacagattg

SEQ ID NO: 5458 - DNA, 31 bp, Artificial Sequence
  Description of Artificial Sequence: Synthetic oligonucleotide
acggaaagtgaaggcccactcacagattgac

SEQ ID NO: 5459 - DNA, 30 bp, Artificial Sequence
  Description of Artificial Sequence: Synthetic oligonucleotide
cggaaagtgaaggcccactcacagattgac

SEQ ID NO: 5460 - DNA, 30 bp, Artificial Sequence
  Description of Artificial Sequence: Synthetic oligonucleotide
ggaaagtgaaggcccactcacagattgacc

SEQ ID NO: 5461 - DNA, 30 bp, Artificial Sequence
  Description of Artificial Sequence: Synthetic oligonucleotide
gaaagtgaaggcccactcacagattgaccg

SEQ ID NO: 5462 - DNA, 31 bp, Artificial Sequence
  Description of Artificial Sequence: Synthetic oligonucleotide
aaagtgaaggcccactcacagattgaccgag

SEQ ID NO: 5463 - DNA, 30 bp, Artificial Sequence
  Description of Artificial Sequence: Synthetic oligonucleotide
aagtgaaggcccactcacagattgaccgag

SEQ ID NO: 5464 - DNA, 29 bp, Artificial Sequence
  Description of Artificial Sequence: Synthetic oligonucleotide
agtgaaggcccactcacagattgaccgag

SEQ ID NO: 5465 - DNA, 28 bp, Artificial Sequence
  Description of Artificial Sequence: Synthetic oligonucleotide
gtgaaggcccactcacagattgaccgag

SEQ ID NO: 5466 - DNA, 29 bp, Artificial Sequence
  Description of Artificial Sequence: Synthetic oligonucleotide
tgaaggcccactcacagattgaccgagtg

SEQ ID NO: 5467 - DNA, 28 bp, Artificial Sequence
  Description of Artificial Sequence: Synthetic oligonucleotide
gaaggcccactcacagattgaccgagtg

SEQ ID NO: 5468 - DNA, 28 bp, Artificial Sequence
  Description of Artificial Sequence: Synthetic oligonucleotide
aaggcccactcacagattgaccgagtgg

SEQ ID NO: 5469 - DNA, 27 bp, Artificial Sequence
  Description of Artificial Sequence: Synthetic oligonucleotide
aggcccactcacagattgaccgagtgg

SEQ ID NO: 5470 - DNA, 27 bp, Artificial Sequence
  Description of Artificial Sequence: Synthetic oligonucleotide
ggcccactcacagattgaccgagtgga

SEQ ID NO: 5471 - DNA, 27 bp, Artificial Sequence
  Description of Artificial Sequence: Synthetic oligonucleotide
gcccactcacagattgaccgagtggac

SEQ ID NO: 5472 - DNA, 27 bp, Artificial Sequence
  Description of Artificial Sequence: Synthetic oligonucleotide
cccactcacagattgaccgagtggacc

SEQ ID NO: 5473 - DNA, 28 bp, Artificial Sequence
  Description of Artificial Sequence: Synthetic oligonucleotide
ccactcacagattgaccgagtggacctg

SEQ ID NO: 5474 - DNA, 28 bp, Artificial Sequence
  Description of Artificial Sequence: Synthetic oligonucleotide
cactcacagattgaccgagtggacctgg

SEQ ID NO: 5475 - DNA, 28 bp, Artificial Sequence
  Description of Artificial Sequence: Synthetic oligonucleotide
actcacagattgaccgagtggacctggg

SEQ ID NO: 5476 - DNA, 27 bp, Artificial Sequence
  Description of Artificial Sequence: Synthetic oligonucleotide
ctcacagattgaccgagtggacctggg

SEQ ID NO: 5477 - DNA, 27 bp, Artificial Sequence
  Description of Artificial Sequence: Synthetic oligonucleotide
tcacagattgaccgagtggacctgggg

SEQ ID NO: 5478 - DNA, 27 bp, Artificial Sequence
  Description of Artificial Sequence: Synthetic oligonucleotide
cacagattgaccgagtggacctgggga

SEQ ID NO: 5479 - DNA, 27 bp, Artificial Sequence
  Description of Artificial Sequence: Synthetic oligonucleotide
acagattgaccgagtggacctggggac

SEQ ID NO: 5480 - DNA, 26 bp, Artificial Sequence
  Description of Artificial Sequence: Synthetic oligonucleotide
cagattgaccgagtggacctggggac

SEQ ID NO: 5481 - DNA, 26 bp, Artificial Sequence
  Description of Artificial Sequence: Synthetic oligonucleotide
agattgaccgagtggacctggggacc

SEQ ID NO: 5482 - DNA, 25 bp, Artificial Sequence
  Description of Artificial Sequence: Synthetic oligonucleotide
gattgaccgagtggacctggggacc

SEQ ID NO: 5483 - DNA, 26 bp, Artificial Sequence
  Description of Artificial Sequence: Synthetic oligonucleotide
attgaccgagtggacctggggaccct

SEQ ID NO: 5484 - DNA, 25 bp, Artificial Sequence
  Description of Artificial Sequence: Synthetic oligonucleotide
ttgaccgagtggacctggggaccct

SEQ ID NO: 5485 - DNA, 23 bp, Artificial Sequence
  Description of Artificial Sequence: Synthetic oligonucleotide
gtcggactggcgcttcctccgca

SEQ ID NO: 5486 - DNA, 23 bp, Artificial Sequence
  Description of Artificial Sequence: Synthetic oligonucleotide
tcggactggcgcttcctccgcag

SEQ ID NO: 5487 - DNA, 22 bp, Artificial Sequence
  Description of Artificial Sequence: Synthetic oligonucleotide
cggactggcgcttcctccgcag

SEQ ID NO: 5488 - DNA, 24 bp, Artificial Sequence
  Description of Artificial Sequence: Synthetic oligonucleotide
ggactggcgcttcctccgcaggta

SEQ ID NO: 5489 - DNA, 24 bp, Artificial Sequence
  Description of Artificial Sequence: Synthetic oligonucleotide
gactggcgcttcctccgcaggtac

SEQ ID NO: 5490 - DNA, 25 bp, Artificial Sequence
  Description of Artificial Sequence: Synthetic oligonucleotide
actggcgcttcctccgcaggtacca

SEQ ID NO: 5491 - DNA, 24 bp, Artificial Sequence
  Description of Artificial Sequence: Synthetic oligonucleotide
ctggcgcttcctccgcaggtacca

SEQ ID NO: 5492 - DNA, 24 bp, Artificial Sequence
  Description of Artificial Sequence: Synthetic oligonucleotide
tggcgcttcctccgcaggtaccac

SEQ ID NO: 5493 - DNA, 23 bp, Artificial Sequence
  Description of Artificial Sequence: Synthetic oligonucleotide
ggcgcttcctccgcaggtaccac

SEQ ID NO: 5494 - DNA, 24 bp, Artificial Sequence
  Description of Artificial Sequence: Synthetic oligonucleotide
gcgcttcctccgcaggtaccacca

SEQ ID NO: 5495 - DNA, 26 bp, Artificial Sequence
  Description of Artificial Sequence: Synthetic oligonucleotide
cgcttcctccgcaggtaccaccagta

SEQ ID NO: 5496 - DNA, 26 bp, Artificial Sequence
  Description of Artificial Sequence: Synthetic oligonucleotide
gcttcctccgcaggtaccaccagtac

SEQ ID NO: 5497 - DNA, 26 bp, Artificial Sequence
  Description of Artificial Sequence: Synthetic oligonucleotide
cttcctccgcaggtaccaccagtacg

SEQ ID NO: 5498 - DNA, 26 bp, Artificial Sequence
  Description of Artificial Sequence: Synthetic oligonucleotide
ttcctccgcaggtaccaccagtacgc

SEQ ID NO: 5499 - DNA, 25 bp, Artificial Sequence
  Description of Artificial Sequence: Synthetic oligonucleotide
tcctccgcaggtaccaccagtacgc

SEQ ID NO: 5500 - DNA, 24 bp, Artificial Sequence
  Description of Artificial Sequence: Synthetic oligonucleotide
cctccgcaggtaccaccagtacgc

SEQ ID NO: 5501 - DNA, 26 bp, Artificial Sequence
  Description of Artificial Sequence: Synthetic oligonucleotide
ctccgcaggtaccaccagtacgccta

SEQ ID NO: 5502 - DNA, 26 bp, Artificial Sequence
  Description of Artificial Sequence: Synthetic oligonucleotide
tccgcaggtaccaccagtacgcctac

SEQ ID NO: 5503 - DNA, 25 bp, Artificial Sequence
  Description of Artificial Sequence: Synthetic oligonucleotide
ccgcaggtaccaccagtacgcctac

SEQ ID NO: 5504 - DNA, 26 bp, Artificial Sequence
  Description of Artificial Sequence: Synthetic oligonucleotide
cgcaggtaccaccagtacgcctacga

SEQ ID NO: 5505 - DNA, 26 bp, Artificial Sequence
  Description of Artificial Sequence: Synthetic oligonucleotide
gcaggtaccaccagtacgcctacgac

SEQ ID NO: 5506 - DNA, 26 bp, Artificial Sequence
  Description of Artificial Sequence: Synthetic oligonucleotide
caggtaccaccagtacgcctacgacg

SEQ ID NO: 5507 - DNA, 26 bp, Artificial Sequence
  Description of Artificial Sequence: Synthetic oligonucleotide
aggtaccaccagtacgcctacgacgg

SEQ ID NO: 5508 - DNA, 29 bp, Artificial Sequence
  Description of Artificial Sequence: Synthetic oligonucleotide
acggaaagtgaaggcccactcacagactg

SEQ ID NO: 5509 - DNA, 28 bp, Artificial Sequence
  Description of Artificial Sequence: Synthetic oligonucleotide
cggaaagtgaaggcccactcacagactg

SEQ ID NO: 5510 - DNA, 29 bp, Artificial Sequence
  Description of Artificial Sequence: Synthetic oligonucleotide
ggaaagtgaaggcccactcacagactgac

SEQ ID NO: 5511 - DNA, 29 bp, Artificial Sequence
  Description of Artificial Sequence: Synthetic oligonucleotide
gaaagtgaaggcccactcacagactgacc

SEQ ID NO: 5512 - DNA, 29 bp, Artificial Sequence
  Description of Artificial Sequence: Synthetic oligonucleotide
aaagtgaaggcccactcacagactgaccg

SEQ ID NO: 5513 - DNA, 28 bp, Artificial Sequence
  Description of Artificial Sequence: Synthetic oligonucleotide
aagtgaaggcccactcacagactgaccg

SEQ ID NO: 5514 - DNA, 27 bp, Artificial Sequence
  Description of Artificial Sequence: Synthetic oligonucleotide
agtgaaggcccactcacagactgaccg

SEQ ID NO: 5515 - DNA, 28 bp, Artificial Sequence
  Description of Artificial Sequence: Synthetic oligonucleotide
cactcacagactgaccgagagaacctgc

SEQ ID NO: 5516 - DNA, 28 bp, Artificial Sequence
  Description of Artificial Sequence: Synthetic oligonucleotide
actcacagactgaccgagagaacctgcg

SEQ ID NO: 5517 - DNA, 27 bp, Artificial Sequence
  Description of Artificial Sequence: Synthetic oligonucleotide
ctcacagactgaccgagagaacctgcg

SEQ ID NO: 5518 - DNA, 27 bp, Artificial Sequence
  Description of Artificial Sequence: Synthetic oligonucleotide
tcacagactgaccgagagaacctgcgg

SEQ ID NO: 5519 - DNA, 27 bp, Artificial Sequence
  Description of Artificial Sequence: Synthetic oligonucleotide
cacagactgaccgagagaacctgcgga

SEQ ID NO: 5520 - DNA, 28 bp, Artificial Sequence
  Description of Artificial Sequence: Synthetic oligonucleotide
acagactgaccgagagaacctgcggatc

SEQ ID NO: 5521 - DNA, 27 bp, Artificial Sequence
  Description of Artificial Sequence: Synthetic oligonucleotide
cagactgaccgagagaacctgcggatc

SEQ ID NO: 5522 - DNA, 27 bp, Artificial Sequence
  Description of Artificial Sequence: Synthetic oligonucleotide
agactgaccgagagaacctgcggatcg

SEQ ID NO: 5523 - DNA, 26 bp, Artificial Sequence
  Description of Artificial Sequence: Synthetic oligonucleotide
gactgaccgagagaacctgcggatcg

SEQ ID NO: 5524 - DNA, 26 bp, Artificial Sequence
  Description of Artificial Sequence: Synthetic oligonucleotide
actgaccgagagaacctgcggatcgc

SEQ ID NO: 5525 - DNA, 25 bp, Artificial Sequence
  Description of Artificial Sequence: Synthetic oligonucleotide
ctgaccgagagaacctgcggatcgc

SEQ ID NO: 5526 - DNA, 25 bp, Artificial Sequence
  Description of Artificial Sequence: Synthetic oligonucleotide
tgaccgagagaacctgcggatcgcg

SEQ ID NO: 5527 - DNA, 24 bp, Artificial Sequence
  Description of Artificial Sequence: Synthetic oligonucleotide
gaccgagagaacctgcggatcgcg

SEQ ID NO: 5528 - DNA, 25 bp, Artificial Sequence
  Description of Artificial Sequence: Synthetic oligonucleotide
accgagagaacctgcggatcgcgct

SEQ ID NO: 5529 - DNA, 24 bp, Artificial Sequence
  Description of Artificial Sequence: Synthetic oligonucleotide
ccgagagaacctgcggatcgcgct

SEQ ID NO: 5530 - DNA, 24 bp, Artificial Sequence
  Description of Artificial Sequence: Synthetic oligonucleotide
cgagagaacctgcggatcgcgctc

SEQ ID NO: 5531 - DNA, 24 bp, Artificial Sequence
  Description of Artificial Sequence: Synthetic oligonucleotide
gagagaacctgcggatcgcgctcc

SEQ ID NO: 5532 - DNA, 24 bp, Artificial Sequence
  Description of Artificial Sequence: Synthetic oligonucleotide
agagaacctgcggatcgcgctccg

SEQ ID NO: 5533 - DNA, 23 bp, Artificial Sequence
  Description of Artificial Sequence: Synthetic oligonucleotide
gagaacctgcggatcgcgctccg

SEQ ID NO: 5534 - DNA, 25 bp, Artificial Sequence
  Description of Artificial Sequence: Synthetic oligonucleotide
agaacctgcggatcgcgctccgcta

SEQ ID NO: 5535 - DNA, 24 bp, Artificial Sequence
  Description of Artificial Sequence: Synthetic oligonucleotide
gaacctgcggatcgcgctccgcta

SEQ ID NO: 5536 - DNA, 26 bp, Artificial Sequence
  Description of Artificial Sequence: Synthetic oligonucleotide
aacctgcggatcgcgctccgctacta

SEQ ID NO: 5537 - DNA, 25 bp, Artificial Sequence
  Description of Artificial Sequence: Synthetic oligonucleotide
acctgcggatcgcgctccgctacta

SEQ ID NO: 5538 - DNA, 24 bp, Artificial Sequence
  Description of Artificial Sequence: Synthetic oligonucleotide
cctgcggatcgcgctccgctacta

SEQ ID NO: 5539 - DNA, 26 bp, Artificial Sequence
  Description of Artificial Sequence: Synthetic oligonucleotide
ctgcggatcgcgctccgctactacaa

SEQ ID NO: 5540 - DNA, 26 bp, Artificial Sequence
  Description of Artificial Sequence: Synthetic oligonucleotide
tgcggatcgcgctccgctactacaac

SEQ ID NO: 5541 - DNA, 25 bp, Artificial Sequence
  Description of Artificial Sequence: Synthetic oligonucleotide
gcggatcgcgctccgctactacaac

SEQ ID NO: 5542 - DNA, 26 bp, Artificial Sequence
  Description of Artificial Sequence: Synthetic oligonucleotide
cggatcgcgctccgctactacaacca

SEQ ID NO: 5543 - DNA, 27 bp, Artificial Sequence
  Description of Artificial Sequence: Synthetic oligonucleotide
ggatcgcgctccgctactacaaccaga

SEQ ID NO: 5544 - DNA, 27 bp, Artificial Sequence
  Description of Artificial Sequence: Synthetic oligonucleotide
gatcgcgctccgctactacaaccagag

SEQ ID NO: 5545 - DNA, 27 bp, Artificial Sequence
  Description of Artificial Sequence: Synthetic oligonucleotide
atcgcgctccgctactacaaccagagc

SEQ ID NO: 5546 - DNA, 26 bp, Artificial Sequence
  Description of Artificial Sequence: Synthetic oligonucleotide
tcgcgctccgctactacaaccagagc

SEQ ID NO: 5547 - DNA, 25 bp, Artificial Sequence
  Description of Artificial Sequence: Synthetic oligonucleotide
cgcgctccgctactacaaccagagc

SEQ ID NO: 5548 - DNA, 26 bp, Artificial Sequence
  Description of Artificial Sequence: Synthetic oligonucleotide
gcgctccgctactacaaccagagcga

SEQ ID NO: 5549 - DNA, 26 bp, Artificial Sequence
  Description of Artificial Sequence: Synthetic oligonucleotide
cgctccgctactacaaccagagcgag

SEQ ID NO: 5550 - DNA, 26 bp, Artificial Sequence
  Description of Artificial Sequence: Synthetic oligonucleotide
gctccgctactacaaccagagcgagg

SEQ ID NO: 5551 - DNA, 26 bp, Artificial Sequence
  Description of Artificial Sequence: Synthetic oligonucleotide
ctccgctactacaaccagagcgaggc

SEQ ID NO: 5552 - DNA, 26 bp, Artificial Sequence
  Description of Artificial Sequence: Synthetic oligonucleotide
tccgctactacaaccagagcgaggcc

SEQ ID NO: 5553 - DNA, 25 bp, Artificial Sequence
  Description of Artificial Sequence: Synthetic oligonucleotide
ccgctactacaaccagagcgaggcc

SEQ ID NO: 5554 - DNA, 25 bp, Artificial Sequence
  Description of Artificial Sequence: Synthetic oligonucleotide
cgctactacaaccagagcgaggccg

SEQ ID NO: 5555 - DNA, 30 bp, Artificial Sequence
  Description of Artificial Sequence: Synthetic oligonucleotide
tggatagagcaggagggtccggagtattag

SEQ ID NO: 5556 - DNA, 29 bp, Artificial Sequence
  Description of Artificial Sequence: Synthetic oligonucleotide
ggatagagcaggagggtccggagtattag

SEQ ID NO: 5557 - DNA, 29 bp, Artificial Sequence
  Description of Artificial Sequence: Synthetic oligonucleotide
gatagagcaggagggtccggagtattagg

SEQ ID NO: 5558 - DNA, 30 bp, Artificial Sequence
  Description of Artificial Sequence: Synthetic oligonucleotide
atagagcaggagggtccggagtattaggac

SEQ ID NO: 5559 - DNA, 29 bp, Artificial Sequence
  Description of Artificial Sequence: Synthetic oligonucleotide
tagagcaggagggtccggagtattaggac

SEQ ID NO: 5560 - DNA, 28 bp, Artificial Sequence
  Description of Artificial Sequence: Synthetic oligonucleotide
agagcaggagggtccggagtattaggac

SEQ ID NO: 5561 - DNA, 27 bp, Artificial Sequence
  Description of Artificial Sequence: Synthetic oligonucleotide
gagcaggagggtccggagtattaggac

SEQ ID NO: 5562 - DNA, 27 bp, Artificial Sequence
  Description of Artificial Sequence: Synthetic oligonucleotide
agcaggagggtccggagtattaggacg

SEQ ID NO: 5563 - DNA, 26 bp, Artificial Sequence
  Description of Artificial Sequence: Synthetic oligonucleotide
gcaggagggtccggagtattaggacg

SEQ ID NO: 5564 - DNA, 26 bp, Artificial Sequence
  Description of Artificial Sequence: Synthetic oligonucleotide
caggagggtccggagtattaggacgg

SEQ ID NO: 5565 - DNA, 26 bp, Artificial Sequence
  Description of Artificial Sequence: Synthetic oligonucleotide
aggagggtccggagtattaggacggg

SEQ ID NO: 5566 - DNA, 25 bp, Artificial Sequence
  Description of Artificial Sequence: Synthetic oligonucleotide
ggagggtccggagtattaggacggg

SEQ ID NO: 5567 - DNA, 26 bp, Artificial Sequence
  Description of Artificial Sequence: Synthetic oligonucleotide
gagggtccggagtattaggacgggga

SEQ ID NO: 5568 - DNA, 27 bp, Artificial Sequence
  Description of Artificial Sequence: Synthetic oligonucleotide
agggtccggagtattaggacggggaga

SEQ ID NO: 5569 - DNA, 26 bp, Artificial Sequence
  Description of Artificial Sequence: Synthetic oligonucleotide
gggtccggagtattaggacggggaga

SEQ ID NO: 5570 - DNA, 27 bp, Artificial Sequence
  Description of Artificial Sequence: Synthetic oligonucleotide
ggtccggagtattaggacggggagaca

SEQ ID NO: 5571 - DNA, 27 bp, Artificial Sequence
  Description of Artificial Sequence: Synthetic oligonucleotide
gtccggagtattaggacggggagacac

SEQ ID NO: 5572 - DNA, 27 bp, Artificial Sequence
  Description of Artificial Sequence: Synthetic oligonucleotide
tccggagtattaggacggggagacacg

SEQ ID NO: 5573 - DNA, 26 bp, Artificial Sequence
  Description of Artificial Sequence: Synthetic oligonucleotide
ccggagtattaggacggggagacacg

SEQ ID NO: 5574 - DNA, 27 bp, Artificial Sequence
  Description of Artificial Sequence: Synthetic oligonucleotide
cggagtattaggacggggagacacgga

SEQ ID NO: 5575 - DNA, 29 bp, Artificial Sequence
  Description of Artificial Sequence: Synthetic oligonucleotide
ggagtattaggacggggagacacggaaag

SEQ ID NO: 5576 - DNA, 30 bp, Artificial Sequence
  Description of Artificial Sequence: Synthetic oligonucleotide
gagtattaggacggggagacacggaaagtg

SEQ ID NO: 5577 - DNA, 32 bp, Artificial Sequence
  Description of Artificial Sequence: Synthetic oligonucleotide
agtattaggacggggagacacggaaagtgaag

SEQ ID NO: 5578 - DNA, 31 bp, Artificial Sequence
  Description of Artificial Sequence: Synthetic oligonucleotide
gtattaggacggggagacacggaaagtgaag

SEQ ID NO: 5579 - DNA, 31 bp, Artificial Sequence
  Description of Artificial Sequence: Synthetic oligonucleotide
tattaggacggggagacacggaaagtgaagg

SEQ ID NO: 5580 - DNA, 30 bp, Artificial Sequence
  Description of Artificial Sequence: Synthetic oligonucleotide
attaggacggggagacacggaaagtgaagg

SEQ ID NO: 5581 - DNA, 29 bp, Artificial Sequence
  Description of Artificial Sequence: Synthetic oligonucleotide
ttaggacggggagacacggaaagtgaagg

SEQ ID NO: 5582 - DNA, 28 bp, Artificial Sequence
  Description of Artificial Sequence: Synthetic oligonucleotide
taggacggggagacacggaaagtgaagg

SEQ ID NO: 5583 - DNA, 27 bp, Artificial Sequence
  Description of Artificial Sequence: Synthetic oligonucleotide
aggacggggagacacggaaagtgaagg

SEQ ID NO: 5584 - DNA, 24 bp, Artificial Sequence
  Description of Artificial Sequence: Synthetic oligonucleotide
tatggctgcgacgtggggtcggac

SEQ ID NO: 5585 - DNA, 23 bp, Artificial Sequence
  Description of Artificial Sequence: Synthetic oligonucleotide
atggctgcgacgtggggtcggac

SEQ ID NO: 5586 - DNA, 27 bp, Artificial Sequence
  Description of Artificial Sequence: Synthetic oligonucleotide
catcgcagtgggctacgtggacgacaa

SEQ ID NO: 5587 - DNA, 27 bp, Artificial Sequence
  Description of Artificial Sequence: Synthetic oligonucleotide
atcgcagtgggctacgtggacgacaag

SEQ ID NO: 5588 - DNA, 26 bp, Artificial Sequence
  Description of Artificial Sequence: Synthetic oligonucleotide
tcgcagtgggctacgtggacgacaag

SEQ ID NO: 5589 - DNA, 25 bp, Artificial Sequence
  Description of Artificial Sequence: Synthetic oligonucleotide
cgcagtgggctacgtggacgacaag

SEQ ID NO: 5590 - DNA, 26 bp, Artificial Sequence
  Description of Artificial Sequence: Synthetic oligonucleotide
gcagtgggctacgtggacgacaagca

SEQ ID NO: 5591 - DNA, 27 bp, Artificial Sequence
  Description of Artificial Sequence: Synthetic oligonucleotide
cagtgggctacgtggacgacaagcagt

SEQ ID NO: 5592 - DNA, 28 bp, Artificial Sequence
  Description of Artificial Sequence: Synthetic oligonucleotide
agtgggctacgtggacgacaagcagttc

SEQ ID NO: 5593 - DNA, 27 bp, Artificial Sequence
  Description of Artificial Sequence: Synthetic oligonucleotide
gtgggctacgtggacgacaagcagttc

SEQ ID NO: 5594 - DNA, 27 bp, Artificial Sequence
  Description of Artificial Sequence: Synthetic oligonucleotide
tgggctacgtggacgacaagcagttcg

SEQ ID NO: 5595 - DNA, 27 bp, Artificial Sequence
  Description of Artificial Sequence: Synthetic oligonucleotide
gggctacgtggacgacaagcagttcgt

SEQ ID NO: 5596 - DNA, 27 bp, Artificial Sequence
  Description of Artificial Sequence: Synthetic oligonucleotide
ggctacgtggacgacaagcagttcgtg

SEQ ID NO: 5597 - DNA, 27 bp, Artificial Sequence
  Description of Artificial Sequence: Synthetic oligonucleotide
gctacgtggacgacaagcagttcgtgc

SEQ ID NO: 5598 - DNA, 27 bp, Artificial Sequence
  Description of Artificial Sequence: Synthetic oligonucleotide
ctacgtggacgacaagcagttcgtgcg

SEQ ID NO: 5599 - DNA, 27 bp, Artificial Sequence
  Description of Artificial Sequence: Synthetic oligonucleotide
tacgtggacgacaagcagttcgtgcgg

SEQ ID NO: 5600 - DNA, 27 bp, Artificial Sequence
  Description of Artificial Sequence: Synthetic oligonucleotide
acgtggacgacaagcagttcgtgcggt

SEQ ID NO: 5601 - DNA, 27 bp, Artificial Sequence
  Description of Artificial Sequence: Synthetic oligonucleotide
cgtggacgacaagcagttcgtgcggtt

SEQ ID NO: 5602 - DNA, 27 bp, Artificial Sequence
  Description of Artificial Sequence: Synthetic oligonucleotide
gtggacgacaagcagttcgtgcggttc

SEQ ID NO: 5603 - DNA, 27 bp, Artificial Sequence
  Description of Artificial Sequence: Synthetic oligonucleotide
tggacgacaagcagttcgtgcggttcg

SEQ ID NO: 5604 - DNA, 27 bp, Artificial Sequence
  Description of Artificial Sequence: Synthetic oligonucleotide
ggacgacaagcagttcgtgcggttcga

SEQ ID NO: 5605 - DNA, 27 bp, Artificial Sequence
  Description of Artificial Sequence: Synthetic oligonucleotide
gacgacaagcagttcgtgcggttcgac

SEQ ID NO: 5606 - DNA, 28 bp, Artificial Sequence
  Description of Artificial Sequence: Synthetic oligonucleotide
acgacaagcagttcgtgcggttcgacag

SEQ ID NO: 5607 - DNA, 27 bp, Artificial Sequence
  Description of Artificial Sequence: Synthetic oligonucleotide
cgacaagcagttcgtgcggttcgacag

SEQ ID NO: 5608 - DNA, 27 bp, Artificial Sequence
  Description of Artificial Sequence: Synthetic oligonucleotide
gacaagcagttcgtgcggttcgacagc

SEQ ID NO: 5609 - DNA, 27 bp, Artificial Sequence
  Description of Artificial Sequence: Synthetic oligonucleotide
acaagcagttcgtgcggttcgacagcg

SEQ ID NO: 5610 - DNA, 27 bp, Artificial Sequence
  Description of Artificial Sequence: Synthetic oligonucleotide
caagcagttcgtgcggttcgacagcga

SEQ ID NO: 5611 - DNA, 27 bp, Artificial Sequence
  Description of Artificial Sequence: Synthetic oligonucleotide
aagcagttcgtgcggttcgacagcgac

SEQ ID NO: 5612 - DNA, 26 bp, Artificial Sequence
  Description of Artificial Sequence: Synthetic oligonucleotide
agcagttcgtgcggttcgacagcgac

SEQ ID NO: 5613 - DNA, 27 bp, Artificial Sequence
  Description of Artificial Sequence: Synthetic oligonucleotide
tgaaggcccactcacagactcaccgac

SEQ ID NO: 5614 - DNA, 27 bp, Artificial Sequence
  Description of Artificial Sequence: Synthetic oligonucleotide
gaaggcccactcacagactcaccgact

SEQ ID NO: 5615 - DNA, 27 bp, Artificial Sequence
  Description of Artificial Sequence: Synthetic oligonucleotide
aaggcccactcacagactcaccgactg

SEQ ID NO: 5616 - DNA, 26 bp, Artificial Sequence
  Description of Artificial Sequence: Synthetic oligonucleotide
aggcccactcacagactcaccgactg

SEQ ID NO: 5617 - DNA, 25 bp, Artificial Sequence
  Description of Artificial Sequence: Synthetic oligonucleotide
ggcccactcacagactcaccgactg

SEQ ID NO: 5618 - DNA, 26 bp, Artificial Sequence
  Description of Artificial Sequence: Synthetic oligonucleotide
gcccactcacagactcaccgactgga

SEQ ID NO: 5619 - DNA, 26 bp, Artificial Sequence
  Description of Artificial Sequence: Synthetic oligonucleotide
cccactcacagactcaccgactggac

SEQ ID NO: 5620 - DNA, 27 bp, Artificial Sequence
  Description of Artificial Sequence: Synthetic oligonucleotide
ccactcacagactcaccgactggacct

SEQ ID NO: 5621 - DNA, 27 bp, Artificial Sequence
  Description of Artificial Sequence: Synthetic oligonucleotide
cactcacagactcaccgactggacctg

SEQ ID NO: 5622 - DNA, 27 bp, Artificial Sequence
  Description of Artificial Sequence: Synthetic oligonucleotide
actcacagactcaccgactggacctgg

SEQ ID NO: 5623 - DNA, 26 bp, Artificial Sequence
  Description of Artificial Sequence: Synthetic oligonucleotide
ctcacagactcaccgactggacctgg

SEQ ID NO: 5624 - DNA, 26 bp, Artificial Sequence
  Description of Artificial Sequence: Synthetic oligonucleotide
tcacagactcaccgactggacctggg

SEQ ID NO: 5625 - DNA, 25 bp, Artificial Sequence
  Description of Artificial Sequence: Synthetic oligonucleotide
cacagactcaccgactggacctggg

SEQ ID NO: 5626 - DNA, 26 bp, Artificial Sequence
  Description of Artificial Sequence: Synthetic oligonucleotide
acagactcaccgactggacctgggga

SEQ ID NO: 5627 - DNA, 25 bp, Artificial Sequence
  Description of Artificial Sequence: Synthetic oligonucleotide
cagactcaccgactggacctgggga

SEQ ID NO: 5628 - DNA, 25 bp, Artificial Sequence
  Description of Artificial Sequence: Synthetic oligonucleotide
agactcaccgactggacctggggac

SEQ ID NO: 5629 - DNA, 24 bp, Artificial Sequence
  Description of Artificial Sequence: Synthetic oligonucleotide
gactcaccgactggacctggggac

SEQ ID NO: 5630 - DNA, 24 bp, Artificial Sequence
  Description of Artificial Sequence: Synthetic oligonucleotide
actcaccgactggacctggggacc

SEQ ID NO: 5631 - DNA, 23 bp, Artificial Sequence
  Description of Artificial Sequence: Synthetic oligonucleotide
ctcaccgactggacctggggacc

SEQ ID NO: 5632 - DNA, 24 bp, Artificial Sequence
  Description of Artificial Sequence: Synthetic oligonucleotide
tcaccgactggacctggggaccct

SEQ ID NO: 5633 - DNA, 23 bp, Artificial Sequence
  Description of Artificial Sequence: Synthetic oligonucleotide
caccgactggacctggggaccct

SEQ ID NO: 5634 - DNA, 23 bp, Artificial Sequence
  Description of Artificial Sequence: Synthetic oligonucleotide
accgactggacctggggaccctg

SEQ ID NO: 5635 - DNA, 22 bp, Artificial Sequence
  Description of Artificial Sequence: Synthetic oligonucleotide
ccgactggacctggggaccctg

SEQ ID NO: 5636 - DNA, 22 bp, Artificial Sequence
  Description of Artificial Sequence: Synthetic oligonucleotide
cgactggacctggggaccctgc

SEQ ID NO: 5637 - DNA, 22 bp, Artificial Sequence
  Description of Artificial Sequence: Synthetic oligonucleotide
gactggacctggggaccctgcg

SEQ ID NO: 5638 - DNA, 22 bp, Artificial Sequence
  Description of Artificial Sequence: Synthetic oligonucleotide
actggacctggggaccctgcgc

SEQ ID NO: 5639 - DNA, 21 bp, Artificial Sequence
  Description of Artificial Sequence: Synthetic oligonucleotide
ctggacctggggaccctgcgc

SEQ ID NO: 5640 - DNA, 22 bp, Artificial Sequence
  Description of Artificial Sequence: Synthetic oligonucleotide
gcgcttcctccgcgggtaccag

SEQ ID NO: 5641 - DNA, 23 bp, Artificial Sequence
  Description of Artificial Sequence: Synthetic oligonucleotide
cgcttcctccgcgggtaccagca

SEQ ID NO: 5642 - DNA, 23 bp, Artificial Sequence
  Description of Artificial Sequence: Synthetic oligonucleotide
gcttcctccgcgggtaccagcag

SEQ ID NO: 5643 - DNA, 24 bp, Artificial Sequence
  Description of Artificial Sequence: Synthetic oligonucleotide
cttcctccgcgggtaccagcagga

SEQ ID NO: 5644 - DNA, 24 bp, Artificial Sequence
  Description of Artificial Sequence: Synthetic oligonucleotide
ttcctccgcgggtaccagcaggac

SEQ ID NO: 5645 - DNA, 23 bp, Artificial Sequence
  Description of Artificial Sequence: Synthetic oligonucleotide
tcctccgcgggtaccagcaggac

SEQ ID NO: 5646 - DNA, 22 bp, Artificial Sequence
  Description of Artificial Sequence: Synthetic oligonucleotide
cctccgcgggtaccagcaggac

SEQ ID NO: 5647 - DNA, 22 bp, Artificial Sequence
  Description of Artificial Sequence: Synthetic oligonucleotide
ctccgcgggtaccagcaggacg

SEQ ID NO: 5648 - DNA, 22 bp, Artificial Sequence
  Description of Artificial Sequence: Synthetic oligonucleotide
tccgcgggtaccagcaggacgc

SEQ ID NO: 5649 - DNA, 21 bp, Artificial Sequence
  Description of Artificial Sequence: Synthetic oligonucleotide
ccgcgggtaccagcaggacgc

SEQ ID NO: 5650 - DNA, 23 bp, Artificial Sequence
  Description of Artificial Sequence: Synthetic oligonucleotide
cgcgggtaccagcaggacgccta

SEQ ID NO: 5651 - DNA, 23 bp, Artificial Sequence
  Description of Artificial Sequence: Synthetic oligonucleotide
gcgggtaccagcaggacgcctac

SEQ ID NO: 5652 - DNA, 24 bp, Artificial Sequence
  Description of Artificial Sequence: Synthetic oligonucleotide
cgggtaccagcaggacgcctacga

SEQ ID NO: 5653 - DNA, 24 bp, Artificial Sequence
  Description of Artificial Sequence: Synthetic oligonucleotide
gggtaccagcaggacgcctacgac

SEQ ID NO: 5654 - DNA, 24 bp, Artificial Sequence
  Description of Artificial Sequence: Synthetic oligonucleotide
ggtaccagcaggacgcctacgacg

SEQ ID NO: 5655 - DNA, 24 bp, Artificial Sequence
  Description of Artificial Sequence: Synthetic oligonucleotide
gtaccagcaggacgcctacgacgg

SEQ ID NO: 5656 - DNA, 26 bp, Artificial Sequence
  Description of Artificial Sequence: Synthetic oligonucleotide
taccagcaggacgcctacgacggcaa

SEQ ID NO: 5657 - DNA, 25 bp, Artificial Sequence
  Description of Artificial Sequence: Synthetic oligonucleotide
accagcaggacgcctacgacggcaa

SEQ ID NO: 5658 - DNA, 24 bp, Artificial Sequence
  Description of Artificial Sequence: Synthetic oligonucleotide
ccagcaggacgcctacgacggcaa

SEQ ID NO: 5659 - DNA, 24 bp, Artificial Sequence
  Description of Artificial Sequence: Synthetic oligonucleotide
cagcaggacgcctacgacggcaag

SEQ ID NO: 5660 - DNA, 27 bp, Artificial Sequence
  Description of Artificial Sequence: Synthetic oligonucleotide
agcaggacgcctacgacggcaaggatt

SEQ ID NO: 5661 - DNA, 26 bp, Artificial Sequence
  Description of Artificial Sequence: Synthetic oligonucleotide
ggacatggcagctcagaccaccaagc

SEQ ID NO: 5662 - DNA, 26 bp, Artificial Sequence
  Description of Artificial Sequence: Synthetic oligonucleotide
gacatggcagctcagaccaccaagcg

SEQ ID NO: 5663 - DNA, 27 bp, Artificial Sequence
  Description of Artificial Sequence: Synthetic oligonucleotide
acatggcagctcagaccaccaagcgca

SEQ ID NO: 5664 - DNA, 27 bp, Artificial Sequence
  Description of Artificial Sequence: Synthetic oligonucleotide
catggcagctcagaccaccaagcgcaa

SEQ ID NO: 5665 - DNA, 27 bp, Artificial Sequence
  Description of Artificial Sequence: Synthetic oligonucleotide
atggcagctcagaccaccaagcgcaag

SEQ ID NO: 5666 - DNA, 27 bp, Artificial Sequence
  Description of Artificial Sequence: Synthetic oligonucleotide
tggcagctcagaccaccaagcgcaagt

SEQ ID NO: 5667 - DNA, 26 bp, Artificial Sequence
  Description of Artificial Sequence: Synthetic oligonucleotide
ggcagctcagaccaccaagcgcaagt

SEQ ID NO: 5668 - DNA, 26 bp, Artificial Sequence
  Description of Artificial Sequence: Synthetic oligonucleotide
gcagctcagaccaccaagcgcaagtg

SEQ ID NO: 5669 - DNA, 26 bp, Artificial Sequence
  Description of Artificial Sequence: Synthetic oligonucleotide
cagctcagaccaccaagcgcaagtgg

SEQ ID NO: 5670 - DNA, 27 bp, Artificial Sequence
  Description of Artificial Sequence: Synthetic oligonucleotide
agctcagaccaccaagcgcaagtggga

SEQ ID NO: 5671 - DNA, 26 bp, Artificial Sequence
  Description of Artificial Sequence: Synthetic oligonucleotide
gctcagaccaccaagcgcaagtggga

SEQ ID NO: 5672 - DNA, 26 bp, Artificial Sequence
  Description of Artificial Sequence: Synthetic oligonucleotide
ctcagaccaccaagcgcaagtgggag

SEQ ID NO: 5673 - DNA, 26 bp, Artificial Sequence
  Description of Artificial Sequence: Synthetic oligonucleotide
tcagaccaccaagcgcaagtgggagg

SEQ ID NO: 5674 - DNA, 25 bp, Artificial Sequence
  Description of Artificial Sequence: Synthetic oligonucleotide
cagaccaccaagcgcaagtgggagg

SEQ ID NO: 5675 - DNA, 25 bp, Artificial Sequence
  Description of Artificial Sequence: Synthetic oligonucleotide
agaccaccaagcgcaagtgggaggc

SEQ ID NO: 5676 - DNA, 24 bp, Artificial Sequence
  Description of Artificial Sequence: Synthetic oligonucleotide
gaccaccaagcgcaagtgggaggc

SEQ ID NO: 5677 - DNA, 24 bp, Artificial Sequence
  Description of Artificial Sequence: Synthetic oligonucleotide
accaccaagcgcaagtgggaggcg

SEQ ID NO: 5678 - DNA, 23 bp, Artificial Sequence
  Description of Artificial Sequence: Synthetic oligonucleotide
ccaccaagcgcaagtgggaggcg

SEQ ID NO: 5679 - DNA, 25 bp, Artificial Sequence
  Description of Artificial Sequence: Synthetic oligonucleotide
ggcgccgtggatagagcaggaggat

SEQ ID NO: 5680 - DNA, 25 bp, Artificial Sequence
  Description of Artificial Sequence: Synthetic oligonucleotide
gcgccgtggatagagcaggaggatc

SEQ ID NO: 5681 - DNA, 25 bp, Artificial Sequence
  Description of Artificial Sequence: Synthetic oligonucleotide
cgccgtggatagagcaggaggatcc

SEQ ID NO: 5682 - DNA, 25 bp, Artificial Sequence
  Description of Artificial Sequence: Synthetic oligonucleotide
gccgtggatagagcaggaggatccg

SEQ ID NO: 5683 - DNA, 26 bp, Artificial Sequence
  Description of Artificial Sequence: Synthetic oligonucleotide
ccgtggatagagcaggaggatccgga

SEQ ID NO: 5684 - DNA, 27 bp, Artificial Sequence
  Description of Artificial Sequence: Synthetic oligonucleotide
cgtggatagagcaggaggatccggagt

SEQ ID NO: 5685 - DNA, 30 bp, Artificial Sequence
  Description of Artificial Sequence: Synthetic oligonucleotide
gtggatagagcaggaggatccggagtattg

SEQ ID NO: 5686 - DNA, 30 bp, Artificial Sequence
  Description of Artificial Sequence: Synthetic oligonucleotide
tggatagagcaggaggatccggagtattgg

SEQ ID NO: 5687 - DNA, 29 bp, Artificial Sequence
  Description of Artificial Sequence: Synthetic oligonucleotide
ggatagagcaggaggatccggagtattgg

SEQ ID NO: 5688 - DNA, 29 bp, Artificial Sequence
  Description of Artificial Sequence: Synthetic oligonucleotide
gatagagcaggaggatccggagtattggg

SEQ ID NO: 5689 - DNA, 30 bp, Artificial Sequence
  Description of Artificial Sequence: Synthetic oligonucleotide
atagagcaggaggatccggagtattgggac

SEQ ID NO: 5690 - DNA, 29 bp, Artificial Sequence
  Description of Artificial Sequence: Synthetic oligonucleotide
tagagcaggaggatccggagtattgggac

SEQ ID NO: 5691 - DNA, 28 bp, Artificial Sequence
  Description of Artificial Sequence: Synthetic oligonucleotide
agagcaggaggatccggagtattgggac

SEQ ID NO: 5692 - DNA, 27 bp, Artificial Sequence
  Description of Artificial Sequence: Synthetic oligonucleotide
gagcaggaggatccggagtattgggac

SEQ ID NO: 5693 - DNA, 27 bp, Artificial Sequence
  Description of Artificial Sequence: Synthetic oligonucleotide
agcaggaggatccggagtattgggacg

SEQ ID NO: 5694 - DNA, 26 bp, Artificial Sequence
  Description of Artificial Sequence: Synthetic oligonucleotide
gcaggaggatccggagtattgggacg

SEQ ID NO: 5695 - DNA, 26 bp, Artificial Sequence
  Description of Artificial Sequence: Synthetic oligonucleotide
caggaggatccggagtattgggacgg

SEQ ID NO: 5696 - DNA, 26 bp, Artificial Sequence
  Description of Artificial Sequence: Synthetic oligonucleotide
aggaggatccggagtattgggacggg

SEQ ID NO: 5697 - DNA, 25 bp, Artificial Sequence
  Description of Artificial Sequence: Synthetic oligonucleotide
ggaggatccggagtattgggacggg

SEQ ID NO: 5698 - DNA, 26 bp, Artificial Sequence
  Description of Artificial Sequence: Synthetic oligonucleotide
gaggatccggagtattgggacgggga

SEQ ID NO: 5699 - DNA, 27 bp, Artificial Sequence
  Description of Artificial Sequence: Synthetic oligonucleotide
aggatccggagtattgggacggggaga

SEQ ID NO: 5700 - DNA, 26 bp, Artificial Sequence
  Description of Artificial Sequence: Synthetic oligonucleotide
ggatccggagtattgggacggggaga

SEQ ID NO: 5701 - DNA, 27 bp, Artificial Sequence
  Description of Artificial Sequence: Synthetic oligonucleotide
gatccggagtattgggacggggagaca

SEQ ID NO: 5702 - DNA, 27 bp, Artificial Sequence
  Description of Artificial Sequence: Synthetic oligonucleotide
atccggagtattgggacggggagacac

SEQ ID NO: 5703 - DNA, 35 bp, Artificial Sequence
  Description of Artificial Sequence: Synthetic oligonucleotide
gctctcactccatgaggtatttcttcacatacgtg

SEQ ID NO: 5704 - DNA, 36 bp, Artificial Sequence
  Description of Artificial Sequence: Synthetic oligonucleotide
ctctcactccatgaggtatttcttcacatacgtgtc

SEQ ID NO: 5705 - DNA, 36 bp, Artificial Sequence
  Description of Artificial Sequence: Synthetic oligonucleotide
tctcactccatgaggtatttcttcacatacgtgtcc

SEQ ID NO: 5706 - DNA, 35 bp, Artificial Sequence
  Description of Artificial Sequence: Synthetic oligonucleotide
ctcactccatgaggtatttcttcacatacgtgtcc

SEQ ID NO: 5707 - DNA, 35 bp, Artificial Sequence
  Description of Artificial Sequence: Synthetic oligonucleotide
tcactccatgaggtatttcttcacatacgtgtccc

SEQ ID NO: 5708 - DNA, 34 bp, Artificial Sequence
  Description of Artificial Sequence: Synthetic oligonucleotide
cactccatgaggtatttcttcacatacgtgtccc

SEQ ID NO: 5709 - DNA, 34 bp, Artificial Sequence
  Description of Artificial Sequence: Synthetic oligonucleotide
actccatgaggtatttcttcacatacgtgtcccg

SEQ ID NO: 5710 - DNA, 33 bp, Artificial Sequence
  Description of Artificial Sequence: Synthetic oligonucleotide
ctccatgaggtatttcttcacatacgtgtcccg

SEQ ID NO: 5711 - DNA, 33 bp, Artificial Sequence
  Description of Artificial Sequence: Synthetic oligonucleotide
tccatgaggtatttcttcacatacgtgtcccgg

SEQ ID NO: 5712 - DNA, 32 bp, Artificial Sequence
  Description of Artificial Sequence: Synthetic oligonucleotide
ccatgaggtatttcttcacatacgtgtcccgg

SEQ ID NO: 5713 - DNA, 32 bp, Artificial Sequence
  Description of Artificial Sequence: Synthetic oligonucleotide
catgaggtatttcttcacatacgtgtcccggc

SEQ ID NO: 5714 - DNA, 32 bp, Artificial Sequence
  Description of Artificial Sequence: Synthetic oligonucleotide
atgaggtatttcttcacatacgtgtcccggcc

SEQ ID NO: 5715 - DNA, 31 bp, Artificial Sequence
  Description of Artificial Sequence: Synthetic oligonucleotide
tgaggtatttcttcacatacgtgtcccggcc

SEQ ID NO: 5716 - DNA, 30 bp, Artificial Sequence
  Description of Artificial Sequence: Synthetic oligonucleotide
gaggtatttcttcacatacgtgtcccggcc

SEQ ID NO: 5717 - DNA, 30 bp, Artificial Sequence
  Description of Artificial Sequence: Synthetic oligonucleotide
aggtatttcttcacatacgtgtcccggccc

SEQ ID NO: 5718 - DNA, 29 bp, Artificial Sequence
  Description of Artificial Sequence: Synthetic oligonucleotide
ggtatttcttcacatacgtgtcccggccc

SEQ ID NO: 5719 - DNA, 29 bp, Artificial Sequence
  Description of Artificial Sequence: Synthetic oligonucleotide
gtatttcttcacatacgtgtcccggcccg

SEQ ID NO: 5720 - DNA, 29 bp, Artificial Sequence
  Description of Artificial Sequence: Synthetic oligonucleotide
tatttcttcacatacgtgtcccggcccgg

SEQ ID NO: 5721 - DNA, 28 bp, Artificial Sequence
  Description of Artificial Sequence: Synthetic oligonucleotide
atttcttcacatacgtgtcccggcccgg

SEQ ID NO: 5722 - DNA, 27 bp, Artificial Sequence
  Description of Artificial Sequence: Synthetic oligonucleotide
tttcttcacatacgtgtcccggcccgg

SEQ ID NO: 5723 - DNA, 26 bp, Artificial Sequence
  Description of Artificial Sequence: Synthetic oligonucleotide
ttcttcacatacgtgtcccggcccgg

SEQ ID NO: 5724 - DNA, 25 bp, Artificial Sequence
  Description of Artificial Sequence: Synthetic oligonucleotide
tcttcacatacgtgtcccggcccgg

SEQ ID NO: 5725 - DNA, 24 bp, Artificial Sequence
  Description of Artificial Sequence: Synthetic oligonucleotide
cttcacatacgtgtcccggcccgg

SEQ ID NO: 5726 - DNA, 24 bp, Artificial Sequence
  Description of Artificial Sequence: Synthetic oligonucleotide
ttcacatacgtgtcccggcccggc

SEQ ID NO: 5727 - DNA, 23 bp, Artificial Sequence
  Description of Artificial Sequence: Synthetic oligonucleotide
tcacatacgtgtcccggcccggc

SEQ ID NO: 5728 - DNA, 22 bp, Artificial Sequence
  Description of Artificial Sequence: Synthetic oligonucleotide
cacatacgtgtcccggcccggc

SEQ ID NO: 5729 - DNA, 22 bp, Artificial Sequence
  Description of Artificial Sequence: Synthetic oligonucleotide
acatacgtgtcccggcccggcc

SEQ ID NO: 5730 - DNA, 21 bp, Artificial Sequence
  Description of Artificial Sequence: Synthetic oligonucleotide
catacgtgtcccggcccggcc

SEQ ID NO: 5731 - DNA, 21 bp, Artificial Sequence
  Description of Artificial Sequence: Synthetic oligonucleotide
atacgtgtcccggcccggccg

SEQ ID NO: 5732 - DNA, 20 bp, Artificial Sequence
  Description of Artificial Sequence: Synthetic oligonucleotide
tacgtgtcccggcccggccg

SEQ ID NO: 5733 - DNA, 20 bp, Artificial Sequence
  Description of Artificial Sequence: Synthetic oligonucleotide
acgtgtcccggcccggccgt

SEQ ID NO: 5734 - DNA, 24 bp, Artificial Sequence
  Description of Artificial Sequence: Synthetic oligonucleotide
aacgggaaggagacgctgcagcgc

SEQ ID NO: 5735 - DNA, 23 bp, Artificial Sequence
  Description of Artificial Sequence: Synthetic oligonucleotide
acgggaaggagacgctgcagcgc

SEQ ID NO: 5736 - DNA, 22 bp, Artificial Sequence
  Description of Artificial Sequence: Synthetic oligonucleotide
cgggaaggagacgctgcagcgc

SEQ ID NO: 5737 - DNA, 22 bp, Artificial Sequence
  Description of Artificial Sequence: Synthetic oligonucleotide
gggaaggagacgctgcagcgcg

SEQ ID NO: 5738 - DNA, 22 bp, Artificial Sequence
  Description of Artificial Sequence: Synthetic oligonucleotide
ggaaggagacgctgcagcgcgc

SEQ ID NO: 5739 - DNA, 22 bp, Artificial Sequence
  Description of Artificial Sequence: Synthetic oligonucleotide
gaaggagacgctgcagcgcgcg

SEQ ID NO: 5740 - DNA, 23 bp, Artificial Sequence
  Description of Artificial Sequence: Synthetic oligonucleotide
aaggagacgctgcagcgcgcgga

SEQ ID NO: 5741 - DNA, 22 bp, Artificial Sequence
  Description of Artificial Sequence: Synthetic oligonucleotide
aggagacgctgcagcgcgcgga

SEQ ID NO: 5742 - DNA, 21 bp, Artificial Sequence
  Description of Artificial Sequence: Synthetic oligonucleotide
ggagacgctgcagcgcgcgga

SEQ ID NO: 5743 - DNA, 21 bp, Artificial Sequence
  Description of Artificial Sequence: Synthetic oligonucleotide
gagacgctgcagcgcgcggac

SEQ ID NO: 5744 - DNA, 21 bp, Artificial Sequence
  Description of Artificial Sequence: Synthetic oligonucleotide
agacgctgcagcgcgcggacg

SEQ ID NO: 5745 - DNA, 20 bp, Artificial Sequence
  Description of Artificial Sequence: Synthetic oligonucleotide
gacgctgcagcgcgcggacg

SEQ ID NO: 5746 - DNA, 20 bp, Artificial Sequence
  Description of Artificial Sequence: Synthetic oligonucleotide
acgctgcagcgcgcggacgc

SEQ ID NO: 5747 - DNA, 20 bp, Artificial Sequence
  Description of Artificial Sequence: Synthetic oligonucleotide
cgctgcagcgcgcggacgct

SEQ ID NO: 5748 - DNA, 20 bp, Artificial Sequence
  Description of Artificial Sequence: Synthetic oligonucleotide
gctgcagcgcgcggacgcct

SEQ ID NO: 5749 - DNA, 20 bp, Artificial Sequence
  Description of Artificial Sequence: Synthetic oligonucleotide
ctgcagcgcgcggacgccct

SEQ ID NO: 5750 - DNA, 20 bp, Artificial Sequence
  Description of Artificial Sequence: Synthetic oligonucleotide
tgcagcgcgcggacgcccct

SEQ ID NO: 5751 - DNA, 20 bp, Artificial Sequence
  Description of Artificial Sequence: Synthetic oligonucleotide
gcagcgcgcggacgcccctt

SEQ ID NO: 5752 - DNA, 22 bp, Artificial Sequence
  Description of Artificial Sequence: Synthetic oligonucleotide
cagcgcgcggacgcccccaaaa

SEQ ID NO: 5753 - DNA, 22 bp, Artificial Sequence
  Description of Artificial Sequence: Synthetic oligonucleotide
agcgcgcggacgcccccaaaac

SEQ ID NO: 5754 - DNA, 21 bp, Artificial Sequence
  Description of Artificial Sequence: Synthetic oligonucleotide
gcgcgcggacgcccccaaaac

SEQ ID NO: 5755 - DNA, 21 bp, Artificial Sequence
  Description of Artificial Sequence: Synthetic oligonucleotide
cgcgcggacgcccccaaaacg

SEQ ID NO: 5756 - DNA, 25 bp, Artificial Sequence
  Description of Artificial Sequence: Synthetic oligonucleotide
gcgcggacgcccccaaaacgcatat

SEQ ID NO: 5757 - DNA, 26 bp, Artificial Sequence
  Description of Artificial Sequence: Synthetic oligonucleotide
cgcggacgcccccaaaacgcatatga

SEQ ID NO: 5758 - DNA, 27 bp, Artificial Sequence
  Description of Artificial Sequence: Synthetic oligonucleotide
gcggacgcccccaaaacgcatatgact

SEQ ID NO: 5759 - DNA, 33 bp, Artificial Sequence
  Description of Artificial Sequence: Synthetic oligonucleotide
tcccactccatgaggtatttctacacctccatg

SEQ ID NO: 5760 - DNA, 32 bp, Artificial Sequence
  Description of Artificial Sequence: Synthetic oligonucleotide
cccactccatgaggtatttctacacctccatg

SEQ ID NO: 5761 - DNA, 33 bp, Artificial Sequence
  Description of Artificial Sequence: Synthetic oligonucleotide
ccactccatgaggtatttctacacctccatgtc

SEQ ID NO: 5762 - DNA, 33 bp, Artificial Sequence
  Description of Artificial Sequence: Synthetic oligonucleotide
cactccatgaggtatttctacacctccatgtcc

SEQ ID NO: 5763 - DNA, 33 bp, Artificial Sequence
  Description of Artificial Sequence: Synthetic oligonucleotide
actccatgaggtatttctacacctccatgtccc

SEQ ID NO: 5764 - DNA, 32 bp, Artificial Sequence
  Description of Artificial Sequence: Synthetic oligonucleotide
ctccatgaggtatttctacacctccatgtccc

SEQ ID NO: 5765 - DNA, 32 bp, Artificial Sequence
  Description of Artificial Sequence: Synthetic oligonucleotide
tccatgaggtatttctacacctccatgtcccg

SEQ ID NO: 5766 - DNA, 31 bp, Artificial Sequence
  Description of Artificial Sequence: Synthetic oligonucleotide
ccatgaggtatttctacacctccatgtcccg

SEQ ID NO: 5767 - DNA, 31 bp, Artificial Sequence
  Description of Artificial Sequence: Synthetic oligonucleotide
catgaggtatttctacacctccatgtcccgg

SEQ ID NO: 5768 - DNA, 31 bp, Artificial Sequence
  Description of Artificial Sequence: Synthetic oligonucleotide
atgaggtatttctacacctccatgtcccggc

SEQ ID NO: 5769 - DNA, 30 bp, Artificial Sequence
  Description of Artificial Sequence: Synthetic oligonucleotide
tgaggtatttctacacctccatgtcccggc

SEQ ID NO: 5770 - DNA, 29 bp, Artificial Sequence
  Description of Artificial Sequence: Synthetic oligonucleotide
gaggtatttctacacctccatgtcccggc

SEQ ID NO: 5771 - DNA, 29 bp, Artificial Sequence
  Description of Artificial Sequence: Synthetic oligonucleotide
aggtatttctacacctccatgtcccggcc

SEQ ID NO: 5772 - DNA, 28 bp, Artificial Sequence
  Description of Artificial Sequence: Synthetic oligonucleotide
ggtatttctacacctccatgtcccggcc

SEQ ID NO: 5773 - DNA, 28 bp, Artificial Sequence
  Description of Artificial Sequence: Synthetic oligonucleotide
gtatttctacacctccatgtcccggccc

SEQ ID NO: 5774 - DNA, 28 bp, Artificial Sequence
  Description of Artificial Sequence: Synthetic oligonucleotide
tatttctacacctccatgtcccggcccg

SEQ ID NO: 5775 - DNA, 27 bp, Artificial Sequence
  Description of Artificial Sequence: Synthetic oligonucleotide
atttctacacctccatgtcccggcccg

SEQ ID NO: 5776 - DNA, 26 bp, Artificial Sequence
  Description of Artificial Sequence: Synthetic oligonucleotide
tttctacacctccatgtcccggcccg

SEQ ID NO: 5777 - DNA, 25 bp, Artificial Sequence
  Description of Artificial Sequence: Synthetic oligonucleotide
ttctacacctccatgtcccggcccg

SEQ ID NO: 5778 - DNA, 24 bp, Artificial Sequence
  Description of Artificial Sequence: Synthetic oligonucleotide
tctacacctccatgtcccggcccg

SEQ ID NO: 5779 - DNA, 23 bp, Artificial Sequence
  Description of Artificial Sequence: Synthetic oligonucleotide
ctacacctccatgtcccggcccg

SEQ ID NO: 5780 - DNA, 23 bp, Artificial Sequence
  Description of Artificial Sequence: Synthetic oligonucleotide
tacacctccatgtcccggcccgg

SEQ ID NO: 5781 - DNA, 22 bp, Artificial Sequence
  Description of Artificial Sequence: Synthetic oligonucleotide
acacctccatgtcccggcccgg

SEQ ID NO: 5782 - DNA, 21 bp, Artificial Sequence
  Description of Artificial Sequence: Synthetic oligonucleotide
cacctccatgtcccggcccgg

SEQ ID NO: 5783 - DNA, 21 bp, Artificial Sequence
  Description of Artificial Sequence: Synthetic oligonucleotide
acctccatgtcccggcccggc

SEQ ID NO: 5784 - DNA, 20 bp, Artificial Sequence
  Description of Artificial Sequence: Synthetic oligonucleotide
cctccatgtcccggcccggc

SEQ ID NO: 5785 - DNA, 20 bp, Artificial Sequence
  Description of Artificial Sequence: Synthetic oligonucleotide
ctccatgtcccggcccggcc

SEQ ID NO: 5786 - DNA, 20 bp, Artificial Sequence
  Description of Artificial Sequence: Synthetic oligonucleotide
tccatgtcccggcccggccg

SEQ ID NO: 5787 - DNA, 20 bp, Artificial Sequence
  Description of Artificial Sequence: Synthetic oligonucleotide
ccatgtcccggcccggccgt

SEQ ID NO: 5788 - DNA, 20 bp, Artificial Sequence
  Description of Artificial Sequence: Synthetic oligonucleotide
catgtcccggcccggccgct

SEQ ID NO: 5789 - DNA, 20 bp, Artificial Sequence
  Description of Artificial Sequence: Synthetic oligonucleotide
atgtcccggcccggccgcgt

SEQ ID NO: 5790 - DNA, 26 bp, Artificial Sequence
  Description of Artificial Sequence: Synthetic oligonucleotide
cgaggccggttctcacaccatccaga

SEQ ID NO: 5791 - DNA, 26 bp, Artificial Sequence
  Description of Artificial Sequence: Synthetic oligonucleotide
gaggccggttctcacaccatccagag

SEQ ID NO: 5792 - DNA, 27 bp, Artificial Sequence
  Description of Artificial Sequence: Synthetic oligonucleotide
aggccggttctcacaccatccagagga

SEQ ID NO: 5793 - DNA, 27 bp, Artificial Sequence
  Description of Artificial Sequence: Synthetic oligonucleotide
ggccggttctcacaccatccagaggat

SEQ ID NO: 5794 - DNA, 27 bp, Artificial Sequence
  Description of Artificial Sequence: Synthetic oligonucleotide
gccggttctcacaccatccagaggatg

SEQ ID NO: 5795 - DNA, 30 bp, Artificial Sequence
  Description of Artificial Sequence: Synthetic oligonucleotide
ccggttctcacaccatccagaggatgtatg

SEQ ID NO: 5796 - DNA, 30 bp, Artificial Sequence
  Description of Artificial Sequence: Synthetic oligonucleotide
cggttctcacaccatccagaggatgtatgg

SEQ ID NO: 5797 - DNA, 30 bp, Artificial Sequence
  Description of Artificial Sequence: Synthetic oligonucleotide
ggttctcacaccatccagaggatgtatggc

SEQ ID NO: 5798 - DNA, 31 bp, Artificial Sequence
  Description of Artificial Sequence: Synthetic oligonucleotide
gttctcacaccatccagaggatgtatggctg

SEQ ID NO: 5799 - DNA, 31 bp, Artificial Sequence
  Description of Artificial Sequence: Synthetic oligonucleotide
ttctcacaccatccagaggatgtatggctgc

SEQ ID NO: 5800 - DNA, 30 bp, Artificial Sequence
  Description of Artificial Sequence: Synthetic oligonucleotide
tctcacaccatccagaggatgtatggctgc

SEQ ID NO: 5801 - DNA, 29 bp, Artificial Sequence
  Description of Artificial Sequence: Synthetic oligonucleotide
ctcacaccatccagaggatgtatggctgc

SEQ ID NO: 5802 - DNA, 29 bp, Artificial Sequence
  Description of Artificial Sequence: Synthetic oligonucleotide
tcacaccatccagaggatgtatggctgcg

SEQ ID NO: 5803 - DNA, 28 bp, Artificial Sequence
  Description of Artificial Sequence: Synthetic oligonucleotide
cacaccatccagaggatgtatggctgcg

SEQ ID NO: 5804 - DNA, 29 bp, Artificial Sequence
  Description of Artificial Sequence: Synthetic oligonucleotide
acaccatccagaggatgtatggctgcgac

SEQ ID NO: 5805 - DNA, 28 bp, Artificial Sequence
  Description of Artificial Sequence: Synthetic oligonucleotide
caccatccagaggatgtatggctgcgac

SEQ ID NO: 5806 - DNA, 28 bp, Artificial Sequence
  Description of Artificial Sequence: Synthetic oligonucleotide
accatccagaggatgtatggctgcgacg

SEQ ID NO: 5807 - DNA, 27 bp, Artificial Sequence
  Description of Artificial Sequence: Synthetic oligonucleotide
ccatccagaggatgtatggctgcgacg

SEQ ID NO: 5808 - DNA, 28 bp, Artificial Sequence
  Description of Artificial Sequence: Synthetic oligonucleotide
catccagaggatgtatggctgcgacgtg

SEQ ID NO: 5809 - DNA, 28 bp, Artificial Sequence
  Description of Artificial Sequence: Synthetic oligonucleotide
atccagaggatgtatggctgcgacgtgg

SEQ ID NO: 5810 - DNA, 22 bp, Artificial Sequence
  Description of Artificial Sequence: Synthetic oligonucleotide
acatccgtgtcccggcccggct

SEQ ID NO: 5811 - DNA, 21 bp, Artificial Sequence
  Description of Artificial Sequence: Synthetic oligonucleotide
catccgtgtcccggcccggct

SEQ ID NO: 5812 - DNA, 21 bp, Artificial Sequence
  Description of Artificial Sequence: Synthetic oligonucleotide
atccgtgtcccggcccggctg

SEQ ID NO: 5813 - DNA, 20 bp, Artificial Sequence
  Description of Artificial Sequence: Synthetic oligonucleotide
tccgtgtcccggcccggctg

SEQ ID NO: 5814 - DNA, 20 bp, Artificial Sequence
  Description of Artificial Sequence: Synthetic oligonucleotide
ccgtgtcccggcccggctgt

SEQ ID NO: 5815 - DNA, 20 bp, Artificial Sequence
  Description of Artificial Sequence: Synthetic oligonucleotide
cgtgtcccggcccggctgct

SEQ ID NO: 5816 - DNA, 20 bp, Artificial Sequence
  Description of Artificial Sequence: Synthetic oligonucleotide
gtgtcccggcccggctgcgt

SEQ ID NO: 5817 - DNA, 20 bp, Artificial Sequence
  Description of Artificial Sequence: Synthetic oligonucleotide
tgtcccggcccggctgcggt

SEQ ID NO: 5818 - DNA, 20 bp, Artificial Sequence
  Description of Artificial Sequence: Synthetic oligonucleotide
gtcccggcccggctgcggtt

SEQ ID NO: 5819 - DNA, 20 bp, Artificial Sequence
  Description of Artificial Sequence: Synthetic oligonucleotide
tcccggcccggctgcgggtt

SEQ ID NO: 5820 - DNA, 20 bp, Artificial Sequence
  Description of Artificial Sequence: Synthetic oligonucleotide
cccggcccggctgcgggttt

SEQ ID NO: 5821 - DNA, 20 bp, Artificial Sequence
  Description of Artificial Sequence: Synthetic oligonucleotide
ccggcccggctgcggggatt

SEQ ID NO: 5822 - DNA, 20 bp, Artificial Sequence
  Description of Artificial Sequence: Synthetic oligonucleotide
cggcccggctgcggggagtt

SEQ ID NO: 5823 - DNA, 20 bp, Artificial Sequence
  Description of Artificial Sequence: Synthetic oligonucleotide
ggcccggctgcggggagctt

SEQ ID NO: 5824 - DNA, 20 bp, Artificial Sequence
  Description of Artificial Sequence: Synthetic oligonucleotide
gcccggctgcggggagcctt

SEQ ID NO: 5825 - DNA, 20 bp, Artificial Sequence
  Description of Artificial Sequence: Synthetic oligonucleotide
cccggctgcggggagccctt

SEQ ID NO: 5826 - DNA, 20 bp, Artificial Sequence
  Description of Artificial Sequence: Synthetic oligonucleotide
ccggctgcggggagcccctt

SEQ ID NO: 5827 - DNA, 20 bp, Artificial Sequence
  Description of Artificial Sequence: Synthetic oligonucleotide
cggctgcggggagccccgtt

SEQ ID NO: 5828 - DNA, 20 bp, Artificial Sequence
  Description of Artificial Sequence: Synthetic oligonucleotide
ggctgcggggagccccgctt

SEQ ID NO: 5829 - DNA, 22 bp, Artificial Sequence
  Description of Artificial Sequence: Synthetic oligonucleotide
gctgcggggagccccgcttcat

SEQ ID NO: 5830 - DNA, 22 bp, Artificial Sequence
  Description of Artificial Sequence: Synthetic oligonucleotide
ctgcggggagccccgcttcatc

SEQ ID NO: 5831 - DNA, 22 bp, Artificial Sequence
  Description of Artificial Sequence: Synthetic oligonucleotide
tgcggggagccccgcttcatcg

SEQ ID NO: 5832 - DNA, 26 bp, Artificial Sequence
  Description of Artificial Sequence: Synthetic oligonucleotide
ggcccactcacagactgaccgagaga

SEQ ID NO: 5833 - DNA, 26 bp, Artificial Sequence
  Description of Artificial Sequence: Synthetic oligonucleotide
gcccactcacagactgaccgagagag

SEQ ID NO: 5834 - DNA, 26 bp, Artificial Sequence
  Description of Artificial Sequence: Synthetic oligonucleotide
cccactcacagactgaccgagagagc

SEQ ID NO: 5835 - DNA, 27 bp, Artificial Sequence
  Description of Artificial Sequence: Synthetic oligonucleotide
ccactcacagactgaccgagagagcct

SEQ ID NO: 5836 - DNA, 27 bp, Artificial Sequence
  Description of Artificial Sequence: Synthetic oligonucleotide
cactcacagactgaccgagagagcctg

SEQ ID NO: 5837 - DNA, 27 bp, Artificial Sequence
  Description of Artificial Sequence: Synthetic oligonucleotide
actcacagactgaccgagagagcctgc

SEQ ID NO: 5838 - DNA, 26 bp, Artificial Sequence
  Description of Artificial Sequence: Synthetic oligonucleotide
ctcacagactgaccgagagagcctgc

SEQ ID NO: 5839 - DNA, 26 bp, Artificial Sequence
  Description of Artificial Sequence: Synthetic oligonucleotide
tcacagactgaccgagagagcctgcg

SEQ ID NO: 5840 - DNA, 25 bp, Artificial Sequence
  Description of Artificial Sequence: Synthetic oligonucleotide
cacagactgaccgagagagcctgcg

SEQ ID NO: 5841 - DNA, 27 bp, Artificial Sequence
  Description of Artificial Sequence: Synthetic oligonucleotide
acagactgaccgagagagcctgcggat

SEQ ID NO: 5842 - DNA, 26 bp, Artificial Sequence
  Description of Artificial Sequence: Synthetic oligonucleotide
cagactgaccgagagagcctgcggat

SEQ ID NO: 5843 - DNA, 26 bp, Artificial Sequence
  Description of Artificial Sequence: Synthetic oligonucleotide
agactgaccgagagagcctgcggatc

SEQ ID NO: 5844 - DNA, 25 bp, Artificial Sequence
  Description of Artificial Sequence: Synthetic oligonucleotide
gactgaccgagagagcctgcggatc

SEQ ID NO: 5845 - DNA, 25 bp, Artificial Sequence
  Description of Artificial Sequence: Synthetic oligonucleotide
actgaccgagagagcctgcggatcg

SEQ ID NO: 5846 - DNA, 24 bp, Artificial Sequence
  Description of Artificial Sequence: Synthetic oligonucleotide
ctgaccgagagagcctgcggatcg

SEQ ID NO: 5847 - DNA, 24 bp, Artificial Sequence
  Description of Artificial Sequence: Synthetic oligonucleotide
tgaccgagagagcctgcggatcgc

SEQ ID NO: 5848 - DNA, 23 bp, Artificial Sequence
  Description of Artificial Sequence: Synthetic oligonucleotide
gaccgagagagcctgcggatcgc

SEQ ID NO: 5849 - DNA, 23 bp, Artificial Sequence
  Description of Artificial Sequence: Synthetic oligonucleotide
accgagagagcctgcggatcgcg

SEQ ID NO: 5850 - DNA, 22 bp, Artificial Sequence
  Description of Artificial Sequence: Synthetic oligonucleotide
ccgagagagcctgcggatcgcg

SEQ ID NO: 5851 - DNA, 23 bp, Artificial Sequence
  Description of Artificial Sequence: Synthetic oligonucleotide
cgagagagcctgcggatcgcgct

SEQ ID NO: 5852 - DNA, 23 bp, Artificial Sequence
  Description of Artificial Sequence: Synthetic oligonucleotide
gagagagcctgcggatcgcgctc

SEQ ID NO: 5853 - DNA, 23 bp, Artificial Sequence
  Description of Artificial Sequence: Synthetic oligonucleotide
agagagcctgcggatcgcgctcc

SEQ ID NO: 5854 - DNA, 22 bp, Artificial Sequence
  Description of Artificial Sequence: Synthetic oligonucleotide
gagagcctgcggatcgcgctcc

SEQ ID NO: 5855 - DNA, 22 bp, Artificial Sequence
  Description of Artificial Sequence: Synthetic oligonucleotide
agagcctgcggatcgcgctccg

SEQ ID NO: 5856 - DNA, 21 bp, Artificial Sequence
  Description of Artificial Sequence: Synthetic oligonucleotide
gagcctgcggatcgcgctccg

SEQ ID NO: 5857 - DNA, 23 bp, Artificial Sequence
  Description of Artificial Sequence: Synthetic oligonucleotide
agcctgcggatcgcgctccgcta

SEQ ID NO: 5858 - DNA, 22 bp, Artificial Sequence
  Description of Artificial Sequence: Synthetic oligonucleotide
gcctgcggatcgcgctccgcta

SEQ ID NO: 5859 - DNA, 33 bp, Artificial Sequence
  Description of Artificial Sequence: Synthetic oligonucleotide
agatacacctgccatgtgcagcatgaggttttg

SEQ ID NO: 5860 - DNA, 32 bp, Artificial Sequence
  Description of Artificial Sequence: Synthetic oligonucleotide
gatacacctgccatgtgcagcatgaggttttg

SEQ ID NO: 5861 - DNA, 32 bp, Artificial Sequence
  Description of Artificial Sequence: Synthetic oligonucleotide
atacacctgccatgtgcagcatgaggttttgc

SEQ ID NO: 5862 - DNA, 31 bp, Artificial Sequence
  Description of Artificial Sequence: Synthetic oligonucleotide
tacacctgccatgtgcagcatgaggttttgc

SEQ ID NO: 5863 - DNA, 30 bp, Artificial Sequence
  Description of Artificial Sequence: Synthetic oligonucleotide
acacctgccatgtgcagcatgaggttttgc

SEQ ID NO: 5864 - DNA, 29 bp, Artificial Sequence
  Description of Artificial Sequence: Synthetic oligonucleotide
cacctgccatgtgcagcatgaggttttgc

SEQ ID NO: 5865 - DNA, 29 bp, Artificial Sequence
  Description of Artificial Sequence: Synthetic oligonucleotide
acctgccatgtgcagcatgaggttttgcc

SEQ ID NO: 5866 - DNA, 28 bp, Artificial Sequence
  Description of Artificial Sequence: Synthetic oligonucleotide
cctgccatgtgcagcatgaggttttgcc

SEQ ID NO: 5867 - DNA, 28 bp, Artificial Sequence
  Description of Artificial Sequence: Synthetic oligonucleotide
ctgccatgtgcagcatgaggttttgccc

SEQ ID NO: 5868 - DNA, 30 bp, Artificial Sequence
  Description of Artificial Sequence: Synthetic oligonucleotide
tgccatgtgcagcatgaggttttgcccaag

SEQ ID NO: 5869 - DNA, 29 bp, Artificial Sequence
  Description of Artificial Sequence: Synthetic oligonucleotide
gccatgtgcagcatgaggttttgcccaag

SEQ ID NO: 5870 - DNA, 29 bp, Artificial Sequence
  Description of Artificial Sequence: Synthetic oligonucleotide
ccatgtgcagcatgaggttttgcccaagc

SEQ ID NO: 5871 - DNA, 29 bp, Artificial Sequence
  Description of Artificial Sequence: Synthetic oligonucleotide
catgtgcagcatgaggttttgcccaagcc

SEQ ID NO: 5872 - DNA, 29 bp, Artificial Sequence
  Description of Artificial Sequence: Synthetic oligonucleotide
atgtgcagcatgaggttttgcccaagccc

SEQ ID NO: 5873 - DNA, 28 bp, Artificial Sequence
  Description of Artificial Sequence: Synthetic oligonucleotide
tgtgcagcatgaggttttgcccaagccc

SEQ ID NO: 5874 - DNA, 27 bp, Artificial Sequence
  Description of Artificial Sequence: Synthetic oligonucleotide
gtgcagcatgaggttttgcccaagccc

SEQ ID NO: 5875 - DNA, 27 bp, Artificial Sequence
  Description of Artificial Sequence: Synthetic oligonucleotide
tgcagcatgaggttttgcccaagcccc

SEQ ID NO: 5876 - DNA, 27 bp, Artificial Sequence
  Description of Artificial Sequence: Synthetic oligonucleotide
gcagcatgaggttttgcccaagcccct

SEQ ID NO: 5877 - DNA, 27 bp, Artificial Sequence
  Description of Artificial Sequence: Synthetic oligonucleotide
cagcatgaggttttgcccaagcccctc

SEQ ID NO: 5878 - DNA, 28 bp, Artificial Sequence
  Description of Artificial Sequence: Synthetic oligonucleotide
agcatgaggttttgcccaagcccctcac

SEQ ID NO: 5879 - DNA, 27 bp, Artificial Sequence
  Description of Artificial Sequence: Synthetic oligonucleotide
gcatgaggttttgcccaagcccctcac

SEQ ID NO: 5880 - DNA, 27 bp, Artificial Sequence
  Description of Artificial Sequence: Synthetic oligonucleotide
catgaggttttgcccaagcccctcacc

SEQ ID NO: 5881 - DNA, 27 bp, Artificial Sequence
  Description of Artificial Sequence: Synthetic oligonucleotide
atgaggttttgcccaagcccctcaccc

SEQ ID NO: 5882 - DNA, 27 bp, Artificial Sequence
  Description of Artificial Sequence: Synthetic oligonucleotide
tgaggttttgcccaagcccctcaccct

SEQ ID NO: 5883 - DNA, 26 bp, Artificial Sequence
  Description of Artificial Sequence: Synthetic oligonucleotide
gaggttttgcccaagcccctcaccct

SEQ ID NO: 5884 - DNA, 27 bp, Artificial Sequence
  Description of Artificial Sequence: Synthetic oligonucleotide
aggttttgcccaagcccctcaccctga

SEQ ID NO: 5885 - DNA, 26 bp, Artificial Sequence
  Description of Artificial Sequence: Synthetic oligonucleotide
ggttttgcccaagcccctcaccctga

SEQ ID NO: 5886 - DNA, 27 bp, Artificial Sequence
  Description of Artificial Sequence: Synthetic oligonucleotide
gttttgcccaagcccctcaccctgaga

SEQ ID NO: 5887 - DNA, 28 bp, Artificial Sequence
  Description of Artificial Sequence: Synthetic oligonucleotide
ttttgcccaagcccctcaccctgagatg

SEQ ID NO: 5888 - DNA, 26 bp, Artificial Sequence
  Description of Artificial Sequence: Synthetic oligonucleotide
agggtccggagtattgggacggggaa

SEQ ID NO: 5889 - DNA, 25 bp, Artificial Sequence
  Description of Artificial Sequence: Synthetic oligonucleotide
gggtccggagtattgggacggggaa

SEQ ID NO: 5890 - DNA, 26 bp, Artificial Sequence
  Description of Artificial Sequence: Synthetic oligonucleotide
ggtccggagtattgggacggggaaca

SEQ ID NO: 5891 - DNA, 26 bp, Artificial Sequence
  Description of Artificial Sequence: Synthetic oligonucleotide
gtccggagtattgggacggggaacac

SEQ ID NO: 5892 - DNA, 26 bp, Artificial Sequence
  Description of Artificial Sequence: Synthetic oligonucleotide
tccggagtattgggacggggaacacg

SEQ ID NO: 5893 - DNA, 25 bp, Artificial Sequence
  Description of Artificial Sequence: Synthetic oligonucleotide
ccggagtattgggacggggaacacg

SEQ ID NO: 5894 - DNA, 27 bp, Artificial Sequence
  Description of Artificial Sequence: Synthetic oligonucleotide
cggagtattgggacggggaacacggaa

SEQ ID NO: 5895 - DNA, 28 bp, Artificial Sequence
  Description of Artificial Sequence: Synthetic oligonucleotide
ggagtattgggacggggaacacggaaag

SEQ ID NO: 5896 - DNA, 29 bp, Artificial Sequence
  Description of Artificial Sequence: Synthetic oligonucleotide
gagtattgggacggggaacacggaaagtg

SEQ ID NO: 5897 - DNA, 31 bp, Artificial Sequence
  Description of Artificial Sequence: Synthetic oligonucleotide
agtattgggacggggaacacggaaagtgaag

SEQ ID NO: 5898 - DNA, 30 bp, Artificial Sequence
  Description of Artificial Sequence: Synthetic oligonucleotide
gtattgggacggggaacacggaaagtgaag

SEQ ID NO: 5899 - DNA, 30 bp, Artificial Sequence
  Description of Artificial Sequence: Synthetic oligonucleotide
tattgggacggggaacacggaaagtgaagg

SEQ ID NO: 5900 - DNA, 29 bp, Artificial Sequence
  Description of Artificial Sequence: Synthetic oligonucleotide
attgggacggggaacacggaaagtgaagg

SEQ ID NO: 5901 - DNA, 28 bp, Artificial Sequence
  Description of Artificial Sequence: Synthetic oligonucleotide
ttgggacggggaacacggaaagtgaagg

SEQ ID NO: 5902 - DNA, 27 bp, Artificial Sequence
  Description of Artificial Sequence: Synthetic oligonucleotide
tgggacggggaacacggaaagtgaagg

SEQ ID NO: 5903 - DNA, 26 bp, Artificial Sequence
  Description of Artificial Sequence: Synthetic oligonucleotide
gggacggggaacacggaaagtgaagg

SEQ ID NO: 5904 - DNA, 26 bp, Artificial Sequence
  Description of Artificial Sequence: Synthetic oligonucleotide
ggacggggaacacggaaagtgaaggc

SEQ ID NO: 5905 - DNA, 26 bp, Artificial Sequence
  Description of Artificial Sequence: Synthetic oligonucleotide
gacggggaacacggaaagtgaaggcc

SEQ ID NO: 5906 - DNA, 27 bp, Artificial Sequence
  Description of Artificial Sequence: Synthetic oligonucleotide
acggggaacacggaaagtgaaggccca

SEQ ID NO: 5907 - DNA, 26 bp, Artificial Sequence
  Description of Artificial Sequence: Synthetic oligonucleotide
cggggaacacggaaagtgaaggccca

SEQ ID NO: 5908 - DNA, 27 bp, Artificial Sequence
  Description of Artificial Sequence: Synthetic oligonucleotide
ggggaacacggaaagtgaaggcccact

SEQ ID NO: 5909 - DNA, 27 bp, Artificial Sequence
  Description of Artificial Sequence: Synthetic oligonucleotide
gggaacacggaaagtgaaggcccactc

SEQ ID NO: 5910 - DNA, 28 bp, Artificial Sequence
  Description of Artificial Sequence: Synthetic oligonucleotide
ggaacacggaaagtgaaggcccactcac

SEQ ID NO: 5911 - DNA, 29 bp, Artificial Sequence
  Description of Artificial Sequence: Synthetic oligonucleotide
gaacacggaaagtgaaggcccactcacag

SEQ ID NO: 5912 - DNA, 31 bp, Artificial Sequence
  Description of Artificial Sequence: Synthetic oligonucleotide
tggacaggagcagagatacacctgccatatg

SEQ ID NO: 5913 - DNA, 30 bp, Artificial Sequence
  Description of Artificial Sequence: Synthetic oligonucleotide
ggacaggagcagagatacacctgccatatg

SEQ ID NO: 5914 - DNA, 30 bp, Artificial Sequence
  Description of Artificial Sequence: Synthetic oligonucleotide
gacaggagcagagatacacctgccatatgc

SEQ ID NO: 5915 - DNA, 31 bp, Artificial Sequence
  Description of Artificial Sequence: Synthetic oligonucleotide
acaggagcagagatacacctgccatatgcag

SEQ ID NO: 5916 - DNA, 30 bp, Artificial Sequence
  Description of Artificial Sequence: Synthetic oligonucleotide
caggagcagagatacacctgccatatgcag

SEQ ID NO: 5917 - DNA, 30 bp, Artificial Sequence
  Description of Artificial Sequence: Synthetic oligonucleotide
aggagcagagatacacctgccatatgcagc

SEQ ID NO: 5918 - DNA, 29 bp, Artificial Sequence
  Description of Artificial Sequence: Synthetic oligonucleotide
ggagcagagatacacctgccatatgcagc

SEQ ID NO: 5919 - DNA, 31 bp, Artificial Sequence
  Description of Artificial Sequence: Synthetic oligonucleotide
gagcagagatacacctgccatatgcagcatg

SEQ ID NO: 5920 - DNA, 32 bp, Artificial Sequence
  Description of Artificial Sequence: Synthetic oligonucleotide
agcagagatacacctgccatatgcagcatgag

SEQ ID NO: 5921 - DNA, 31 bp, Artificial Sequence
  Description of Artificial Sequence: Synthetic oligonucleotide
gcagagatacacctgccatatgcagcatgag

SEQ ID NO: 5922 - DNA, 31 bp, Artificial Sequence
  Description of Artificial Sequence: Synthetic oligonucleotide
cagagatacacctgccatatgcagcatgagg

SEQ ID NO: 5923 - DNA, 31 bp, Artificial Sequence
  Description of Artificial Sequence: Synthetic oligonucleotide
agagatacacctgccatatgcagcatgaggg

SEQ ID NO: 5924 - DNA, 30 bp, Artificial Sequence
  Description of Artificial Sequence: Synthetic oligonucleotide
gagatacacctgccatatgcagcatgaggg

SEQ ID NO: 5925 - DNA, 33 bp, Artificial Sequence
  Description of Artificial Sequence: Synthetic oligonucleotide
agatacacctgccatatgcagcatgagggtttg

SEQ ID NO: 5926 - DNA, 32 bp, Artificial Sequence
  Description of Artificial Sequence: Synthetic oligonucleotide
gatacacctgccatatgcagcatgagggtttg

SEQ ID NO: 5927 - DNA, 32 bp, Artificial Sequence
  Description of Artificial Sequence: Synthetic oligonucleotide
atacacctgccatatgcagcatgagggtttgc

SEQ ID NO: 5928 - DNA, 31 bp, Artificial Sequence
  Description of Artificial Sequence: Synthetic oligonucleotide
tacacctgccatatgcagcatgagggtttgc

SEQ ID NO: 5929 - DNA, 30 bp, Artificial Sequence
  Description of Artificial Sequence: Synthetic oligonucleotide
acacctgccatatgcagcatgagggtttgc

SEQ ID NO: 5930 - DNA, 29 bp, Artificial Sequence
  Description of Artificial Sequence: Synthetic oligonucleotide
cacctgccatatgcagcatgagggtttgc

SEQ ID NO: 5931 - DNA, 29 bp, Artificial Sequence
  Description of Artificial Sequence: Synthetic oligonucleotide
acctgccatatgcagcatgagggtttgcc

SEQ ID NO: 5932 - DNA, 28 bp, Artificial Sequence
  Description of Artificial Sequence: Synthetic oligonucleotide
cctgccatatgcagcatgagggtttgcc

SEQ ID NO: 5933 - DNA, 28 bp, Artificial Sequence
  Description of Artificial Sequence: Synthetic oligonucleotide
ctgccatatgcagcatgagggtttgccc

SEQ ID NO: 5934 - DNA, 30 bp, Artificial Sequence
  Description of Artificial Sequence: Synthetic oligonucleotide
tgccatatgcagcatgagggtttgcccaag

SEQ ID NO: 5935 - DNA, 29 bp, Artificial Sequence
  Description of Artificial Sequence: Synthetic oligonucleotide
gccatatgcagcatgagggtttgcccaag

SEQ ID NO: 5936 - DNA, 29 bp, Artificial Sequence
  Description of Artificial Sequence: Synthetic oligonucleotide
ccatatgcagcatgagggtttgcccaagc

SEQ ID NO: 5937 - DNA, 29 bp, Artificial Sequence
  Description of Artificial Sequence: Synthetic oligonucleotide
catatgcagcatgagggtttgcccaagcc

SEQ ID NO: 5938 - DNA, 29 bp, Artificial Sequence
  Description of Artificial Sequence: Synthetic oligonucleotide
atatgcagcatgagggtttgcccaagccc

SEQ ID NO: 5939 - DNA, 28 bp, Artificial Sequence
  Description of Artificial Sequence: Synthetic oligonucleotide
tatgcagcatgagggtttgcccaagccc

SEQ ID NO: 5940 - DNA, 27 bp, Artificial Sequence
  Description of Artificial Sequence: Synthetic oligonucleotide
atgcagcatgagggtttgcccaagccc

SEQ ID NO: 5941 - DNA, 27 bp, Artificial Sequence
  Description of Artificial Sequence: Synthetic oligonucleotide
gcagttgagagcctacctggagggcaa

SEQ ID NO: 5942 - DNA, 27 bp, Artificial Sequence
  Description of Artificial Sequence: Synthetic oligonucleotide
cagttgagagcctacctggagggcaag

SEQ ID NO: 5943 - DNA, 28 bp, Artificial Sequence
  Description of Artificial Sequence: Synthetic oligonucleotide
agttgagagcctacctggagggcaagtg

SEQ ID NO: 5944 - DNA, 27 bp, Artificial Sequence
  Description of Artificial Sequence: Synthetic oligonucleotide
gttgagagcctacctggagggcaagtg

SEQ ID NO: 5945 - DNA, 27 bp, Artificial Sequence
  Description of Artificial Sequence: Synthetic oligonucleotide
ttgagagcctacctggagggcaagtgc

SEQ ID NO: 5946 - DNA, 26 bp, Artificial Sequence
  Description of Artificial Sequence: Synthetic oligonucleotide
tgagagcctacctggagggcaagtgc

SEQ ID NO: 5947 - DNA, 25 bp, Artificial Sequence
  Description of Artificial Sequence: Synthetic oligonucleotide
gagagcctacctggagggcaagtgc

SEQ ID NO: 5948 - DNA, 26 bp, Artificial Sequence
  Description of Artificial Sequence: Synthetic oligonucleotide
agagcctacctggagggcaagtgcgt

SEQ ID NO: 5949 - DNA, 25 bp, Artificial Sequence
  Description of Artificial Sequence: Synthetic oligonucleotide
gagcctacctggagggcaagtgcgt

SEQ ID NO: 5950 - DNA, 25 bp, Artificial Sequence
  Description of Artificial Sequence: Synthetic oligonucleotide
agcctacctggagggcaagtgcgtg

SEQ ID NO: 5951 - DNA, 24 bp, Artificial Sequence
  Description of Artificial Sequence: Synthetic oligonucleotide
gcctacctggagggcaagtgcgtg

SEQ ID NO: 5952 - DNA, 25 bp, Artificial Sequence
  Description of Artificial Sequence: Synthetic oligonucleotide
cctacctggagggcaagtgcgtgga

SEQ ID NO: 5953 - DNA, 26 bp, Artificial Sequence
  Description of Artificial Sequence: Synthetic oligonucleotide
ctacctggagggcaagtgcgtggagt

SEQ ID NO: 5954 - DNA, 26 bp, Artificial Sequence
  Description of Artificial Sequence: Synthetic oligonucleotide
tacctggagggcaagtgcgtggagtg

SEQ ID NO: 5955 - DNA, 25 bp, Artificial Sequence
  Description of Artificial Sequence: Synthetic oligonucleotide
acctggagggcaagtgcgtggagtg

SEQ ID NO: 5956 - DNA, 24 bp, Artificial Sequence
  Description of Artificial Sequence: Synthetic oligonucleotide
cctggagggcaagtgcgtggagtg

SEQ ID NO: 5957 - DNA, 24 bp, Artificial Sequence
  Description of Artificial Sequence: Synthetic oligonucleotide
ctggagggcaagtgcgtggagtgg

SEQ ID NO: 5958 - DNA, 25 bp, Artificial Sequence
  Description of Artificial Sequence: Synthetic oligonucleotide
tggagggcaagtgcgtggagtggct

SEQ ID NO: 5959 - DNA, 24 bp, Artificial Sequence
  Description of Artificial Sequence: Synthetic oligonucleotide
ggagggcaagtgcgtggagtggct

SEQ ID NO: 5960 - DNA, 24 bp, Artificial Sequence
  Description of Artificial Sequence: Synthetic oligonucleotide
gagggcaagtgcgtggagtggctc

SEQ ID NO: 5961 - DNA, 24 bp, Artificial Sequence
  Description of Artificial Sequence: Synthetic oligonucleotide
agggcaagtgcgtggagtggctcc

SEQ ID NO: 5962 - DNA, 23 bp, Artificial Sequence
  Description of Artificial Sequence: Synthetic oligonucleotide
gggcaagtgcgtggagtggctcc

SEQ ID NO: 5963 - DNA, 23 bp, Artificial Sequence
  Description of Artificial Sequence: Synthetic oligonucleotide
ggcaagtgcgtggagtggctccg

SEQ ID NO: 5964 - DNA, 24 bp, Artificial Sequence
  Description of Artificial Sequence: Synthetic oligonucleotide
gcaagtgcgtggagtggctccgca

SEQ ID NO: 5965 - DNA, 27 bp, Artificial Sequence
  Description of Artificial Sequence: Synthetic oligonucleotide
caagtgcgtggagtggctccgcagata

SEQ ID NO: 5966 - DNA, 27 bp, Artificial Sequence
  Description of Artificial Sequence: Synthetic oligonucleotide
aagtgcgtggagtggctccgcagatac

SEQ ID NO: 5967 - DNA, 26 bp, Artificial Sequence
  Description of Artificial Sequence: Synthetic oligonucleotide
agtgcgtggagtggctccgcagatac

SEQ ID NO: 5968 - DNA, 31 bp, Artificial Sequence
  Description of Artificial Sequence: Synthetic oligonucleotide
acacggaatgtgaaggcccactcacagattg

SEQ ID NO: 5969 - DNA, 30 bp, Artificial Sequence
  Description of Artificial Sequence: Synthetic oligonucleotide
cacggaatgtgaaggcccactcacagattg

SEQ ID NO: 5970 - DNA, 31 bp, Artificial Sequence
  Description of Artificial Sequence: Synthetic oligonucleotide
acggaatgtgaaggcccactcacagattgac

SEQ ID NO: 5971 - DNA, 30 bp, Artificial Sequence
  Description of Artificial Sequence: Synthetic oligonucleotide
cggaatgtgaaggcccactcacagattgac

SEQ ID NO: 5972 - DNA, 30 bp, Artificial Sequence
  Description of Artificial Sequence: Synthetic oligonucleotide
ggaatgtgaaggcccactcacagattgacc

SEQ ID NO: 5973 - DNA, 30 bp, Artificial Sequence
  Description of Artificial Sequence: Synthetic oligonucleotide
gaatgtgaaggcccactcacagattgaccg

SEQ ID NO: 5974 - DNA, 31 bp, Artificial Sequence
  Description of Artificial Sequence: Synthetic oligonucleotide
aatgtgaaggcccactcacagattgaccgag

SEQ ID NO: 5975 - DNA, 30 bp, Artificial Sequence
  Description of Artificial Sequence: Synthetic oligonucleotide
atgtgaaggcccactcacagattgaccgag

SEQ ID NO: 5976 - DNA, 29 bp, Artificial Sequence
  Description of Artificial Sequence: Synthetic oligonucleotide
tgtgaaggcccactcacagattgaccgag

SEQ ID NO: 5977 - DNA, 25 bp, Artificial Sequence
  Description of Artificial Sequence: Synthetic oligonucleotide
aggaggggccggagtattgggacga

SEQ ID NO: 5978 - DNA, 24 bp, Artificial Sequence
  Description of Artificial Sequence: Synthetic oligonucleotide
ggaggggccggagtattgggacga

SEQ ID NO: 5979 - DNA, 24 bp, Artificial Sequence
  Description of Artificial Sequence: Synthetic oligonucleotide
gaggggccggagtattgggacgag

SEQ ID NO: 5980 - DNA, 25 bp, Artificial Sequence
  Description of Artificial Sequence: Synthetic oligonucleotide
aggggccggagtattgggacgagga

SEQ ID NO: 5981 - DNA, 24 bp, Artificial Sequence
  Description of Artificial Sequence: Synthetic oligonucleotide
ggggccggagtattgggacgagga

SEQ ID NO: 5982 - DNA, 25 bp, Artificial Sequence
  Description of Artificial Sequence: Synthetic oligonucleotide
gggccggagtattgggacgaggaga

SEQ ID NO: 5983 - DNA, 26 bp, Artificial Sequence
  Description of Artificial Sequence: Synthetic oligonucleotide
ggccggagtattgggacgaggagaca

SEQ ID NO: 5984 - DNA, 26 bp, Artificial Sequence
  Description of Artificial Sequence: Synthetic oligonucleotide
gccggagtattgggacgaggagacag

SEQ ID NO: 5985 - DNA, 26 bp, Artificial Sequence
  Description of Artificial Sequence: Synthetic oligonucleotide
ccggagtattgggacgaggagacagg

SEQ ID NO: 5986 - DNA, 27 bp, Artificial Sequence
  Description of Artificial Sequence: Synthetic oligonucleotide
cggagtattgggacgaggagacaggga

SEQ ID NO: 5987 - DNA, 29 bp, Artificial Sequence
  Description of Artificial Sequence: Synthetic oligonucleotide
ggagtattgggacgaggagacagggaaag

SEQ ID NO: 5988 - DNA, 30 bp, Artificial Sequence
  Description of Artificial Sequence: Synthetic oligonucleotide
gagtattgggacgaggagacagggaaagtg

SEQ ID NO: 5989 - DNA, 32 bp, Artificial Sequence
  Description of Artificial Sequence: Synthetic oligonucleotide
agtattgggacgaggagacagggaaagtgaag

SEQ ID NO: 5990 - DNA, 31 bp, Artificial Sequence
  Description of Artificial Sequence: Synthetic oligonucleotide
gtattgggacgaggagacagggaaagtgaag

SEQ ID NO: 5991 - DNA, 31 bp, Artificial Sequence
  Description of Artificial Sequence: Synthetic oligonucleotide
tattgggacgaggagacagggaaagtgaagg

SEQ ID NO: 5992 - DNA, 30 bp, Artificial Sequence
  Description of Artificial Sequence: Synthetic oligonucleotide
attgggacgaggagacagggaaagtgaagg

SEQ ID NO: 5993 - DNA, 29 bp, Artificial Sequence
  Description of Artificial Sequence: Synthetic oligonucleotide
ttgggacgaggagacagggaaagtgaagg

SEQ ID NO: 5994 - DNA, 28 bp, Artificial Sequence
  Description of Artificial Sequence: Synthetic oligonucleotide
tgggacgaggagacagggaaagtgaagg

SEQ ID NO: 5995 - DNA, 27 bp, Artificial Sequence
  Description of Artificial Sequence: Synthetic oligonucleotide
gggacgaggagacagggaaagtgaagg

SEQ ID NO: 5996 - DNA, 27 bp, Artificial Sequence
  Description of Artificial Sequence: Synthetic oligonucleotide
ggacgaggagacagggaaagtgaaggc

SEQ ID NO: 5997 - DNA, 27 bp, Artificial Sequence
  Description of Artificial Sequence: Synthetic oligonucleotide
gacgaggagacagggaaagtgaaggcc

SEQ ID NO: 5998 - DNA, 27 bp, Artificial Sequence
  Description of Artificial Sequence: Synthetic oligonucleotide
acgaggagacagggaaagtgaaggccc

SEQ ID NO: 5999 - DNA, 27 bp, Artificial Sequence
  Description of Artificial Sequence: Synthetic oligonucleotide
cgaggagacagggaaagtgaaggccca

SEQ ID NO: 6000 - DNA, 27 bp, Artificial Sequence
  Description of Artificial Sequence: Synthetic oligonucleotide
gaggagacagggaaagtgaaggcccac

SEQ ID NO: 6001 - DNA, 28 bp, Artificial Sequence
  Description of Artificial Sequence: Synthetic oligonucleotide
aggagacagggaaagtgaaggcccactc

SEQ ID NO: 6002 - DNA, 27 bp, Artificial Sequence
  Description of Artificial Sequence: Synthetic oligonucleotide
ggagacagggaaagtgaaggcccactc

SEQ ID NO: 6003 - DNA, 28 bp, Artificial Sequence
  Description of Artificial Sequence: Synthetic oligonucleotide
gagacagggaaagtgaaggcccactcac

SEQ ID NO: 6004 - DNA, 29 bp, Artificial Sequence
  Description of Artificial Sequence: Synthetic oligonucleotide
agacagggaaagtgaaggcccactcacag

SEQ ID NO: 6005 - DNA, 28 bp, Artificial Sequence
  Description of Artificial Sequence: Synthetic oligonucleotide
gacagggaaagtgaaggcccactcacag

SEQ ID NO: 6006 - DNA, 29 bp, Artificial Sequence
  Description of Artificial Sequence: Synthetic oligonucleotide
acagggaaagtgaaggcccactcacagac

SEQ ID NO: 6007 - DNA, 28 bp, Artificial Sequence
  Description of Artificial Sequence: Synthetic oligonucleotide
cagggaaagtgaaggcccactcacagac

SEQ ID NO: 6008 - DNA, 29 bp, Artificial Sequence
  Description of Artificial Sequence: Synthetic oligonucleotide
agggaaagtgaaggcccactcacagactg

SEQ ID NO: 6009 - DNA, 28 bp, Artificial Sequence
  Description of Artificial Sequence: Synthetic oligonucleotide
gggaaagtgaaggcccactcacagactg

SEQ ID NO: 6010 - DNA, 26 bp, Artificial Sequence
  Description of Artificial Sequence: Synthetic oligonucleotide
aagcacaagtgggaggcggcccatga

SEQ ID NO: 6011 - DNA, 25 bp, Artificial Sequence
  Description of Artificial Sequence: Synthetic oligonucleotide
agcacaagtgggaggcggcccatga

SEQ ID NO: 6012 - DNA, 24 bp, Artificial Sequence
  Description of Artificial Sequence: Synthetic oligonucleotide
gcacaagtgggaggcggcccatga

SEQ ID NO: 6013 - DNA, 24 bp, Artificial Sequence
  Description of Artificial Sequence: Synthetic oligonucleotide
cacaagtgggaggcggcccatgag

SEQ ID NO: 6014 - DNA, 24 bp, Artificial Sequence
  Description of Artificial Sequence: Synthetic oligonucleotide
acaagtgggaggcggcccatgagg

SEQ ID NO: 6015 - DNA, 23 bp, Artificial Sequence
  Description of Artificial Sequence: Synthetic oligonucleotide
caagtgggaggcggcccatgagg

SEQ ID NO: 6016 - DNA, 23 bp, Artificial Sequence
  Description of Artificial Sequence: Synthetic oligonucleotide
aagtgggaggcggcccatgaggc

SEQ ID NO: 6017 - DNA, 22 bp, Artificial Sequence
  Description of Artificial Sequence: Synthetic oligonucleotide
agtgggaggcggcccatgaggc

SEQ ID NO: 6018 - DNA, 21 bp, Artificial Sequence
  Description of Artificial Sequence: Synthetic oligonucleotide
gtgggaggcggcccatgaggc

SEQ ID NO: 6019 - DNA, 21 bp, Artificial Sequence
  Description of Artificial Sequence: Synthetic oligonucleotide
tgggaggcggcccatgaggcg

SEQ ID NO: 6020 - DNA, 20 bp, Artificial Sequence
  Description of Artificial Sequence: Synthetic oligonucleotide
gggaggcggcccatgaggcg

SEQ ID NO: 6021 - DNA, 21 bp, Artificial Sequence
  Description of Artificial Sequence: Synthetic oligonucleotide
ggaggcggcccatgaggcgga

SEQ ID NO: 6022 - DNA, 21 bp, Artificial Sequence
  Description of Artificial Sequence: Synthetic oligonucleotide
gaggcggcccatgaggcggag

SEQ ID NO: 6023 - DNA, 22 bp, Artificial Sequence
  Description of Artificial Sequence: Synthetic oligonucleotide
aggcggcccatgaggcggagca

SEQ ID NO: 6024 - DNA, 21 bp, Artificial Sequence
  Description of Artificial Sequence: Synthetic oligonucleotide
ggcggcccatgaggcggagca

SEQ ID NO: 6025 - DNA, 21 bp, Artificial Sequence
  Description of Artificial Sequence: Synthetic oligonucleotide
gcggcccatgaggcggagcag

SEQ ID NO: 6026 - DNA, 22 bp, Artificial Sequence
  Description of Artificial Sequence: Synthetic oligonucleotide
cggcccatgaggcggagcagca

SEQ ID NO: 6027 - DNA, 23 bp, Artificial Sequence
  Description of Artificial Sequence: Synthetic oligonucleotide
ggcccatgaggcggagcagcaga

SEQ ID NO: 6028 - DNA, 24 bp, Artificial Sequence
  Description of Artificial Sequence: Synthetic oligonucleotide
gcccatgaggcggagcagcagaga

SEQ ID NO: 6029 - DNA, 24 bp, Artificial Sequence
  Description of Artificial Sequence: Synthetic oligonucleotide
cccatgaggcggagcagcagagag

SEQ ID NO: 6030 - DNA, 24 bp, Artificial Sequence
  Description of Artificial Sequence: Synthetic oligonucleotide
ccatgaggcggagcagcagagagc

SEQ ID NO: 6031 - DNA, 26 bp, Artificial Sequence
  Description of Artificial Sequence: Synthetic oligonucleotide
catgaggcggagcagcagagagccta

SEQ ID NO: 6032 - DNA, 26 bp, Artificial Sequence
  Description of Artificial Sequence: Synthetic oligonucleotide
atgaggcggagcagcagagagcctac

SEQ ID NO: 6033 - DNA, 25 bp, Artificial Sequence
  Description of Artificial Sequence: Synthetic oligonucleotide
tgaggcggagcagcagagagcctac

SEQ ID NO: 6034 - DNA, 24 bp, Artificial Sequence
  Description of Artificial Sequence: Synthetic oligonucleotide
gaggcggagcagcagagagcctac

SEQ ID NO: 6035 - DNA, 25 bp, Artificial Sequence
  Description of Artificial Sequence: Synthetic oligonucleotide
aggcggagcagcagagagcctacct

SEQ ID NO: 6036 - DNA, 23 bp, Artificial Sequence
  Description of Artificial Sequence: Synthetic oligonucleotide
caagcacaagtgggaggcggccc

SEQ ID NO: 6037 - DNA, 24 bp, Artificial Sequence
  Description of Artificial Sequence: Synthetic oligonucleotide
aagcacaagtgggaggcggcccgt

SEQ ID NO: 6038 - DNA, 23 bp, Artificial Sequence
  Description of Artificial Sequence: Synthetic oligonucleotide
agcacaagtgggaggcggcccgt

SEQ ID NO: 6039 - DNA, 22 bp, Artificial Sequence
  Description of Artificial Sequence: Synthetic oligonucleotide
gcacaagtgggaggcggcccgt

SEQ ID NO: 6040 - DNA, 23 bp, Artificial Sequence
  Description of Artificial Sequence: Synthetic oligonucleotide
cacaagtgggaggcggcccgtgt

SEQ ID NO: 6041 - DNA, 23 bp, Artificial Sequence
  Description of Artificial Sequence: Synthetic oligonucleotide
acaagtgggaggcggcccgtgtg

SEQ ID NO: 6042 - DNA, 22 bp, Artificial Sequence
  Description of Artificial Sequence: Synthetic oligonucleotide
caagtgggaggcggcccgtgtg

SEQ ID NO: 6043 - DNA, 22 bp, Artificial Sequence
  Description of Artificial Sequence: Synthetic oligonucleotide
aagtgggaggcggcccgtgtgg

SEQ ID NO: 6044 - DNA, 21 bp, Artificial Sequence
  Description of Artificial Sequence: Synthetic oligonucleotide
agtgggaggcggcccgtgtgg

SEQ ID NO: 6045 - DNA, 20 bp, Artificial Sequence
  Description of Artificial Sequence: Synthetic oligonucleotide
gtgggaggcggcccgtgtgg

SEQ ID NO: 6046 - DNA, 20 bp, Artificial Sequence
  Description of Artificial Sequence: Synthetic oligonucleotide
tgggaggcggcccgtgtggc

SEQ ID NO: 6047 - DNA, 20 bp, Artificial Sequence
  Description of Artificial Sequence: Synthetic oligonucleotide
gggaggcggcccgtgtggct

SEQ ID NO: 6048 - DNA, 20 bp, Artificial Sequence
  Description of Artificial Sequence: Synthetic oligonucleotide
ggaggcggcccgtgtggcgt

SEQ ID NO: 6049 - DNA, 20 bp, Artificial Sequence
  Description of Artificial Sequence: Synthetic oligonucleotide
gaggcggcccgtgtggcgga

SEQ ID NO: 6050 - DNA, 20 bp, Artificial Sequence
  Description of Artificial Sequence: Synthetic oligonucleotide
aggcggcccgtgtggcggag

SEQ ID NO: 6051 - DNA, 20 bp, Artificial Sequence
  Description of Artificial Sequence: Synthetic oligonucleotide
ggcggcccgtgtggcggagt

SEQ ID NO: 6052 - DNA, 20 bp, Artificial Sequence
  Description of Artificial Sequence: Synthetic oligonucleotide
gcggcccgtgtggcggagca

SEQ ID NO: 6053 - DNA, 22 bp, Artificial Sequence
  Description of Artificial Sequence: Synthetic oligonucleotide
cggcccgtgtggcggagcagtt

SEQ ID NO: 6054 - DNA, 23 bp, Artificial Sequence
  Description of Artificial Sequence: Synthetic oligonucleotide
ggcccgtgtggcggagcagttga

SEQ ID NO: 6055 - DNA, 24 bp, Artificial Sequence
  Description of Artificial Sequence: Synthetic oligonucleotide
gcccgtgtggcggagcagttgaga

SEQ ID NO: 6056 - DNA, 24 bp, Artificial Sequence
  Description of Artificial Sequence: Synthetic oligonucleotide
cccgtgtggcggagcagttgagag

SEQ ID NO: 6057 - DNA, 24 bp, Artificial Sequence
  Description of Artificial Sequence: Synthetic oligonucleotide
ccgtgtggcggagcagttgagagc

SEQ ID NO: 6058 - DNA, 26 bp, Artificial Sequence
  Description of Artificial Sequence: Synthetic oligonucleotide
cgtgtggcggagcagttgagagccta

SEQ ID NO: 6059 - DNA, 26 bp, Artificial Sequence
  Description of Artificial Sequence: Synthetic oligonucleotide
gtgtggcggagcagttgagagcctac

SEQ ID NO: 6060 - DNA, 26 bp, Artificial Sequence
  Description of Artificial Sequence: Synthetic oligonucleotide
cagttgagagcctacctggagggcga

SEQ ID NO: 6061 - DNA, 27 bp, Artificial Sequence
  Description of Artificial Sequence: Synthetic oligonucleotide
agttgagagcctacctggagggcgagt

SEQ ID NO: 6062 - DNA, 26 bp, Artificial Sequence
  Description of Artificial Sequence: Synthetic oligonucleotide
gttgagagcctacctggagggcgagt

SEQ ID NO: 6063 - DNA, 26 bp, Artificial Sequence
  Description of Artificial Sequence: Synthetic oligonucleotide
ttgagagcctacctggagggcgagtg

SEQ ID NO: 6064 - DNA, 25 bp, Artificial Sequence
  Description of Artificial Sequence: Synthetic oligonucleotide
tgagagcctacctggagggcgagtg

SEQ ID NO: 6065 - DNA, 24 bp, Artificial Sequence
  Description of Artificial Sequence: Synthetic oligonucleotide
gagagcctacctggagggcgagtg

SEQ ID NO: 6066 - DNA, 24 bp, Artificial Sequence
  Description of Artificial Sequence: Synthetic oligonucleotide
agagcctacctggagggcgagtgc

SEQ ID NO: 6067 - DNA, 23 bp, Artificial Sequence
  Description of Artificial Sequence: Synthetic oligonucleotide
gagcctacctggagggcgagtgc

SEQ ID NO: 6068 - DNA, 24 bp, Artificial Sequence
  Description of Artificial Sequence: Synthetic oligonucleotide
agcctacctggagggcgagtgcgt

SEQ ID NO: 6069 - DNA, 23 bp, Artificial Sequence
  Description of Artificial Sequence: Synthetic oligonucleotide
gcctacctggagggcgagtgcgt

SEQ ID NO: 6070 - DNA, 23 bp, Artificial Sequence
  Description of Artificial Sequence: Synthetic oligonucleotide
cctacctggagggcgagtgcgtg

SEQ ID NO: 6071 - DNA, 24 bp, Artificial Sequence
  Description of Artificial Sequence: Synthetic oligonucleotide
ctacctggagggcgagtgcgtgga

SEQ ID NO: 6072 - DNA, 25 bp, Artificial Sequence
  Description of Artificial Sequence: Synthetic oligonucleotide
tacctggagggcgagtgcgtggagt

SEQ ID NO: 6073 - DNA, 24 bp, Artificial Sequence
  Description of Artificial Sequence: Synthetic oligonucleotide
acctggagggcgagtgcgtggagt

SEQ ID NO: 6074 - DNA, 23 bp, Artificial Sequence
  Description of Artificial Sequence: Synthetic oligonucleotide
cctggagggcgagtgcgtggagt

SEQ ID NO: 6075 - DNA, 23 bp, Artificial Sequence
  Description of Artificial Sequence: Synthetic oligonucleotide
ctggagggcgagtgcgtggagtg

SEQ ID NO: 6076 - DNA, 23 bp, Artificial Sequence
  Description of Artificial Sequence: Synthetic oligonucleotide
tggagggcgagtgcgtggagtgg

SEQ ID NO: 6077 - DNA, 22 bp, Artificial Sequence
  Description of Artificial Sequence: Synthetic oligonucleotide
ggagggcgagtgcgtggagtgg

SEQ ID NO: 6078 - DNA, 23 bp, Artificial Sequence
  Description of Artificial Sequence: Synthetic oligonucleotide
gagggcgagtgcgtggagtggct

SEQ ID NO: 6079 - DNA, 23 bp, Artificial Sequence
  Description of Artificial Sequence: Synthetic oligonucleotide
agggcgagtgcgtggagtggctc

SEQ ID NO: 6080 - DNA, 22 bp, Artificial Sequence
  Description of Artificial Sequence: Synthetic oligonucleotide
gggcgagtgcgtggagtggctc

SEQ ID NO: 6081 - DNA, 22 bp, Artificial Sequence
  Description of Artificial Sequence: Synthetic oligonucleotide
ggcgagtgcgtggagtggctcc

SEQ ID NO: 6082 - DNA, 22 bp, Artificial Sequence
  Description of Artificial Sequence: Synthetic oligonucleotide
gcgagtgcgtggagtggctccg

SEQ ID NO: 6083 - DNA, 23 bp, Artificial Sequence
  Description of Artificial Sequence: Synthetic oligonucleotide
cgagtgcgtggagtggctccgca

SEQ ID NO: 6084 - DNA, 26 bp, Artificial Sequence
  Description of Artificial Sequence: Synthetic oligonucleotide
gagtgcgtggagtggctccgcagata

SEQ ID NO: 6085 - DNA, 27 bp, Artificial Sequence
  Description of Artificial Sequence: Synthetic oligonucleotide
gggatggaaccttccagaagtgggcga

SEQ ID NO: 6086 - DNA, 27 bp, Artificial Sequence
  Description of Artificial Sequence: Synthetic oligonucleotide
ggatggaaccttccagaagtgggcgac

SEQ ID NO: 6087 - DNA, 28 bp, Artificial Sequence
  Description of Artificial Sequence: Synthetic oligonucleotide
gatggaaccttccagaagtgggcgactg

SEQ ID NO: 6088 - DNA, 29 bp, Artificial Sequence
  Description of Artificial Sequence: Synthetic oligonucleotide
atggaaccttccagaagtgggcgactgtg

SEQ ID NO: 6089 - DNA, 28 bp, Artificial Sequence
  Description of Artificial Sequence: Synthetic oligonucleotide
tggaaccttccagaagtgggcgactgtg

SEQ ID NO: 6090 - DNA, 27 bp, Artificial Sequence
  Description of Artificial Sequence: Synthetic oligonucleotide
ggaaccttccagaagtgggcgactgtg

SEQ ID NO: 6091 - DNA, 27 bp, Artificial Sequence
  Description of Artificial Sequence: Synthetic oligonucleotide
gaaccttccagaagtgggcgactgtgg

SEQ ID NO: 6092 - DNA, 28 bp, Artificial Sequence
  Description of Artificial Sequence: Synthetic oligonucleotide
aaccttccagaagtgggcgactgtggtg

SEQ ID NO: 6093 - DNA, 27 bp, Artificial Sequence
  Description of Artificial Sequence: Synthetic oligonucleotide
accttccagaagtgggcgactgtggtg

SEQ ID NO: 6094 - DNA, 26 bp, Artificial Sequence
  Description of Artificial Sequence: Synthetic oligonucleotide
ccttccagaagtgggcgactgtggtg

SEQ ID NO: 6095 - DNA, 27 bp, Artificial Sequence
  Description of Artificial Sequence: Synthetic oligonucleotide
cttccagaagtgggcgactgtggtggt

SEQ ID NO: 6096 - DNA, 27 bp, Artificial Sequence
  Description of Artificial Sequence: Synthetic oligonucleotide
ttccagaagtgggcgactgtggtggtg

SEQ ID NO: 6097 - DNA, 26 bp, Artificial Sequence
  Description of Artificial Sequence: Synthetic oligonucleotide
tccagaagtgggcgactgtggtggtg

SEQ ID NO: 6098 - DNA, 25 bp, Artificial Sequence
  Description of Artificial Sequence: Synthetic oligonucleotide
ccagaagtgggcgactgtggtggtg

SEQ ID NO: 6099 - DNA, 25 bp, Artificial Sequence
  Description of Artificial Sequence: Synthetic oligonucleotide
cagaagtgggcgactgtggtggtgc

SEQ ID NO: 6100 - DNA, 27 bp, Artificial Sequence
  Description of Artificial Sequence: Synthetic oligonucleotide
agaagtgggcgactgtggtggtgcctt

SEQ ID NO: 6101 - DNA, 26 bp, Artificial Sequence
  Description of Artificial Sequence: Synthetic oligonucleotide
gaagtgggcgactgtggtggtgcctt

SEQ ID NO: 6102 - DNA, 27 bp, Artificial Sequence
  Description of Artificial Sequence: Synthetic oligonucleotide
aagtgggcgactgtggtggtgccttct

SEQ ID NO: 6103 - DNA, 26 bp, Artificial Sequence
  Description of Artificial Sequence: Synthetic oligonucleotide
agtgggcgactgtggtggtgccttct

SEQ ID NO: 6104 - DNA, 25 bp, Artificial Sequence
  Description of Artificial Sequence: Synthetic oligonucleotide
gtgggcgactgtggtggtgccttct

SEQ ID NO: 6105 - DNA, 25 bp, Artificial Sequence
  Description of Artificial Sequence: Synthetic oligonucleotide
tgggcgactgtggtggtgccttctg

SEQ ID NO: 6106 - DNA, 24 bp, Artificial Sequence
  Description of Artificial Sequence: Synthetic oligonucleotide
gggcgactgtggtggtgccttctg

SEQ ID NO: 6107 - DNA, 25 bp, Artificial Sequence
  Description of Artificial Sequence: Synthetic oligonucleotide
ggcgactgtggtggtgccttctgga

SEQ ID NO: 6108 - DNA, 26 bp, Artificial Sequence
  Description of Artificial Sequence: Synthetic oligonucleotide
gcgactgtggtggtgccttctggaca

SEQ ID NO: 6109 - DNA, 26 bp, Artificial Sequence
  Description of Artificial Sequence: Synthetic oligonucleotide
cgactgtggtggtgccttctggacag

SEQ ID NO: 6110 - DNA, 27 bp, Artificial Sequence
  Description of Artificial Sequence: Synthetic oligonucleotide
gactgtggtggtgccttctggacagga

SEQ ID NO: 6111 - DNA, 27 bp, Artificial Sequence
  Description of Artificial Sequence: Synthetic oligonucleotide
actgtggtggtgccttctggacaggag

SEQ ID NO: 6112 - DNA, 22 bp, Artificial Sequence
  Description of Artificial Sequence: Synthetic oligonucleotide
ggagccgtcttcccagcccacc

SEQ ID NO: 6113 - DNA, 20 bp, Artificial Sequence
  Description of Artificial Sequence: Synthetic oligonucleotide
aggatggagccgcgggcgcg

SEQ ID NO: 6114 - DNA, 20 bp, Artificial Sequence
  Description of Artificial Sequence: Synthetic oligonucleotide
ggatggagccgcgggcgcgt

SEQ ID NO: 6115 - DNA, 20 bp, Artificial Sequence
  Description of Artificial Sequence: Synthetic oligonucleotide
gatggagccgcgggcgcggt

SEQ ID NO: 6116 - DNA, 20 bp, Artificial Sequence
  Description of Artificial Sequence: Synthetic oligonucleotide
atggagccgcgggcgcggtg

SEQ ID NO: 6117 - DNA, 20 bp, Artificial Sequence
  Description of Artificial Sequence: Synthetic oligonucleotide
tggagccgcgggcgcggtgt

SEQ ID NO: 6118 - DNA, 20 bp, Artificial Sequence
  Description of Artificial Sequence: Synthetic oligonucleotide
ggagccgcgggcgcggtgtt

SEQ ID NO: 6119 - DNA, 21 bp, Artificial Sequence
  Description of Artificial Sequence: Synthetic oligonucleotide
gagccgcgggcgcggtggata

SEQ ID NO: 6120 - DNA, 22 bp, Artificial Sequence
  Description of Artificial Sequence: Synthetic oligonucleotide
agccgcgggcgcggtggataga

SEQ ID NO: 6121 - DNA, 21 bp, Artificial Sequence
  Description of Artificial Sequence: Synthetic oligonucleotide
gccgcgggcgcggtggataga

SEQ ID NO: 6122 - DNA, 21 bp, Artificial Sequence
  Description of Artificial Sequence: Synthetic oligonucleotide
ccgcgggcgcggtggatagag

SEQ ID NO: 6123 - DNA, 22 bp, Artificial Sequence
  Description of Artificial Sequence: Synthetic oligonucleotide
cgcgggcgcggtggatagagca

SEQ ID NO: 6124 - DNA, 22 bp, Artificial Sequence
  Description of Artificial Sequence: Synthetic oligonucleotide
gcgggcgcggtggatagagcag

SEQ ID NO: 6125 - DNA, 23 bp, Artificial Sequence
  Description of Artificial Sequence: Synthetic oligonucleotide
cgggcgcggtggatagagcagga

SEQ ID NO: 6126 - DNA, 23 bp, Artificial Sequence
  Description of Artificial Sequence: Synthetic oligonucleotide
gggcgcggtggatagagcaggag

SEQ ID NO: 6127 - DNA, 23 bp, Artificial Sequence
  Description of Artificial Sequence: Synthetic oligonucleotide
ggcgcggtggatagagcaggagg

SEQ ID NO: 6128 - DNA, 24 bp, Artificial Sequence
  Description of Artificial Sequence: Synthetic oligonucleotide
gcgcggtggatagagcaggagggt

SEQ ID NO: 6129 - DNA, 24 bp, Artificial Sequence
  Description of Artificial Sequence: Synthetic oligonucleotide
cgcggtggatagagcaggagggtc

SEQ ID NO: 6130 - DNA, 24 bp, Artificial Sequence
  Description of Artificial Sequence: Synthetic oligonucleotide
gcggtggatagagcaggagggtcc

SEQ ID NO: 6131 - DNA, 24 bp, Artificial Sequence
  Description of Artificial Sequence: Synthetic oligonucleotide
cggtggatagagcaggagggtccg

SEQ ID NO: 6132 - DNA, 25 bp, Artificial Sequence
  Description of Artificial Sequence: Synthetic oligonucleotide
ggtggatagagcaggagggtccgga

SEQ ID NO: 6133 - DNA, 27 bp, Artificial Sequence
  Description of Artificial Sequence: Synthetic oligonucleotide
gcatgagggtttgcccaagcccctcat

SEQ ID NO: 6134 - DNA, 27 bp, Artificial Sequence
  Description of Artificial Sequence: Synthetic oligonucleotide
catgagggtttgcccaagcccctcatc

SEQ ID NO: 6135 - DNA, 27 bp, Artificial Sequence
  Description of Artificial Sequence: Synthetic oligonucleotide
atgagggtttgcccaagcccctcatcc

SEQ ID NO: 6136 - DNA, 27 bp, Artificial Sequence
  Description of Artificial Sequence: Synthetic oligonucleotide
tgagggtttgcccaagcccctcatcct

SEQ ID NO: 6137 - DNA, 26 bp, Artificial Sequence
  Description of Artificial Sequence: Synthetic oligonucleotide
gagggtttgcccaagcccctcatcct

SEQ ID NO: 6138 - DNA, 27 bp, Artificial Sequence
  Description of Artificial Sequence: Synthetic oligonucleotide
agggtttgcccaagcccctcatcctga

SEQ ID NO: 6139 - DNA, 26 bp, Artificial Sequence
  Description of Artificial Sequence: Synthetic oligonucleotide
gggtttgcccaagcccctcatcctga

SEQ ID NO: 6140 - DNA, 27 bp, Artificial Sequence
  Description of Artificial Sequence: Synthetic oligonucleotide
ggtttgcccaagcccctcatcctgaga

SEQ ID NO: 6141 - DNA, 28 bp, Artificial Sequence
  Description of Artificial Sequence: Synthetic oligonucleotide
gtttgcccaagcccctcatcctgagatg

SEQ ID NO: 6142 - DNA, 28 bp, Artificial Sequence
  Description of Artificial Sequence: Synthetic oligonucleotide
tttgcccaagcccctcatcctgagatgg

SEQ ID NO: 6143 - DNA, 27 bp, Artificial Sequence
  Description of Artificial Sequence: Synthetic oligonucleotide
ttgcccaagcccctcatcctgagatgg

SEQ ID NO: 6144 - DNA, 26 bp, Artificial Sequence
  Description of Artificial Sequence: Synthetic oligonucleotide
tgcccaagcccctcatcctgagatgg

SEQ ID NO: 6145 - DNA, 25 bp, Artificial Sequence
  Description of Artificial Sequence: Synthetic oligonucleotide
gcccaagcccctcatcctgagatgg

SEQ ID NO: 6146 - DNA, 26 bp, Artificial Sequence
  Description of Artificial Sequence: Synthetic oligonucleotide
cccaagcccctcatcctgagatggga

SEQ ID NO: 6147 - DNA, 26 bp, Artificial Sequence
  Description of Artificial Sequence: Synthetic oligonucleotide
ccaagcccctcatcctgagatgggag

SEQ ID NO: 6148 - DNA, 26 bp, Artificial Sequence
  Description of Artificial Sequence: Synthetic oligonucleotide
caagcccctcatcctgagatgggagc

SEQ ID NO: 6149 - DNA, 26 bp, Artificial Sequence
  Description of Artificial Sequence: Synthetic oligonucleotide
aagcccctcatcctgagatgggagcc

SEQ ID NO: 6150 - DNA, 25 bp, Artificial Sequence
  Description of Artificial Sequence: Synthetic oligonucleotide
agcccctcatcctgagatgggagcc

SEQ ID NO: 6151 - DNA, 24 bp, Artificial Sequence
  Description of Artificial Sequence: Synthetic oligonucleotide
gcccctcatcctgagatgggagcc

SEQ ID NO: 6152 - DNA, 25 bp, Artificial Sequence
  Description of Artificial Sequence: Synthetic oligonucleotide
cccctcatcctgagatgggagccgt

SEQ ID NO: 6153 - DNA, 27 bp, Artificial Sequence
  Description of Artificial Sequence: Synthetic oligonucleotide
ccctcatcctgagatgggagccgtctt

SEQ ID NO: 6154 - DNA, 27 bp, Artificial Sequence
  Description of Artificial Sequence: Synthetic oligonucleotide
cctcatcctgagatgggagccgtcttc

SEQ ID NO: 6155 - DNA, 27 bp, Artificial Sequence
  Description of Artificial Sequence: Synthetic oligonucleotide
ctcatcctgagatgggagccgtcttcc

SEQ ID NO: 6156 - DNA, 27 bp, Artificial Sequence
  Description of Artificial Sequence: Synthetic oligonucleotide
tcatcctgagatgggagccgtcttccc

SEQ ID NO: 6157 - DNA, 27 bp, Artificial Sequence
  Description of Artificial Sequence: Synthetic oligonucleotide
catcctgagatgggagccgtcttccca

SEQ ID NO: 6158 - DNA, 27 bp, Artificial Sequence
  Description of Artificial Sequence: Synthetic oligonucleotide
atcctgagatgggagccgtcttcccag

SEQ ID NO: 6159 - DNA, 26 bp, Artificial Sequence
  Description of Artificial Sequence: Synthetic oligonucleotide
tcctgagatgggagccgtcttcccag

SEQ ID NO: 6160 - DNA, 25 bp, Artificial Sequence
  Description of Artificial Sequence: Synthetic oligonucleotide
tccgcgggtaccagcaggacgctta

SEQ ID NO: 6161 - DNA, 24 bp, Artificial Sequence
  Description of Artificial Sequence: Synthetic oligonucleotide
ccgcgggtaccagcaggacgctta

SEQ ID NO: 6162 - DNA, 24 bp, Artificial Sequence
  Description of Artificial Sequence: Synthetic oligonucleotide
cgcgggtaccagcaggacgcttac

SEQ ID NO: 6163 - DNA, 25 bp, Artificial Sequence
  Description of Artificial Sequence: Synthetic oligonucleotide
gcgggtaccagcaggacgcttacga

SEQ ID NO: 6164 - DNA, 25 bp, Artificial Sequence
  Description of Artificial Sequence: Synthetic oligonucleotide
cgggtaccagcaggacgcttacgac

SEQ ID NO: 6165 - DNA, 25 bp, Artificial Sequence
  Description of Artificial Sequence: Synthetic oligonucleotide
gggtaccagcaggacgcttacgacg

SEQ ID NO: 6166 - DNA, 25 bp, Artificial Sequence
  Description of Artificial Sequence: Synthetic oligonucleotide
ggtaccagcaggacgcttacgacgg

SEQ ID NO: 6167 - DNA, 27 bp, Artificial Sequence
  Description of Artificial Sequence: Synthetic oligonucleotide
gtaccagcaggacgcttacgacggcaa

SEQ ID NO: 6168 - DNA, 27 bp, Artificial Sequence
  Description of Artificial Sequence: Synthetic oligonucleotide
taccagcaggacgcttacgacggcaag

SEQ ID NO: 6169 - DNA, 26 bp, Artificial Sequence
  Description of Artificial Sequence: Synthetic oligonucleotide
accagcaggacgcttacgacggcaag

SEQ ID NO: 6170 - DNA, 25 bp, Artificial Sequence
  Description of Artificial Sequence: Synthetic oligonucleotide
ccagcaggacgcttacgacggcaag

SEQ ID NO: 6171 - DNA, 27 bp, Artificial Sequence
  Description of Artificial Sequence: Synthetic oligonucleotide
cagcaggacgcttacgacggcaaggat

SEQ ID NO: 6172 - DNA, 29 bp, Artificial Sequence
  Description of Artificial Sequence: Synthetic oligonucleotide
agcaggacgcttacgacggcaaggattac

SEQ ID NO: 6173 - DNA, 28 bp, Artificial Sequence
  Description of Artificial Sequence: Synthetic oligonucleotide
gcaggacgcttacgacggcaaggattac

SEQ ID NO: 6174 - DNA, 30 bp, Artificial Sequence
  Description of Artificial Sequence: Synthetic oligonucleotide
caggacgcttacgacggcaaggattacatc

SEQ ID NO: 6175 - DNA, 30 bp, Artificial Sequence
  Description of Artificial Sequence: Synthetic oligonucleotide
aggacgcttacgacggcaaggattacatcg

SEQ ID NO: 6176 - DNA, 29 bp, Artificial Sequence
  Description of Artificial Sequence: Synthetic oligonucleotide
ggacgcttacgacggcaaggattacatcg

SEQ ID NO: 6177 - DNA, 29 bp, Artificial Sequence
  Description of Artificial Sequence: Synthetic oligonucleotide
gacgcttacgacggcaaggattacatcgc

SEQ ID NO: 6178 - DNA, 29 bp, Artificial Sequence
  Description of Artificial Sequence: Synthetic oligonucleotide
acgcttacgacggcaaggattacatcgcc

SEQ ID NO: 6179 - DNA, 28 bp, Artificial Sequence
  Description of Artificial Sequence: Synthetic oligonucleotide
cgcttacgacggcaaggattacatcgcc

SEQ ID NO: 6180 - DNA, 28 bp, Artificial Sequence
  Description of Artificial Sequence: Synthetic oligonucleotide
gcttacgacggcaaggattacatcgccc

SEQ ID NO: 6181 - DNA, 29 bp, Artificial Sequence
  Description of Artificial Sequence: Synthetic oligonucleotide
cttacgacggcaaggattacatcgccctg

SEQ ID NO: 6182 - DNA, 31 bp, Artificial Sequence
  Description of Artificial Sequence: Synthetic oligonucleotide
ttacgacggcaaggattacatcgccctgaac

SEQ ID NO: 6183 - DNA, 23 bp, Artificial Sequence
  Description of Artificial Sequence: Synthetic oligonucleotide
gcggcggacatggcggctcagat

SEQ ID NO: 6184 - DNA, 24 bp, Artificial Sequence
  Description of Artificial Sequence: Synthetic oligonucleotide
cggcggacatggcggctcagatca

SEQ ID NO: 6185 - DNA, 24 bp, Artificial Sequence
  Description of Artificial Sequence: Synthetic oligonucleotide
ggcggacatggcggctcagatcac

SEQ ID NO: 6186 - DNA, 24 bp, Artificial Sequence
  Description of Artificial Sequence: Synthetic oligonucleotide
gcggacatggcggctcagatcacc

SEQ ID NO: 6187 - DNA, 25 bp, Artificial Sequence
  Description of Artificial Sequence: Synthetic oligonucleotide
cggacatggcggctcagatcaccca

SEQ ID NO: 6188 - DNA, 25 bp, Artificial Sequence
  Description of Artificial Sequence: Synthetic oligonucleotide
ggacatggcggctcagatcacccag

SEQ ID NO: 6189 - DNA, 25 bp, Artificial Sequence
  Description of Artificial Sequence: Synthetic oligonucleotide
gacatggcggctcagatcacccagc

SEQ ID NO: 6190 - DNA, 25 bp, Artificial Sequence
  Description of Artificial Sequence: Synthetic oligonucleotide
acatggcggctcagatcacccagcg

SEQ ID NO: 6191 - DNA, 24 bp, Artificial Sequence
  Description of Artificial Sequence: Synthetic oligonucleotide
catggcggctcagatcacccagcg

SEQ ID NO: 6192 - DNA, 26 bp, Artificial Sequence
  Description of Artificial Sequence: Synthetic oligonucleotide
atggcggctcagatcacccagcgcaa

SEQ ID NO: 6193 - DNA, 25 bp, Artificial Sequence
  Description of Artificial Sequence: Synthetic oligonucleotide
tggcggctcagatcacccagcgcaa

SEQ ID NO: 6194 - DNA, 24 bp, Artificial Sequence
  Description of Artificial Sequence: Synthetic oligonucleotide
ggcggctcagatcacccagcgcaa

SEQ ID NO: 6195 - DNA, 25 bp, Artificial Sequence
  Description of Artificial Sequence: Synthetic oligonucleotide
gcggctcagatcacccagcgcaagt

SEQ ID NO: 6196 - DNA, 25 bp, Artificial Sequence
  Description of Artificial Sequence: Synthetic oligonucleotide
cggctcagatcacccagcgcaagtg

SEQ ID NO: 6197 - DNA, 25 bp, Artificial Sequence
  Description of Artificial Sequence: Synthetic oligonucleotide
ggctcagatcacccagcgcaagtgg

SEQ ID NO: 6198 - DNA, 27 bp, Artificial Sequence
  Description of Artificial Sequence: Synthetic oligonucleotide
ctcagatcacccagcgcaagtgggaga

SEQ ID NO: 6199 - DNA, 27 bp, Artificial Sequence
  Description of Artificial Sequence: Synthetic oligonucleotide
tcagatcacccagcgcaagtgggagac

SEQ ID NO: 6200 - DNA, 26 bp, Artificial Sequence
  Description of Artificial Sequence: Synthetic oligonucleotide
cagatcacccagcgcaagtgggagac

SEQ ID NO: 6201 - DNA, 26 bp, Artificial Sequence
  Description of Artificial Sequence: Synthetic oligonucleotide
agatcacccagcgcaagtgggagacg

SEQ ID NO: 6202 - DNA, 25 bp, Artificial Sequence
  Description of Artificial Sequence: Synthetic oligonucleotide
gatcacccagcgcaagtgggagacg

SEQ ID NO: 6203 - DNA, 25 bp, Artificial Sequence
  Description of Artificial Sequence: Synthetic oligonucleotide
atcacccagcgcaagtgggagacgg

SEQ ID NO: 6204 - DNA, 24 bp, Artificial Sequence
  Description of Artificial Sequence: Synthetic oligonucleotide
tcacccagcgcaagtgggagacgg

SEQ ID NO: 6205 - DNA, 23 bp, Artificial Sequence
  Description of Artificial Sequence: Synthetic oligonucleotide
cacccagcgcaagtgggagacgg

SEQ ID NO: 6206 - DNA, 23 bp, Artificial Sequence
  Description of Artificial Sequence: Synthetic oligonucleotide
acccagcgcaagtgggagacggc

SEQ ID NO: 6207 - DNA, 22 bp, Artificial Sequence
  Description of Artificial Sequence: Synthetic oligonucleotide
cccagcgcaagtgggagacggc

SEQ ID NO: 6208 - DNA, 22 bp, Artificial Sequence
  Description of Artificial Sequence: Synthetic oligonucleotide
ccagcgcaagtgggagacggcc

SEQ ID NO: 6209 - DNA, 24 bp, Artificial Sequence
  Description of Artificial Sequence: Synthetic oligonucleotide
cagcgcaagtgggagacggcccat

SEQ ID NO: 6210 - DNA, 25 bp, Artificial Sequence
  Description of Artificial Sequence: Synthetic oligonucleotide
agcgcaagtgggagacggcccatga

SEQ ID NO: 6211 - DNA, 24 bp, Artificial Sequence
  Description of Artificial Sequence: Synthetic oligonucleotide
gcgcaagtgggagacggcccatga

SEQ ID NO: 6212 - DNA, 24 bp, Artificial Sequence
  Description of Artificial Sequence: Synthetic oligonucleotide
cgcaagtgggagacggcccatgag

SEQ ID NO: 6213 - DNA, 24 bp, Artificial Sequence
  Description of Artificial Sequence: Synthetic oligonucleotide
gcaagtgggagacggcccatgagg

SEQ ID NO: 6214 - DNA, 24 bp, Artificial Sequence
  Description of Artificial Sequence: Synthetic oligonucleotide
cagtggagagcctacctggagggc

SEQ ID NO: 6215 - DNA, 24 bp, Artificial Sequence
  Description of Artificial Sequence: Synthetic oligonucleotide
agtggagagcctacctggagggcc

SEQ ID NO: 6216 - DNA, 23 bp, Artificial Sequence
  Description of Artificial Sequence: Synthetic oligonucleotide
gtggagagcctacctggagggcc

SEQ ID NO: 6217 - DNA, 23 bp, Artificial Sequence
  Description of Artificial Sequence: Synthetic oligonucleotide
tggagagcctacctggagggccg

SEQ ID NO: 6218 - DNA, 22 bp, Artificial Sequence
  Description of Artificial Sequence: Synthetic oligonucleotide
ggagagcctacctggagggccg

SEQ ID NO: 6219 - DNA, 22 bp, Artificial Sequence
  Description of Artificial Sequence: Synthetic oligonucleotide
tgcagcgcacggacgcccccaa

SEQ ID NO: 6220 - DNA, 21 bp, Artificial Sequence
  Description of Artificial Sequence: Synthetic oligonucleotide
gcagcgcacggacgcccccaa

SEQ ID NO: 6221 - DNA, 22 bp, Artificial Sequence
  Description of Artificial Sequence: Synthetic oligonucleotide
cagcgcacggacgcccccaaga

SEQ ID NO: 6222 - DNA, 22 bp, Artificial Sequence
  Description of Artificial Sequence: Synthetic oligonucleotide
agcgcacggacgcccccaagac

SEQ ID NO: 6223 - DNA, 21 bp, Artificial Sequence
  Description of Artificial Sequence: Synthetic oligonucleotide
gcgcacggacgcccccaagac

SEQ ID NO: 6224 - DNA, 21 bp, Artificial Sequence
  Description of Artificial Sequence: Synthetic oligonucleotide
cgcacggacgcccccaagacg

SEQ ID NO: 6225 - DNA, 25 bp, Artificial Sequence
  Description of Artificial Sequence: Synthetic oligonucleotide
gcacggacgcccccaagacgcatat

SEQ ID NO: 6226 - DNA, 26 bp, Artificial Sequence
  Description of Artificial Sequence: Synthetic oligonucleotide
cacggacgcccccaagacgcatatga

SEQ ID NO: 6227 - DNA, 27 bp, Artificial Sequence
  Description of Artificial Sequence: Synthetic oligonucleotide
acggacgcccccaagacgcatatgact

SEQ ID NO: 6228 - DNA, 26 bp, Artificial Sequence
  Description of Artificial Sequence: Synthetic oligonucleotide
cggacgcccccaagacgcatatgact

SEQ ID NO: 6229 - DNA, 27 bp, Artificial Sequence
  Description of Artificial Sequence: Synthetic oligonucleotide
ggacgcccccaagacgcatatgactca

SEQ ID NO: 6230 - DNA, 27 bp, Artificial Sequence
  Description of Artificial Sequence: Synthetic oligonucleotide
gacgcccccaagacgcatatgactcac

SEQ ID NO: 6231 - DNA, 27 bp, Artificial Sequence
  Description of Artificial Sequence: Synthetic oligonucleotide
acgcccccaagacgcatatgactcacc

SEQ ID NO: 6232 - DNA, 27 bp, Artificial Sequence
  Description of Artificial Sequence: Synthetic oligonucleotide
cgcccccaagacgcatatgactcacca

SEQ ID NO: 6233 - DNA, 27 bp, Artificial Sequence
  Description of Artificial Sequence: Synthetic oligonucleotide
gcccccaagacgcatatgactcaccac

SEQ ID NO: 6234 - DNA, 27 bp, Artificial Sequence
  Description of Artificial Sequence: Synthetic oligonucleotide
cccccaagacgcatatgactcaccacg

SEQ ID NO: 6235 - DNA, 27 bp, Artificial Sequence
  Description of Artificial Sequence: Synthetic oligonucleotide
ccccaagacgcatatgactcaccacgc

SEQ ID NO: 6236 - DNA, 28 bp, Artificial Sequence
  Description of Artificial Sequence: Synthetic oligonucleotide
cccaagacgcatatgactcaccacgctg

SEQ ID NO: 6237 - DNA, 29 bp, Artificial Sequence
  Description of Artificial Sequence: Synthetic oligonucleotide
ccaagacgcatatgactcaccacgctgtc

SEQ ID NO: 6238 - DNA, 30 bp, Artificial Sequence
  Description of Artificial Sequence: Synthetic oligonucleotide
caagacgcatatgactcaccacgctgtctc

SEQ ID NO: 6239 - DNA, 31 bp, Artificial Sequence
  Description of Artificial Sequence: Synthetic oligonucleotide
aagacgcatatgactcaccacgctgtctctg

SEQ ID NO: 6240 - DNA, 30 bp, Artificial Sequence
  Description of Artificial Sequence: Synthetic oligonucleotide
agacgcatatgactcaccacgctgtctctg

SEQ ID NO: 6241 - DNA, 29 bp, Artificial Sequence
  Description of Artificial Sequence: Synthetic oligonucleotide
gacgcatatgactcaccacgctgtctctg

SEQ ID NO: 6242 - DNA, 32 bp, Artificial Sequence
  Description of Artificial Sequence: Synthetic oligonucleotide
atatgactcaccacgctgtctctgaccatgag

SEQ ID NO: 6243 - DNA, 31 bp, Artificial Sequence
  Description of Artificial Sequence: Synthetic oligonucleotide
tatgactcaccacgctgtctctgaccatgag

SEQ ID NO: 6244 - DNA, 30 bp, Artificial Sequence
  Description of Artificial Sequence: Synthetic oligonucleotide
atgactcaccacgctgtctctgaccatgag

SEQ ID NO: 6245 - DNA, 29 bp, Artificial Sequence
  Description of Artificial Sequence: Synthetic oligonucleotide
tgactcaccacgctgtctctgaccatgag

SEQ ID NO: 6246 - DNA, 28 bp, Artificial Sequence
  Description of Artificial Sequence: Synthetic oligonucleotide
gactcaccacgctgtctctgaccatgag

SEQ ID NO: 6247 - DNA, 28 bp, Artificial Sequence
  Description of Artificial Sequence: Synthetic oligonucleotide
actcaccacgctgtctctgaccatgagg

SEQ ID NO: 6248 - DNA, 27 bp, Artificial Sequence
  Description of Artificial Sequence: Synthetic oligonucleotide
ctcaccacgctgtctctgaccatgagg

SEQ ID NO: 6249 - DNA, 27 bp, Artificial Sequence
  Description of Artificial Sequence: Synthetic oligonucleotide
tcaccacgctgtctctgaccatgaggc

SEQ ID NO: 6250 - DNA, 26 bp, Artificial Sequence
  Description of Artificial Sequence: Synthetic oligonucleotide
caccacgctgtctctgaccatgaggc

SEQ ID NO: 6251 - DNA, 27 bp, Artificial Sequence
  Description of Artificial Sequence: Synthetic oligonucleotide
accacgctgtctctgaccatgaggcca

SEQ ID NO: 6252 - DNA, 26 bp, Artificial Sequence
  Description of Artificial Sequence: Synthetic oligonucleotide
ccacgctgtctctgaccatgaggcca

SEQ ID NO: 6253 - DNA, 26 bp, Artificial Sequence
  Description of Artificial Sequence: Synthetic oligonucleotide
cacgctgtctctgaccatgaggccac

SEQ ID NO: 6254 - DNA, 26 bp, Artificial Sequence
  Description of Artificial Sequence: Synthetic oligonucleotide
acgctgtctctgaccatgaggccacc

SEQ ID NO: 6255 - DNA, 25 bp, Artificial Sequence
  Description of Artificial Sequence: Synthetic oligonucleotide
cgctgtctctgaccatgaggccacc

SEQ ID NO: 6256 - DNA, 26 bp, Artificial Sequence
  Description of Artificial Sequence: Synthetic oligonucleotide
gctgtctctgaccatgaggccaccct

SEQ ID NO: 6257 - DNA, 27 bp, Artificial Sequence
  Description of Artificial Sequence: Synthetic oligonucleotide
ctgtctctgaccatgaggccaccctga

SEQ ID NO: 6258 - DNA, 27 bp, Artificial Sequence
  Description of Artificial Sequence: Synthetic oligonucleotide
tgtctctgaccatgaggccaccctgag

SEQ ID NO: 6259 - DNA, 26 bp, Artificial Sequence
  Description of Artificial Sequence: Synthetic oligonucleotide
gtctctgaccatgaggccaccctgag

SEQ ID NO: 6260 - DNA, 23 bp, Artificial Sequence
  Description of Artificial Sequence: Synthetic oligonucleotide
gagaccaggcctgcaggggatgg

SEQ ID NO: 6261 - DNA, 24 bp, Artificial Sequence
  Description of Artificial Sequence: Synthetic oligonucleotide
agaccaggcctgcaggggatggga

SEQ ID NO: 6262 - DNA, 23 bp, Artificial Sequence
  Description of Artificial Sequence: Synthetic oligonucleotide
gaccaggcctgcaggggatggga

SEQ ID NO: 6263 - DNA, 23 bp, Artificial Sequence
  Description of Artificial Sequence: Synthetic oligonucleotide
accaggcctgcaggggatgggac

SEQ ID NO: 6264 - DNA, 22 bp, Artificial Sequence
  Description of Artificial Sequence: Synthetic oligonucleotide
ccaggcctgcaggggatgggac

SEQ ID NO: 6265 - DNA, 24 bp, Artificial Sequence
  Description of Artificial Sequence: Synthetic oligonucleotide
caggcctgcaggggatgggacctt

SEQ ID NO: 6266 - DNA, 24 bp, Artificial Sequence
  Description of Artificial Sequence: Synthetic oligonucleotide
aggcctgcaggggatgggaccttc

SEQ ID NO: 6267 - DNA, 23 bp, Artificial Sequence
  Description of Artificial Sequence: Synthetic oligonucleotide
ggcctgcaggggatgggaccttc

SEQ ID NO: 6268 - DNA, 24 bp, Artificial Sequence
  Description of Artificial Sequence: Synthetic oligonucleotide
gcctgcaggggatgggaccttcca

SEQ ID NO: 6269 - DNA, 26 bp, Artificial Sequence
  Description of Artificial Sequence: Synthetic oligonucleotide
cctgcaggggatgggaccttccagaa

SEQ ID NO: 6270 - DNA, 27 bp, Artificial Sequence
  Description of Artificial Sequence: Synthetic oligonucleotide
ctgcaggggatgggaccttccagaagt

SEQ ID NO: 6271 - DNA, 27 bp, Artificial Sequence
  Description of Artificial Sequence: Synthetic oligonucleotide
tgcaggggatgggaccttccagaagtg

SEQ ID NO: 6272 - DNA, 26 bp, Artificial Sequence
  Description of Artificial Sequence: Synthetic oligonucleotide
gcaggggatgggaccttccagaagtg

SEQ ID NO: 6273 - DNA, 26 bp, Artificial Sequence
  Description of Artificial Sequence: Synthetic oligonucleotide
caggggatgggaccttccagaagtgg

SEQ ID NO: 6274 - DNA, 26 bp, Artificial Sequence
  Description of Artificial Sequence: Synthetic oligonucleotide
aggggatgggaccttccagaagtggg

SEQ ID NO: 6275 - DNA, 25 bp, Artificial Sequence
  Description of Artificial Sequence: Synthetic oligonucleotide
ggggatgggaccttccagaagtggg

SEQ ID NO: 6276 - DNA, 25 bp, Artificial Sequence
  Description of Artificial Sequence: Synthetic oligonucleotide
gggatgggaccttccagaagtgggc

SEQ ID NO: 6277 - DNA, 26 bp, Artificial Sequence
  Description of Artificial Sequence: Synthetic oligonucleotide
ggatgggaccttccagaagtgggcgt

SEQ ID NO: 6278 - DNA, 27 bp, Artificial Sequence
  Description of Artificial Sequence: Synthetic oligonucleotide
gatgggaccttccagaagtgggcgtct

SEQ ID NO: 6279 - DNA, 27 bp, Artificial Sequence
  Description of Artificial Sequence: Synthetic oligonucleotide
atgggaccttccagaagtgggcgtctg

SEQ ID NO: 6280 - DNA, 27 bp, Artificial Sequence
  Description of Artificial Sequence: Synthetic oligonucleotide
tgggaccttccagaagtgggcgtctgt

SEQ ID NO: 6281 - DNA, 26 bp, Artificial Sequence
  Description of Artificial Sequence: Synthetic oligonucleotide
gggaccttccagaagtgggcgtctgt

SEQ ID NO: 6282 - DNA, 26 bp, Artificial Sequence
  Description of Artificial Sequence: Synthetic oligonucleotide
ggaccttccagaagtgggcgtctgtg

SEQ ID NO: 6283 - DNA, 27 bp, Artificial Sequence
  Description of Artificial Sequence: Synthetic oligonucleotide
gaccttccagaagtgggcgtctgtggt

SEQ ID NO: 6284 - DNA, 27 bp, Artificial Sequence
  Description of Artificial Sequence: Synthetic oligonucleotide
accttccagaagtgggcgtctgtggtg

SEQ ID NO: 6285 - DNA, 26 bp, Artificial Sequence
  Description of Artificial Sequence: Synthetic oligonucleotide
ccttccagaagtgggcgtctgtggtg

SEQ ID NO: 6286 - DNA, 27 bp, Artificial Sequence
  Description of Artificial Sequence: Synthetic oligonucleotide
cttccagaagtgggcgtctgtggtggt

SEQ ID NO: 6287 - DNA, 27 bp, Artificial Sequence
  Description of Artificial Sequence: Synthetic oligonucleotide
ttccagaagtgggcgtctgtggtggtg

SEQ ID NO: 6288 - DNA, 26 bp, Artificial Sequence
  Description of Artificial Sequence: Synthetic oligonucleotide
tccagaagtgggcgtctgtggtggtg

SEQ ID NO: 6289 - DNA, 25 bp, Artificial Sequence
  Description of Artificial Sequence: Synthetic oligonucleotide
ccagaagtgggcgtctgtggtggtg

SEQ ID NO: 6290 - DNA, 25 bp, Artificial Sequence
  Description of Artificial Sequence: Synthetic oligonucleotide
cagaagtgggcgtctgtggtggtgc

SEQ ID NO: 6291 - DNA, 27 bp, Artificial Sequence
  Description of Artificial Sequence: Synthetic oligonucleotide
agaagtgggcgtctgtggtggtgcctt

SEQ ID NO: 6292 - DNA, 26 bp, Artificial Sequence
  Description of Artificial Sequence: Synthetic oligonucleotide
gaagtgggcgtctgtggtggtgcctt

SEQ ID NO: 6293 - DNA, 27 bp, Artificial Sequence
  Description of Artificial Sequence: Synthetic oligonucleotide
aagtgggcgtctgtggtggtgccttct

SEQ ID NO: 6294 - DNA, 26 bp, Artificial Sequence
  Description of Artificial Sequence: Synthetic oligonucleotide
agtgggcgtctgtggtggtgccttct

SEQ ID NO: 6295 - DNA, 25 bp, Artificial Sequence
  Description of Artificial Sequence: Synthetic oligonucleotide
gtgggcgtctgtggtggtgccttct

SEQ ID NO: 6296 - DNA, 25 bp, Artificial Sequence
  Description of Artificial Sequence: Synthetic oligonucleotide
tgggcgtctgtggtggtgccttctg

SEQ ID NO: 6297 - DNA, 24 bp, Artificial Sequence
  Description of Artificial Sequence: Synthetic oligonucleotide
gggcgtctgtggtggtgccttctg

SEQ ID NO: 6298 - DNA, 25 bp, Artificial Sequence
  Description of Artificial Sequence: Synthetic oligonucleotide
ggcgtctgtggtggtgccttctgga

SEQ ID NO: 6299 - DNA, 26 bp, Artificial Sequence
  Description of Artificial Sequence: Synthetic oligonucleotide
gcgtctgtggtggtgccttctggaca

SEQ ID NO: 6300 - DNA, 26 bp, Artificial Sequence
  Description of Artificial Sequence: Synthetic oligonucleotide
cgtctgtggtggtgccttctggacag

SEQ ID NO: 6301 - DNA, 27 bp, Artificial Sequence
  Description of Artificial Sequence: Synthetic oligonucleotide
gtctgtggtggtgccttctggacagga

SEQ ID NO: 6302 - DNA, 27 bp, Artificial Sequence
  Description of Artificial Sequence: Synthetic oligonucleotide
tctgtggtggtgccttctggacaggag

SEQ ID NO: 6303 - DNA, 22 bp, Artificial Sequence
  Description of Artificial Sequence: Synthetic oligonucleotide
gtgcggttcgacagcgacgccc

SEQ ID NO: 6304 - DNA, 22 bp, Artificial Sequence
  Description of Artificial Sequence: Synthetic oligonucleotide
tgcggttcgacagcgacgcccc

SEQ ID NO: 6305 - DNA, 21 bp, Artificial Sequence
  Description of Artificial Sequence: Synthetic oligonucleotide
gcggttcgacagcgacgcccc

SEQ ID NO: 6306 - DNA, 22 bp, Artificial Sequence
  Description of Artificial Sequence: Synthetic oligonucleotide
cggttcgacagcgacgccccga

SEQ ID NO: 6307 - DNA, 22 bp, Artificial Sequence
  Description of Artificial Sequence: Synthetic oligonucleotide
ggttcgacagcgacgccccgag

SEQ ID NO: 6308 - DNA, 22 bp, Artificial Sequence
  Description of Artificial Sequence: Synthetic oligonucleotide
gttcgacagcgacgccccgagc

SEQ ID NO: 6309 - DNA, 23 bp, Artificial Sequence
  Description of Artificial Sequence: Synthetic oligonucleotide
ttcgacagcgacgccccgagcca

SEQ ID NO: 6310 - DNA, 22 bp, Artificial Sequence
  Description of Artificial Sequence: Synthetic oligonucleotide
tcgacagcgacgccccgagcca

SEQ ID NO: 6311 - DNA, 21 bp, Artificial Sequence
  Description of Artificial Sequence: Synthetic oligonucleotide
cgacagcgacgccccgagcca

SEQ ID NO: 6312 - DNA, 22 bp, Artificial Sequence
  Description of Artificial Sequence: Synthetic oligonucleotide
gacagcgacgccccgagccaga

SEQ ID NO: 6313 - DNA, 22 bp, Artificial Sequence
  Description of Artificial Sequence: Synthetic oligonucleotide
acagcgacgccccgagccagag

SEQ ID NO: 6314 - DNA, 21 bp, Artificial Sequence
  Description of Artificial Sequence: Synthetic oligonucleotide
cagcgacgccccgagccagag

SEQ ID NO: 6315 - DNA, 23 bp, Artificial Sequence
  Description of Artificial Sequence: Synthetic oligonucleotide
agcgacgccccgagccagaggat

SEQ ID NO: 6316 - DNA, 22 bp, Artificial Sequence
  Description of Artificial Sequence: Synthetic oligonucleotide
gcgacgccccgagccagaggat

SEQ ID NO: 6317 - DNA, 22 bp, Artificial Sequence
  Description of Artificial Sequence: Synthetic oligonucleotide
cgacgccccgagccagaggatg

SEQ ID NO: 6318 - DNA, 23 bp, Artificial Sequence
  Description of Artificial Sequence: Synthetic oligonucleotide
gacgccccgagccagaggatgga

SEQ ID NO: 6319 - DNA, 23 bp, Artificial Sequence
  Description of Artificial Sequence: Synthetic oligonucleotide
acgccccgagccagaggatggag

SEQ ID NO: 6320 - DNA, 22 bp, Artificial Sequence
  Description of Artificial Sequence: Synthetic oligonucleotide
cgccccgagccagaggatggag

SEQ ID NO: 6321 - DNA, 22 bp, Artificial Sequence
  Description of Artificial Sequence: Synthetic oligonucleotide
gccccgagccagaggatggagc

SEQ ID NO: 6322 - DNA, 22 bp, Artificial Sequence
  Description of Artificial Sequence: Synthetic oligonucleotide
ccccgagccagaggatggagcc

SEQ ID NO: 6323 - DNA, 22 bp, Artificial Sequence
  Description of Artificial Sequence: Synthetic oligonucleotide
cccgagccagaggatggagccg

SEQ ID NO: 6324 - DNA, 22 bp, Artificial Sequence
  Description of Artificial Sequence: Synthetic oligonucleotide
ccgagccagaggatggagccgc

SEQ ID NO: 6325 - DNA, 27 bp, Artificial Sequence
  Description of Artificial Sequence: Synthetic oligonucleotide
gggacggggagacacggaaagtgaaga

SEQ ID NO: 6326 - DNA, 27 bp, Artificial Sequence
  Description of Artificial Sequence: Synthetic oligonucleotide
ggacggggagacacggaaagtgaagac

SEQ ID NO: 6327 - DNA, 27 bp, Artificial Sequence
  Description of Artificial Sequence: Synthetic oligonucleotide
gacggggagacacggaaagtgaagacc

SEQ ID NO: 6328 - DNA, 27 bp, Artificial Sequence
  Description of Artificial Sequence: Synthetic oligonucleotide
acggggagacacggaaagtgaagaccc

SEQ ID NO: 6329 - DNA, 27 bp, Artificial Sequence
  Description of Artificial Sequence: Synthetic oligonucleotide
cggggagacacggaaagtgaagaccca

SEQ ID NO: 6330 - DNA, 27 bp, Artificial Sequence
  Description of Artificial Sequence: Synthetic oligonucleotide
ggggagacacggaaagtgaagacccac

SEQ ID NO: 6331 - DNA, 28 bp, Artificial Sequence
  Description of Artificial Sequence: Synthetic oligonucleotide
gggagacacggaaagtgaagacccactc

SEQ ID NO: 6332 - DNA, 29 bp, Artificial Sequence
  Description of Artificial Sequence: Synthetic oligonucleotide
ggagacacggaaagtgaagacccactcac

SEQ ID NO: 6333 - DNA, 30 bp, Artificial Sequence
  Description of Artificial Sequence: Synthetic oligonucleotide
gagacacggaaagtgaagacccactcacag

SEQ ID NO: 6334 - DNA, 31 bp, Artificial Sequence
  Description of Artificial Sequence: Synthetic oligonucleotide
agacacggaaagtgaagacccactcacagac

SEQ ID NO: 6335 - DNA, 30 bp, Artificial Sequence
  Description of Artificial Sequence: Synthetic oligonucleotide
gacacggaaagtgaagacccactcacagac

SEQ ID NO: 6336 - DNA, 31 bp, Artificial Sequence
  Description of Artificial Sequence: Synthetic oligonucleotide
acacggaaagtgaagacccactcacagactc

SEQ ID NO: 6337 - DNA, 30 bp, Artificial Sequence
  Description of Artificial Sequence: Synthetic oligonucleotide
cacggaaagtgaagacccactcacagactc

SEQ ID NO: 6338 - DNA, 31 bp, Artificial Sequence
  Description of Artificial Sequence: Synthetic oligonucleotide
acggaaagtgaagacccactcacagactcac

SEQ ID NO: 6339 - DNA, 30 bp, Artificial Sequence
  Description of Artificial Sequence: Synthetic oligonucleotide
cggaaagtgaagacccactcacagactcac

SEQ ID NO: 6340 - DNA, 30 bp, Artificial Sequence
  Description of Artificial Sequence: Synthetic oligonucleotide
ggaaagtgaagacccactcacagactcacc

SEQ ID NO: 6341 - DNA, 30 bp, Artificial Sequence
  Description of Artificial Sequence: Synthetic oligonucleotide
gaaagtgaagacccactcacagactcaccg

SEQ ID NO: 6342 - DNA, 31 bp, Artificial Sequence
  Description of Artificial Sequence: Synthetic oligonucleotide
aaagtgaagacccactcacagactcaccgag

SEQ ID NO: 6343 - DNA, 30 bp, Artificial Sequence
  Description of Artificial Sequence: Synthetic oligonucleotide
aagtgaagacccactcacagactcaccgag

SEQ ID NO: 6344 - DNA, 29 bp, Artificial Sequence
  Description of Artificial Sequence: Synthetic oligonucleotide
agtgaagacccactcacagactcaccgag

SEQ ID NO: 6345 - DNA, 28 bp, Artificial Sequence
  Description of Artificial Sequence: Synthetic oligonucleotide
gtgaagacccactcacagactcaccgag

SEQ ID NO: 6346 - DNA, 29 bp, Artificial Sequence
  Description of Artificial Sequence: Synthetic oligonucleotide
tgaagacccactcacagactcaccgagtg

SEQ ID NO: 6347 - DNA, 28 bp, Artificial Sequence
  Description of Artificial Sequence: Synthetic oligonucleotide
gaagacccactcacagactcaccgagtg

SEQ ID NO: 6348 - DNA, 28 bp, Artificial Sequence
  Description of Artificial Sequence: Synthetic oligonucleotide
aagacccactcacagactcaccgagtgg

SEQ ID NO: 6349 - DNA, 27 bp, Artificial Sequence
  Description of Artificial Sequence: Synthetic oligonucleotide
agacccactcacagactcaccgagtgg

SEQ ID NO: 6350 - DNA, 27 bp, Artificial Sequence
  Description of Artificial Sequence: Synthetic oligonucleotide
gacccactcacagactcaccgagtgga

SEQ ID NO: 6351 - DNA, 27 bp, Artificial Sequence
  Description of Artificial Sequence: Synthetic oligonucleotide
acccactcacagactcaccgagtggac

SEQ ID NO: 6352 - DNA, 27 bp, Artificial Sequence
  Description of Artificial Sequence: Synthetic oligonucleotide
ctgcggagatcacactgacctggcagt

SEQ ID NO: 6353 - DNA, 27 bp, Artificial Sequence
  Description of Artificial Sequence: Synthetic oligonucleotide
tgcggagatcacactgacctggcagtg

SEQ ID NO: 6354 - DNA, 26 bp, Artificial Sequence
  Description of Artificial Sequence: Synthetic oligonucleotide
gcggagatcacactgacctggcagtg

SEQ ID NO: 6355 - DNA, 26 bp, Artificial Sequence
  Description of Artificial Sequence: Synthetic oligonucleotide
cggagatcacactgacctggcagtgg

SEQ ID NO: 6356 - DNA, 27 bp, Artificial Sequence
  Description of Artificial Sequence: Synthetic oligonucleotide
ggagatcacactgacctggcagtggga

SEQ ID NO: 6357 - DNA, 28 bp, Artificial Sequence
  Description of Artificial Sequence: Synthetic oligonucleotide
gagatcacactgacctggcagtgggatg

SEQ ID NO: 6358 - DNA, 28 bp, Artificial Sequence
  Description of Artificial Sequence: Synthetic oligonucleotide
agatcacactgacctggcagtgggatgg

SEQ ID NO: 6359 - DNA, 27 bp, Artificial Sequence
  Description of Artificial Sequence: Synthetic oligonucleotide
gatcacactgacctggcagtgggatgg

SEQ ID NO: 6360 - DNA, 27 bp, Artificial Sequence
  Description of Artificial Sequence: Synthetic oligonucleotide
atcacactgacctggcagtgggatggg

SEQ ID NO: 6361 - DNA, 26 bp, Artificial Sequence
  Description of Artificial Sequence: Synthetic oligonucleotide
tcacactgacctggcagtgggatggg

SEQ ID NO: 6362 - DNA, 25 bp, Artificial Sequence
  Description of Artificial Sequence: Synthetic oligonucleotide
cacactgacctggcagtgggatggg

SEQ ID NO: 6363 - DNA, 26 bp, Artificial Sequence
  Description of Artificial Sequence: Synthetic oligonucleotide
acactgacctggcagtgggatgggga

SEQ ID NO: 6364 - DNA, 25 bp, Artificial Sequence
  Description of Artificial Sequence: Synthetic oligonucleotide
cactgacctggcagtgggatgggga

SEQ ID NO: 6365 - DNA, 25 bp, Artificial Sequence
  Description of Artificial Sequence: Synthetic oligonucleotide
actgacctggcagtgggatggggag

SEQ ID NO: 6366 - DNA, 24 bp, Artificial Sequence
  Description of Artificial Sequence: Synthetic oligonucleotide
ctgacctggcagtgggatggggag

SEQ ID NO: 6367 - DNA, 25 bp, Artificial Sequence
  Description of Artificial Sequence: Synthetic oligonucleotide
tgacctggcagtgggatggggagga

SEQ ID NO: 6368 - DNA, 24 bp, Artificial Sequence
  Description of Artificial Sequence: Synthetic oligonucleotide
gacctggcagtgggatggggagga

SEQ ID NO: 6369 - DNA, 24 bp, Artificial Sequence
  Description of Artificial Sequence: Synthetic oligonucleotide
acctggcagtgggatggggaggac

SEQ ID NO: 6370 - DNA, 23 bp, Artificial Sequence
  Description of Artificial Sequence: Synthetic oligonucleotide
cctggcagtgggatggggaggac

SEQ ID NO: 6371 - DNA, 24 bp, Artificial Sequence
  Description of Artificial Sequence: Synthetic oligonucleotide
ctggcagtgggatggggaggacca

SEQ ID NO: 6372 - DNA, 25 bp, Artificial Sequence
  Description of Artificial Sequence: Synthetic oligonucleotide
tggcagtgggatggggaggaccaga

SEQ ID NO: 6373 - DNA, 24 bp, Artificial Sequence
  Description of Artificial Sequence: Synthetic oligonucleotide
ggcagtgggatggggaggaccaga

SEQ ID NO: 6374 - DNA, 24 bp, Artificial Sequence
  Description of Artificial Sequence: Synthetic oligonucleotide
gcagtgggatggggaggaccagac

SEQ ID NO: 6375 - DNA, 24 bp, Artificial Sequence
  Description of Artificial Sequence: Synthetic oligonucleotide
cagtgggatggggaggaccagacc

SEQ ID NO: 6376 - DNA, 25 bp, Artificial Sequence
  Description of Artificial Sequence: Synthetic oligonucleotide
agtgggatggggaggaccagaccca

SEQ ID NO: 6377 - DNA, 24 bp, Artificial Sequence
  Description of Artificial Sequence: Synthetic oligonucleotide
gtgggatggggaggaccagaccca

SEQ ID NO: 6378 - DNA, 24 bp, Artificial Sequence
  Description of Artificial Sequence: Synthetic oligonucleotide
tgggatggggaggaccagacccag

SEQ ID NO: 6379 - DNA, 23 bp, Artificial Sequence
  Description of Artificial Sequence: Synthetic oligonucleotide
gcggggagccccgcttcatcgta

SEQ ID NO: 6380 - DNA, 24 bp, Artificial Sequence
  Description of Artificial Sequence: Synthetic oligonucleotide
cggggagccccgcttcatcgtagt

SEQ ID NO: 6381 - DNA, 24 bp, Artificial Sequence
  Description of Artificial Sequence: Synthetic oligonucleotide
ggggagccccgcttcatcgtagtg

SEQ ID NO: 6382 - DNA, 24 bp, Artificial Sequence
  Description of Artificial Sequence: Synthetic oligonucleotide
gggagccccgcttcatcgtagtgg

SEQ ID NO: 6383 - DNA, 24 bp, Artificial Sequence
  Description of Artificial Sequence: Synthetic oligonucleotide
ggagccccgcttcatcgtagtggg

SEQ ID NO: 6384 - DNA, 26 bp, Artificial Sequence
  Description of Artificial Sequence: Synthetic oligonucleotide
gagccccgcttcatcgtagtgggcta

SEQ ID NO: 6385 - DNA, 26 bp, Artificial Sequence
  Description of Artificial Sequence: Synthetic oligonucleotide
agccccgcttcatcgtagtgggctac

SEQ ID NO: 6386 - DNA, 25 bp, Artificial Sequence
  Description of Artificial Sequence: Synthetic oligonucleotide
gccccgcttcatcgtagtgggctac

SEQ ID NO: 6387 - DNA, 26 bp, Artificial Sequence
  Description of Artificial Sequence: Synthetic oligonucleotide
ccccgcttcatcgtagtgggctacgt

SEQ ID NO: 6388 - DNA, 26 bp, Artificial Sequence
  Description of Artificial Sequence: Synthetic oligonucleotide
cccgcttcatcgtagtgggctacgtg

SEQ ID NO: 6389 - DNA, 27 bp, Artificial Sequence
  Description of Artificial Sequence: Synthetic oligonucleotide
ccgcttcatcgtagtgggctacgtgga

SEQ ID NO: 6390 - DNA, 27 bp, Artificial Sequence
  Description of Artificial Sequence: Synthetic oligonucleotide
cgcttcatcgtagtgggctacgtggac

SEQ ID NO: 6391 - DNA, 27 bp, Artificial Sequence
  Description of Artificial Sequence: Synthetic oligonucleotide
gcttcatcgtagtgggctacgtggacg

SEQ ID NO: 6392 - DNA, 28 bp, Artificial Sequence
  Description of Artificial Sequence: Synthetic oligonucleotide
cttcatcgtagtgggctacgtggacgac

SEQ ID NO: 6393 - DNA, 29 bp, Artificial Sequence
  Description of Artificial Sequence: Synthetic oligonucleotide
ttcatcgtagtgggctacgtggacgacac

SEQ ID NO: 6394 - DNA, 28 bp, Artificial Sequence
  Description of Artificial Sequence: Synthetic oligonucleotide
tcatcgtagtgggctacgtggacgacac

SEQ ID NO: 6395 - DNA, 27 bp, Artificial Sequence
  Description of Artificial Sequence: Synthetic oligonucleotide
catcgtagtgggctacgtggacgacac

SEQ ID NO: 6396 - DNA, 27 bp, Artificial Sequence
  Description of Artificial Sequence: Synthetic oligonucleotide
atcgtagtgggctacgtggacgacacg

SEQ ID NO: 6397 - DNA, 26 bp, Artificial Sequence
  Description of Artificial Sequence: Synthetic oligonucleotide
tcgtagtgggctacgtggacgacacg

SEQ ID NO: 6398 - DNA, 25 bp, Artificial Sequence
  Description of Artificial Sequence: Synthetic oligonucleotide
cgtagtgggctacgtggacgacacg

SEQ ID NO: 6399 - DNA, 26 bp, Artificial Sequence
  Description of Artificial Sequence: Synthetic oligonucleotide
gtagtgggctacgtggacgacacgca

SEQ ID NO: 6400 - DNA, 27 bp, Artificial Sequence
  Description of Artificial Sequence: Synthetic oligonucleotide
tagtgggctacgtggacgacacgcagt

SEQ ID NO: 6401 - DNA, 34 bp, Artificial Sequence
  Description of Artificial Sequence: Synthetic oligonucleotide
ctctcactccatgaggtatttctacacctccatg

SEQ ID NO: 6402 - DNA, 35 bp, Artificial Sequence
  Description of Artificial Sequence: Synthetic oligonucleotide
tctcactccatgaggtatttctacacctccatgtc

SEQ ID NO: 6403 - DNA, 34 bp, Artificial Sequence
  Description of Artificial Sequence: Synthetic oligonucleotide
ctcactccatgaggtatttctacacctccatgtc

SEQ ID NO: 6404 - DNA, 34 bp, Artificial Sequence
  Description of Artificial Sequence: Synthetic oligonucleotide
tcactccatgaggtatttctacacctccatgtcc

SEQ ID NO: 6405 - DNA, 27 bp, Artificial Sequence
  Description of Artificial Sequence: Synthetic oligonucleotide
agcaggagggtccggagtattgggaca

SEQ ID NO: 6406 - DNA, 26 bp, Artificial Sequence
  Description of Artificial Sequence: Synthetic oligonucleotide
gcaggagggtccggagtattgggaca

SEQ ID NO: 6407 - DNA, 26 bp, Artificial Sequence
  Description of Artificial Sequence: Synthetic oligonucleotide
caggagggtccggagtattgggacag

SEQ ID NO: 6408 - DNA, 26 bp, Artificial Sequence
  Description of Artificial Sequence: Synthetic oligonucleotide
aggagggtccggagtattgggacagg

SEQ ID NO: 6409 - DNA, 25 bp, Artificial Sequence
  Description of Artificial Sequence: Synthetic oligonucleotide
ggagggtccggagtattgggacagg

SEQ ID NO: 6410 - DNA, 26 bp, Artificial Sequence
  Description of Artificial Sequence: Synthetic oligonucleotide
gagggtccggagtattgggacaggga

SEQ ID NO: 6411 - DNA, 27 bp, Artificial Sequence
  Description of Artificial Sequence: Synthetic oligonucleotide
agggtccggagtattgggacagggaga

SEQ ID NO: 6412 - DNA, 26 bp, Artificial Sequence
  Description of Artificial Sequence: Synthetic oligonucleotide
gggtccggagtattgggacagggaga

SEQ ID NO: 6413 - DNA, 27 bp, Artificial Sequence
  Description of Artificial Sequence: Synthetic oligonucleotide
ggtccggagtattgggacagggagaca

SEQ ID NO: 6414 - DNA, 27 bp, Artificial Sequence
  Description of Artificial Sequence: Synthetic oligonucleotide
gtccggagtattgggacagggagacac

SEQ ID NO: 6415 - DNA, 27 bp, Artificial Sequence
  Description of Artificial Sequence: Synthetic oligonucleotide
tccggagtattgggacagggagacacg

SEQ ID NO: 6416 - DNA, 26 bp, Artificial Sequence
  Description of Artificial Sequence: Synthetic oligonucleotide
ccggagtattgggacagggagacacg

SEQ ID NO: 6417 - DNA, 27 bp, Artificial Sequence
  Description of Artificial Sequence: Synthetic oligonucleotide
cggagtattgggacagggagacacgga

SEQ ID NO: 6418 - DNA, 29 bp, Artificial Sequence
  Description of Artificial Sequence: Synthetic oligonucleotide
ggagtattgggacagggagacacggaaag

SEQ ID NO: 6419 - DNA, 30 bp, Artificial Sequence
  Description of Artificial Sequence: Synthetic oligonucleotide
gagtattgggacagggagacacggaaagtg

SEQ ID NO: 6420 - DNA, 32 bp, Artificial Sequence
  Description of Artificial Sequence: Synthetic oligonucleotide
agtattgggacagggagacacggaaagtgaag

SEQ ID NO: 6421 - DNA, 31 bp, Artificial Sequence
  Description of Artificial Sequence: Synthetic oligonucleotide
gtattgggacagggagacacggaaagtgaag

SEQ ID NO: 6422 - DNA, 31 bp, Artificial Sequence
  Description of Artificial Sequence: Synthetic oligonucleotide
tattgggacagggagacacggaaagtgaagg

SEQ ID NO: 6423 - DNA, 30 bp, Artificial Sequence
  Description of Artificial Sequence: Synthetic oligonucleotide
attgggacagggagacacggaaagtgaagg

SEQ ID NO: 6424 - DNA, 29 bp, Artificial Sequence
  Description of Artificial Sequence: Synthetic oligonucleotide
ttgggacagggagacacggaaagtgaagg

SEQ ID NO: 6425 - DNA, 28 bp, Artificial Sequence
  Description of Artificial Sequence: Synthetic oligonucleotide
tgggacagggagacacggaaagtgaagg

SEQ ID NO: 6426 - DNA, 27 bp, Artificial Sequence
  Description of Artificial Sequence: Synthetic oligonucleotide
gggacagggagacacggaaagtgaagg

SEQ ID NO: 6427 - DNA, 27 bp, Artificial Sequence
  Description of Artificial Sequence: Synthetic oligonucleotide
ggacagggagacacggaaagtgaaggc

SEQ ID NO: 6428 - DNA, 27 bp, Artificial Sequence
  Description of Artificial Sequence: Synthetic oligonucleotide
gacagggagacacggaaagtgaaggcc

SEQ ID NO: 6429 - DNA, 27 bp, Artificial Sequence
  Description of Artificial Sequence: Synthetic oligonucleotide
acagggagacacggaaagtgaaggccc

SEQ ID NO: 6430 - DNA, 27 bp, Artificial Sequence
  Description of Artificial Sequence: Synthetic oligonucleotide
cagggagacacggaaagtgaaggccca

SEQ ID NO: 6431 - DNA, 27 bp, Artificial Sequence
  Description of Artificial Sequence: Synthetic oligonucleotide
agggagacacggaaagtgaaggcccac

SEQ ID NO: 6432 - DNA, 25 bp, Artificial Sequence
  Description of Artificial Sequence: Synthetic oligonucleotide
cgccgtggatagagcaggagggtct

SEQ ID NO: 6433 - DNA, 25 bp, Artificial Sequence
  Description of Artificial Sequence: Synthetic oligonucleotide
gccgtggatagagcaggagggtctg

SEQ ID NO: 6434 - DNA, 26 bp, Artificial Sequence
  Description of Artificial Sequence: Synthetic oligonucleotide
ccgtggatagagcaggagggtctgga

SEQ ID NO: 6435 - DNA, 27 bp, Artificial Sequence
  Description of Artificial Sequence: Synthetic oligonucleotide
cgtggatagagcaggagggtctggagt

SEQ ID NO: 6436 - DNA, 30 bp, Artificial Sequence
  Description of Artificial Sequence: Synthetic oligonucleotide
gtggatagagcaggagggtctggagtattg

SEQ ID NO: 6437 - DNA, 30 bp, Artificial Sequence
  Description of Artificial Sequence: Synthetic oligonucleotide
tggatagagcaggagggtctggagtattgg

SEQ ID NO: 6438 - DNA, 29 bp, Artificial Sequence
  Description of Artificial Sequence: Synthetic oligonucleotide
ggatagagcaggagggtctggagtattgg

SEQ ID NO: 6439 - DNA, 29 bp, Artificial Sequence
  Description of Artificial Sequence: Synthetic oligonucleotide
gatagagcaggagggtctggagtattggg

SEQ ID NO: 6440 - DNA, 30 bp, Artificial Sequence
  Description of Artificial Sequence: Synthetic oligonucleotide
atagagcaggagggtctggagtattgggac

SEQ ID NO: 6441 - DNA, 29 bp, Artificial Sequence
  Description of Artificial Sequence: Synthetic oligonucleotide
tagagcaggagggtctggagtattgggac

SEQ ID NO: 6442 - DNA, 28 bp, Artificial Sequence
  Description of Artificial Sequence: Synthetic oligonucleotide
agagcaggagggtctggagtattgggac

SEQ ID NO: 6443 - DNA, 27 bp, Artificial Sequence
  Description of Artificial Sequence: Synthetic oligonucleotide
gagcaggagggtctggagtattgggac

SEQ ID NO: 6444 - DNA, 27 bp, Artificial Sequence
  Description of Artificial Sequence: Synthetic oligonucleotide
agcaggagggtctggagtattgggacg

SEQ ID NO: 6445 - DNA, 26 bp, Artificial Sequence
  Description of Artificial Sequence: Synthetic oligonucleotide
gcaggagggtctggagtattgggacg

SEQ ID NO: 6446 - DNA, 26 bp, Artificial Sequence
  Description of Artificial Sequence: Synthetic oligonucleotide
caggagggtctggagtattgggacgg

SEQ ID NO: 6447 - DNA, 26 bp, Artificial Sequence
  Description of Artificial Sequence: Synthetic oligonucleotide
aggagggtctggagtattgggacggg

SEQ ID NO: 6448 - DNA, 25 bp, Artificial Sequence
  Description of Artificial Sequence: Synthetic oligonucleotide
ggagggtctggagtattgggacggg

SEQ ID NO: 6449 - DNA, 26 bp, Artificial Sequence
  Description of Artificial Sequence: Synthetic oligonucleotide
gagggtctggagtattgggacgggga

SEQ ID NO: 6450 - DNA, 27 bp, Artificial Sequence
  Description of Artificial Sequence: Synthetic oligonucleotide
agggtctggagtattgggacggggaga

SEQ ID NO: 6451 - DNA, 26 bp, Artificial Sequence
  Description of Artificial Sequence: Synthetic oligonucleotide
gggtctggagtattgggacggggaga

SEQ ID NO: 6452 - DNA, 27 bp, Artificial Sequence
  Description of Artificial Sequence: Synthetic oligonucleotide
ggtctggagtattgggacggggagaca

SEQ ID NO: 6453 - DNA, 27 bp, Artificial Sequence
  Description of Artificial Sequence: Synthetic oligonucleotide
gtctggagtattgggacggggagacac

SEQ ID NO: 6454 - DNA, 27 bp, Artificial Sequence
  Description of Artificial Sequence: Synthetic oligonucleotide
tctggagtattgggacggggagacacg

SEQ ID NO: 6455 - DNA, 26 bp, Artificial Sequence
  Description of Artificial Sequence: Synthetic oligonucleotide
ctggagtattgggacggggagacacg

SEQ ID NO: 6456 - DNA, 27 bp, Artificial Sequence
  Description of Artificial Sequence: Synthetic oligonucleotide
tggagtattgggacggggagacacgga

SEQ ID NO: 6457 - DNA, 21 bp, Artificial Sequence
  Description of Artificial Sequence: Synthetic oligonucleotide
gactggcgcttcctccgcggg

SEQ ID NO: 6458 - DNA, 23 bp, Artificial Sequence
  Description of Artificial Sequence: Synthetic oligonucleotide
actggcgcttcctccgcgggcat

SEQ ID NO: 6459 - DNA, 22 bp, Artificial Sequence
  Description of Artificial Sequence: Synthetic oligonucleotide
ctggcgcttcctccgcgggcat

SEQ ID NO: 6460 - DNA, 23 bp, Artificial Sequence
  Description of Artificial Sequence: Synthetic oligonucleotide
tggcgcttcctccgcgggcatga

SEQ ID NO: 6461 - DNA, 22 bp, Artificial Sequence
  Description of Artificial Sequence: Synthetic oligonucleotide
ggcgcttcctccgcgggcatga

SEQ ID NO: 6462 - DNA, 22 bp, Artificial Sequence
  Description of Artificial Sequence: Synthetic oligonucleotide
gcgcttcctccgcgggcatgac

SEQ ID NO: 6463 - DNA, 23 bp, Artificial Sequence
  Description of Artificial Sequence: Synthetic oligonucleotide
cgcttcctccgcgggcatgacca

SEQ ID NO: 6464 - DNA, 25 bp, Artificial Sequence
  Description of Artificial Sequence: Synthetic oligonucleotide
gcttcctccgcgggcatgaccagta

SEQ ID NO: 6465 - DNA, 25 bp, Artificial Sequence
  Description of Artificial Sequence: Synthetic oligonucleotide
cttcctccgcgggcatgaccagtac

SEQ ID NO: 6466 - DNA, 25 bp, Artificial Sequence
  Description of Artificial Sequence: Synthetic oligonucleotide
ttcctccgcgggcatgaccagtacg

SEQ ID NO: 6467 - DNA, 24 bp, Artificial Sequence
  Description of Artificial Sequence: Synthetic oligonucleotide
tcctccgcgggcatgaccagtacg

SEQ ID NO: 6468 - DNA, 23 bp, Artificial Sequence
  Description of Artificial Sequence: Synthetic oligonucleotide
cctccgcgggcatgaccagtacg

SEQ ID NO: 6469 - DNA, 23 bp, Artificial Sequence
  Description of Artificial Sequence: Synthetic oligonucleotide
ctccgcgggcatgaccagtacgc

SEQ ID NO: 6470 - DNA, 25 bp, Artificial Sequence
  Description of Artificial Sequence: Synthetic oligonucleotide
tccgcgggcatgaccagtacgccta

SEQ ID NO: 6471 - DNA, 24 bp, Artificial Sequence
  Description of Artificial Sequence: Synthetic oligonucleotide
ccgcgggcatgaccagtacgccta

SEQ ID NO: 6472 - DNA, 24 bp, Artificial Sequence
  Description of Artificial Sequence: Synthetic oligonucleotide
cgcgggcatgaccagtacgcctac

SEQ ID NO: 6473 - DNA, 25 bp, Artificial Sequence
  Description of Artificial Sequence: Synthetic oligonucleotide
gcgggcatgaccagtacgcctacga

SEQ ID NO: 6474 - DNA, 25 bp, Artificial Sequence
  Description of Artificial Sequence: Synthetic oligonucleotide
cgggcatgaccagtacgcctacgac

SEQ ID NO: 6475 - DNA, 25 bp, Artificial Sequence
  Description of Artificial Sequence: Synthetic oligonucleotide
gggcatgaccagtacgcctacgacg

SEQ ID NO: 6476 - DNA, 25 bp, Artificial Sequence
  Description of Artificial Sequence: Synthetic oligonucleotide
ggcatgaccagtacgcctacgacgg

SEQ ID NO: 6477 - DNA, 27 bp, Artificial Sequence
  Description of Artificial Sequence: Synthetic oligonucleotide
gcatgaccagtacgcctacgacggcaa

SEQ ID NO: 6478 - DNA, 27 bp, Artificial Sequence
  Description of Artificial Sequence: Synthetic oligonucleotide
catgaccagtacgcctacgacggcaag

SEQ ID NO: 6479 - DNA, 27 bp, Artificial Sequence
  Description of Artificial Sequence: Synthetic oligonucleotide
atgaccagtacgcctacgacggcaagg

SEQ ID NO: 6480 - DNA, 27 bp, Artificial Sequence
  Description of Artificial Sequence: Synthetic oligonucleotide
tgaccagtacgcctacgacggcaagga

SEQ ID NO: 6481 - DNA, 27 bp, Artificial Sequence
  Description of Artificial Sequence: Synthetic oligonucleotide
gaccagtacgcctacgacggcaaggat

SEQ ID NO: 6482 - DNA, 22 bp, Artificial Sequence
  Description of Artificial Sequence: Synthetic oligonucleotide
acccagcgcaagtgggaggcgg

SEQ ID NO: 6483 - DNA, 21 bp, Artificial Sequence
  Description of Artificial Sequence: Synthetic oligonucleotide
cccagcgcaagtgggaggcgg

SEQ ID NO: 6484 - DNA, 21 bp, Artificial Sequence
  Description of Artificial Sequence: Synthetic oligonucleotide
ccagcgcaagtgggaggcggc

SEQ ID NO: 6485 - DNA, 21 bp, Artificial Sequence
  Description of Artificial Sequence: Synthetic oligonucleotide
cagcgcaagtgggaggcggcc

SEQ ID NO: 6486 - DNA, 20 bp, Artificial Sequence
  Description of Artificial Sequence: Synthetic oligonucleotide
gtgtcccggcccggccgcat

SEQ ID NO: 6487 - DNA, 20 bp, Artificial Sequence
  Description of Artificial Sequence: Synthetic oligonucleotide
tgtcccggcccggccgcagt

SEQ ID NO: 6488 - DNA, 20 bp, Artificial Sequence
  Description of Artificial Sequence: Synthetic oligonucleotide
gtcccggcccggccgcagtt

SEQ ID NO: 6489 - DNA, 20 bp, Artificial Sequence
  Description of Artificial Sequence: Synthetic oligonucleotide
tcccggcccggccgcaggtt

SEQ ID NO: 6490 - DNA, 20 bp, Artificial Sequence
  Description of Artificial Sequence: Synthetic oligonucleotide
cccggcccggccgcaggttt

SEQ ID NO: 6491 - DNA, 20 bp, Artificial Sequence
  Description of Artificial Sequence: Synthetic oligonucleotide
ccggcccggccgcagggatt

SEQ ID NO: 6492 - DNA, 20 bp, Artificial Sequence
  Description of Artificial Sequence: Synthetic oligonucleotide
cggcccggccgcagggagtt

SEQ ID NO: 6493 - DNA, 20 bp, Artificial Sequence
  Description of Artificial Sequence: Synthetic oligonucleotide
ggcccggccgcagggagctt

SEQ ID NO: 6494 - DNA, 20 bp, Artificial Sequence
  Description of Artificial Sequence: Synthetic oligonucleotide
gcccggccgcagggagcctt

SEQ ID NO: 6495 - DNA, 20 bp, Artificial Sequence
  Description of Artificial Sequence: Synthetic oligonucleotide
cccggccgcagggagccctt

SEQ ID NO: 6496 - DNA, 20 bp, Artificial Sequence
  Description of Artificial Sequence: Synthetic oligonucleotide
ccggccgcagggagcccctt

SEQ ID NO: 6497 - DNA, 20 bp, Artificial Sequence
  Description of Artificial Sequence: Synthetic oligonucleotide
cggccgcagggagccccgtt

SEQ ID NO: 6498 - DNA, 20 bp, Artificial Sequence
  Description of Artificial Sequence: Synthetic oligonucleotide
ggccgcagggagccccgctt

SEQ ID NO: 6499 - DNA, 22 bp, Artificial Sequence
  Description of Artificial Sequence: Synthetic oligonucleotide
gccgcagggagccccgcttcat

SEQ ID NO: 6500 - DNA, 22 bp, Artificial Sequence
  Description of Artificial Sequence: Synthetic oligonucleotide
ccgcagggagccccgcttcatc

SEQ ID NO: 6501 - DNA, 22 bp, Artificial Sequence
  Description of Artificial Sequence: Synthetic oligonucleotide
cgcagggagccccgcttcatcg

SEQ ID NO: 6502 - DNA, 23 bp, Artificial Sequence
  Description of Artificial Sequence: Synthetic oligonucleotide
gcagggagccccgcttcatcgca

SEQ ID NO: 6503 - DNA, 24 bp, Artificial Sequence
  Description of Artificial Sequence: Synthetic oligonucleotide
cagggagccccgcttcatcgcagt

SEQ ID NO: 6504 - DNA, 24 bp, Artificial Sequence
  Description of Artificial Sequence: Synthetic oligonucleotide
agggagccccgcttcatcgcagtg

SEQ ID NO: 6505 - DNA, 24 bp, Artificial Sequence
  Description of Artificial Sequence: Synthetic oligonucleotide
tggcgcttcctccgcgggtatgac

SEQ ID NO: 6506 - DNA, 23 bp, Artificial Sequence
  Description of Artificial Sequence: Synthetic oligonucleotide
ggcgcttcctccgcgggtatgac

SEQ ID NO: 6507 - DNA, 24 bp, Artificial Sequence
  Description of Artificial Sequence: Synthetic oligonucleotide
gcgcttcctccgcgggtatgacca

SEQ ID NO: 6508 - DNA, 26 bp, Artificial Sequence
  Description of Artificial Sequence: Synthetic oligonucleotide
cgcttcctccgcgggtatgaccagta

SEQ ID NO: 6509 - DNA, 26 bp, Artificial Sequence
  Description of Artificial Sequence: Synthetic oligonucleotide
gcttcctccgcgggtatgaccagtac

SEQ ID NO: 6510 - DNA, 26 bp, Artificial Sequence
  Description of Artificial Sequence: Synthetic oligonucleotide
cttcctccgcgggtatgaccagtacg

SEQ ID NO: 6511 - DNA, 26 bp, Artificial Sequence
  Description of Artificial Sequence: Synthetic oligonucleotide
ttcctccgcgggtatgaccagtacgc

SEQ ID NO: 6512 - DNA, 25 bp, Artificial Sequence
  Description of Artificial Sequence: Synthetic oligonucleotide
tcctccgcgggtatgaccagtacgc

SEQ ID NO: 6513 - DNA, 24 bp, Artificial Sequence
  Description of Artificial Sequence: Synthetic oligonucleotide
cctccgcgggtatgaccagtacgc

SEQ ID NO: 6514 - DNA, 26 bp, Artificial Sequence
  Description of Artificial Sequence: Synthetic oligonucleotide
ctccgcgggtatgaccagtacgccta

SEQ ID NO: 6515 - DNA, 26 bp, Artificial Sequence
  Description of Artificial Sequence: Synthetic oligonucleotide
tccgcgggtatgaccagtacgcctac

SEQ ID NO: 6516 - DNA, 25 bp, Artificial Sequence
  Description of Artificial Sequence: Synthetic oligonucleotide
ccgcgggtatgaccagtacgcctac

SEQ ID NO: 6517 - DNA, 26 bp, Artificial Sequence
  Description of Artificial Sequence: Synthetic oligonucleotide
cgcgggtatgaccagtacgcctacga

SEQ ID NO: 6518 - DNA, 26 bp, Artificial Sequence
  Description of Artificial Sequence: Synthetic oligonucleotide
gcgggtatgaccagtacgcctacgac

SEQ ID NO: 6519 - DNA, 26 bp, Artificial Sequence
  Description of Artificial Sequence: Synthetic oligonucleotide
cgggtatgaccagtacgcctacgacg

SEQ ID NO: 6520 - DNA, 26 bp, Artificial Sequence
  Description of Artificial Sequence: Synthetic oligonucleotide
gggtatgaccagtacgcctacgacgg

SEQ ID NO: 6521 - DNA, 27 bp, Artificial Sequence
  Description of Artificial Sequence: Synthetic oligonucleotide
ggtatgaccagtacgcctacgacggca

SEQ ID NO: 6522 - DNA, 28 bp, Artificial Sequence
  Description of Artificial Sequence: Synthetic oligonucleotide
gtatgaccagtacgcctacgacggcaag

SEQ ID NO: 6523 - DNA, 28 bp, Artificial Sequence
  Description of Artificial Sequence: Synthetic oligonucleotide
tatgaccagtacgcctacgacggcaagg

SEQ ID NO: 6524 - DNA, 27 bp, Artificial Sequence
  Description of Artificial Sequence: Synthetic oligonucleotide
gaggccggttctcacaccatccagatg

SEQ ID NO: 6525 - DNA, 29 bp, Artificial Sequence
  Description of Artificial Sequence: Synthetic oligonucleotide
aggccggttctcacaccatccagatgatg

SEQ ID NO: 6526 - DNA, 28 bp, Artificial Sequence
  Description of Artificial Sequence: Synthetic oligonucleotide
ggccggttctcacaccatccagatgatg

SEQ ID NO: 6527 - DNA, 31 bp, Artificial Sequence
  Description of Artificial Sequence: Synthetic oligonucleotide
gccggttctcacaccatccagatgatgtatg

SEQ ID NO: 6528 - DNA, 31 bp, Artificial Sequence
  Description of Artificial Sequence: Synthetic oligonucleotide
ccggttctcacaccatccagatgatgtatgg

SEQ ID NO: 6529 - DNA, 29 bp, Artificial Sequence
  Description of Artificial Sequence: Synthetic oligonucleotide
cctacgacggcaaggattacatcgccttg

SEQ ID NO: 6530 - DNA, 31 bp, Artificial Sequence
  Description of Artificial Sequence: Synthetic oligonucleotide
ctacgacggcaaggattacatcgccttgaac

SEQ ID NO: 6531 - DNA, 31 bp, Artificial Sequence
  Description of Artificial Sequence: Synthetic oligonucleotide
tacgacggcaaggattacatcgccttgaacg

SEQ ID NO: 6532 - DNA, 30 bp, Artificial Sequence
  Description of Artificial Sequence: Synthetic oligonucleotide
acgacggcaaggattacatcgccttgaacg

SEQ ID NO: 6533 - DNA, 29 bp, Artificial Sequence
  Description of Artificial Sequence: Synthetic oligonucleotide
cgacggcaaggattacatcgccttgaacg

SEQ ID NO: 6534 - DNA, 30 bp, Artificial Sequence
  Description of Artificial Sequence: Synthetic oligonucleotide
gacggcaaggattacatcgccttgaacgag

SEQ ID NO: 6535 - DNA, 30 bp, Artificial Sequence
  Description of Artificial Sequence: Synthetic oligonucleotide
acggcaaggattacatcgccttgaacgagg

SEQ ID NO: 6536 - DNA, 29 bp, Artificial Sequence
  Description of Artificial Sequence: Synthetic oligonucleotide
cggcaaggattacatcgccttgaacgagg

SEQ ID NO: 6537 - DNA, 30 bp, Artificial Sequence
  Description of Artificial Sequence: Synthetic oligonucleotide
ggcaaggattacatcgccttgaacgaggac

SEQ ID NO: 6538 - DNA, 30 bp, Artificial Sequence
  Description of Artificial Sequence: Synthetic oligonucleotide
gcaaggattacatcgccttgaacgaggacc

SEQ ID NO: 6539 - DNA, 31 bp, Artificial Sequence
  Description of Artificial Sequence: Synthetic oligonucleotide
caaggattacatcgccttgaacgaggacctg

SEQ ID NO: 6540 - DNA, 31 bp, Artificial Sequence
  Description of Artificial Sequence: Synthetic oligonucleotide
aaggattacatcgccttgaacgaggacctgc

SEQ ID NO: 6541 - DNA, 30 bp, Artificial Sequence
  Description of Artificial Sequence: Synthetic oligonucleotide
aggattacatcgccttgaacgaggacctgc

SEQ ID NO: 6542 - DNA, 29 bp, Artificial Sequence
  Description of Artificial Sequence: Synthetic oligonucleotide
ggattacatcgccttgaacgaggacctgc

SEQ ID NO: 6543 - DNA, 29 bp, Artificial Sequence
  Description of Artificial Sequence: Synthetic oligonucleotide
gattacatcgccttgaacgaggacctgcg

SEQ ID NO: 6544 - DNA, 29 bp, Artificial Sequence
  Description of Artificial Sequence: Synthetic oligonucleotide
attacatcgccttgaacgaggacctgcgc

SEQ ID NO: 6545 - DNA, 28 bp, Artificial Sequence
  Description of Artificial Sequence: Synthetic oligonucleotide
ttacatcgccttgaacgaggacctgcgc

SEQ ID NO: 6546 - DNA, 27 bp, Artificial Sequence
  Description of Artificial Sequence: Synthetic oligonucleotide
tacatcgccttgaacgaggacctgcgc

SEQ ID NO: 6547 - DNA, 27 bp, Artificial Sequence
  Description of Artificial Sequence: Synthetic oligonucleotide
acatcgccttgaacgaggacctgcgct

SEQ ID NO: 6548 - DNA, 26 bp, Artificial Sequence
  Description of Artificial Sequence: Synthetic oligonucleotide
catcgccttgaacgaggacctgcgct

SEQ ID NO: 6549 - DNA, 27 bp, Artificial Sequence
  Description of Artificial Sequence: Synthetic oligonucleotide
atcgccttgaacgaggacctgcgctct

SEQ ID NO: 6550 - DNA, 27 bp, Artificial Sequence
  Description of Artificial Sequence: Synthetic oligonucleotide
tcgccttgaacgaggacctgcgctctt

SEQ ID NO: 6551 - DNA, 26 bp, Artificial Sequence
  Description of Artificial Sequence: Synthetic oligonucleotide
cgccttgaacgaggacctgcgctctt

SEQ ID NO: 6552 - DNA, 26 bp, Artificial Sequence
  Description of Artificial Sequence: Synthetic oligonucleotide
gccttgaacgaggacctgcgctcttg

SEQ ID NO: 6553 - DNA, 27 bp, Artificial Sequence
  Description of Artificial Sequence: Synthetic oligonucleotide
ccttgaacgaggacctgcgctcttgga

SEQ ID NO: 6554 - DNA, 27 bp, Artificial Sequence
  Description of Artificial Sequence: Synthetic oligonucleotide
cttgaacgaggacctgcgctcttggac

SEQ ID NO: 6555 - DNA, 27 bp, Artificial Sequence
  Description of Artificial Sequence: Synthetic oligonucleotide
ttgaacgaggacctgcgctcttggacc

SEQ ID NO: 6556 - DNA, 22 bp, Artificial Sequence
  Description of Artificial Sequence: Synthetic oligonucleotide
gcaagtgggaggcggcccgtgt

SEQ ID NO: 6557 - DNA, 26 bp, Artificial Sequence
  Description of Artificial Sequence: Synthetic oligonucleotide
agagcctacctggagggcacgtgcat

SEQ ID NO: 6558 - DNA, 25 bp, Artificial Sequence
  Description of Artificial Sequence: Synthetic oligonucleotide
gagcctacctggagggcacgtgcat

SEQ ID NO: 6559 - DNA, 25 bp, Artificial Sequence
  Description of Artificial Sequence: Synthetic oligonucleotide
agcctacctggagggcacgtgcatg

SEQ ID NO: 6560 - DNA, 24 bp, Artificial Sequence
  Description of Artificial Sequence: Synthetic oligonucleotide
gcctacctggagggcacgtgcatg

SEQ ID NO: 6561 - DNA, 25 bp, Artificial Sequence
  Description of Artificial Sequence: Synthetic oligonucleotide
cctacctggagggcacgtgcatgga

SEQ ID NO: 6562 - DNA, 26 bp, Artificial Sequence
  Description of Artificial Sequence: Synthetic oligonucleotide
ctacctggagggcacgtgcatggagt

SEQ ID NO: 6563 - DNA, 26 bp, Artificial Sequence
  Description of Artificial Sequence: Synthetic oligonucleotide
tacctggagggcacgtgcatggagtg

SEQ ID NO: 6564 - DNA, 25 bp, Artificial Sequence
  Description of Artificial Sequence: Synthetic oligonucleotide
acctggagggcacgtgcatggagtg

SEQ ID NO: 6565 - DNA, 24 bp, Artificial Sequence
  Description of Artificial Sequence: Synthetic oligonucleotide
cctggagggcacgtgcatggagtg

SEQ ID NO: 6566 - DNA, 24 bp, Artificial Sequence
  Description of Artificial Sequence: Synthetic oligonucleotide
ctggagggcacgtgcatggagtgg

SEQ ID NO: 6567 - DNA, 25 bp, Artificial Sequence
  Description of Artificial Sequence: Synthetic oligonucleotide
tggagggcacgtgcatggagtggct

SEQ ID NO: 6568 - DNA, 24 bp, Artificial Sequence
  Description of Artificial Sequence: Synthetic oligonucleotide
ggagggcacgtgcatggagtggct

SEQ ID NO: 6569 - DNA, 24 bp, Artificial Sequence
  Description of Artificial Sequence: Synthetic oligonucleotide
gagggcacgtgcatggagtggctc

SEQ ID NO: 6570 - DNA, 24 bp, Artificial Sequence
  Description of Artificial Sequence: Synthetic oligonucleotide
agggcacgtgcatggagtggctcc

SEQ ID NO: 6571 - DNA, 23 bp, Artificial Sequence
  Description of Artificial Sequence: Synthetic oligonucleotide
gggcacgtgcatggagtggctcc

SEQ ID NO: 6572 - DNA, 23 bp, Artificial Sequence
  Description of Artificial Sequence: Synthetic oligonucleotide
ggcacgtgcatggagtggctccg

SEQ ID NO: 6573 - DNA, 24 bp, Artificial Sequence
  Description of Artificial Sequence: Synthetic oligonucleotide
gcacgtgcatggagtggctccgca

SEQ ID NO: 6574 - DNA, 27 bp, Artificial Sequence
  Description of Artificial Sequence: Synthetic oligonucleotide
cacgtgcatggagtggctccgcagata

SEQ ID NO: 6575 - DNA, 27 bp, Artificial Sequence
  Description of Artificial Sequence: Synthetic oligonucleotide
acgtgcatggagtggctccgcagatac

SEQ ID NO: 6576 - DNA, 26 bp, Artificial Sequence
  Description of Artificial Sequence: Synthetic oligonucleotide
cgtgcatggagtggctccgcagatac

SEQ ID NO: 6577 - DNA, 27 bp, Artificial Sequence
  Description of Artificial Sequence: Synthetic oligonucleotide
gtgcatggagtggctccgcagatacct

SEQ ID NO: 6578 - DNA, 27 bp, Artificial Sequence
  Description of Artificial Sequence: Synthetic oligonucleotide
tgcatggagtggctccgcagatacctg

SEQ ID NO: 6579 - DNA, 26 bp, Artificial Sequence
  Description of Artificial Sequence: Synthetic oligonucleotide
gcatggagtggctccgcagatacctg

SEQ ID NO: 6580 - DNA, 27 bp, Artificial Sequence
  Description of Artificial Sequence: Synthetic oligonucleotide
catggagtggctccgcagatacctgga

SEQ ID NO: 6581 - DNA, 27 bp, Artificial Sequence
  Description of Artificial Sequence: Synthetic oligonucleotide
atggagtggctccgcagatacctggag

SEQ ID NO: 6582 - DNA, 25 bp, Artificial Sequence
  Description of Artificial Sequence: Synthetic oligonucleotide
ggcgccgtggatagagcaggagagt

SEQ ID NO: 6583 - DNA, 25 bp, Artificial Sequence
  Description of Artificial Sequence: Synthetic oligonucleotide
gcgccgtggatagagcaggagagtc

SEQ ID NO: 6584 - DNA, 25 bp, Artificial Sequence
  Description of Artificial Sequence: Synthetic oligonucleotide
cgccgtggatagagcaggagagtcc

SEQ ID NO: 6585 - DNA, 25 bp, Artificial Sequence
  Description of Artificial Sequence: Synthetic oligonucleotide
gccgtggatagagcaggagagtccg

SEQ ID NO: 6586 - DNA, 26 bp, Artificial Sequence
  Description of Artificial Sequence: Synthetic oligonucleotide
ccgtggatagagcaggagagtccgga

SEQ ID NO: 6587 - DNA, 27 bp, Artificial Sequence
  Description of Artificial Sequence: Synthetic oligonucleotide
cgtggatagagcaggagagtccggagt

SEQ ID NO: 6588 - DNA, 30 bp, Artificial Sequence
  Description of Artificial Sequence: Synthetic oligonucleotide
gtggatagagcaggagagtccggagtattg

SEQ ID NO: 6589 - DNA, 30 bp, Artificial Sequence
  Description of Artificial Sequence: Synthetic oligonucleotide
tggatagagcaggagagtccggagtattgg

SEQ ID NO: 6590 - DNA, 29 bp, Artificial Sequence
  Description of Artificial Sequence: Synthetic oligonucleotide
ggatagagcaggagagtccggagtattgg

SEQ ID NO: 6591 - DNA, 29 bp, Artificial Sequence
  Description of Artificial Sequence: Synthetic oligonucleotide
gatagagcaggagagtccggagtattggg

SEQ ID NO: 6592 - DNA, 30 bp, Artificial Sequence
  Description of Artificial Sequence: Synthetic oligonucleotide
atagagcaggagagtccggagtattgggac

SEQ ID NO: 6593 - DNA, 29 bp, Artificial Sequence
  Description of Artificial Sequence: Synthetic oligonucleotide
tagagcaggagagtccggagtattgggac

SEQ ID NO: 6594 - DNA, 28 bp, Artificial Sequence
  Description of Artificial Sequence: Synthetic oligonucleotide
agagcaggagagtccggagtattgggac

SEQ ID NO: 6595 - DNA, 27 bp, Artificial Sequence
  Description of Artificial Sequence: Synthetic oligonucleotide
gagcaggagagtccggagtattgggac

SEQ ID NO: 6596 - DNA, 27 bp, Artificial Sequence
  Description of Artificial Sequence: Synthetic oligonucleotide
agcaggagagtccggagtattgggacg

SEQ ID NO: 6597 - DNA, 26 bp, Artificial Sequence
  Description of Artificial Sequence: Synthetic oligonucleotide
gcaggagagtccggagtattgggacg

SEQ ID NO: 6598 - DNA, 26 bp, Artificial Sequence
  Description of Artificial Sequence: Synthetic oligonucleotide
caggagagtccggagtattgggacgg

SEQ ID NO: 6599 - DNA, 26 bp, Artificial Sequence
  Description of Artificial Sequence: Synthetic oligonucleotide
aggagagtccggagtattgggacggg

SEQ ID NO: 6600 - DNA, 25 bp, Artificial Sequence
  Description of Artificial Sequence: Synthetic oligonucleotide
ggagagtccggagtattgggacggg

SEQ ID NO: 6601 - DNA, 26 bp, Artificial Sequence
  Description of Artificial Sequence: Synthetic oligonucleotide
gagagtccggagtattgggacgggga

SEQ ID NO: 6602 - DNA, 27 bp, Artificial Sequence
  Description of Artificial Sequence: Synthetic oligonucleotide
agagtccggagtattgggacggggaga

SEQ ID NO: 6603 - DNA, 26 bp, Artificial Sequence
  Description of Artificial Sequence: Synthetic oligonucleotide
gagtccggagtattgggacggggaga

SEQ ID NO: 6604 - DNA, 27 bp, Artificial Sequence
  Description of Artificial Sequence: Synthetic oligonucleotide
agtccggagtattgggacggggagaca

SEQ ID NO: 6605 - DNA, 26 bp, Artificial Sequence
  Description of Artificial Sequence: Synthetic oligonucleotide
gccggttctcacaccgtccagaggtt

SEQ ID NO: 6606 - DNA, 27 bp, Artificial Sequence
  Description of Artificial Sequence: Synthetic oligonucleotide
ccggttctcacaccgtccagaggttgt

SEQ ID NO: 6607 - DNA, 29 bp, Artificial Sequence
  Description of Artificial Sequence: Synthetic oligonucleotide
cggttctcacaccgtccagaggttgtatg

SEQ ID NO: 6608 - DNA, 29 bp, Artificial Sequence
  Description of Artificial Sequence: Synthetic oligonucleotide
ggttctcacaccgtccagaggttgtatgg

SEQ ID NO: 6609 - DNA, 29 bp, Artificial Sequence
  Description of Artificial Sequence: Synthetic oligonucleotide
gttctcacaccgtccagaggttgtatggc

SEQ ID NO: 6610 - DNA, 30 bp, Artificial Sequence
  Description of Artificial Sequence: Synthetic oligonucleotide
ttctcacaccgtccagaggttgtatggctg

SEQ ID NO: 6611 - DNA, 29 bp, Artificial Sequence
  Description of Artificial Sequence: Synthetic oligonucleotide
tctcacaccgtccagaggttgtatggctg

SEQ ID NO: 6612 - DNA, 28 bp, Artificial Sequence
  Description of Artificial Sequence: Synthetic oligonucleotide
ctcacaccgtccagaggttgtatggctg

SEQ ID NO: 6613 - DNA, 28 bp, Artificial Sequence
  Description of Artificial Sequence: Synthetic oligonucleotide
tcacaccgtccagaggttgtatggctgc

SEQ ID NO: 6614 - DNA, 27 bp, Artificial Sequence
  Description of Artificial Sequence: Synthetic oligonucleotide
cacaccgtccagaggttgtatggctgc

SEQ ID NO: 6615 - DNA, 27 bp, Artificial Sequence
  Description of Artificial Sequence: Synthetic oligonucleotide
acaccgtccagaggttgtatggctgcg

SEQ ID NO: 6616 - DNA, 27 bp, Artificial Sequence
  Description of Artificial Sequence: Synthetic oligonucleotide
caccgtccagaggttgtatggctgcga

SEQ ID NO: 6617 - DNA, 27 bp, Artificial Sequence
  Description of Artificial Sequence: Synthetic oligonucleotide
accgtccagaggttgtatggctgcgac

SEQ ID NO: 6618 - DNA, 26 bp, Artificial Sequence
  Description of Artificial Sequence: Synthetic oligonucleotide
ccgtccagaggttgtatggctgcgac

SEQ ID NO: 6619 - DNA, 27 bp, Artificial Sequence
  Description of Artificial Sequence: Synthetic oligonucleotide
cgtccagaggttgtatggctgcgacgt

SEQ ID NO: 6620 - DNA, 27 bp, Artificial Sequence
  Description of Artificial Sequence: Synthetic oligonucleotide
gtccagaggttgtatggctgcgacgtg

SEQ ID NO: 6621 - DNA, 27 bp, Artificial Sequence
  Description of Artificial Sequence: Synthetic oligonucleotide
tccagaggttgtatggctgcgacgtgg

SEQ ID NO: 6622 - DNA, 26 bp, Artificial Sequence
  Description of Artificial Sequence: Synthetic oligonucleotide
ccagaggttgtatggctgcgacgtgg

SEQ ID NO: 6623 - DNA, 26 bp, Artificial Sequence
  Description of Artificial Sequence: Synthetic oligonucleotide
cagaggttgtatggctgcgacgtggg

SEQ ID NO: 6624 - DNA, 27 bp, Artificial Sequence
  Description of Artificial Sequence: Synthetic oligonucleotide
agaggttgtatggctgcgacgtggggt

SEQ ID NO: 6625 - DNA, 26 bp, Artificial Sequence
  Description of Artificial Sequence: Synthetic oligonucleotide
gaggttgtatggctgcgacgtggggt

SEQ ID NO: 6626 - DNA, 26 bp, Artificial Sequence
  Description of Artificial Sequence: Synthetic oligonucleotide
aggttgtatggctgcgacgtggggtc

SEQ ID NO: 6627 - DNA, 25 bp, Artificial Sequence
  Description of Artificial Sequence: Synthetic oligonucleotide
ggttgtatggctgcgacgtggggtc

SEQ ID NO: 6628 - DNA, 25 bp, Artificial Sequence
  Description of Artificial Sequence: Synthetic oligonucleotide
gttgtatggctgcgacgtggggtcg

SEQ ID NO: 6629 - DNA, 26 bp, Artificial Sequence
  Description of Artificial Sequence: Synthetic oligonucleotide
ttgtatggctgcgacgtggggtcgga

SEQ ID NO: 6630 - DNA, 28 bp, Artificial Sequence
  Description of Artificial Sequence: Synthetic oligonucleotide
acacggaaagtgaaggcccactcacagg

SEQ ID NO: 6631 - DNA, 27 bp, Artificial Sequence
  Description of Artificial Sequence: Synthetic oligonucleotide
cacggaaagtgaaggcccactcacagg

SEQ ID NO: 6632 - DNA, 27 bp, Artificial Sequence
  Description of Artificial Sequence: Synthetic oligonucleotide
acggaaagtgaaggcccactcacaggc

SEQ ID NO: 6633 - DNA, 27 bp, Artificial Sequence
  Description of Artificial Sequence: Synthetic oligonucleotide
cggaaagtgaaggcccactcacaggct

SEQ ID NO: 6634 - DNA, 27 bp, Artificial Sequence
  Description of Artificial Sequence: Synthetic oligonucleotide
ggaaagtgaaggcccactcacaggctc

SEQ ID NO: 6635 - DNA, 28 bp, Artificial Sequence
  Description of Artificial Sequence: Synthetic oligonucleotide
gaaagtgaaggcccactcacaggctcac

SEQ ID NO: 6636 - DNA, 28 bp, Artificial Sequence
  Description of Artificial Sequence: Synthetic oligonucleotide
aaagtgaaggcccactcacaggctcacc

SEQ ID NO: 6637 - DNA, 27 bp, Artificial Sequence
  Description of Artificial Sequence: Synthetic oligonucleotide
aagtgaaggcccactcacaggctcacc

SEQ ID NO: 6638 - DNA, 26 bp, Artificial Sequence
  Description of Artificial Sequence: Synthetic oligonucleotide
agtgaaggcccactcacaggctcacc

SEQ ID NO: 6639 - DNA, 25 bp, Artificial Sequence
  Description of Artificial Sequence: Synthetic oligonucleotide
gtgaaggcccactcacaggctcacc

SEQ ID NO: 6640 - DNA, 26 bp, Artificial Sequence
  Description of Artificial Sequence: Synthetic oligonucleotide
tgaaggcccactcacaggctcaccga

SEQ ID NO: 6641 - DNA, 25 bp, Artificial Sequence
  Description of Artificial Sequence: Synthetic oligonucleotide
gaaggcccactcacaggctcaccga

SEQ ID NO: 6642 - DNA, 26 bp, Artificial Sequence
  Description of Artificial Sequence: Synthetic oligonucleotide
aaggcccactcacaggctcaccgagt

SEQ ID NO: 6643 - DNA, 25 bp, Artificial Sequence
  Description of Artificial Sequence: Synthetic oligonucleotide
aggcccactcacaggctcaccgagt

SEQ ID NO: 6644 - DNA, 24 bp, Artificial Sequence
  Description of Artificial Sequence: Synthetic oligonucleotide
ggcccactcacaggctcaccgagt

SEQ ID NO: 6645 - DNA, 24 bp, Artificial Sequence
  Description of Artificial Sequence: Synthetic oligonucleotide
gcccactcacaggctcaccgagtg

SEQ ID NO: 6646 - DNA, 25 bp, Artificial Sequence
  Description of Artificial Sequence: Synthetic oligonucleotide
cccactcacaggctcaccgagtgga

SEQ ID NO: 6647 - DNA, 25 bp, Artificial Sequence
  Description of Artificial Sequence: Synthetic oligonucleotide
ccactcacaggctcaccgagtggac

SEQ ID NO: 6648 - DNA, 26 bp, Artificial Sequence
  Description of Artificial Sequence: Synthetic oligonucleotide
cactcacaggctcaccgagtggacct

SEQ ID NO: 6649 - DNA, 26 bp, Artificial Sequence
  Description of Artificial Sequence: Synthetic oligonucleotide
actcacaggctcaccgagtggacctg

SEQ ID NO: 6650 - DNA, 25 bp, Artificial Sequence
  Description of Artificial Sequence: Synthetic oligonucleotide
ctcacaggctcaccgagtggacctg

SEQ ID NO: 6651 - DNA, 25 bp, Artificial Sequence
  Description of Artificial Sequence: Synthetic oligonucleotide
tcacaggctcaccgagtggacctgg

SEQ ID NO: 6652 - DNA, 24 bp, Artificial Sequence
  Description of Artificial Sequence: Synthetic oligonucleotide
cacaggctcaccgagtggacctgg

SEQ ID NO: 6653 - DNA, 24 bp, Artificial Sequence
  Description of Artificial Sequence: Synthetic oligonucleotide
acaggctcaccgagtggacctggg

SEQ ID NO: 6654 - DNA, 23 bp, Artificial Sequence
  Description of Artificial Sequence: Synthetic oligonucleotide
caggctcaccgagtggacctggg

SEQ ID NO: 6655 - DNA, 24 bp, Artificial Sequence
  Description of Artificial Sequence: Synthetic oligonucleotide
aggctcaccgagtggacctgggga

SEQ ID NO: 6656 - DNA, 23 bp, Artificial Sequence
  Description of Artificial Sequence: Synthetic oligonucleotide
ggctcaccgagtggacctgggga

SEQ ID NO: 6657 - DNA, 23 bp, Artificial Sequence
  Description of Artificial Sequence: Synthetic oligonucleotide
gctcaccgagtggacctggggac

SEQ ID NO: 6658 - DNA, 22 bp, Artificial Sequence
  Description of Artificial Sequence: Synthetic oligonucleotide
gcacgtgcgtggagtggctccc

SEQ ID NO: 6659 - DNA, 23 bp, Artificial Sequence
  Description of Artificial Sequence: Synthetic oligonucleotide
cacgtgcgtggagtggctcccca

SEQ ID NO: 6660 - DNA, 26 bp, Artificial Sequence
  Description of Artificial Sequence: Synthetic oligonucleotide
acgtgcgtggagtggctccccagata

SEQ ID NO: 6661 - DNA, 25 bp, Artificial Sequence
  Description of Artificial Sequence: Synthetic oligonucleotide
cgtgcgtggagtggctccccagata

SEQ ID NO: 6662 - DNA, 25 bp, Artificial Sequence
  Description of Artificial Sequence: Synthetic oligonucleotide
gtgcgtggagtggctccccagatac

SEQ ID NO: 6663 - DNA, 26 bp, Artificial Sequence
  Description of Artificial Sequence: Synthetic oligonucleotide
tgcgtggagtggctccccagatacct

SEQ ID NO: 6664 - DNA, 25 bp, Artificial Sequence
  Description of Artificial Sequence: Synthetic oligonucleotide
gcgtggagtggctccccagatacct

SEQ ID NO: 6665 - DNA, 25 bp, Artificial Sequence
  Description of Artificial Sequence: Synthetic oligonucleotide
cgtggagtggctccccagatacctg

SEQ ID NO: 6666 - DNA, 26 bp, Artificial Sequence
  Description of Artificial Sequence: Synthetic oligonucleotide
gtggagtggctccccagatacctgga

SEQ ID NO: 6667 - DNA, 27 bp, Artificial Sequence
  Description of Artificial Sequence: Synthetic oligonucleotide
tggagtggctccccagatacctggaga

SEQ ID NO: 6668 - DNA, 27 bp, Artificial Sequence
  Description of Artificial Sequence: Synthetic oligonucleotide
ggagtggctccccagatacctggagaa

SEQ ID NO: 6669 - DNA, 27 bp, Artificial Sequence
  Description of Artificial Sequence: Synthetic oligonucleotide
gagtggctccccagatacctggagaac

SEQ ID NO: 6670 - DNA, 27 bp, Artificial Sequence
  Description of Artificial Sequence: Synthetic oligonucleotide
agtggctccccagatacctggagaacg

SEQ ID NO: 6671 - DNA, 26 bp, Artificial Sequence
  Description of Artificial Sequence: Synthetic oligonucleotide
gtggctccccagatacctggagaacg

SEQ ID NO: 6672 - DNA, 26 bp, Artificial Sequence
  Description of Artificial Sequence: Synthetic oligonucleotide
tggctccccagatacctggagaacgg

SEQ ID NO: 6673 - DNA, 25 bp, Artificial Sequence
  Description of Artificial Sequence: Synthetic oligonucleotide
ggctccccagatacctggagaacgg

SEQ ID NO: 6674 - DNA, 27 bp, Artificial Sequence
  Description of Artificial Sequence: Synthetic oligonucleotide
gctccccagatacctggagaacgggaa

SEQ ID NO: 6675 - DNA, 27 bp, Artificial Sequence
  Description of Artificial Sequence: Synthetic oligonucleotide
ctccccagatacctggagaacgggaag

SEQ ID NO: 6676 - DNA, 27 bp, Artificial Sequence
  Description of Artificial Sequence: Synthetic oligonucleotide
tccccagatacctggagaacgggaagg

SEQ ID NO: 6677 - DNA, 27 bp, Artificial Sequence
  Description of Artificial Sequence: Synthetic oligonucleotide
ccccagatacctggagaacgggaagga

SEQ ID NO: 6678 - DNA, 27 bp, Artificial Sequence
  Description of Artificial Sequence: Synthetic oligonucleotide
cccagatacctggagaacgggaaggag

SEQ ID NO: 6679 - DNA, 28 bp, Artificial Sequence
  Description of Artificial Sequence: Synthetic oligonucleotide
ccagatacctggagaacgggaaggagac

SEQ ID NO: 6680 - DNA, 31 bp, Artificial Sequence
  Description of Artificial Sequence: Synthetic oligonucleotide
tggtgccttctggacaggagcagagataaac

SEQ ID NO: 6681 - DNA, 30 bp, Artificial Sequence
  Description of Artificial Sequence: Synthetic oligonucleotide
ggtgccttctggacaggagcagagataaac

SEQ ID NO: 6682 - DNA, 30 bp, Artificial Sequence
  Description of Artificial Sequence: Synthetic oligonucleotide
gtgccttctggacaggagcagagataaacc

SEQ ID NO: 6683 - DNA, 31 bp, Artificial Sequence
  Description of Artificial Sequence: Synthetic oligonucleotide
tgccttctggacaggagcagagataaacctg

SEQ ID NO: 6684 - DNA, 30 bp, Artificial Sequence
  Description of Artificial Sequence: Synthetic oligonucleotide
gccttctggacaggagcagagataaacctg

SEQ ID NO: 6685 - DNA, 30 bp, Artificial Sequence
  Description of Artificial Sequence: Synthetic oligonucleotide
ccttctggacaggagcagagataaacctgc

SEQ ID NO: 6686 - DNA, 30 bp, Artificial Sequence
  Description of Artificial Sequence: Synthetic oligonucleotide
cttctggacaggagcagagataaacctgcc

SEQ ID NO: 6687 - DNA, 32 bp, Artificial Sequence
  Description of Artificial Sequence: Synthetic oligonucleotide
ttctggacaggagcagagataaacctgccatg

SEQ ID NO: 6688 - DNA, 31 bp, Artificial Sequence
  Description of Artificial Sequence: Synthetic oligonucleotide
tctggacaggagcagagataaacctgccatg

SEQ ID NO: 6689 - DNA, 30 bp, Artificial Sequence
  Description of Artificial Sequence: Synthetic oligonucleotide
ctggacaggagcagagataaacctgccatg

SEQ ID NO: 6690 - DNA, 31 bp, Artificial Sequence
  Description of Artificial Sequence: Synthetic oligonucleotide
tggacaggagcagagataaacctgccatgtg

SEQ ID NO: 6691 - DNA, 30 bp, Artificial Sequence
  Description of Artificial Sequence: Synthetic oligonucleotide
ggacaggagcagagataaacctgccatgtg

SEQ ID NO: 6692 - DNA, 30 bp, Artificial Sequence
  Description of Artificial Sequence: Synthetic oligonucleotide
gacaggagcagagataaacctgccatgtgc

SEQ ID NO: 6693 - DNA, 31 bp, Artificial Sequence
  Description of Artificial Sequence: Synthetic oligonucleotide
acaggagcagagataaacctgccatgtgcag

SEQ ID NO: 6694 - DNA, 30 bp, Artificial Sequence
  Description of Artificial Sequence: Synthetic oligonucleotide
caggagcagagataaacctgccatgtgcag

SEQ ID NO: 6695 - DNA, 30 bp, Artificial Sequence
  Description of Artificial Sequence: Synthetic oligonucleotide
aggagcagagataaacctgccatgtgcagc

SEQ ID NO: 6696 - DNA, 29 bp, Artificial Sequence
  Description of Artificial Sequence: Synthetic oligonucleotide
ggagcagagataaacctgccatgtgcagc

SEQ ID NO: 6697 - DNA, 31 bp, Artificial Sequence
  Description of Artificial Sequence: Synthetic oligonucleotide
gagcagagataaacctgccatgtgcagcatg

SEQ ID NO: 6698 - DNA, 32 bp, Artificial Sequence
  Description of Artificial Sequence: Synthetic oligonucleotide
agcagagataaacctgccatgtgcagcatgag

SEQ ID NO: 6699 - DNA, 31 bp, Artificial Sequence
  Description of Artificial Sequence: Synthetic oligonucleotide
gcagagataaacctgccatgtgcagcatgag

SEQ ID NO: 6700 - DNA, 31 bp, Artificial Sequence
  Description of Artificial Sequence: Synthetic oligonucleotide
cagagataaacctgccatgtgcagcatgagg

SEQ ID NO: 6701 - DNA, 31 bp, Artificial Sequence
  Description of Artificial Sequence: Synthetic oligonucleotide
agagataaacctgccatgtgcagcatgaggg

SEQ ID NO: 6702 - DNA, 30 bp, Artificial Sequence
  Description of Artificial Sequence: Synthetic oligonucleotide
gagataaacctgccatgtgcagcatgaggg

SEQ ID NO: 6703 - DNA, 33 bp, Artificial Sequence
  Description of Artificial Sequence: Synthetic oligonucleotide
agataaacctgccatgtgcagcatgagggtttg

SEQ ID NO: 6704 - DNA, 32 bp, Artificial Sequence
  Description of Artificial Sequence: Synthetic oligonucleotide
gataaacctgccatgtgcagcatgagggtttg

SEQ ID NO: 6705 - DNA, 32 bp, Artificial Sequence
  Description of Artificial Sequence: Synthetic oligonucleotide
ataaacctgccatgtgcagcatgagggtttgc

SEQ ID NO: 6706 - DNA, 31 bp, Artificial Sequence
  Description of Artificial Sequence: Synthetic oligonucleotide
taaacctgccatgtgcagcatgagggtttgc

SEQ ID NO: 6707 - DNA, 30 bp, Artificial Sequence
  Description of Artificial Sequence: Synthetic oligonucleotide
aaacctgccatgtgcagcatgagggtttgc

SEQ ID NO: 6708 - DNA, 29 bp, Artificial Sequence
  Description of Artificial Sequence: Synthetic oligonucleotide
aacctgccatgtgcagcatgagggtttgc

SEQ ID NO: 6709 - DNA, 26 bp, Artificial Sequence
  Description of Artificial Sequence: Synthetic oligonucleotide
acgacacgcagttcgtgcggttcgac

SEQ ID NO: 6710 - DNA, 25 bp, Artificial Sequence
  Description of Artificial Sequence: Synthetic oligonucleotide
cgacacgcagttcgtgcggttcgac

SEQ ID NO: 6711 - DNA, 25 bp, Artificial Sequence
  Description of Artificial Sequence: Synthetic oligonucleotide
gacacgcagttcgtgcggttcgacg

SEQ ID NO: 6712 - DNA, 25 bp, Artificial Sequence
  Description of Artificial Sequence: Synthetic oligonucleotide
acacgcagttcgtgcggttcgacgg

SEQ ID NO: 6713 - DNA, 24 bp, Artificial Sequence
  Description of Artificial Sequence: Synthetic oligonucleotide
cacgcagttcgtgcggttcgacgg

SEQ ID NO: 6714 - DNA, 24 bp, Artificial Sequence
  Description of Artificial Sequence: Synthetic oligonucleotide
acgcagttcgtgcggttcgacggc

SEQ ID NO: 6715 - DNA, 23 bp, Artificial Sequence
  Description of Artificial Sequence: Synthetic oligonucleotide
cgcagttcgtgcggttcgacggc

SEQ ID NO: 6716 - DNA, 24 bp, Artificial Sequence
  Description of Artificial Sequence: Synthetic oligonucleotide
gcagttcgtgcggttcgacggcga

SEQ ID NO: 6717 - DNA, 24 bp, Artificial Sequence
  Description of Artificial Sequence: Synthetic oligonucleotide
cagttcgtgcggttcgacggcgac

SEQ ID NO: 6718 - DNA, 24 bp, Artificial Sequence
  Description of Artificial Sequence: Synthetic oligonucleotide
agttcgtgcggttcgacggcgacg

SEQ ID NO: 6719 - DNA, 23 bp, Artificial Sequence
  Description of Artificial Sequence: Synthetic oligonucleotide
gttcgtgcggttcgacggcgacg

SEQ ID NO: 6720 - DNA, 23 bp, Artificial Sequence
  Description of Artificial Sequence: Synthetic oligonucleotide
ttcgtgcggttcgacggcgacgc

SEQ ID NO: 6721 - DNA, 22 bp, Artificial Sequence
  Description of Artificial Sequence: Synthetic oligonucleotide
tcgtgcggttcgacggcgacgc

SEQ ID NO: 6722 - DNA, 21 bp, Artificial Sequence
  Description of Artificial Sequence: Synthetic oligonucleotide
cgtgcggttcgacggcgacgc

SEQ ID NO: 6723 - DNA, 21 bp, Artificial Sequence
  Description of Artificial Sequence: Synthetic oligonucleotide
gtgcggttcgacggcgacgcc

SEQ ID NO: 6724 - DNA, 21 bp, Artificial Sequence
  Description of Artificial Sequence: Synthetic oligonucleotide
tgcggttcgacggcgacgccg

SEQ ID NO: 6725 - DNA, 20 bp, Artificial Sequence
  Description of Artificial Sequence: Synthetic oligonucleotide
gcggttcgacggcgacgccg

SEQ ID NO: 6726 - DNA, 20 bp, Artificial Sequence
  Description of Artificial Sequence: Synthetic oligonucleotide
cggttcgacggcgacgccgc

SEQ ID NO: 6727 - DNA, 21 bp, Artificial Sequence
  Description of Artificial Sequence: Synthetic oligonucleotide
ggttcgacggcgacgccgcga

SEQ ID NO: 6728 - DNA, 21 bp, Artificial Sequence
  Description of Artificial Sequence: Synthetic oligonucleotide
gttcgacggcgacgccgcgag

SEQ ID NO: 6729 - DNA, 21 bp, Artificial Sequence
  Description of Artificial Sequence: Synthetic oligonucleotide
ttcgacggcgacgccgcgagc

SEQ ID NO: 6730 - DNA, 20 bp, Artificial Sequence
  Description of Artificial Sequence: Synthetic oligonucleotide
tcgacggcgacgccgcgagc

SEQ ID NO: 6731 - DNA, 20 bp, Artificial Sequence
  Description of Artificial Sequence: Synthetic oligonucleotide
cgacggcgacgccgcgagct

SEQ ID NO: 6732 - DNA, 20 bp, Artificial Sequence
  Description of Artificial Sequence: Synthetic oligonucleotide
gacggcgacgccgcgagcca

SEQ ID NO: 6733 - DNA, 21 bp, Artificial Sequence
  Description of Artificial Sequence: Synthetic oligonucleotide
acggcgacgccgcgagccaga

SEQ ID NO: 6734 - DNA, 20 bp, Artificial Sequence
  Description of Artificial Sequence: Synthetic oligonucleotide
cggcgacgccgcgagccaga

SEQ ID NO: 6735 - DNA, 20 bp, Artificial Sequence
  Description of Artificial Sequence: Synthetic oligonucleotide
ggcgacgccgcgagccagag

SEQ ID NO: 6736 - DNA, 21 bp, Artificial Sequence
  Description of Artificial Sequence: Synthetic oligonucleotide
agcgacgccgcgagccagagg

SEQ ID NO: 6737 - DNA, 20 bp, Artificial Sequence
  Description of Artificial Sequence: Synthetic oligonucleotide
gcgacgccgcgagccagagg

SEQ ID NO: 6738 - DNA, 21 bp, Artificial Sequence
  Description of Artificial Sequence: Synthetic oligonucleotide
cgacgccgcgagccagagggt

SEQ ID NO: 6739 - DNA, 21 bp, Artificial Sequence
  Description of Artificial Sequence: Synthetic oligonucleotide
gacgccgcgagccagagggtg

SEQ ID NO: 6740 - DNA, 22 bp, Artificial Sequence
  Description of Artificial Sequence: Synthetic oligonucleotide
acgccgcgagccagagggtgga

SEQ ID NO: 6741 - DNA, 21 bp, Artificial Sequence
  Description of Artificial Sequence: Synthetic oligonucleotide
cgccgcgagccagagggtgga

SEQ ID NO: 6742 - DNA, 21 bp, Artificial Sequence
  Description of Artificial Sequence: Synthetic oligonucleotide
gccgcgagccagagggtggag

SEQ ID NO: 6743 - DNA, 21 bp, Artificial Sequence
  Description of Artificial Sequence: Synthetic oligonucleotide
ccgcgagccagagggtggagc

SEQ ID NO: 6744 - DNA, 21 bp, Artificial Sequence
  Description of Artificial Sequence: Synthetic oligonucleotide
cgcgagccagagggtggagcc

SEQ ID NO: 6745 - DNA, 21 bp, Artificial Sequence
  Description of Artificial Sequence: Synthetic oligonucleotide
gcgagccagagggtggagccg

SEQ ID NO: 6746 - DNA, 21 bp, Artificial Sequence
  Description of Artificial Sequence: Synthetic oligonucleotide
cgagccagagggtggagccgc

SEQ ID NO: 6747 - DNA, 21 bp, Artificial Sequence
  Description of Artificial Sequence: Synthetic oligonucleotide
gagccagagggtggagccgcg

SEQ ID NO: 6748 - DNA, 21 bp, Artificial Sequence
  Description of Artificial Sequence: Synthetic oligonucleotide
agccagagggtggagccgcgg

SEQ ID NO: 6749 - DNA, 20 bp, Artificial Sequence
  Description of Artificial Sequence: Synthetic oligonucleotide
gccagagggtggagccgcgg

SEQ ID NO: 6750 - DNA, 20 bp, Artificial Sequence
  Description of Artificial Sequence: Synthetic oligonucleotide
ccagagggtggagccgcggg

SEQ ID NO: 6751 - DNA, 20 bp, Artificial Sequence
  Description of Artificial Sequence: Synthetic oligonucleotide
cagagggtggagccgcgggc

SEQ ID NO: 6752 - DNA, 20 bp, Artificial Sequence
  Description of Artificial Sequence: Synthetic oligonucleotide
agagggtggagccgcgggcg

SEQ ID NO: 6753 - DNA, 20 bp, Artificial Sequence
  Description of Artificial Sequence: Synthetic oligonucleotide
gagggtggagccgcgggcgt

SEQ ID NO: 6754 - DNA, 20 bp, Artificial Sequence
  Description of Artificial Sequence: Synthetic oligonucleotide
agggtggagccgcgggcgct

SEQ ID NO: 6755 - DNA, 20 bp, Artificial Sequence
  Description of Artificial Sequence: Synthetic oligonucleotide
gggtggagccgcgggcgctt

SEQ ID NO: 6756 - DNA, 20 bp, Artificial Sequence
  Description of Artificial Sequence: Synthetic oligonucleotide
ggtggagccgcgggcgcctt

SEQ ID NO: 6757 - DNA, 20 bp, Artificial Sequence
  Description of Artificial Sequence: Synthetic oligonucleotide
gtggagccgcgggcgccgtt

SEQ ID NO: 6758 - DNA, 27 bp, Artificial Sequence
  Description of Artificial Sequence: Synthetic oligonucleotide
agaggatgtatggctgcgacgtgggga

SEQ ID NO: 6759 - DNA, 26 bp, Artificial Sequence
  Description of Artificial Sequence: Synthetic oligonucleotide
gaggatgtatggctgcgacgtgggga

SEQ ID NO: 6760 - DNA, 26 bp, Artificial Sequence
  Description of Artificial Sequence: Synthetic oligonucleotide
aggatgtatggctgcgacgtggggac

SEQ ID NO: 6761 - DNA, 25 bp, Artificial Sequence
  Description of Artificial Sequence: Synthetic oligonucleotide
ggatgtatggctgcgacgtggggac

SEQ ID NO: 6762 - DNA, 25 bp, Artificial Sequence
  Description of Artificial Sequence: Synthetic oligonucleotide
gatgtatggctgcgacgtggggacg

SEQ ID NO: 6763 - DNA, 26 bp, Artificial Sequence
  Description of Artificial Sequence: Synthetic oligonucleotide
atgtatggctgcgacgtggggacgga

SEQ ID NO: 6764 - DNA, 25 bp, Artificial Sequence
  Description of Artificial Sequence: Synthetic oligonucleotide
tgtatggctgcgacgtggggacgga

SEQ ID NO: 6765 - DNA, 24 bp, Artificial Sequence
  Description of Artificial Sequence: Synthetic oligonucleotide
gtatggctgcgacgtggggacgga

SEQ ID NO: 6766 - DNA, 25 bp, Artificial Sequence
  Description of Artificial Sequence: Synthetic oligonucleotide
tatggctgcgacgtggggacggact

SEQ ID NO: 6767 - DNA, 24 bp, Artificial Sequence
  Description of Artificial Sequence: Synthetic oligonucleotide
atggctgcgacgtggggacggact

SEQ ID NO: 6768 - DNA, 23 bp, Artificial Sequence
  Description of Artificial Sequence: Synthetic oligonucleotide
tggctgcgacgtggggacggact

SEQ ID NO: 6769 - DNA, 22 bp, Artificial Sequence
  Description of Artificial Sequence: Synthetic oligonucleotide
ggctgcgacgtggggacggact

SEQ ID NO: 6770 - DNA, 22 bp, Artificial Sequence
  Description of Artificial Sequence: Synthetic oligonucleotide
gctgcgacgtggggacggactg

SEQ ID NO: 6771 - DNA, 22 bp, Artificial Sequence
  Description of Artificial Sequence: Synthetic oligonucleotide
ctgcgacgtggggacggactgg

SEQ ID NO: 6772 - DNA, 22 bp, Artificial Sequence
  Description of Artificial Sequence: Synthetic oligonucleotide
tgcgacgtggggacggactggc

SEQ ID NO: 6773 - DNA, 21 bp, Artificial Sequence
  Description of Artificial Sequence: Synthetic oligonucleotide
gcgacgtggggacggactggc

SEQ ID NO: 6774 - DNA, 21 bp, Artificial Sequence
  Description of Artificial Sequence: Synthetic oligonucleotide
cgacgtggggacggactggcg

SEQ ID NO: 6775 - DNA, 23 bp, Artificial Sequence
  Description of Artificial Sequence: Synthetic oligonucleotide
gacgtggggacggactggcgctt

SEQ ID NO: 6776 - DNA, 23 bp, Artificial Sequence
  Description of Artificial Sequence: Synthetic oligonucleotide
acgtggggacggactggcgcttc

SEQ ID NO: 6777 - DNA, 22 bp, Artificial Sequence
  Description of Artificial Sequence: Synthetic oligonucleotide
cgtggggacggactggcgcttc

SEQ ID NO: 6778 - DNA, 23 bp, Artificial Sequence
  Description of Artificial Sequence: Synthetic oligonucleotide
gtggggacggactggcgcttcct

SEQ ID NO: 6779 - DNA, 23 bp, Artificial Sequence
  Description of Artificial Sequence: Synthetic oligonucleotide
tggggacggactggcgcttcctc

SEQ ID NO: 6780 - DNA, 22 bp, Artificial Sequence
  Description of Artificial Sequence: Synthetic oligonucleotide
ggggacggactggcgcttcctc

SEQ ID NO: 6781 - DNA, 22 bp, Artificial Sequence
  Description of Artificial Sequence: Synthetic oligonucleotide
gggacggactggcgcttcctcc

SEQ ID NO: 6782 - DNA, 22 bp, Artificial Sequence
  Description of Artificial Sequence: Synthetic oligonucleotide
ggacggactggcgcttcctccg

SEQ ID NO: 6783 - DNA, 22 bp, Artificial Sequence
  Description of Artificial Sequence: Synthetic oligonucleotide
gacggactggcgcttcctccgc

SEQ ID NO: 6784 - DNA, 22 bp, Artificial Sequence
  Description of Artificial Sequence: Synthetic oligonucleotide
acggactggcgcttcctccgcg

SEQ ID NO: 6785 - DNA, 25 bp, Artificial Sequence
  Description of Artificial Sequence: Synthetic oligonucleotide
cacaagtgggaggcggcccatgtga

SEQ ID NO: 6786 - DNA, 25 bp, Artificial Sequence
  Description of Artificial Sequence: Synthetic oligonucleotide
acaagtgggaggcggcccatgtgac

SEQ ID NO: 6787 - DNA, 24 bp, Artificial Sequence
  Description of Artificial Sequence: Synthetic oligonucleotide
caagtgggaggcggcccatgtgac

SEQ ID NO: 6788 - DNA, 24 bp, Artificial Sequence
  Description of Artificial Sequence: Synthetic oligonucleotide
aagtgggaggcggcccatgtgacg

SEQ ID NO: 6789 - DNA, 23 bp, Artificial Sequence
  Description of Artificial Sequence: Synthetic oligonucleotide
agtgggaggcggcccatgtgacg

SEQ ID NO: 6790 - DNA, 22 bp, Artificial Sequence
  Description of Artificial Sequence: Synthetic oligonucleotide
gtgggaggcggcccatgtgacg

SEQ ID NO: 6791 - DNA, 23 bp, Artificial Sequence
  Description of Artificial Sequence: Synthetic oligonucleotide
tgggaggcggcccatgtgacgga

SEQ ID NO: 6792 - DNA, 22 bp, Artificial Sequence
  Description of Artificial Sequence: Synthetic oligonucleotide
gggaggcggcccatgtgacgga

SEQ ID NO: 6793 - DNA, 22 bp, Artificial Sequence
  Description of Artificial Sequence: Synthetic oligonucleotide
ggaggcggcccatgtgacggag

SEQ ID NO: 6794 - DNA, 23 bp, Artificial Sequence
  Description of Artificial Sequence: Synthetic oligonucleotide
gaggcggcccatgtgacggagca

SEQ ID NO: 6795 - DNA, 25 bp, Artificial Sequence
  Description of Artificial Sequence: Synthetic oligonucleotide
aggcggcccatgtgacggagcagtt

SEQ ID NO: 6796 - DNA, 24 bp, Artificial Sequence
  Description of Artificial Sequence: Synthetic oligonucleotide
ggcggcccatgtgacggagcagtt

SEQ ID NO: 6797 - DNA, 25 bp, Artificial Sequence
  Description of Artificial Sequence: Synthetic oligonucleotide
gcggcccatgtgacggagcagttga

SEQ ID NO: 6798 - DNA, 26 bp, Artificial Sequence
  Description of Artificial Sequence: Synthetic oligonucleotide
cggcccatgtgacggagcagttgaga

SEQ ID NO: 6799 - DNA, 26 bp, Artificial Sequence
  Description of Artificial Sequence: Synthetic oligonucleotide
ggcccatgtgacggagcagttgagag

SEQ ID NO: 6800 - DNA, 26 bp, Artificial Sequence
  Description of Artificial Sequence: Synthetic oligonucleotide
gcccatgtgacggagcagttgagagc

SEQ ID NO: 6801 - DNA, 27 bp, Artificial Sequence
  Description of Artificial Sequence: Synthetic oligonucleotide
cccatgtgacggagcagttgagagcct

SEQ ID NO: 6802 - DNA, 28 bp, Artificial Sequence
  Description of Artificial Sequence: Synthetic oligonucleotide
ccatgtgacggagcagttgagagcctac

SEQ ID NO: 6803 - DNA, 28 bp, Artificial Sequence
  Description of Artificial Sequence: Synthetic oligonucleotide
catgtgacggagcagttgagagcctacc

SEQ ID NO: 6804 - DNA, 29 bp, Artificial Sequence
  Description of Artificial Sequence: Synthetic oligonucleotide
atgtgacggagcagttgagagcctacctg

SEQ ID NO: 6805 - DNA, 28 bp, Artificial Sequence
  Description of Artificial Sequence: Synthetic oligonucleotide
tgtgacggagcagttgagagcctacctg

SEQ ID NO: 6806 - DNA, 27 bp, Artificial Sequence
  Description of Artificial Sequence: Synthetic oligonucleotide
gtgacggagcagttgagagcctacctg

SEQ ID NO: 6807 - DNA, 27 bp, Artificial Sequence
  Description of Artificial Sequence: Synthetic oligonucleotide
tgacggagcagttgagagcctacctgg

SEQ ID NO: 6808 - DNA, 27 bp, Artificial Sequence
  Description of Artificial Sequence: Synthetic oligonucleotide
gacggagcagttgagagcctacctgga

SEQ ID NO: 6809 - DNA, 27 bp, Artificial Sequence
  Description of Artificial Sequence: Synthetic oligonucleotide
acggagcagttgagagcctacctggag

SEQ ID NO: 6810 - DNA, 23 bp, Artificial Sequence
  Description of Artificial Sequence: Synthetic oligonucleotide
cgcggcggacttggcagctcaga

SEQ ID NO: 6811 - DNA, 23 bp, Artificial Sequence
  Description of Artificial Sequence: Synthetic oligonucleotide
gcggcggacttggcagctcagac

SEQ ID NO: 6812 - DNA, 24 bp, Artificial Sequence
  Description of Artificial Sequence: Synthetic oligonucleotide
cggcggacttggcagctcagacca

SEQ ID NO: 6813 - DNA, 24 bp, Artificial Sequence
  Description of Artificial Sequence: Synthetic oligonucleotide
ggcggacttggcagctcagaccac

SEQ ID NO: 6814 - DNA, 26 bp, Artificial Sequence
  Description of Artificial Sequence: Synthetic oligonucleotide
gcggacttggcagctcagaccaccaa

SEQ ID NO: 6815 - DNA, 26 bp, Artificial Sequence
  Description of Artificial Sequence: Synthetic oligonucleotide
cggacttggcagctcagaccaccaag

SEQ ID NO: 6816 - DNA, 27 bp, Artificial Sequence
  Description of Artificial Sequence: Synthetic oligonucleotide
ggacttggcagctcagaccaccaagca

SEQ ID NO: 6817 - DNA, 27 bp, Artificial Sequence
  Description of Artificial Sequence: Synthetic oligonucleotide
gacttggcagctcagaccaccaagcac

SEQ ID NO: 6818 - DNA, 29 bp, Artificial Sequence
  Description of Artificial Sequence: Synthetic oligonucleotide
acttggcagctcagaccaccaagcacaag

SEQ ID NO: 6819 - DNA, 28 bp, Artificial Sequence
  Description of Artificial Sequence: Synthetic oligonucleotide
cttggcagctcagaccaccaagcacaag

SEQ ID NO: 6820 - DNA, 29 bp, Artificial Sequence
  Description of Artificial Sequence: Synthetic oligonucleotide
ttggcagctcagaccaccaagcacaagtg

SEQ ID NO: 6821 - DNA, 21 bp, Artificial Sequence
  Description of Artificial Sequence: Synthetic oligonucleotide
tgcgctcttggaccgcggcgg

SEQ ID NO: 6822 - DNA, 20 bp, Artificial Sequence
  Description of Artificial Sequence: Synthetic oligonucleotide
gcgctcttggaccgcggcgg

SEQ ID NO: 6823 - DNA, 20 bp, Artificial Sequence
  Description of Artificial Sequence: Synthetic oligonucleotide
cgctcttggaccgcggcggc

SEQ ID NO: 6824 - DNA, 22 bp, Artificial Sequence
  Description of Artificial Sequence: Synthetic oligonucleotide
gctcttggaccgcggcggccat

SEQ ID NO: 6825 - DNA, 22 bp, Artificial Sequence
  Description of Artificial Sequence: Synthetic oligonucleotide
ctcttggaccgcggcggccatg

SEQ ID NO: 6826 - DNA, 22 bp, Artificial Sequence
  Description of Artificial Sequence: Synthetic oligonucleotide
tcttggaccgcggcggccatgg

SEQ ID NO: 6827 - DNA, 21 bp, Artificial Sequence
  Description of Artificial Sequence: Synthetic oligonucleotide
cttggaccgcggcggccatgg

SEQ ID NO: 6828 - DNA, 22 bp, Artificial Sequence
  Description of Artificial Sequence: Synthetic oligonucleotide
ttggaccgcggcggccatggca

SEQ ID NO: 6829 - DNA, 21 bp, Artificial Sequence
  Description of Artificial Sequence: Synthetic oligonucleotide
tggaccgcggcggccatggca

SEQ ID NO: 6830 - DNA, 20 bp, Artificial Sequence
  Description of Artificial Sequence: Synthetic oligonucleotide
ggaccgcggcggccatggca

SEQ ID NO: 6831 - DNA, 20 bp, Artificial Sequence
  Description of Artificial Sequence: Synthetic oligonucleotide
gaccgcggcggccatggcag

SEQ ID NO: 6832 - DNA, 21 bp, Artificial Sequence
  Description of Artificial Sequence: Synthetic oligonucleotide
accgcggcggccatggcagct

SEQ ID NO: 6833 - DNA, 20 bp, Artificial Sequence
  Description of Artificial Sequence: Synthetic oligonucleotide
ccgcggcggccatggcagct

SEQ ID NO: 6834 - DNA, 21 bp, Artificial Sequence
  Description of Artificial Sequence: Synthetic oligonucleotide
cgcggcggccatggcagctca

SEQ ID NO: 6835 - DNA, 22 bp, Artificial Sequence
  Description of Artificial Sequence: Synthetic oligonucleotide
gcggcggccatggcagctcaga

SEQ ID NO: 6836 - DNA, 22 bp, Artificial Sequence
  Description of Artificial Sequence: Synthetic oligonucleotide
cggcggccatggcagctcagac

SEQ ID NO: 6837 - DNA, 23 bp, Artificial Sequence
  Description of Artificial Sequence: Synthetic oligonucleotide
ggcggccatggcagctcagacca

SEQ ID NO: 6838 - DNA, 23 bp, Artificial Sequence
  Description of Artificial Sequence: Synthetic oligonucleotide
gcggccatggcagctcagaccac

SEQ ID NO: 6839 - DNA, 25 bp, Artificial Sequence
  Description of Artificial Sequence: Synthetic oligonucleotide
cggccatggcagctcagaccaccaa

SEQ ID NO: 6840 - DNA, 25 bp, Artificial Sequence
  Description of Artificial Sequence: Synthetic oligonucleotide
ggccatggcagctcagaccaccaag

SEQ ID NO: 6841 - DNA, 26 bp, Artificial Sequence
  Description of Artificial Sequence: Synthetic oligonucleotide
gccatggcagctcagaccaccaagca

SEQ ID NO: 6842 - DNA, 27 bp, Artificial Sequence
  Description of Artificial Sequence: Synthetic oligonucleotide
ccatggcagctcagaccaccaagcaca

SEQ ID NO: 6843 - DNA, 23 bp, Artificial Sequence
  Description of Artificial Sequence: Synthetic oligonucleotide
ggcacgtgcgtggagtggctcca

SEQ ID NO: 6844 - DNA, 24 bp, Artificial Sequence
  Description of Artificial Sequence: Synthetic oligonucleotide
gcacgtgcgtggagtggctccaca

SEQ ID NO: 6845 - DNA, 27 bp, Artificial Sequence
  Description of Artificial Sequence: Synthetic oligonucleotide
cacgtgcgtggagtggctccacagata

SEQ ID NO: 6846 - DNA, 27 bp, Artificial Sequence
  Description of Artificial Sequence: Synthetic oligonucleotide
acgtgcgtggagtggctccacagatac

SEQ ID NO: 6847 - DNA, 26 bp, Artificial Sequence
  Description of Artificial Sequence: Synthetic oligonucleotide
cgtgcgtggagtggctccacagatac

SEQ ID NO: 6848 - DNA, 27 bp, Artificial Sequence
  Description of Artificial Sequence: Synthetic oligonucleotide
gtgcgtggagtggctccacagatacct

SEQ ID NO: 6849 - DNA, 27 bp, Artificial Sequence
  Description of Artificial Sequence: Synthetic oligonucleotide
tgcgtggagtggctccacagatacctg

SEQ ID NO: 6850 - DNA, 26 bp, Artificial Sequence
  Description of Artificial Sequence: Synthetic oligonucleotide
gcgtggagtggctccacagatacctg

SEQ ID NO: 6851 - DNA, 27 bp, Artificial Sequence
  Description of Artificial Sequence: Synthetic oligonucleotide
cgtggagtggctccacagatacctgga

SEQ ID NO: 6852 - DNA, 27 bp, Artificial Sequence
  Description of Artificial Sequence: Synthetic oligonucleotide
gtggagtggctccacagatacctggag

SEQ ID NO: 6853 - DNA, 29 bp, Artificial Sequence
  Description of Artificial Sequence: Synthetic oligonucleotide
tggagtggctccacagatacctggagaac

SEQ ID NO: 6854 - DNA, 28 bp, Artificial Sequence
  Description of Artificial Sequence: Synthetic oligonucleotide
ggagtggctccacagatacctggagaac

SEQ ID NO: 6855 - DNA, 28 bp, Artificial Sequence
  Description of Artificial Sequence: Synthetic oligonucleotide
gagtggctccacagatacctggagaacg

SEQ ID NO: 6856 - DNA, 28 bp, Artificial Sequence
  Description of Artificial Sequence: Synthetic oligonucleotide
agtggctccacagatacctggagaacgg

SEQ ID NO: 6857 - DNA, 27 bp, Artificial Sequence
  Description of Artificial Sequence: Synthetic oligonucleotide
gtggctccacagatacctggagaacgg

SEQ ID NO: 6858 - DNA, 27 bp, Artificial Sequence
  Description of Artificial Sequence: Synthetic oligonucleotide
tggctccacagatacctggagaacggg

SEQ ID NO: 6859 - DNA, 27 bp, Artificial Sequence
  Description of Artificial Sequence: Synthetic oligonucleotide
ggctccacagatacctggagaacggga

SEQ ID NO: 6860 - DNA, 28 bp, Artificial Sequence
  Description of Artificial Sequence: Synthetic oligonucleotide
gctccacagatacctggagaacgggaag

SEQ ID NO: 6861 - DNA, 28 bp, Artificial Sequence
  Description of Artificial Sequence: Synthetic oligonucleotide
ctccacagatacctggagaacgggaagg

SEQ ID NO: 6862 - DNA, 29 bp, Artificial Sequence
  Description of Artificial Sequence: Synthetic oligonucleotide
tccacagatacctggagaacgggaaggag

SEQ ID NO: 6863 - DNA, 28 bp, Artificial Sequence
  Description of Artificial Sequence: Synthetic oligonucleotide
ccacagatacctggagaacgggaaggag

SEQ ID NO: 6864 - DNA, 29 bp, Artificial Sequence
  Description of Artificial Sequence: Synthetic oligonucleotide
cacagatacctggagaacgggaaggagac

SEQ ID NO: 6865 - DNA, 29 bp, Artificial Sequence
  Description of Artificial Sequence: Synthetic oligonucleotide
acagatacctggagaacgggaaggagacg

SEQ ID NO: 6866 - DNA, 28 bp, Artificial Sequence
  Description of Artificial Sequence: Synthetic oligonucleotide
cctgaaagaggacctgcgctcttggatc

SEQ ID NO: 6867 - DNA, 28 bp, Artificial Sequence
  Description of Artificial Sequence: Synthetic oligonucleotide
ctgaaagaggacctgcgctcttggatcg

SEQ ID NO: 6868 - DNA, 28 bp, Artificial Sequence
  Description of Artificial Sequence: Synthetic oligonucleotide
tgaaagaggacctgcgctcttggatcgc

SEQ ID NO: 6869 - DNA, 27 bp, Artificial Sequence
  Description of Artificial Sequence: Synthetic oligonucleotide
gaaagaggacctgcgctcttggatcgc

SEQ ID NO: 6870 - DNA, 27 bp, Artificial Sequence
  Description of Artificial Sequence: Synthetic oligonucleotide
aaagaggacctgcgctcttggatcgcg

SEQ ID NO: 6871 - DNA, 26 bp, Artificial Sequence
  Description of Artificial Sequence: Synthetic oligonucleotide
aagaggacctgcgctcttggatcgcg

SEQ ID NO: 6872 - DNA, 25 bp, Artificial Sequence
  Description of Artificial Sequence: Synthetic oligonucleotide
agaggacctgcgctcttggatcgcg

SEQ ID NO: 6873 - DNA, 24 bp, Artificial Sequence
  Description of Artificial Sequence: Synthetic oligonucleotide
gaggacctgcgctcttggatcgcg

SEQ ID NO: 6874 - DNA, 24 bp, Artificial Sequence
  Description of Artificial Sequence: Synthetic oligonucleotide
aggacctgcgctcttggatcgcgg

SEQ ID NO: 6875 - DNA, 23 bp, Artificial Sequence
  Description of Artificial Sequence: Synthetic oligonucleotide
ggacctgcgctcttggatcgcgg

SEQ ID NO: 6876 - DNA, 23 bp, Artificial Sequence
  Description of Artificial Sequence: Synthetic oligonucleotide
gacctgcgctcttggatcgcggc

SEQ ID NO: 6877 - DNA, 23 bp, Artificial Sequence
  Description of Artificial Sequence: Synthetic oligonucleotide
acctgcgctcttggatcgcggcg

SEQ ID NO: 6878 - DNA, 22 bp, Artificial Sequence
  Description of Artificial Sequence: Synthetic oligonucleotide
cctgcgctcttggatcgcggcg

SEQ ID NO: 6879 - DNA, 23 bp, Artificial Sequence
  Description of Artificial Sequence: Synthetic oligonucleotide
ctgcgctcttggatcgcggcgga

SEQ ID NO: 6880 - DNA, 25 bp, Artificial Sequence
  Description of Artificial Sequence: Synthetic oligonucleotide
tgcgctcttggatcgcggcggacat

SEQ ID NO: 6881 - DNA, 24 bp, Artificial Sequence
  Description of Artificial Sequence: Synthetic oligonucleotide
gcgctcttggatcgcggcggacat

SEQ ID NO: 6882 - DNA, 24 bp, Artificial Sequence
  Description of Artificial Sequence: Synthetic oligonucleotide
cgctcttggatcgcggcggacatg

SEQ ID NO: 6883 - DNA, 24 bp, Artificial Sequence
  Description of Artificial Sequence: Synthetic oligonucleotide
gctcttggatcgcggcggacatgg

SEQ ID NO: 6884 - DNA, 25 bp, Artificial Sequence
  Description of Artificial Sequence: Synthetic oligonucleotide
ctcttggatcgcggcggacatggca

SEQ ID NO: 6885 - DNA, 25 bp, Artificial Sequence
  Description of Artificial Sequence: Synthetic oligonucleotide
tcttggatcgcggcggacatggcag

SEQ ID NO: 6886 - DNA, 24 bp, Artificial Sequence
  Description of Artificial Sequence: Synthetic oligonucleotide
cttggatcgcggcggacatggcag

SEQ ID NO: 6887 - DNA, 25 bp, Artificial Sequence
  Description of Artificial Sequence: Synthetic oligonucleotide
ttggatcgcggcggacatggcagct

SEQ ID NO: 6888 - DNA, 24 bp, Artificial Sequence
  Description of Artificial Sequence: Synthetic oligonucleotide
tggatcgcggcggacatggcagct

SEQ ID NO: 6889 - DNA, 23 bp, Artificial Sequence
  Description of Artificial Sequence: Synthetic oligonucleotide
ggatcgcggcggacatggcagct

SEQ ID NO: 6890 - DNA, 24 bp, Artificial Sequence
  Description of Artificial Sequence: Synthetic oligonucleotide
gatcgcggcggacatggcagctca

SEQ ID NO: 6891 - DNA, 25 bp, Artificial Sequence
  Description of Artificial Sequence: Synthetic oligonucleotide
atcgcggcggacatggcagctcaga

SEQ ID NO: 6892 - DNA, 24 bp, Artificial Sequence
  Description of Artificial Sequence: Synthetic oligonucleotide
tcgcggcggacatggcagctcaga

SEQ ID NO: 6893 - DNA, 27 bp, Artificial Sequence
  Description of Artificial Sequence: Synthetic oligonucleotide
tggagaacgggaaggagacgctgcagt

SEQ ID NO: 6894 - DNA, 26 bp, Artificial Sequence
  Description of Artificial Sequence: Synthetic oligonucleotide
ggagaacgggaaggagacgctgcagt

SEQ ID NO: 6895 - DNA, 26 bp, Artificial Sequence
  Description of Artificial Sequence: Synthetic oligonucleotide
gagaacgggaaggagacgctgcagtg

SEQ ID NO: 6896 - DNA, 27 bp, Artificial Sequence
  Description of Artificial Sequence: Synthetic oligonucleotide
agaacgggaaggagacgctgcagtgca

SEQ ID NO: 6897 - DNA, 26 bp, Artificial Sequence
  Description of Artificial Sequence: Synthetic oligonucleotide
gaacgggaaggagacgctgcagtgca

SEQ ID NO: 6898 - DNA, 26 bp, Artificial Sequence
  Description of Artificial Sequence: Synthetic oligonucleotide
aacgggaaggagacgctgcagtgcac

SEQ ID NO: 6899 - DNA, 25 bp, Artificial Sequence
  Description of Artificial Sequence: Synthetic oligonucleotide
acgggaaggagacgctgcagtgcac

SEQ ID NO: 6900 - DNA, 24 bp, Artificial Sequence
  Description of Artificial Sequence: Synthetic oligonucleotide
cgggaaggagacgctgcagtgcac

SEQ ID NO: 6901 - DNA, 24 bp, Artificial Sequence
  Description of Artificial Sequence: Synthetic oligonucleotide
gggaaggagacgctgcagtgcacg

SEQ ID NO: 6902 - DNA, 25 bp, Artificial Sequence
  Description of Artificial Sequence: Synthetic oligonucleotide
ggaaggagacgctgcagtgcacgga

SEQ ID NO: 6903 - DNA, 25 bp, Artificial Sequence
  Description of Artificial Sequence: Synthetic oligonucleotide
gaaggagacgctgcagtgcacggac

SEQ ID NO: 6904 - DNA, 25 bp, Artificial Sequence
  Description of Artificial Sequence: Synthetic oligonucleotide
aaggagacgctgcagtgcacggacg

SEQ ID NO: 6905 - DNA, 24 bp, Artificial Sequence
  Description of Artificial Sequence: Synthetic oligonucleotide
aggagacgctgcagtgcacggacg

SEQ ID NO: 6906 - DNA, 23 bp, Artificial Sequence
  Description of Artificial Sequence: Synthetic oligonucleotide
ggagacgctgcagtgcacggacg

SEQ ID NO: 6907 - DNA, 23 bp, Artificial Sequence
  Description of Artificial Sequence: Synthetic oligonucleotide
gagacgctgcagtgcacggacgc

SEQ ID NO: 6908 - DNA, 23 bp, Artificial Sequence
  Description of Artificial Sequence: Synthetic oligonucleotide
agacgctgcagtgcacggacgcc

SEQ ID NO: 6909 - DNA, 22 bp, Artificial Sequence
  Description of Artificial Sequence: Synthetic oligonucleotide
gacgctgcagtgcacggacgcc

SEQ ID NO: 6910 - DNA, 22 bp, Artificial Sequence
  Description of Artificial Sequence: Synthetic oligonucleotide
acgctgcagtgcacggacgccc

SEQ ID NO: 6911 - DNA, 21 bp, Artificial Sequence
  Description of Artificial Sequence: Synthetic oligonucleotide
cgctgcagtgcacggacgccc

SEQ ID NO: 6912 - DNA, 21 bp, Artificial Sequence
  Description of Artificial Sequence: Synthetic oligonucleotide
gctgcagtgcacggacgcccc

SEQ ID NO: 6913 - DNA, 25 bp, Artificial Sequence
  Description of Artificial Sequence: Synthetic oligonucleotide
ctgcagtgcacggacgcccccaaaa

SEQ ID NO: 6914 - DNA, 25 bp, Artificial Sequence
  Description of Artificial Sequence: Synthetic oligonucleotide
tgcagtgcacggacgcccccaaaac

SEQ ID NO: 6915 - DNA, 24 bp, Artificial Sequence
  Description of Artificial Sequence: Synthetic oligonucleotide
gcagtgcacggacgcccccaaaac

SEQ ID NO: 6916 - DNA, 24 bp, Artificial Sequence
  Description of Artificial Sequence: Synthetic oligonucleotide
cagtgcacggacgcccccaaaacg

SEQ ID NO: 6917 - DNA, 27 bp, Artificial Sequence
  Description of Artificial Sequence: Synthetic oligonucleotide
agtgcacggacgcccccaaaacgcata

SEQ ID NO: 6918 - DNA, 27 bp, Artificial Sequence
  Description of Artificial Sequence: Synthetic oligonucleotide
gtgcacggacgcccccaaaacgcatat

SEQ ID NO: 6919 - DNA, 27 bp, Artificial Sequence
  Description of Artificial Sequence: Synthetic oligonucleotide
tgcacggacgcccccaaaacgcatatg

SEQ ID NO: 6920 - DNA, 23 bp, Artificial Sequence
  Description of Artificial Sequence: Synthetic oligonucleotide
agacggcccatgaggcggagcag

SEQ ID NO: 6921 - DNA, 22 bp, Artificial Sequence
  Description of Artificial Sequence: Synthetic oligonucleotide
gacggcccatgaggcggagcag

SEQ ID NO: 6922 - DNA, 23 bp, Artificial Sequence
  Description of Artificial Sequence: Synthetic oligonucleotide
acggcccatgaggcggagcagct

SEQ ID NO: 6923 - DNA, 22 bp, Artificial Sequence
  Description of Artificial Sequence: Synthetic oligonucleotide
cggcccatgaggcggagcagct

SEQ ID NO: 6924 - DNA, 23 bp, Artificial Sequence
  Description of Artificial Sequence: Synthetic oligonucleotide
ggcccatgaggcggagcagctga

SEQ ID NO: 6925 - DNA, 24 bp, Artificial Sequence
  Description of Artificial Sequence: Synthetic oligonucleotide
gcccatgaggcggagcagctgaga

SEQ ID NO: 6926 - DNA, 24 bp, Artificial Sequence
  Description of Artificial Sequence: Synthetic oligonucleotide
cccatgaggcggagcagctgagag

SEQ ID NO: 6927 - DNA, 24 bp, Artificial Sequence
  Description of Artificial Sequence: Synthetic oligonucleotide
ccatgaggcggagcagctgagagc

SEQ ID NO: 6928 - DNA, 26 bp, Artificial Sequence
  Description of Artificial Sequence: Synthetic oligonucleotide
catgaggcggagcagctgagagccta

SEQ ID NO: 6929 - DNA, 26 bp, Artificial Sequence
  Description of Artificial Sequence: Synthetic oligonucleotide
atgaggcggagcagctgagagcctac

SEQ ID NO: 6930 - DNA, 25 bp, Artificial Sequence
  Description of Artificial Sequence: Synthetic oligonucleotide
tgaggcggagcagctgagagcctac

SEQ ID NO: 6931 - DNA, 24 bp, Artificial Sequence
  Description of Artificial Sequence: Synthetic oligonucleotide
gaggcggagcagctgagagcctac

SEQ ID NO: 6932 - DNA, 25 bp, Artificial Sequence
  Description of Artificial Sequence: Synthetic oligonucleotide
aggcggagcagctgagagcctacct

SEQ ID NO: 6933 - DNA, 25 bp, Artificial Sequence
  Description of Artificial Sequence: Synthetic oligonucleotide
agacggcccatgaggcggagcagtt

SEQ ID NO: 6934 - DNA, 24 bp, Artificial Sequence
  Description of Artificial Sequence: Synthetic oligonucleotide
gacggcccatgaggcggagcagtt

SEQ ID NO: 6935 - DNA, 25 bp, Artificial Sequence
  Description of Artificial Sequence: Synthetic oligonucleotide
acggcccatgaggcggagcagttga

SEQ ID NO: 6936 - DNA, 24 bp, Artificial Sequence
  Description of Artificial Sequence: Synthetic oligonucleotide
cggcccatgaggcggagcagttga

SEQ ID NO: 6937 - DNA, 25 bp, Artificial Sequence
  Description of Artificial Sequence: Synthetic oligonucleotide
ggcccatgaggcggagcagttgaga

SEQ ID NO: 6938 - DNA, 25 bp, Artificial Sequence
  Description of Artificial Sequence: Synthetic oligonucleotide
gcccatgaggcggagcagttgagag

SEQ ID NO: 6939 - DNA, 25 bp, Artificial Sequence
  Description of Artificial Sequence: Synthetic oligonucleotide
cccatgaggcggagcagttgagagc

SEQ ID NO: 6940 - DNA, 27 bp, Artificial Sequence
  Description of Artificial Sequence: Synthetic oligonucleotide
ccatgaggcggagcagttgagagccta

SEQ ID NO: 6941 - DNA, 27 bp, Artificial Sequence
  Description of Artificial Sequence: Synthetic oligonucleotide
catgaggcggagcagttgagagcctac

SEQ ID NO: 6942 - DNA, 27 bp, Artificial Sequence
  Description of Artificial Sequence: Synthetic oligonucleotide
atgaggcggagcagttgagagcctacc

SEQ ID NO: 6943 - DNA, 27 bp, Artificial Sequence
  Description of Artificial Sequence: Synthetic oligonucleotide
tgaggcggagcagttgagagcctacct

SEQ ID NO: 6944 - DNA, 26 bp, Artificial Sequence
  Description of Artificial Sequence: Synthetic oligonucleotide
gaggcggagcagttgagagcctacct

SEQ ID NO: 6945 - DNA, 26 bp, Artificial Sequence
  Description of Artificial Sequence: Synthetic oligonucleotide
aggcggagcagttgagagcctacctg

SEQ ID NO: 6946 - DNA, 21 bp, Artificial Sequence
  Description of Artificial Sequence: Synthetic oligonucleotide
gctgcgacgtggggccggact

SEQ ID NO: 6947 - DNA, 21 bp, Artificial Sequence
  Description of Artificial Sequence: Synthetic oligonucleotide
ctgcgacgtggggccggactg

SEQ ID NO: 6948 - DNA, 21 bp, Artificial Sequence
  Description of Artificial Sequence: Synthetic oligonucleotide
tgcgacgtggggccggactgg

SEQ ID NO: 6949 - DNA, 20 bp, Artificial Sequence
  Description of Artificial Sequence: Synthetic oligonucleotide
gcgacgtggggccggactgg

SEQ ID NO: 6950 - DNA, 20 bp, Artificial Sequence
  Description of Artificial Sequence: Synthetic oligonucleotide
cgacgtggggccggactggc

SEQ ID NO: 6951 - DNA, 20 bp, Artificial Sequence
  Description of Artificial Sequence: Synthetic oligonucleotide
gacgtggggccggactggcg

SEQ ID NO: 6952 - DNA, 22 bp, Artificial Sequence
  Description of Artificial Sequence: Synthetic oligonucleotide
acgtggggccggactggcgctt

SEQ ID NO: 6953 - DNA, 21 bp, Artificial Sequence
  Description of Artificial Sequence: Synthetic oligonucleotide
cgtggggccggactggcgctt

SEQ ID NO: 6954 - DNA, 21 bp, Artificial Sequence
  Description of Artificial Sequence: Synthetic oligonucleotide
gtggggccggactggcgcttc

SEQ ID NO: 6955 - DNA, 22 bp, Artificial Sequence
  Description of Artificial Sequence: Synthetic oligonucleotide
tggggccggactggcgcttcct

SEQ ID NO: 6956 - DNA, 21 bp, Artificial Sequence
  Description of Artificial Sequence: Synthetic oligonucleotide
ggggccggactggcgcttcct

SEQ ID NO: 6957 - DNA, 21 bp, Artificial Sequence
  Description of Artificial Sequence: Synthetic oligonucleotide
gggccggactggcgcttcctg

SEQ ID NO: 6958 - DNA, 21 bp, Artificial Sequence
  Description of Artificial Sequence: Synthetic oligonucleotide
ggccggactggcgcttcctgc

SEQ ID NO: 6959 - DNA, 21 bp, Artificial Sequence
  Description of Artificial Sequence: Synthetic oligonucleotide
gccggactggcgcttcctgcg

SEQ ID NO: 6960 - DNA, 21 bp, Artificial Sequence
  Description of Artificial Sequence: Synthetic oligonucleotide
ccggactggcgcttcctgcgc

SEQ ID NO: 6961 - DNA, 23 bp, Artificial Sequence
  Description of Artificial Sequence: Synthetic oligonucleotide
agccagaggatggagccgcgggt

SEQ ID NO: 6962 - DNA, 22 bp, Artificial Sequence
  Description of Artificial Sequence: Synthetic oligonucleotide
gccagaggatggagccgcgggt

SEQ ID NO: 6963 - DNA, 22 bp, Artificial Sequence
  Description of Artificial Sequence: Synthetic oligonucleotide
ccagaggatggagccgcgggtg

SEQ ID NO: 6964 - DNA, 22 bp, Artificial Sequence
  Description of Artificial Sequence: Synthetic oligonucleotide
cagaggatggagccgcgggtgc

SEQ ID NO: 6965 - DNA, 22 bp, Artificial Sequence
  Description of Artificial Sequence: Synthetic oligonucleotide
agaggatggagccgcgggtgcc

SEQ ID NO: 6966 - DNA, 21 bp, Artificial Sequence
  Description of Artificial Sequence: Synthetic oligonucleotide
gaggatggagccgcgggtgcc

SEQ ID NO: 6967 - DNA, 22 bp, Artificial Sequence
  Description of Artificial Sequence: Synthetic oligonucleotide
aggatggagccgcgggtgccgt

SEQ ID NO: 6968 - DNA, 21 bp, Artificial Sequence
  Description of Artificial Sequence: Synthetic oligonucleotide
ggatggagccgcgggtgccgt

SEQ ID NO: 6969 - DNA, 21 bp, Artificial Sequence
  Description of Artificial Sequence: Synthetic oligonucleotide
gatggagccgcgggtgccgtg

SEQ ID NO: 6970 - DNA, 24 bp, Artificial Sequence
  Description of Artificial Sequence: Synthetic oligonucleotide
atggagccgcgggtgccgtggata

SEQ ID NO: 6971 - DNA, 23 bp, Artificial Sequence
  Description of Artificial Sequence: Synthetic oligonucleotide
tggagccgcgggtgccgtggata

SEQ ID NO: 6972 - DNA, 22 bp, Artificial Sequence
  Description of Artificial Sequence: Synthetic oligonucleotide
ggagccgcgggtgccgtggata

SEQ ID NO: 6973 - DNA, 23 bp, Artificial Sequence
  Description of Artificial Sequence: Synthetic oligonucleotide
gagccgcgggtgccgtggataga

SEQ ID NO: 6974 - DNA, 23 bp, Artificial Sequence
  Description of Artificial Sequence: Synthetic oligonucleotide
agccgcgggtgccgtggatagag

SEQ ID NO: 6975 - DNA, 22 bp, Artificial Sequence
  Description of Artificial Sequence: Synthetic oligonucleotide
gccgcgggtgccgtggatagag

SEQ ID NO: 6976 - DNA, 23 bp, Artificial Sequence
  Description of Artificial Sequence: Synthetic oligonucleotide
ccgcgggtgccgtggatagagca

SEQ ID NO: 6977 - DNA, 23 bp, Artificial Sequence
  Description of Artificial Sequence: Synthetic oligonucleotide
cgcgggtgccgtggatagagcag

SEQ ID NO: 6978 - DNA, 24 bp, Artificial Sequence
  Description of Artificial Sequence: Synthetic oligonucleotide
gcgggtgccgtggatagagcagga

SEQ ID NO: 6979 - DNA, 24 bp, Artificial Sequence
  Description of Artificial Sequence: Synthetic oligonucleotide
cgggtgccgtggatagagcaggag

SEQ ID NO: 6980 - DNA, 24 bp, Artificial Sequence
  Description of Artificial Sequence: Synthetic oligonucleotide
gggtgccgtggatagagcaggagg

SEQ ID NO: 6981 - DNA, 25 bp, Artificial Sequence
  Description of Artificial Sequence: Synthetic oligonucleotide
ggtgccgtggatagagcaggagggt

SEQ ID NO: 6982 - DNA, 25 bp, Artificial Sequence
  Description of Artificial Sequence: Synthetic oligonucleotide
gtgccgtggatagagcaggagggtc

SEQ ID NO: 6983 - DNA, 25 bp, Artificial Sequence
  Description of Artificial Sequence: Synthetic oligonucleotide
tgccgtggatagagcaggagggtcc

SEQ ID NO: 6984 - DNA, 24 bp, Artificial Sequence
  Description of Artificial Sequence: Synthetic oligonucleotide
gcggacatggcagctcagaccacc

SEQ ID NO: 6985 - DNA, 25 bp, Artificial Sequence
  Description of Artificial Sequence: Synthetic oligonucleotide
cggacatggcagctcagaccaccca

SEQ ID NO: 6986 - DNA, 25 bp, Artificial Sequence
  Description of Artificial Sequence: Synthetic oligonucleotide
ggacatggcagctcagaccacccag

SEQ ID NO: 6987 - DNA, 26 bp, Artificial Sequence
  Description of Artificial Sequence: Synthetic oligonucleotide
gacatggcagctcagaccacccagca

SEQ ID NO: 6988 - DNA, 27 bp, Artificial Sequence
  Description of Artificial Sequence: Synthetic oligonucleotide
acatggcagctcagaccacccagcaca

SEQ ID NO: 6989 - DNA, 27 bp, Artificial Sequence
  Description of Artificial Sequence: Synthetic oligonucleotide
catggcagctcagaccacccagcacaa

SEQ ID NO: 6990 - DNA, 27 bp, Artificial Sequence
  Description of Artificial Sequence: Synthetic oligonucleotide
atggcagctcagaccacccagcacaag

SEQ ID NO: 6991 - DNA, 27 bp, Artificial Sequence
  Description of Artificial Sequence: Synthetic oligonucleotide
tggcagctcagaccacccagcacaagt

SEQ ID NO: 6992 - DNA, 26 bp, Artificial Sequence
  Description of Artificial Sequence: Synthetic oligonucleotide
ggcagctcagaccacccagcacaagt

SEQ ID NO: 6993 - DNA, 26 bp, Artificial Sequence
  Description of Artificial Sequence: Synthetic oligonucleotide
gcagctcagaccacccagcacaagtg

SEQ ID NO: 6994 - DNA, 26 bp, Artificial Sequence
  Description of Artificial Sequence: Synthetic oligonucleotide
cagctcagaccacccagcacaagtgg

SEQ ID NO: 6995 - DNA, 27 bp, Artificial Sequence
  Description of Artificial Sequence: Synthetic oligonucleotide
agctcagaccacccagcacaagtggga

SEQ ID NO: 6996 - DNA, 26 bp, Artificial Sequence
  Description of Artificial Sequence: Synthetic oligonucleotide
gctcagaccacccagcacaagtggga

SEQ ID NO: 6997 - DNA, 26 bp, Artificial Sequence
  Description of Artificial Sequence: Synthetic oligonucleotide
ctcagaccacccagcacaagtgggag

SEQ ID NO: 6998 - DNA, 26 bp, Artificial Sequence
  Description of Artificial Sequence: Synthetic oligonucleotide
tcagaccacccagcacaagtgggagg

SEQ ID NO: 6999 - DNA, 25 bp, Artificial Sequence
  Description of Artificial Sequence: Synthetic oligonucleotide
cagaccacccagcacaagtgggagg

SEQ ID NO: 7000 - DNA, 25 bp, Artificial Sequence
  Description of Artificial Sequence: Synthetic oligonucleotide
agaccacccagcacaagtgggaggc

SEQ ID NO: 7001 - DNA, 24 bp, Artificial Sequence
  Description of Artificial Sequence: Synthetic oligonucleotide
gaccacccagcacaagtgggaggc

SEQ ID NO: 7002 - DNA, 24 bp, Artificial Sequence
  Description of Artificial Sequence: Synthetic oligonucleotide
accacccagcacaagtgggaggcg

SEQ ID NO: 7003 - DNA, 23 bp, Artificial Sequence
  Description of Artificial Sequence: Synthetic oligonucleotide
ccacccagcacaagtgggaggcg

SEQ ID NO: 7004 - DNA, 23 bp, Artificial Sequence
  Description of Artificial Sequence: Synthetic oligonucleotide
cacccagcacaagtgggaggcgg

SEQ ID NO: 7005 - DNA, 23 bp, Artificial Sequence
  Description of Artificial Sequence: Synthetic oligonucleotide
acccagcacaagtgggaggcggc

SEQ ID NO: 7006 - DNA, 22 bp, Artificial Sequence
  Description of Artificial Sequence: Synthetic oligonucleotide
cccagcacaagtgggaggcggc

SEQ ID NO: 7007 - DNA, 22 bp, Artificial Sequence
  Description of Artificial Sequence: Synthetic oligonucleotide
ccagcacaagtgggaggcggcc

SEQ ID NO: 7008 - DNA, 24 bp, Artificial Sequence
  Description of Artificial Sequence: Synthetic oligonucleotide
cagcacaagtgggaggcggcccat

SEQ ID NO: 7009 - DNA, 27 bp, Artificial Sequence
  Description of Artificial Sequence: Synthetic oligonucleotide
acacgcagttcgtgcggttcgacagct

SEQ ID NO: 7010 - DNA, 27 bp, Artificial Sequence
  Description of Artificial Sequence: Synthetic oligonucleotide
cacgcagttcgtgcggttcgacagcta

SEQ ID NO: 7011 - DNA, 27 bp, Artificial Sequence
  Description of Artificial Sequence: Synthetic oligonucleotide
acgcagttcgtgcggttcgacagctac

SEQ ID NO: 7012 - DNA, 26 bp, Artificial Sequence
  Description of Artificial Sequence: Synthetic oligonucleotide
cgcagttcgtgcggttcgacagctac

SEQ ID NO: 7013 - DNA, 26 bp, Artificial Sequence
  Description of Artificial Sequence: Synthetic oligonucleotide
gcagttcgtgcggttcgacagctacg

SEQ ID NO: 7014 - DNA, 26 bp, Artificial Sequence
  Description of Artificial Sequence: Synthetic oligonucleotide
cagttcgtgcggttcgacagctacgc

SEQ ID NO: 7015 - DNA, 26 bp, Artificial Sequence
  Description of Artificial Sequence: Synthetic oligonucleotide
agttcgtgcggttcgacagctacgcc

SEQ ID NO: 7016 - DNA, 25 bp, Artificial Sequence
  Description of Artificial Sequence: Synthetic oligonucleotide
gttcgtgcggttcgacagctacgcc

SEQ ID NO: 7017 - DNA, 25 bp, Artificial Sequence
  Description of Artificial Sequence: Synthetic oligonucleotide
ttcgtgcggttcgacagctacgccg

SEQ ID NO: 7018 - DNA, 24 bp, Artificial Sequence
  Description of Artificial Sequence: Synthetic oligonucleotide
tcgtgcggttcgacagctacgccg

SEQ ID NO: 7019 - DNA, 23 bp, Artificial Sequence
  Description of Artificial Sequence: Synthetic oligonucleotide
cgtgcggttcgacagctacgccg

SEQ ID NO: 7020 - DNA, 23 bp, Artificial Sequence
  Description of Artificial Sequence: Synthetic oligonucleotide
gtgcggttcgacagctacgccgc

SEQ ID NO: 7021 - DNA, 24 bp, Artificial Sequence
  Description of Artificial Sequence: Synthetic oligonucleotide
tgcggttcgacagctacgccgcga

SEQ ID NO: 7022 - DNA, 23 bp, Artificial Sequence
  Description of Artificial Sequence: Synthetic oligonucleotide
gcggttcgacagctacgccgcga

SEQ ID NO: 7023 - DNA, 23 bp, Artificial Sequence
  Description of Artificial Sequence: Synthetic oligonucleotide
cggttcgacagctacgccgcgag

SEQ ID NO: 7024 - DNA, 23 bp, Artificial Sequence
  Description of Artificial Sequence: Synthetic oligonucleotide
ggttcgacagctacgccgcgagc

SEQ ID NO: 7025 - DNA, 24 bp, Artificial Sequence
  Description of Artificial Sequence: Synthetic oligonucleotide
gttcgacagctacgccgcgagcca

SEQ ID NO: 7026 - DNA, 25 bp, Artificial Sequence
  Description of Artificial Sequence: Synthetic oligonucleotide
ttcgacagctacgccgcgagccaga

SEQ ID NO: 7027 - DNA, 24 bp, Artificial Sequence
  Description of Artificial Sequence: Synthetic oligonucleotide
tcgacagctacgccgcgagccaga

SEQ ID NO: 7028 - DNA, 23 bp, Artificial Sequence
  Description of Artificial Sequence: Synthetic oligonucleotide
cgacagctacgccgcgagccaga

SEQ ID NO: 7029 - DNA, 23 bp, Artificial Sequence
  Description of Artificial Sequence: Synthetic oligonucleotide
gacagctacgccgcgagccagag

SEQ ID NO: 7030 - DNA, 25 bp, Artificial Sequence
  Description of Artificial Sequence: Synthetic oligonucleotide
acagctacgccgcgagccagaggat

SEQ ID NO: 7031 - DNA, 24 bp, Artificial Sequence
  Description of Artificial Sequence: Synthetic oligonucleotide
cagctacgccgcgagccagaggat

SEQ ID NO: 7032 - DNA, 24 bp, Artificial Sequence
  Description of Artificial Sequence: Synthetic oligonucleotide
agctacgccgcgagccagaggatg

SEQ ID NO: 7033 - DNA, 23 bp, Artificial Sequence
  Description of Artificial Sequence: Synthetic oligonucleotide
gctacgccgcgagccagaggatg

SEQ ID NO: 7034 - DNA, 24 bp, Artificial Sequence
  Description of Artificial Sequence: Synthetic oligonucleotide
ctacgccgcgagccagaggatgga

SEQ ID NO: 7035 - DNA, 24 bp, Artificial Sequence
  Description of Artificial Sequence: Synthetic oligonucleotide
tacgccgcgagccagaggatggag

SEQ ID NO: 7036 - DNA, 25 bp, Artificial Sequence
  Description of Artificial Sequence: Synthetic oligonucleotide
gcgccgtggatagagcaggagggta

SEQ ID NO: 7037 - DNA, 25 bp, Artificial Sequence
  Description of Artificial Sequence: Synthetic oligonucleotide
cgccgtggatagagcaggagggtac

SEQ ID NO: 7038 - DNA, 25 bp, Artificial Sequence
  Description of Artificial Sequence: Synthetic oligonucleotide
gccgtggatagagcaggagggtacg

SEQ ID NO: 7039 - DNA, 26 bp, Artificial Sequence
  Description of Artificial Sequence: Synthetic oligonucleotide
ccgtggatagagcaggagggtacgga

SEQ ID NO: 7040 - DNA, 27 bp, Artificial Sequence
  Description of Artificial Sequence: Synthetic oligonucleotide
cgtggatagagcaggagggtacggagt

SEQ ID NO: 7041 - DNA, 30 bp, Artificial Sequence
  Description of Artificial Sequence: Synthetic oligonucleotide
gtggatagagcaggagggtacggagtattg

SEQ ID NO: 7042 - DNA, 30 bp, Artificial Sequence
  Description of Artificial Sequence: Synthetic oligonucleotide
tggatagagcaggagggtacggagtattgg

SEQ ID NO: 7043 - DNA, 29 bp, Artificial Sequence
  Description of Artificial Sequence: Synthetic oligonucleotide
ggatagagcaggagggtacggagtattgg

SEQ ID NO: 7044 - DNA, 29 bp, Artificial Sequence
  Description of Artificial Sequence: Synthetic oligonucleotide
gatagagcaggagggtacggagtattggg

SEQ ID NO: 7045 - DNA, 30 bp, Artificial Sequence
  Description of Artificial Sequence: Synthetic oligonucleotide
atagagcaggagggtacggagtattgggac

SEQ ID NO: 7046 - DNA, 29 bp, Artificial Sequence
  Description of Artificial Sequence: Synthetic oligonucleotide
tagagcaggagggtacggagtattgggac

SEQ ID NO: 7047 - DNA, 28 bp, Artificial Sequence
  Description of Artificial Sequence: Synthetic oligonucleotide
agagcaggagggtacggagtattgggac

SEQ ID NO: 7048 - DNA, 27 bp, Artificial Sequence
  Description of Artificial Sequence: Synthetic oligonucleotide
gagcaggagggtacggagtattgggac

SEQ ID NO: 7049 - DNA, 27 bp, Artificial Sequence
  Description of Artificial Sequence: Synthetic oligonucleotide
agcaggagggtacggagtattgggacg

SEQ ID NO: 7050 - DNA, 26 bp, Artificial Sequence
  Description of Artificial Sequence: Synthetic oligonucleotide
gcaggagggtacggagtattgggacg

SEQ ID NO: 7051 - DNA, 26 bp, Artificial Sequence
  Description of Artificial Sequence: Synthetic oligonucleotide
caggagggtacggagtattgggacgg

SEQ ID NO: 7052 - DNA, 26 bp, Artificial Sequence
  Description of Artificial Sequence: Synthetic oligonucleotide
aggagggtacggagtattgggacggg

SEQ ID NO: 7053 - DNA, 25 bp, Artificial Sequence
  Description of Artificial Sequence: Synthetic oligonucleotide
ggagggtacggagtattgggacggg

SEQ ID NO: 7054 - DNA, 26 bp, Artificial Sequence
  Description of Artificial Sequence: Synthetic oligonucleotide
gagggtacggagtattgggacgggga

SEQ ID NO: 7055 - DNA, 27 bp, Artificial Sequence
  Description of Artificial Sequence: Synthetic oligonucleotide
agggtacggagtattgggacggggaga

SEQ ID NO: 7056 - DNA, 26 bp, Artificial Sequence
  Description of Artificial Sequence: Synthetic oligonucleotide
gggtacggagtattgggacggggaga

SEQ ID NO: 7057 - DNA, 27 bp, Artificial Sequence
  Description of Artificial Sequence: Synthetic oligonucleotide
ggtacggagtattgggacggggagaca

SEQ ID NO: 7058 - DNA, 27 bp, Artificial Sequence
  Description of Artificial Sequence: Synthetic oligonucleotide
gtacggagtattgggacggggagacac

SEQ ID NO: 7059 - DNA, 27 bp, Artificial Sequence
  Description of Artificial Sequence: Synthetic oligonucleotide
tacggagtattgggacggggagacacg

SEQ ID NO: 7060 - DNA, 26 bp, Artificial Sequence
  Description of Artificial Sequence: Synthetic oligonucleotide
acggagtattgggacggggagacacg

SEQ ID NO: 7061 - DNA, 25 bp, Artificial Sequence
  Description of Artificial Sequence: Synthetic oligonucleotide
ggtaccaccagtacgcctacgacgc

SEQ ID NO: 7062 - DNA, 27 bp, Artificial Sequence
  Description of Artificial Sequence: Synthetic oligonucleotide
gtaccaccagtacgcctacgacgccaa

SEQ ID NO: 7063 - DNA, 27 bp, Artificial Sequence
  Description of Artificial Sequence: Synthetic oligonucleotide
taccaccagtacgcctacgacgccaag

SEQ ID NO: 7064 - DNA, 26 bp, Artificial Sequence
  Description of Artificial Sequence: Synthetic oligonucleotide
accaccagtacgcctacgacgccaag

SEQ ID NO: 7065 - DNA, 25 bp, Artificial Sequence
  Description of Artificial Sequence: Synthetic oligonucleotide
ccaccagtacgcctacgacgccaag

SEQ ID NO: 7066 - DNA, 27 bp, Artificial Sequence
  Description of Artificial Sequence: Synthetic oligonucleotide
caccagtacgcctacgacgccaaggat

SEQ ID NO: 7067 - DNA, 29 bp, Artificial Sequence
  Description of Artificial Sequence: Synthetic oligonucleotide
accagtacgcctacgacgccaaggattac

SEQ ID NO: 7068 - DNA, 28 bp, Artificial Sequence
  Description of Artificial Sequence: Synthetic oligonucleotide
ccagtacgcctacgacgccaaggattac

SEQ ID NO: 7069 - DNA, 30 bp, Artificial Sequence
  Description of Artificial Sequence: Synthetic oligonucleotide
cagtacgcctacgacgccaaggattacatc

SEQ ID NO: 7070 - DNA, 30 bp, Artificial Sequence
  Description of Artificial Sequence: Synthetic oligonucleotide
agtacgcctacgacgccaaggattacatcg

SEQ ID NO: 7071 - DNA, 29 bp, Artificial Sequence
  Description of Artificial Sequence: Synthetic oligonucleotide
gtacgcctacgacgccaaggattacatcg

SEQ ID NO: 7072 - DNA, 29 bp, Artificial Sequence
  Description of Artificial Sequence: Synthetic oligonucleotide
tacgcctacgacgccaaggattacatcgc

SEQ ID NO: 7073 - DNA, 28 bp, Artificial Sequence
  Description of Artificial Sequence: Synthetic oligonucleotide
acgcctacgacgccaaggattacatcgc

SEQ ID NO: 7074 - DNA, 27 bp, Artificial Sequence
  Description of Artificial Sequence: Synthetic oligonucleotide
cgcctacgacgccaaggattacatcgc

SEQ ID NO: 7075 - DNA, 27 bp, Artificial Sequence
  Description of Artificial Sequence: Synthetic oligonucleotide
gcctacgacgccaaggattacatcgcc

SEQ ID NO: 7076 - DNA, 27 bp, Artificial Sequence
  Description of Artificial Sequence: Synthetic oligonucleotide
cctacgacgccaaggattacatcgccc

SEQ ID NO: 7077 - DNA, 28 bp, Artificial Sequence
  Description of Artificial Sequence: Synthetic oligonucleotide
ctacgacgccaaggattacatcgccctg

SEQ ID NO: 7078 - DNA, 31 bp, Artificial Sequence
  Description of Artificial Sequence: Synthetic oligonucleotide
tacgacgccaaggattacatcgccctgaaag

SEQ ID NO: 7079 - DNA, 30 bp, Artificial Sequence
  Description of Artificial Sequence: Synthetic oligonucleotide
acgacgccaaggattacatcgccctgaaag

SEQ ID NO: 7080 - DNA, 29 bp, Artificial Sequence
  Description of Artificial Sequence: Synthetic oligonucleotide
cgacgccaaggattacatcgccctgaaag

SEQ ID NO: 7081 - DNA, 30 bp, Artificial Sequence
  Description of Artificial Sequence: Synthetic oligonucleotide
gacgccaaggattacatcgccctgaaagag

SEQ ID NO: 7082 - DNA, 30 bp, Artificial Sequence
  Description of Artificial Sequence: Synthetic oligonucleotide
acgccaaggattacatcgccctgaaagagg

SEQ ID NO: 7083 - DNA, 29 bp, Artificial Sequence
  Description of Artificial Sequence: Synthetic oligonucleotide
cgccaaggattacatcgccctgaaagagg

SEQ ID NO: 7084 - DNA, 30 bp, Artificial Sequence
  Description of Artificial Sequence: Synthetic oligonucleotide
gccaaggattacatcgccctgaaagaggac

SEQ ID NO: 7085 - DNA, 30 bp, Artificial Sequence
  Description of Artificial Sequence: Synthetic oligonucleotide
ccaaggattacatcgccctgaaagaggacc

SEQ ID NO: 7086 - DNA, 24 bp, Artificial Sequence
  Description of Artificial Sequence: Synthetic oligonucleotide
gcttcctccgcgggtaccaccagt

SEQ ID NO: 7087 - DNA, 24 bp, Artificial Sequence
  Description of Artificial Sequence: Synthetic oligonucleotide
cttcctccgcgggtaccaccagtc

SEQ ID NO: 7088 - DNA, 24 bp, Artificial Sequence
  Description of Artificial Sequence: Synthetic oligonucleotide
ttcctccgcgggtaccaccagtcc

SEQ ID NO: 7089 - DNA, 23 bp, Artificial Sequence
  Description of Artificial Sequence: Synthetic oligonucleotide
tcctccgcgggtaccaccagtcc

SEQ ID NO: 7090 - DNA, 22 bp, Artificial Sequence
  Description of Artificial Sequence: Synthetic oligonucleotide
cctccgcgggtaccaccagtcc

SEQ ID NO: 7091 - DNA, 22 bp, Artificial Sequence
  Description of Artificial Sequence: Synthetic oligonucleotide
ctccgcgggtaccaccagtccg

SEQ ID NO: 7092 - DNA, 22 bp, Artificial Sequence
  Description of Artificial Sequence: Synthetic oligonucleotide
tccgcgggtaccaccagtccgc

SEQ ID NO: 7093 - DNA, 21 bp, Artificial Sequence
  Description of Artificial Sequence: Synthetic oligonucleotide
ccgcgggtaccaccagtccgc

SEQ ID NO: 7094 - DNA, 23 bp, Artificial Sequence
  Description of Artificial Sequence: Synthetic oligonucleotide
cgcgggtaccaccagtccgccta

SEQ ID NO: 7095 - DNA, 23 bp, Artificial Sequence
  Description of Artificial Sequence: Synthetic oligonucleotide
gcgggtaccaccagtccgcctac

SEQ ID NO: 7096 - DNA, 24 bp, Artificial Sequence
  Description of Artificial Sequence: Synthetic oligonucleotide
cgggtaccaccagtccgcctacga

SEQ ID NO: 7097 - DNA, 24 bp, Artificial Sequence
  Description of Artificial Sequence: Synthetic oligonucleotide
gggtaccaccagtccgcctacgac

SEQ ID NO: 7098 - DNA, 24 bp, Artificial Sequence
  Description of Artificial Sequence: Synthetic oligonucleotide
ggtaccaccagtccgcctacgacg

SEQ ID NO: 7099 - DNA, 24 bp, Artificial Sequence
  Description of Artificial Sequence: Synthetic oligonucleotide
gtaccaccagtccgcctacgacgg

SEQ ID NO: 7100 - DNA, 26 bp, Artificial Sequence
  Description of Artificial Sequence: Synthetic oligonucleotide
taccaccagtccgcctacgacggcaa

SEQ ID NO: 7101 - DNA, 25 bp, Artificial Sequence
  Description of Artificial Sequence: Synthetic oligonucleotide
accaccagtccgcctacgacggcaa

SEQ ID NO: 7102 - DNA, 24 bp, Artificial Sequence
  Description of Artificial Sequence: Synthetic oligonucleotide
ccaccagtccgcctacgacggcaa

SEQ ID NO: 7103 - DNA, 24 bp, Artificial Sequence
  Description of Artificial Sequence: Synthetic oligonucleotide
caccagtccgcctacgacggcaag

SEQ ID NO: 7104 - DNA, 27 bp, Artificial Sequence
  Description of Artificial Sequence: Synthetic oligonucleotide
accagtccgcctacgacggcaaggatt

SEQ ID NO: 7105 - DNA, 27 bp, Artificial Sequence
  Description of Artificial Sequence: Synthetic oligonucleotide
ccagtccgcctacgacggcaaggatta

SEQ ID NO: 7106 - DNA, 27 bp, Artificial Sequence
  Description of Artificial Sequence: Synthetic oligonucleotide
cagtccgcctacgacggcaaggattac

SEQ ID NO: 7107 - DNA, 29 bp, Artificial Sequence
  Description of Artificial Sequence: Synthetic oligonucleotide
agtccgcctacgacggcaaggattacatc

SEQ ID NO: 7108 - DNA, 28 bp, Artificial Sequence
  Description of Artificial Sequence: Synthetic oligonucleotide
gtccgcctacgacggcaaggattacatc

SEQ ID NO: 7109 - DNA, 28 bp, Artificial Sequence
  Description of Artificial Sequence: Synthetic oligonucleotide
tccgcctacgacggcaaggattacatcg

SEQ ID NO: 7110 - DNA, 27 bp, Artificial Sequence
  Description of Artificial Sequence: Synthetic oligonucleotide
ccgcctacgacggcaaggattacatcg

SEQ ID NO: 7111 - DNA, 28 bp, Artificial Sequence
  Description of Artificial Sequence: Synthetic oligonucleotide
aggggatggaaccttccagaagtgggtg

SEQ ID NO: 7112 - DNA, 27 bp, Artificial Sequence
  Description of Artificial Sequence: Synthetic oligonucleotide
ggggatggaaccttccagaagtgggtg

SEQ ID NO: 7113 - DNA, 27 bp, Artificial Sequence
  Description of Artificial Sequence: Synthetic oligonucleotide
gggatggaaccttccagaagtgggtgg

SEQ ID NO: 7114 - DNA, 27 bp, Artificial Sequence
  Description of Artificial Sequence: Synthetic oligonucleotide
ggatggaaccttccagaagtgggtggc

SEQ ID NO: 7115 - DNA, 28 bp, Artificial Sequence
  Description of Artificial Sequence: Synthetic oligonucleotide
gatggaaccttccagaagtgggtggctg

SEQ ID NO: 7116 - DNA, 29 bp, Artificial Sequence
  Description of Artificial Sequence: Synthetic oligonucleotide
atggaaccttccagaagtgggtggctgtg

SEQ ID NO: 7117 - DNA, 28 bp, Artificial Sequence
  Description of Artificial Sequence: Synthetic oligonucleotide
tggaaccttccagaagtgggtggctgtg

SEQ ID NO: 7118 - DNA, 27 bp, Artificial Sequence
  Description of Artificial Sequence: Synthetic oligonucleotide
ggaaccttccagaagtgggtggctgtg

SEQ ID NO: 7119 - DNA, 27 bp, Artificial Sequence
  Description of Artificial Sequence: Synthetic oligonucleotide
gaaccttccagaagtgggtggctgtgg

SEQ ID NO: 7120 - DNA, 28 bp, Artificial Sequence
  Description of Artificial Sequence: Synthetic oligonucleotide
aaccttccagaagtgggtggctgtggtg

SEQ ID NO: 7121 - DNA, 27 bp, Artificial Sequence
  Description of Artificial Sequence: Synthetic oligonucleotide
accttccagaagtgggtggctgtggtg

SEQ ID NO: 7122 - DNA, 26 bp, Artificial Sequence
  Description of Artificial Sequence: Synthetic oligonucleotide
ccttccagaagtgggtggctgtggtg

SEQ ID NO: 7123 - DNA, 27 bp, Artificial Sequence
  Description of Artificial Sequence: Synthetic oligonucleotide
cttccagaagtgggtggctgtggtggt

SEQ ID NO: 7124 - DNA, 27 bp, Artificial Sequence
  Description of Artificial Sequence: Synthetic oligonucleotide
ttccagaagtgggtggctgtggtggtg

SEQ ID NO: 7125 - DNA, 26 bp, Artificial Sequence
  Description of Artificial Sequence: Synthetic oligonucleotide
tccagaagtgggtggctgtggtggtg

SEQ ID NO: 7126 - DNA, 25 bp, Artificial Sequence
  Description of Artificial Sequence: Synthetic oligonucleotide
ccagaagtgggtggctgtggtggtg

SEQ ID NO: 7127 - DNA, 25 bp, Artificial Sequence
  Description of Artificial Sequence: Synthetic oligonucleotide
cagaagtgggtggctgtggtggtgc

SEQ ID NO: 7128 - DNA, 27 bp, Artificial Sequence
  Description of Artificial Sequence: Synthetic oligonucleotide
agaagtgggtggctgtggtggtgcctt

SEQ ID NO: 7129 - DNA, 26 bp, Artificial Sequence
  Description of Artificial Sequence: Synthetic oligonucleotide
gaagtgggtggctgtggtggtgcctt

SEQ ID NO: 7130 - DNA, 27 bp, Artificial Sequence
  Description of Artificial Sequence: Synthetic oligonucleotide
aagtgggtggctgtggtggtgccttct

SEQ ID NO: 7131 - DNA, 26 bp, Artificial Sequence
  Description of Artificial Sequence: Synthetic oligonucleotide
agtgggtggctgtggtggtgccttct

SEQ ID NO: 7132 - DNA, 25 bp, Artificial Sequence
  Description of Artificial Sequence: Synthetic oligonucleotide
gtgggtggctgtggtggtgccttct

SEQ ID NO: 7133 - DNA, 25 bp, Artificial Sequence
  Description of Artificial Sequence: Synthetic oligonucleotide
tgggtggctgtggtggtgccttctg

SEQ ID NO: 7134 - DNA, 24 bp, Artificial Sequence
  Description of Artificial Sequence: Synthetic oligonucleotide
gggtggctgtggtggtgccttctg

SEQ ID NO: 7135 - DNA, 25 bp, Artificial Sequence
  Description of Artificial Sequence: Synthetic oligonucleotide
ggtggctgtggtggtgccttctgga

SEQ ID NO: 7136 - DNA, 26 bp, Artificial Sequence
  Description of Artificial Sequence: Synthetic oligonucleotide
gtggctgtggtggtgccttctggaca

SEQ ID NO: 7137 - DNA, 26 bp, Artificial Sequence
  Description of Artificial Sequence: Synthetic oligonucleotide
tggctgtggtggtgccttctggacag

SEQ ID NO: 7138 - DNA, 24 bp, Artificial Sequence
  Description of Artificial Sequence: Synthetic oligonucleotide
atggccgtcatggctccccgaacc

SEQ ID NO: 7139 - DNA, 23 bp, Artificial Sequence
  Description of Artificial Sequence: Synthetic oligonucleotide
tggccgtcatggctccccgaacc

SEQ ID NO: 7140 - DNA, 22 bp, Artificial Sequence
  Description of Artificial Sequence: Synthetic oligonucleotide
ggccgtcatggctccccgaacc

SEQ ID NO: 7141 - DNA, 23 bp, Artificial Sequence
  Description of Artificial Sequence: Synthetic oligonucleotide
gccgtcatggctccccgaaccct

SEQ ID NO: 7142 - DNA, 23 bp, Artificial Sequence
  Description of Artificial Sequence: Synthetic oligonucleotide
ccgtcatggctccccgaaccctc

SEQ ID NO: 7143 - DNA, 24 bp, Artificial Sequence
  Description of Artificial Sequence: Synthetic oligonucleotide
cgtcatggctccccgaaccctcgt

SEQ ID NO: 7144 - DNA, 24 bp, Artificial Sequence
  Description of Artificial Sequence: Synthetic oligonucleotide
gtcatggctccccgaaccctcgtc

SEQ ID NO: 7145 - DNA, 25 bp, Artificial Sequence
  Description of Artificial Sequence: Synthetic oligonucleotide
tcatggctccccgaaccctcgtcct

SEQ ID NO: 7146 - DNA, 24 bp, Artificial Sequence
  Description of Artificial Sequence: Synthetic oligonucleotide
catggctccccgaaccctcgtcct

SEQ ID NO: 7147 - DNA, 24 bp, Artificial Sequence
  Description of Artificial Sequence: Synthetic oligonucleotide
atggctccccgaaccctcgtcctg

SEQ ID NO: 7148 - DNA, 23 bp, Artificial Sequence
  Description of Artificial Sequence: Synthetic oligonucleotide
tggctccccgaaccctcgtcctg

SEQ ID NO: 7149 - DNA, 22 bp, Artificial Sequence
  Description of Artificial Sequence: Synthetic oligonucleotide
ggctccccgaaccctcgtcctg

SEQ ID NO: 7150 - DNA, 24 bp, Artificial Sequence
  Description of Artificial Sequence: Synthetic oligonucleotide
gctccccgaaccctcgtcctgcta

SEQ ID NO: 7151 - DNA, 25 bp, Artificial Sequence
  Description of Artificial Sequence: Synthetic oligonucleotide
ctccccgaaccctcgtcctgctact

SEQ ID NO: 7152 - DNA, 26 bp, Artificial Sequence
  Description of Artificial Sequence: Synthetic oligonucleotide
tccccgaaccctcgtcctgctactct

SEQ ID NO: 7153 - DNA, 23 bp, Artificial Sequence
  Description of Artificial Sequence: Synthetic oligonucleotide
cgctcttggaccgcggcggacaa

SEQ ID NO: 7154 - DNA, 23 bp, Artificial Sequence
  Description of Artificial Sequence: Synthetic oligonucleotide
gctcttggaccgcggcggacaag

SEQ ID NO: 7155 - DNA, 23 bp, Artificial Sequence
  Description of Artificial Sequence: Synthetic oligonucleotide
ctcttggaccgcggcggacaagg

SEQ ID NO: 7156 - DNA, 24 bp, Artificial Sequence
  Description of Artificial Sequence: Synthetic oligonucleotide
tcttggaccgcggcggacaaggca

SEQ ID NO: 7157 - DNA, 23 bp, Artificial Sequence
  Description of Artificial Sequence: Synthetic oligonucleotide
cttggaccgcggcggacaaggca

SEQ ID NO: 7158 - DNA, 23 bp, Artificial Sequence
  Description of Artificial Sequence: Synthetic oligonucleotide
ttggaccgcggcggacaaggcag

SEQ ID NO: 7159 - DNA, 22 bp, Artificial Sequence
  Description of Artificial Sequence: Synthetic oligonucleotide
tggaccgcggcggacaaggcag

SEQ ID NO: 7160 - DNA, 21 bp, Artificial Sequence
  Description of Artificial Sequence: Synthetic oligonucleotide
ggaccgcggcggacaaggcag

SEQ ID NO: 7161 - DNA, 22 bp, Artificial Sequence
  Description of Artificial Sequence: Synthetic oligonucleotide
gaccgcggcggacaaggcagct

SEQ ID NO: 7162 - DNA, 23 bp, Artificial Sequence
  Description of Artificial Sequence: Synthetic oligonucleotide
accgcggcggacaaggcagctca

SEQ ID NO: 7163 - DNA, 22 bp, Artificial Sequence
  Description of Artificial Sequence: Synthetic oligonucleotide
ccgcggcggacaaggcagctca

SEQ ID NO: 7164 - DNA, 23 bp, Artificial Sequence
  Description of Artificial Sequence: Synthetic oligonucleotide
cgcggcggacaaggcagctcaga

SEQ ID NO: 7165 - DNA, 23 bp, Artificial Sequence
  Description of Artificial Sequence: Synthetic oligonucleotide
gcggcggacaaggcagctcagac

SEQ ID NO: 7166 - DNA, 24 bp, Artificial Sequence
  Description of Artificial Sequence: Synthetic oligonucleotide
cggcggacaaggcagctcagacca

SEQ ID NO: 7167 - DNA, 24 bp, Artificial Sequence
  Description of Artificial Sequence: Synthetic oligonucleotide
ggcggacaaggcagctcagaccac

SEQ ID NO: 7168 - DNA, 26 bp, Artificial Sequence
  Description of Artificial Sequence: Synthetic oligonucleotide
gcggacaaggcagctcagaccaccaa

SEQ ID NO: 7169 - DNA, 26 bp, Artificial Sequence
  Description of Artificial Sequence: Synthetic oligonucleotide
cggacaaggcagctcagaccaccaag

SEQ ID NO: 7170 - DNA, 27 bp, Artificial Sequence
  Description of Artificial Sequence: Synthetic oligonucleotide
ggacaaggcagctcagaccaccaagca

SEQ ID NO: 7171 - DNA, 27 bp, Artificial Sequence
  Description of Artificial Sequence: Synthetic oligonucleotide
gacaaggcagctcagaccaccaagcac

SEQ ID NO: 7172 - DNA, 29 bp, Artificial Sequence
  Description of Artificial Sequence: Synthetic oligonucleotide
acaaggcagctcagaccaccaagcacaag

SEQ ID NO: 7173 - DNA, 28 bp, Artificial Sequence
  Description of Artificial Sequence: Synthetic oligonucleotide
caaggcagctcagaccaccaagcacaag

SEQ ID NO: 7174 - DNA, 29 bp, Artificial Sequence
  Description of Artificial Sequence: Synthetic oligonucleotide
aaggcagctcagaccaccaagcacaagtg

SEQ ID NO: 7175 - DNA, 28 bp, Artificial Sequence
  Description of Artificial Sequence: Synthetic oligonucleotide
aggcagctcagaccaccaagcacaagtg

SEQ ID NO: 7176 - DNA, 26 bp, Artificial Sequence
  Description of Artificial Sequence: Synthetic oligonucleotide
ctgcgcggctactacaaccagagcca

SEQ ID NO: 7177 - DNA, 26 bp, Artificial Sequence
  Description of Artificial Sequence: Synthetic oligonucleotide
tgcgcggctactacaaccagagccag

SEQ ID NO: 7178 - DNA, 25 bp, Artificial Sequence
  Description of Artificial Sequence: Synthetic oligonucleotide
gcgcggctactacaaccagagccag

SEQ ID NO: 7179 - DNA, 25 bp, Artificial Sequence
  Description of Artificial Sequence: Synthetic oligonucleotide
cgcggctactacaaccagagccagg

SEQ ID NO: 7180 - DNA, 25 bp, Artificial Sequence
  Description of Artificial Sequence: Synthetic oligonucleotide
gcggctactacaaccagagccaggc

SEQ ID NO: 7181 - DNA, 25 bp, Artificial Sequence
  Description of Artificial Sequence: Synthetic oligonucleotide
cggctactacaaccagagccaggcc

SEQ ID NO: 7182 - DNA, 25 bp, Artificial Sequence
  Description of Artificial Sequence: Synthetic oligonucleotide
ggctactacaaccagagccaggccg

SEQ ID NO: 7183 - DNA, 27 bp, Artificial Sequence
  Description of Artificial Sequence: Synthetic oligonucleotide
gctactacaaccagagccaggccggtt

SEQ ID NO: 7184 - DNA, 27 bp, Artificial Sequence
  Description of Artificial Sequence: Synthetic oligonucleotide
ctactacaaccagagccaggccggttc

SEQ ID NO: 7185 - DNA, 28 bp, Artificial Sequence
  Description of Artificial Sequence: Synthetic oligonucleotide
tactacaaccagagccaggccggttctc

SEQ ID NO: 7186 - DNA, 27 bp, Artificial Sequence
  Description of Artificial Sequence: Synthetic oligonucleotide
actacaaccagagccaggccggttctc

SEQ ID NO: 7187 - DNA, 27 bp, Artificial Sequence
  Description of Artificial Sequence: Synthetic oligonucleotide
ctacaaccagagccaggccggttctca

SEQ ID NO: 7188 - DNA, 27 bp, Artificial Sequence
  Description of Artificial Sequence: Synthetic oligonucleotide
tacaaccagagccaggccggttctcac

SEQ ID NO: 7189 - DNA, 27 bp, Artificial Sequence
  Description of Artificial Sequence: Synthetic oligonucleotide
acaaccagagccaggccggttctcaca

SEQ ID NO: 7190 - DNA, 26 bp, Artificial Sequence
  Description of Artificial Sequence: Synthetic oligonucleotide
caaccagagccaggccggttctcaca

SEQ ID NO: 7191 - DNA, 26 bp, Artificial Sequence
  Description of Artificial Sequence: Synthetic oligonucleotide
aaccagagccaggccggttctcacac

SEQ ID NO: 7192 - DNA, 25 bp, Artificial Sequence
  Description of Artificial Sequence: Synthetic oligonucleotide
accagagccaggccggttctcacac

SEQ ID NO: 7193 - DNA, 24 bp, Artificial Sequence
  Description of Artificial Sequence: Synthetic oligonucleotide
ccagagccaggccggttctcacac

SEQ ID NO: 7194 - DNA, 24 bp, Artificial Sequence
  Description of Artificial Sequence: Synthetic oligonucleotide
cagagccaggccggttctcacacc

SEQ ID NO: 7195 - DNA, 25 bp, Artificial Sequence
  Description of Artificial Sequence: Synthetic oligonucleotide
agagccaggccggttctcacaccgt

SEQ ID NO: 7196 - DNA, 24 bp, Artificial Sequence
  Description of Artificial Sequence: Synthetic oligonucleotide
gagccaggccggttctcacaccgt

SEQ ID NO: 7197 - DNA, 24 bp, Artificial Sequence
  Description of Artificial Sequence: Synthetic oligonucleotide
agccaggccggttctcacaccgtc

SEQ ID NO: 7198 - DNA, 23 bp, Artificial Sequence
  Description of Artificial Sequence: Synthetic oligonucleotide
gccaggccggttctcacaccgtc

SEQ ID NO: 7199 - DNA, 24 bp, Artificial Sequence
  Description of Artificial Sequence: Synthetic oligonucleotide
ccaggccggttctcacaccgtcca

SEQ ID NO: 7200 - DNA, 25 bp, Artificial Sequence
  Description of Artificial Sequence: Synthetic oligonucleotide
caggccggttctcacaccgtccaga

SEQ ID NO: 7201 - DNA, 26 bp, Artificial Sequence
  Description of Artificial Sequence: Synthetic oligonucleotide
acgcagttcgtgcggttcgacagcca

SEQ ID NO: 7202 - DNA, 25 bp, Artificial Sequence
  Description of Artificial Sequence: Synthetic oligonucleotide
cgcagttcgtgcggttcgacagcca

SEQ ID NO: 7203 - DNA, 25 bp, Artificial Sequence
  Description of Artificial Sequence: Synthetic oligonucleotide
gcagttcgtgcggttcgacagccac

SEQ ID NO: 7204 - DNA, 25 bp, Artificial Sequence
  Description of Artificial Sequence: Synthetic oligonucleotide
cagttcgtgcggttcgacagccacg

SEQ ID NO: 7205 - DNA, 25 bp, Artificial Sequence
  Description of Artificial Sequence: Synthetic oligonucleotide
agttcgtgcggttcgacagccacgc

SEQ ID NO: 7206 - DNA, 24 bp, Artificial Sequence
  Description of Artificial Sequence: Synthetic oligonucleotide
gttcgtgcggttcgacagccacgc

SEQ ID NO: 7207 - DNA, 24 bp, Artificial Sequence
  Description of Artificial Sequence: Synthetic oligonucleotide
ttcgtgcggttcgacagccacgcc

SEQ ID NO: 7208 - DNA, 23 bp, Artificial Sequence
  Description of Artificial Sequence: Synthetic oligonucleotide
tcgtgcggttcgacagccacgcc

SEQ ID NO: 7209 - DNA, 22 bp, Artificial Sequence
  Description of Artificial Sequence: Synthetic oligonucleotide
cgtgcggttcgacagccacgcc

SEQ ID NO: 7210 - DNA, 22 bp, Artificial Sequence
  Description of Artificial Sequence: Synthetic oligonucleotide
gtgcggttcgacagccacgccg

SEQ ID NO: 7211 - DNA, 22 bp, Artificial Sequence
  Description of Artificial Sequence: Synthetic oligonucleotide
tgcggttcgacagccacgccgc

SEQ ID NO: 7212 - DNA, 21 bp, Artificial Sequence
  Description of Artificial Sequence: Synthetic oligonucleotide
gcggttcgacagccacgccgc

SEQ ID NO: 7213 - DNA, 22 bp, Artificial Sequence
  Description of Artificial Sequence: Synthetic oligonucleotide
cggttcgacagccacgccgcga

SEQ ID NO: 7214 - DNA, 22 bp, Artificial Sequence
  Description of Artificial Sequence: Synthetic oligonucleotide
ggttcgacagccacgccgcgag

SEQ ID NO: 7215 - DNA, 22 bp, Artificial Sequence
  Description of Artificial Sequence: Synthetic oligonucleotide
gttcgacagccacgccgcgagc

SEQ ID NO: 7216 - DNA, 23 bp, Artificial Sequence
  Description of Artificial Sequence: Synthetic oligonucleotide
ttcgacagccacgccgcgagcca

SEQ ID NO: 7217 - DNA, 22 bp, Artificial Sequence
  Description of Artificial Sequence: Synthetic oligonucleotide
tcgacagccacgccgcgagcca

SEQ ID NO: 7218 - DNA, 21 bp, Artificial Sequence
  Description of Artificial Sequence: Synthetic oligonucleotide
cgacagccacgccgcgagcca

SEQ ID NO: 7219 - DNA, 22 bp, Artificial Sequence
  Description of Artificial Sequence: Synthetic oligonucleotide
gacagccacgccgcgagccaga

SEQ ID NO: 7220 - DNA, 22 bp, Artificial Sequence
  Description of Artificial Sequence: Synthetic oligonucleotide
acagccacgccgcgagccagag

SEQ ID NO: 7221 - DNA, 21 bp, Artificial Sequence
  Description of Artificial Sequence: Synthetic oligonucleotide
cagccacgccgcgagccagag

SEQ ID NO: 7222 - DNA, 23 bp, Artificial Sequence
  Description of Artificial Sequence: Synthetic oligonucleotide
agccacgccgcgagccagaggat

SEQ ID NO: 7223 - DNA, 22 bp, Artificial Sequence
  Description of Artificial Sequence: Synthetic oligonucleotide
gccacgccgcgagccagaggat

SEQ ID NO: 7224 - DNA, 22 bp, Artificial Sequence
  Description of Artificial Sequence: Synthetic oligonucleotide
ccacgccgcgagccagaggatg

SEQ ID NO: 7225 - DNA, 23 bp, Artificial Sequence
  Description of Artificial Sequence: Synthetic oligonucleotide
cacgccgcgagccagaggatgga

SEQ ID NO: 7226 - DNA, 25 bp, Artificial Sequence
  Description of Artificial Sequence: Synthetic oligonucleotide
ggcccatgtggcggagcagttgaca

SEQ ID NO: 7227 - DNA, 25 bp, Artificial Sequence
  Description of Artificial Sequence: Synthetic oligonucleotide
gcccatgtggcggagcagttgacag

SEQ ID NO: 7228 - DNA, 25 bp, Artificial Sequence
  Description of Artificial Sequence: Synthetic oligonucleotide
cccatgtggcggagcagttgacagc

SEQ ID NO: 7229 - DNA, 27 bp, Artificial Sequence
  Description of Artificial Sequence: Synthetic oligonucleotide
ccatgtggcggagcagttgacagccta

SEQ ID NO: 7230 - DNA, 27 bp, Artificial Sequence
  Description of Artificial Sequence: Synthetic oligonucleotide
catgtggcggagcagttgacagcctac

SEQ ID NO: 7231 - DNA, 27 bp, Artificial Sequence
  Description of Artificial Sequence: Synthetic oligonucleotide
atgtggcggagcagttgacagcctacc

SEQ ID NO: 7232 - DNA, 27 bp, Artificial Sequence
  Description of Artificial Sequence: Synthetic oligonucleotide
tgtggcggagcagttgacagcctacct

SEQ ID NO: 7233 - DNA, 26 bp, Artificial Sequence
  Description of Artificial Sequence: Synthetic oligonucleotide
gtggcggagcagttgacagcctacct

SEQ ID NO: 7234 - DNA, 26 bp, Artificial Sequence
  Description of Artificial Sequence: Synthetic oligonucleotide
tggcggagcagttgacagcctacctg

SEQ ID NO: 7235 - DNA, 25 bp, Artificial Sequence
  Description of Artificial Sequence: Synthetic oligonucleotide
ggcggagcagttgacagcctacctg

SEQ ID NO: 7236 - DNA, 26 bp, Artificial Sequence
  Description of Artificial Sequence: Synthetic oligonucleotide
gcggagcagttgacagcctacctgga

SEQ ID NO: 7237 - DNA, 26 bp, Artificial Sequence
  Description of Artificial Sequence: Synthetic oligonucleotide
cggagcagttgacagcctacctggag

SEQ ID NO: 7238 - DNA, 26 bp, Artificial Sequence
  Description of Artificial Sequence: Synthetic oligonucleotide
ggagcagttgacagcctacctggagg

SEQ ID NO: 7239 - DNA, 26 bp, Artificial Sequence
  Description of Artificial Sequence: Synthetic oligonucleotide
gagcagttgacagcctacctggaggg

SEQ ID NO: 7240 - DNA, 27 bp, Artificial Sequence
  Description of Artificial Sequence: Synthetic oligonucleotide
agcagttgacagcctacctggagggca

SEQ ID NO: 7241 - DNA, 26 bp, Artificial Sequence
  Description of Artificial Sequence: Synthetic oligonucleotide
gcagttgacagcctacctggagggca

SEQ ID NO: 7242 - DNA, 26 bp, Artificial Sequence
  Description of Artificial Sequence: Synthetic oligonucleotide
cagttgacagcctacctggagggcac

SEQ ID NO: 7243 - DNA, 27 bp, Artificial Sequence
  Description of Artificial Sequence: Synthetic oligonucleotide
agttgacagcctacctggagggcacgt

SEQ ID NO: 7244 - DNA, 26 bp, Artificial Sequence
  Description of Artificial Sequence: Synthetic oligonucleotide
gttgacagcctacctggagggcacgt

SEQ ID NO: 7245 - DNA, 26 bp, Artificial Sequence
  Description of Artificial Sequence: Synthetic oligonucleotide
ttgacagcctacctggagggcacgtg

SEQ ID NO: 7246 - DNA, 25 bp, Artificial Sequence
  Description of Artificial Sequence: Synthetic oligonucleotide
tgacagcctacctggagggcacgtg

SEQ ID NO: 7247 - DNA, 24 bp, Artificial Sequence
  Description of Artificial Sequence: Synthetic oligonucleotide
gacagcctacctggagggcacgtg

SEQ ID NO: 7248 - DNA, 24 bp, Artificial Sequence
  Description of Artificial Sequence: Synthetic oligonucleotide
acagcctacctggagggcacgtgc

SEQ ID NO: 7249 - DNA, 23 bp, Artificial Sequence
  Description of Artificial Sequence: Synthetic oligonucleotide
cagcctacctggagggcacgtgc

SEQ ID NO: 7250 - DNA, 27 bp, Artificial Sequence
  Description of Artificial Sequence: Synthetic oligonucleotide
caaccagagcgaggccggttctcacat

SEQ ID NO: 7251 - DNA, 27 bp, Artificial Sequence
  Description of Artificial Sequence: Synthetic oligonucleotide
aaccagagcgaggccggttctcacatc

SEQ ID NO: 7252 - DNA, 26 bp, Artificial Sequence
  Description of Artificial Sequence: Synthetic oligonucleotide
accagagcgaggccggttctcacatc

SEQ ID NO: 7253 - DNA, 25 bp, Artificial Sequence
  Description of Artificial Sequence: Synthetic oligonucleotide
ccagagcgaggccggttctcacatc

SEQ ID NO: 7254 - DNA, 26 bp, Artificial Sequence
  Description of Artificial Sequence: Synthetic oligonucleotide
cagagcgaggccggttctcacatcgt

SEQ ID NO: 7255 - DNA, 26 bp, Artificial Sequence
  Description of Artificial Sequence: Synthetic oligonucleotide
agagcgaggccggttctcacatcgtc

SEQ ID NO: 7256 - DNA, 25 bp, Artificial Sequence
  Description of Artificial Sequence: Synthetic oligonucleotide
gagcgaggccggttctcacatcgtc

SEQ ID NO: 7257 - DNA, 26 bp, Artificial Sequence
  Description of Artificial Sequence: Synthetic oligonucleotide
agcgaggccggttctcacatcgtcca

SEQ ID NO: 7258 - DNA, 25 bp, Artificial Sequence
  Description of Artificial Sequence: Synthetic oligonucleotide
gcgaggccggttctcacatcgtcca

SEQ ID NO: 7259 - DNA, 26 bp, Artificial Sequence
  Description of Artificial Sequence: Synthetic oligonucleotide
cgaggccggttctcacatcgtccaga

SEQ ID NO: 7260 - DNA, 26 bp, Artificial Sequence
  Description of Artificial Sequence: Synthetic oligonucleotide
gaggccggttctcacatcgtccagag

SEQ ID NO: 7261 - DNA, 27 bp, Artificial Sequence
  Description of Artificial Sequence: Synthetic oligonucleotide
aggccggttctcacatcgtccagagga

SEQ ID NO: 7262 - DNA, 27 bp, Artificial Sequence
  Description of Artificial Sequence: Synthetic oligonucleotide
ggccggttctcacatcgtccagaggat

SEQ ID NO: 7263 - DNA, 27 bp, Artificial Sequence
  Description of Artificial Sequence: Synthetic oligonucleotide
gccggttctcacatcgtccagaggatg

SEQ ID NO: 7264 - DNA, 30 bp, Artificial Sequence
  Description of Artificial Sequence: Synthetic oligonucleotide
ccggttctcacatcgtccagaggatgtatg

SEQ ID NO: 7265 - DNA, 30 bp, Artificial Sequence
  Description of Artificial Sequence: Synthetic oligonucleotide
cggttctcacatcgtccagaggatgtatgg

SEQ ID NO: 7266 - DNA, 30 bp, Artificial Sequence
  Description of Artificial Sequence: Synthetic oligonucleotide
ggttctcacatcgtccagaggatgtatggc

SEQ ID NO: 7267 - DNA, 31 bp, Artificial Sequence
  Description of Artificial Sequence: Synthetic oligonucleotide
gttctcacatcgtccagaggatgtatggctg

SEQ ID NO: 7268 - DNA, 31 bp, Artificial Sequence
  Description of Artificial Sequence: Synthetic oligonucleotide
ttctcacatcgtccagaggatgtatggctgc

SEQ ID NO: 7269 - DNA, 30 bp, Artificial Sequence
  Description of Artificial Sequence: Synthetic oligonucleotide
tctcacatcgtccagaggatgtatggctgc

SEQ ID NO: 7270 - DNA, 29 bp, Artificial Sequence
  Description of Artificial Sequence: Synthetic oligonucleotide
ctcacatcgtccagaggatgtatggctgc

SEQ ID NO: 7271 - DNA, 29 bp, Artificial Sequence
  Description of Artificial Sequence: Synthetic oligonucleotide
tcacatcgtccagaggatgtatggctgcg

SEQ ID NO: 7272 - DNA, 28 bp, Artificial Sequence
  Description of Artificial Sequence: Synthetic oligonucleotide
cacatcgtccagaggatgtatggctgcg

SEQ ID NO: 7273 - DNA, 29 bp, Artificial Sequence
  Description of Artificial Sequence: Synthetic oligonucleotide
acatcgtccagaggatgtatggctgcgac

SEQ ID NO: 7274 - DNA, 28 bp, Artificial Sequence
  Description of Artificial Sequence: Synthetic oligonucleotide
catcgtccagaggatgtatggctgcgac

SEQ ID NO: 7275 - DNA, 28 bp, Artificial Sequence
  Description of Artificial Sequence: Synthetic oligonucleotide
atcgtccagaggatgtatggctgcgacg

SEQ ID NO: 7276 - DNA, 27 bp, Artificial Sequence
  Description of Artificial Sequence: Synthetic oligonucleotide
tcgtccagaggatgtatggctgcgacg

SEQ ID NO: 7277 - DNA, 27 bp, Artificial Sequence
  Description of Artificial Sequence: Synthetic oligonucleotide
gaaggcccactcacagactcaccgaga

SEQ ID NO: 7278 - DNA, 27 bp, Artificial Sequence
  Description of Artificial Sequence: Synthetic oligonucleotide
aaggcccactcacagactcaccgagag

SEQ ID NO: 7279 - DNA, 26 bp, Artificial Sequence
  Description of Artificial Sequence: Synthetic oligonucleotide
aggcccactcacagactcaccgagag

SEQ ID NO: 7280 - DNA, 25 bp, Artificial Sequence
  Description of Artificial Sequence: Synthetic oligonucleotide
ggcccactcacagactcaccgagag

SEQ ID NO: 7281 - DNA, 26 bp, Artificial Sequence
  Description of Artificial Sequence: Synthetic oligonucleotide
gcccactcacagactcaccgagagga

SEQ ID NO: 7282 - DNA, 26 bp, Artificial Sequence
  Description of Artificial Sequence: Synthetic oligonucleotide
cccactcacagactcaccgagaggac

SEQ ID NO: 7283 - DNA, 27 bp, Artificial Sequence
  Description of Artificial Sequence: Synthetic oligonucleotide
ccactcacagactcaccgagaggacct

SEQ ID NO: 7284 - DNA, 27 bp, Artificial Sequence
  Description of Artificial Sequence: Synthetic oligonucleotide
cactcacagactcaccgagaggacctg

SEQ ID NO: 7285 - DNA, 27 bp, Artificial Sequence
  Description of Artificial Sequence: Synthetic oligonucleotide
actcacagactcaccgagaggacctgg

SEQ ID NO: 7286 - DNA, 26 bp, Artificial Sequence
  Description of Artificial Sequence: Synthetic oligonucleotide
ctcacagactcaccgagaggacctgg

SEQ ID NO: 7287 - DNA, 26 bp, Artificial Sequence
  Description of Artificial Sequence: Synthetic oligonucleotide
tcacagactcaccgagaggacctggg

SEQ ID NO: 7288 - DNA, 25 bp, Artificial Sequence
  Description of Artificial Sequence: Synthetic oligonucleotide
cacagactcaccgagaggacctggg

SEQ ID NO: 7289 - DNA, 26 bp, Artificial Sequence
  Description of Artificial Sequence: Synthetic oligonucleotide
acagactcaccgagaggacctgggga

SEQ ID NO: 7290 - DNA, 25 bp, Artificial Sequence
  Description of Artificial Sequence: Synthetic oligonucleotide
cagactcaccgagaggacctgggga

SEQ ID NO: 7291 - DNA, 25 bp, Artificial Sequence
  Description of Artificial Sequence: Synthetic oligonucleotide
agactcaccgagaggacctggggac

SEQ ID NO: 7292 - DNA, 24 bp, Artificial Sequence
  Description of Artificial Sequence: Synthetic oligonucleotide
gactcaccgagaggacctggggac

SEQ ID NO: 7293 - DNA, 24 bp, Artificial Sequence
  Description of Artificial Sequence: Synthetic oligonucleotide
actcaccgagaggacctggggacc

SEQ ID NO: 7294 - DNA, 23 bp, Artificial Sequence
  Description of Artificial Sequence: Synthetic oligonucleotide
ctcaccgagaggacctggggacc

SEQ ID NO: 7295 - DNA, 24 bp, Artificial Sequence
  Description of Artificial Sequence: Synthetic oligonucleotide
tcaccgagaggacctggggaccct

SEQ ID NO: 7296 - DNA, 23 bp, Artificial Sequence
  Description of Artificial Sequence: Synthetic oligonucleotide
caccgagaggacctggggaccct

SEQ ID NO: 7297 - DNA, 23 bp, Artificial Sequence
  Description of Artificial Sequence: Synthetic oligonucleotide
accgagaggacctggggaccctg

SEQ ID NO: 7298 - DNA, 22 bp, Artificial Sequence
  Description of Artificial Sequence: Synthetic oligonucleotide
ccgagaggacctggggaccctg

SEQ ID NO: 7299 - DNA, 22 bp, Artificial Sequence
  Description of Artificial Sequence: Synthetic oligonucleotide
cgagaggacctggggaccctgc

SEQ ID NO: 7300 - DNA, 22 bp, Artificial Sequence
  Description of Artificial Sequence: Synthetic oligonucleotide
gagaggacctggggaccctgcg

SEQ ID NO: 7301 - DNA, 22 bp, Artificial Sequence
  Description of Artificial Sequence: Synthetic oligonucleotide
agaggacctggggaccctgcgc

SEQ ID NO: 7302 - DNA, 21 bp, Artificial Sequence
  Description of Artificial Sequence: Synthetic oligonucleotide
gaggacctggggaccctgcgc

SEQ ID NO: 7303 - DNA, 21 bp, Artificial Sequence
  Description of Artificial Sequence: Synthetic oligonucleotide
aggacctggggaccctgcgcg

SEQ ID NO: 7304 - DNA, 27 bp, Artificial Sequence
  Description of Artificial Sequence: Synthetic oligonucleotide
agcaggagaggcctgagtattgggacg

SEQ ID NO: 7305 - DNA, 26 bp, Artificial Sequence
  Description of Artificial Sequence: Synthetic oligonucleotide
gcaggagaggcctgagtattgggacg

SEQ ID NO: 7306 - DNA, 26 bp, Artificial Sequence
  Description of Artificial Sequence: Synthetic oligonucleotide
caggagaggcctgagtattgggacgg

SEQ ID NO: 7307 - DNA, 26 bp, Artificial Sequence
  Description of Artificial Sequence: Synthetic oligonucleotide
aggagaggcctgagtattgggacggg

SEQ ID NO: 7308 - DNA, 25 bp, Artificial Sequence
  Description of Artificial Sequence: Synthetic oligonucleotide
ggagaggcctgagtattgggacggg

SEQ ID NO: 7309 - DNA, 26 bp, Artificial Sequence
  Description of Artificial Sequence: Synthetic oligonucleotide
gagaggcctgagtattgggacgggga

SEQ ID NO: 7310 - DNA, 27 bp, Artificial Sequence
  Description of Artificial Sequence: Synthetic oligonucleotide
agaggcctgagtattgggacggggaga

SEQ ID NO: 7311 - DNA, 26 bp, Artificial Sequence
  Description of Artificial Sequence: Synthetic oligonucleotide
gaggcctgagtattgggacggggaga

SEQ ID NO: 7312 - DNA, 27 bp, Artificial Sequence
  Description of Artificial Sequence: Synthetic oligonucleotide
aggcctgagtattgggacggggagaca

SEQ ID NO: 7313 - DNA, 26 bp, Artificial Sequence
  Description of Artificial Sequence: Synthetic oligonucleotide
ggcctgagtattgggacggggagaca

SEQ ID NO: 7314 - DNA, 26 bp, Artificial Sequence
  Description of Artificial Sequence: Synthetic oligonucleotide
gcctgagtattgggacggggagacac

SEQ ID NO: 7315 - DNA, 26 bp, Artificial Sequence
  Description of Artificial Sequence: Synthetic oligonucleotide
cctgagtattgggacggggagacacg

SEQ ID NO: 7316 - DNA, 27 bp, Artificial Sequence
  Description of Artificial Sequence: Synthetic oligonucleotide
ctgagtattgggacggggagacacgga

SEQ ID NO: 7317 - DNA, 29 bp, Artificial Sequence
  Description of Artificial Sequence: Synthetic oligonucleotide
tgagtattgggacggggagacacggaaag

SEQ ID NO: 7318 - DNA, 27 bp, Artificial Sequence
  Description of Artificial Sequence: Synthetic oligonucleotide
cttcatcgcagtgggctacgtggacca

SEQ ID NO: 7319 - DNA, 27 bp, Artificial Sequence
  Description of Artificial Sequence: Synthetic oligonucleotide
ttcatcgcagtgggctacgtggaccac

SEQ ID NO: 7320 - DNA, 27 bp, Artificial Sequence
  Description of Artificial Sequence: Synthetic oligonucleotide
tcatcgcagtgggctacgtggaccaca

SEQ ID NO: 7321 - DNA, 26 bp, Artificial Sequence
  Description of Artificial Sequence: Synthetic oligonucleotide
catcgcagtgggctacgtggaccaca

SEQ ID NO: 7322 - DNA, 26 bp, Artificial Sequence
  Description of Artificial Sequence: Synthetic oligonucleotide
atcgcagtgggctacgtggaccacac

SEQ ID NO: 7323 - DNA, 25 bp, Artificial Sequence
  Description of Artificial Sequence: Synthetic oligonucleotide
tcgcagtgggctacgtggaccacac

SEQ ID NO: 7324 - DNA, 24 bp, Artificial Sequence
  Description of Artificial Sequence: Synthetic oligonucleotide
cgcagtgggctacgtggaccacac

SEQ ID NO: 7325 - DNA, 24 bp, Artificial Sequence
  Description of Artificial Sequence: Synthetic oligonucleotide
gcagtgggctacgtggaccacacg

SEQ ID NO: 7326 - DNA, 25 bp, Artificial Sequence
  Description of Artificial Sequence: Synthetic oligonucleotide
cagtgggctacgtggaccacacgca

SEQ ID NO: 7327 - DNA, 27 bp, Artificial Sequence
  Description of Artificial Sequence: Synthetic oligonucleotide
agtgggctacgtggaccacacgcagtt

SEQ ID NO: 7328 - DNA, 26 bp, Artificial Sequence
  Description of Artificial Sequence: Synthetic oligonucleotide
gtgggctacgtggaccacacgcagtt

SEQ ID NO: 7329 - DNA, 26 bp, Artificial Sequence
  Description of Artificial Sequence: Synthetic oligonucleotide
tgggctacgtggaccacacgcagttc

SEQ ID NO: 7330 - DNA, 25 bp, Artificial Sequence
  Description of Artificial Sequence: Synthetic oligonucleotide
gggctacgtggaccacacgcagttc

SEQ ID NO: 7331 - DNA, 26 bp, Artificial Sequence
  Description of Artificial Sequence: Synthetic oligonucleotide
ggctacgtggaccacacgcagttcgt

SEQ ID NO: 7332 - DNA, 26 bp, Artificial Sequence
  Description of Artificial Sequence: Synthetic oligonucleotide
gctacgtggaccacacgcagttcgtg

SEQ ID NO: 7333 - DNA, 26 bp, Artificial Sequence
  Description of Artificial Sequence: Synthetic oligonucleotide
ctacgtggaccacacgcagttcgtgc

SEQ ID NO: 7334 - DNA, 26 bp, Artificial Sequence
  Description of Artificial Sequence: Synthetic oligonucleotide
tacgtggaccacacgcagttcgtgcg

SEQ ID NO: 7335 - DNA, 25 bp, Artificial Sequence
  Description of Artificial Sequence: Synthetic oligonucleotide
acgtggaccacacgcagttcgtgcg

SEQ ID NO: 7336 - DNA, 24 bp, Artificial Sequence
  Description of Artificial Sequence: Synthetic oligonucleotide
cgtggaccacacgcagttcgtgcg

SEQ ID NO: 7337 - DNA, 26 bp, Artificial Sequence
  Description of Artificial Sequence: Synthetic oligonucleotide
gtggaccacacgcagttcgtgcggtt

SEQ ID NO: 7338 - DNA, 26 bp, Artificial Sequence
  Description of Artificial Sequence: Synthetic oligonucleotide
tggaccacacgcagttcgtgcggttc

SEQ ID NO: 7339 - DNA, 25 bp, Artificial Sequence
  Description of Artificial Sequence: Synthetic oligonucleotide
ggaccacacgcagttcgtgcggttc

SEQ ID NO: 7340 - DNA, 26 bp, Artificial Sequence
  Description of Artificial Sequence: Synthetic oligonucleotide
gaccacacgcagttcgtgcggttcga

SEQ ID NO: 7341 - DNA, 27 bp, Artificial Sequence
  Description of Artificial Sequence: Synthetic oligonucleotide
accacacgcagttcgtgcggttcgaca

SEQ ID NO: 7342 - DNA, 26 bp, Artificial Sequence
  Description of Artificial Sequence: Synthetic oligonucleotide
ccacacgcagttcgtgcggttcgaca

SEQ ID NO: 7343 - DNA, 26 bp, Artificial Sequence
  Description of Artificial Sequence: Synthetic oligonucleotide
cacacgcagttcgtgcggttcgacag

SEQ ID NO: 7344 - DNA, 23 bp, Artificial Sequence
  Description of Artificial Sequence: Synthetic oligonucleotide
tgcgacgtggggtcggactggca

SEQ ID NO: 7345 - DNA, 22 bp, Artificial Sequence
  Description of Artificial Sequence: Synthetic oligonucleotide
gcgacgtggggtcggactggca

SEQ ID NO: 7346 - DNA, 24 bp, Artificial Sequence
  Description of Artificial Sequence: Synthetic oligonucleotide
cgacgtggggtcggactggcactt

SEQ ID NO: 7347 - DNA, 24 bp, Artificial Sequence
  Description of Artificial Sequence: Synthetic oligonucleotide
gacgtggggtcggactggcacttc

SEQ ID NO: 7348 - DNA, 25 bp, Artificial Sequence
  Description of Artificial Sequence: Synthetic oligonucleotide
acgtggggtcggactggcacttcct

SEQ ID NO: 7349 - DNA, 24 bp, Artificial Sequence
  Description of Artificial Sequence: Synthetic oligonucleotide
cgtggggtcggactggcacttcct

SEQ ID NO: 7350 - DNA, 24 bp, Artificial Sequence
  Description of Artificial Sequence: Synthetic oligonucleotide
gtggggtcggactggcacttcctc

SEQ ID NO: 7351 - DNA, 24 bp, Artificial Sequence
  Description of Artificial Sequence: Synthetic oligonucleotide
tggggtcggactggcacttcctcc

SEQ ID NO: 7352 - DNA, 23 bp, Artificial Sequence
  Description of Artificial Sequence: Synthetic oligonucleotide
ggggtcggactggcacttcctcc

SEQ ID NO: 7353 - DNA, 23 bp, Artificial Sequence
  Description of Artificial Sequence: Synthetic oligonucleotide
gggtcggactggcacttcctccg

SEQ ID NO: 7354 - DNA, 23 bp, Artificial Sequence
  Description of Artificial Sequence: Synthetic oligonucleotide
ggtcggactggcacttcctccgc

SEQ ID NO: 7355 - DNA, 23 bp, Artificial Sequence
  Description of Artificial Sequence: Synthetic oligonucleotide
gtcggactggcacttcctccgcg

SEQ ID NO: 7356 - DNA, 23 bp, Artificial Sequence
  Description of Artificial Sequence: Synthetic oligonucleotide
tcggactggcacttcctccgcgg

SEQ ID NO: 7357 - DNA, 22 bp, Artificial Sequence
  Description of Artificial Sequence: Synthetic oligonucleotide
cggactggcacttcctccgcgg

SEQ ID NO: 7358 - DNA, 24 bp, Artificial Sequence
  Description of Artificial Sequence: Synthetic oligonucleotide
ggactggcacttcctccgcgggta

SEQ ID NO: 7359 - DNA, 24 bp, Artificial Sequence
  Description of Artificial Sequence: Synthetic oligonucleotide
gactggcacttcctccgcgggtac

SEQ ID NO: 7360 - DNA, 25 bp, Artificial Sequence
  Description of Artificial Sequence: Synthetic oligonucleotide
actggcacttcctccgcgggtacca

SEQ ID NO: 7361 - DNA, 24 bp, Artificial Sequence
  Description of Artificial Sequence: Synthetic oligonucleotide
ctggcacttcctccgcgggtacca

SEQ ID NO: 7362 - DNA, 24 bp, Artificial Sequence
  Description of Artificial Sequence: Synthetic oligonucleotide
tggcacttcctccgcgggtaccac

SEQ ID NO: 7363 - DNA, 23 bp, Artificial Sequence
  Description of Artificial Sequence: Synthetic oligonucleotide
ggcacttcctccgcgggtaccac

SEQ ID NO: 7364 - DNA, 24 bp, Artificial Sequence
  Description of Artificial Sequence: Synthetic oligonucleotide
gcacttcctccgcgggtaccacca

SEQ ID NO: 7365 - DNA, 26 bp, Artificial Sequence
  Description of Artificial Sequence: Synthetic oligonucleotide
cacttcctccgcgggtaccaccagta

SEQ ID NO: 7366 - DNA, 26 bp, Artificial Sequence
  Description of Artificial Sequence: Synthetic oligonucleotide
acttcctccgcgggtaccaccagtac

SEQ ID NO: 7367 - DNA, 25 bp, Artificial Sequence
  Description of Artificial Sequence: Synthetic oligonucleotide
cgcttcctccgcgggtatgaccagt

SEQ ID NO: 7368 - DNA, 25 bp, Artificial Sequence
  Description of Artificial Sequence: Synthetic oligonucleotide
gcttcctccgcgggtatgaccagtc

SEQ ID NO: 7369 - DNA, 25 bp, Artificial Sequence
  Description of Artificial Sequence: Synthetic oligonucleotide
cttcctccgcgggtatgaccagtcc

SEQ ID NO: 7370 - DNA, 25 bp, Artificial Sequence
  Description of Artificial Sequence: Synthetic oligonucleotide
ttcctccgcgggtatgaccagtccg

SEQ ID NO: 7371 - DNA, 24 bp, Artificial Sequence
  Description of Artificial Sequence: Synthetic oligonucleotide
tcctccgcgggtatgaccagtccg

SEQ ID NO: 7372 - DNA, 23 bp, Artificial Sequence
  Description of Artificial Sequence: Synthetic oligonucleotide
cctccgcgggtatgaccagtccg

SEQ ID NO: 7373 - DNA, 23 bp, Artificial Sequence
  Description of Artificial Sequence: Synthetic oligonucleotide
ctccgcgggtatgaccagtccgc

SEQ ID NO: 7374 - DNA, 25 bp, Artificial Sequence
  Description of Artificial Sequence: Synthetic oligonucleotide
tccgcgggtatgaccagtccgccta

SEQ ID NO: 7375 - DNA, 24 bp, Artificial Sequence
  Description of Artificial Sequence: Synthetic oligonucleotide
ccgcgggtatgaccagtccgccta

SEQ ID NO: 7376 - DNA, 24 bp, Artificial Sequence
  Description of Artificial Sequence: Synthetic oligonucleotide
cgcgggtatgaccagtccgcctac

SEQ ID NO: 7377 - DNA, 25 bp, Artificial Sequence
  Description of Artificial Sequence: Synthetic oligonucleotide
gcgggtatgaccagtccgcctacga

SEQ ID NO: 7378 - DNA, 25 bp, Artificial Sequence
  Description of Artificial Sequence: Synthetic oligonucleotide
cgggtatgaccagtccgcctacgac

SEQ ID NO: 7379 - DNA, 25 bp, Artificial Sequence
  Description of Artificial Sequence: Synthetic oligonucleotide
gggtatgaccagtccgcctacgacg

SEQ ID NO: 7380 - DNA, 25 bp, Artificial Sequence
  Description of Artificial Sequence: Synthetic oligonucleotide
ggtatgaccagtccgcctacgacgg

SEQ ID NO: 7381 - DNA, 27 bp, Artificial Sequence
  Description of Artificial Sequence: Synthetic oligonucleotide
gtatgaccagtccgcctacgacggcaa

SEQ ID NO: 7382 - DNA, 27 bp, Artificial Sequence
  Description of Artificial Sequence: Synthetic oligonucleotide
tatgaccagtccgcctacgacggcaag

SEQ ID NO: 7383 - DNA, 26 bp, Artificial Sequence
  Description of Artificial Sequence: Synthetic oligonucleotide
atgaccagtccgcctacgacggcaag

SEQ ID NO: 7384 - DNA, 25 bp, Artificial Sequence
  Description of Artificial Sequence: Synthetic oligonucleotide
tgaccagtccgcctacgacggcaag

SEQ ID NO: 7385 - DNA, 24 bp, Artificial Sequence
  Description of Artificial Sequence: Synthetic oligonucleotide
gaccagtccgcctacgacggcaag

SEQ ID NO: 7386 - DNA, 28 bp, Artificial Sequence
  Description of Artificial Sequence: Synthetic oligonucleotide
tgaaagaggacctgcgctcttggacctc

SEQ ID NO: 7387 - DNA, 27 bp, Artificial Sequence
  Description of Artificial Sequence: Synthetic oligonucleotide
gaaagaggacctgcgctcttggacctc

SEQ ID NO: 7388 - DNA, 27 bp, Artificial Sequence
  Description of Artificial Sequence: Synthetic oligonucleotide
aaagaggacctgcgctcttggacctcg

SEQ ID NO: 7389 - DNA, 26 bp, Artificial Sequence
  Description of Artificial Sequence: Synthetic oligonucleotide
aagaggacctgcgctcttggacctcg

SEQ ID NO: 7390 - DNA, 25 bp, Artificial Sequence
  Description of Artificial Sequence: Synthetic oligonucleotide
agaggacctgcgctcttggacctcg

SEQ ID NO: 7391 - DNA, 24 bp, Artificial Sequence
  Description of Artificial Sequence: Synthetic oligonucleotide
gaggacctgcgctcttggacctcg

SEQ ID NO: 7392 - DNA, 24 bp, Artificial Sequence
  Description of Artificial Sequence: Synthetic oligonucleotide
aggacctgcgctcttggacctcgg

SEQ ID NO: 7393 - DNA, 23 bp, Artificial Sequence
  Description of Artificial Sequence: Synthetic oligonucleotide
ggacctgcgctcttggacctcgg

SEQ ID NO: 7394 - DNA, 23 bp, Artificial Sequence
  Description of Artificial Sequence: Synthetic oligonucleotide
gacctgcgctcttggacctcggc

SEQ ID NO: 7395 - DNA, 23 bp, Artificial Sequence
  Description of Artificial Sequence: Synthetic oligonucleotide
acctgcgctcttggacctcggcg

SEQ ID NO: 7396 - DNA, 22 bp, Artificial Sequence
  Description of Artificial Sequence: Synthetic oligonucleotide
cctgcgctcttggacctcggcg

SEQ ID NO: 7397 - DNA, 23 bp, Artificial Sequence
  Description of Artificial Sequence: Synthetic oligonucleotide
ctgcgctcttggacctcggcgga

SEQ ID NO: 7398 - DNA, 25 bp, Artificial Sequence
  Description of Artificial Sequence: Synthetic oligonucleotide
tgcgctcttggacctcggcggacat

SEQ ID NO: 7399 - DNA, 24 bp, Artificial Sequence
  Description of Artificial Sequence: Synthetic oligonucleotide
gcgctcttggacctcggcggacat

SEQ ID NO: 7400 - DNA, 24 bp, Artificial Sequence
  Description of Artificial Sequence: Synthetic oligonucleotide
cgctcttggacctcggcggacatg

SEQ ID NO: 7401 - DNA, 24 bp, Artificial Sequence
  Description of Artificial Sequence: Synthetic oligonucleotide
gctcttggacctcggcggacatgg

SEQ ID NO: 7402 - DNA, 25 bp, Artificial Sequence
  Description of Artificial Sequence: Synthetic oligonucleotide
ctcttggacctcggcggacatggca

SEQ ID NO: 7403 - DNA, 25 bp, Artificial Sequence
  Description of Artificial Sequence: Synthetic oligonucleotide
tcttggacctcggcggacatggcag

SEQ ID NO: 7404 - DNA, 24 bp, Artificial Sequence
  Description of Artificial Sequence: Synthetic oligonucleotide
cttggacctcggcggacatggcag

SEQ ID NO: 7405 - DNA, 25 bp, Artificial Sequence
  Description of Artificial Sequence: Synthetic oligonucleotide
ttggacctcggcggacatggcagct

SEQ ID NO: 7406 - DNA, 24 bp, Artificial Sequence
  Description of Artificial Sequence: Synthetic oligonucleotide
tggacctcggcggacatggcagct

SEQ ID NO: 7407 - DNA, 23 bp, Artificial Sequence
  Description of Artificial Sequence: Synthetic oligonucleotide
ggacctcggcggacatggcagct

SEQ ID NO: 7408 - DNA, 24 bp, Artificial Sequence
  Description of Artificial Sequence: Synthetic oligonucleotide
gacctcggcggacatggcagctca

SEQ ID NO: 7409 - DNA, 25 bp, Artificial Sequence
  Description of Artificial Sequence: Synthetic oligonucleotide
acctcggcggacatggcagctcaga

SEQ ID NO: 7410 - DNA, 24 bp, Artificial Sequence
  Description of Artificial Sequence: Synthetic oligonucleotide
cctcggcggacatggcagctcaga

SEQ ID NO: 7411 - DNA, 24 bp, Artificial Sequence
  Description of Artificial Sequence: Synthetic oligonucleotide
ctcggcggacatggcagctcagac

SEQ ID NO: 7412 - DNA, 25 bp, Artificial Sequence
  Description of Artificial Sequence: Synthetic oligonucleotide
tcggcggacatggcagctcagacca

SEQ ID NO: 7413 - DNA, 26 bp, Artificial Sequence
  Description of Artificial Sequence: Synthetic oligonucleotide
gcggacatggcggctcagatcaccaa

SEQ ID NO: 7414 - DNA, 26 bp, Artificial Sequence
  Description of Artificial Sequence: Synthetic oligonucleotide
cggacatggcggctcagatcaccaag

SEQ ID NO: 7415 - DNA, 26 bp, Artificial Sequence
  Description of Artificial Sequence: Synthetic oligonucleotide
ggacatggcggctcagatcaccaagc

SEQ ID NO: 7416 - DNA, 26 bp, Artificial Sequence
  Description of Artificial Sequence: Synthetic oligonucleotide
gacatggcggctcagatcaccaagcg

SEQ ID NO: 7417 - DNA, 27 bp, Artificial Sequence
  Description of Artificial Sequence: Synthetic oligonucleotide
acatggcggctcagatcaccaagcgca

SEQ ID NO: 7418 - DNA, 27 bp, Artificial Sequence
  Description of Artificial Sequence: Synthetic oligonucleotide
catggcggctcagatcaccaagcgcaa

SEQ ID NO: 7419 - DNA, 27 bp, Artificial Sequence
  Description of Artificial Sequence: Synthetic oligonucleotide
atggcggctcagatcaccaagcgcaag

SEQ ID NO: 7420 - DNA, 27 bp, Artificial Sequence
  Description of Artificial Sequence: Synthetic oligonucleotide
tggcggctcagatcaccaagcgcaagt

SEQ ID NO: 7421 - DNA, 26 bp, Artificial Sequence
  Description of Artificial Sequence: Synthetic oligonucleotide
ggcggctcagatcaccaagcgcaagt

SEQ ID NO: 7422 - DNA, 26 bp, Artificial Sequence
  Description of Artificial Sequence: Synthetic oligonucleotide
gcggctcagatcaccaagcgcaagtg

SEQ ID NO: 7423 - DNA, 26 bp, Artificial Sequence
  Description of Artificial Sequence: Synthetic oligonucleotide
cggctcagatcaccaagcgcaagtgg

SEQ ID NO: 7424 - DNA, 27 bp, Artificial Sequence
  Description of Artificial Sequence: Synthetic oligonucleotide
ggctcagatcaccaagcgcaagtggga

SEQ ID NO: 7425 - DNA, 25 bp, Artificial Sequence
  Description of Artificial Sequence: Synthetic oligonucleotide
gacatggcagctcagaccacccagc

SEQ ID NO: 7426 - DNA, 25 bp, Artificial Sequence
  Description of Artificial Sequence: Synthetic oligonucleotide
acatggcagctcagaccacccagcg

SEQ ID NO: 7427 - DNA, 24 bp, Artificial Sequence
  Description of Artificial Sequence: Synthetic oligonucleotide
catggcagctcagaccacccagcg

SEQ ID NO: 7428 - DNA, 26 bp, Artificial Sequence
  Description of Artificial Sequence: Synthetic oligonucleotide
atggcagctcagaccacccagcgcaa

SEQ ID NO: 7429 - DNA, 25 bp, Artificial Sequence
  Description of Artificial Sequence: Synthetic oligonucleotide
tggcagctcagaccacccagcgcaa

SEQ ID NO: 7430 - DNA, 24 bp, Artificial Sequence
  Description of Artificial Sequence: Synthetic oligonucleotide
ggcagctcagaccacccagcgcaa

SEQ ID NO: 7431 - DNA, 25 bp, Artificial Sequence
  Description of Artificial Sequence: Synthetic oligonucleotide
gcagctcagaccacccagcgcaagt

SEQ ID NO: 7432 - DNA, 25 bp, Artificial Sequence
  Description of Artificial Sequence: Synthetic oligonucleotide
cagctcagaccacccagcgcaagtg

SEQ ID NO: 7433 - DNA, 25 bp, Artificial Sequence
  Description of Artificial Sequence: Synthetic oligonucleotide
agctcagaccacccagcgcaagtgg

SEQ ID NO: 7434 - DNA, 24 bp, Artificial Sequence
  Description of Artificial Sequence: Synthetic oligonucleotide
gctcagaccacccagcgcaagtgg

SEQ ID NO: 7435 - DNA, 25 bp, Artificial Sequence
  Description of Artificial Sequence: Synthetic oligonucleotide
ctcagaccacccagcgcaagtggga

SEQ ID NO: 7436 - DNA, 25 bp, Artificial Sequence
  Description of Artificial Sequence: Synthetic oligonucleotide
tcagaccacccagcgcaagtgggag

SEQ ID NO: 7437 - DNA, 24 bp, Artificial Sequence
  Description of Artificial Sequence: Synthetic oligonucleotide
cagaccacccagcgcaagtgggag

SEQ ID NO: 7438 - DNA, 24 bp, Artificial Sequence
  Description of Artificial Sequence: Synthetic oligonucleotide
agaccacccagcgcaagtgggagg

SEQ ID NO: 7439 - DNA, 23 bp, Artificial Sequence
  Description of Artificial Sequence: Synthetic oligonucleotide
gaccacccagcgcaagtgggagg

SEQ ID NO: 7440 - DNA, 23 bp, Artificial Sequence
  Description of Artificial Sequence: Synthetic oligonucleotide
accacccagcgcaagtgggaggc

SEQ ID NO: 7441 - DNA, 22 bp, Artificial Sequence
  Description of Artificial Sequence: Synthetic oligonucleotide
ccacccagcgcaagtgggaggc

SEQ ID NO: 7442 - DNA, 23 bp, Artificial Sequence
  Description of Artificial Sequence: Synthetic oligonucleotide
agtggacctggggaccctgcgca

SEQ ID NO: 7443 - DNA, 22 bp, Artificial Sequence
  Description of Artificial Sequence: Synthetic oligonucleotide
gtggacctggggaccctgcgca

SEQ ID NO: 7444 - DNA, 22 bp, Artificial Sequence
  Description of Artificial Sequence: Synthetic oligonucleotide
tggacctggggaccctgcgcag

SEQ ID NO: 7445 - DNA, 21 bp, Artificial Sequence
  Description of Artificial Sequence: Synthetic oligonucleotide
ggacctggggaccctgcgcag

SEQ ID NO: 7446 - DNA, 23 bp, Artificial Sequence
  Description of Artificial Sequence: Synthetic oligonucleotide
gacctggggaccctgcgcagcta

SEQ ID NO: 7447 - DNA, 25 bp, Artificial Sequence
  Description of Artificial Sequence: Synthetic oligonucleotide
acctggggaccctgcgcagctacta

SEQ ID NO: 7448 - DNA, 24 bp, Artificial Sequence
  Description of Artificial Sequence: Synthetic oligonucleotide
cctggggaccctgcgcagctacta

SEQ ID NO: 7449 - DNA, 26 bp, Artificial Sequence
  Description of Artificial Sequence: Synthetic oligonucleotide
ctggggaccctgcgcagctactacaa

SEQ ID NO: 7450 - DNA, 26 bp, Artificial Sequence
  Description of Artificial Sequence: Synthetic oligonucleotide
tggggaccctgcgcagctactacaac

SEQ ID NO: 7451 - DNA, 25 bp, Artificial Sequence
  Description of Artificial Sequence: Synthetic oligonucleotide
ggggaccctgcgcagctactacaac

SEQ ID NO: 7452 - DNA, 26 bp, Artificial Sequence
  Description of Artificial Sequence: Synthetic oligonucleotide
gggaccctgcgcagctactacaacca

SEQ ID NO: 7453 - DNA, 27 bp, Artificial Sequence
  Description of Artificial Sequence: Synthetic oligonucleotide
ggaccctgcgcagctactacaaccaga

SEQ ID NO: 7454 - DNA, 27 bp, Artificial Sequence
  Description of Artificial Sequence: Synthetic oligonucleotide
gaccctgcgcagctactacaaccagag

SEQ ID NO: 7455 - DNA, 27 bp, Artificial Sequence
  Description of Artificial Sequence: Synthetic oligonucleotide
accctgcgcagctactacaaccagagc

SEQ ID NO: 7456 - DNA, 26 bp, Artificial Sequence
  Description of Artificial Sequence: Synthetic oligonucleotide
ccctgcgcagctactacaaccagagc

SEQ ID NO: 7457 - DNA, 27 bp, Artificial Sequence
  Description of Artificial Sequence: Synthetic oligonucleotide
cctgcgcagctactacaaccagagcga

SEQ ID NO: 7458 - DNA, 27 bp, Artificial Sequence
  Description of Artificial Sequence: Synthetic oligonucleotide
ctgcgcagctactacaaccagagcgag

SEQ ID NO: 7459 - DNA, 27 bp, Artificial Sequence
  Description of Artificial Sequence: Synthetic oligonucleotide
tgcgcagctactacaaccagagcgagg

SEQ ID NO: 7460 - DNA, 26 bp, Artificial Sequence
  Description of Artificial Sequence: Synthetic oligonucleotide
gcgcagctactacaaccagagcgagg

SEQ ID NO: 7461 - DNA, 26 bp, Artificial Sequence
  Description of Artificial Sequence: Synthetic oligonucleotide
cgcagctactacaaccagagcgaggc

SEQ ID NO: 7462 - DNA, 26 bp, Artificial Sequence
  Description of Artificial Sequence: Synthetic oligonucleotide
gcagctactacaaccagagcgaggcc

SEQ ID NO: 7463 - DNA, 26 bp, Artificial Sequence
  Description of Artificial Sequence: Synthetic oligonucleotide
cagctactacaaccagagcgaggccg

SEQ ID NO: 7464 - DNA, 27 bp, Artificial Sequence
  Description of Artificial Sequence: Synthetic oligonucleotide
agctactacaaccagagcgaggccggt

SEQ ID NO: 7465 - DNA, 25 bp, Artificial Sequence
  Description of Artificial Sequence: Synthetic oligonucleotide
gcttcctccgcgggtaccaccacta

SEQ ID NO: 7466 - DNA, 25 bp, Artificial Sequence
  Description of Artificial Sequence: Synthetic oligonucleotide
cttcctccgcgggtaccaccactac

SEQ ID NO: 7467 - DNA, 25 bp, Artificial Sequence
  Description of Artificial Sequence: Synthetic oligonucleotide
ttcctccgcgggtaccaccactacg

SEQ ID NO: 7468 - DNA, 24 bp, Artificial Sequence
  Description of Artificial Sequence: Synthetic oligonucleotide
tcctccgcgggtaccaccactacg

SEQ ID NO: 7469 - DNA, 23 bp, Artificial Sequence
  Description of Artificial Sequence: Synthetic oligonucleotide
cctccgcgggtaccaccactacg

SEQ ID NO: 7470 - DNA, 23 bp, Artificial Sequence
  Description of Artificial Sequence: Synthetic oligonucleotide
ctccgcgggtaccaccactacgc

SEQ ID NO: 7471 - DNA, 25 bp, Artificial Sequence
  Description of Artificial Sequence: Synthetic oligonucleotide
tccgcgggtaccaccactacgccta

SEQ ID NO: 7472 - DNA, 24 bp, Artificial Sequence
  Description of Artificial Sequence: Synthetic oligonucleotide
ccgcgggtaccaccactacgccta

SEQ ID NO: 7473 - DNA, 24 bp, Artificial Sequence
  Description of Artificial Sequence: Synthetic oligonucleotide
cgcgggtaccaccactacgcctac

SEQ ID NO: 7474 - DNA, 25 bp, Artificial Sequence
  Description of Artificial Sequence: Synthetic oligonucleotide
gcgggtaccaccactacgcctacga

SEQ ID NO: 7475 - DNA, 25 bp, Artificial Sequence
  Description of Artificial Sequence: Synthetic oligonucleotide
cgggtaccaccactacgcctacgac

SEQ ID NO: 7476 - DNA, 25 bp, Artificial Sequence
  Description of Artificial Sequence: Synthetic oligonucleotide
gggtaccaccactacgcctacgacg

SEQ ID NO: 7477 - DNA, 25 bp, Artificial Sequence
  Description of Artificial Sequence: Synthetic oligonucleotide
ggtaccaccactacgcctacgacgg

SEQ ID NO: 7478 - DNA, 27 bp, Artificial Sequence
  Description of Artificial Sequence: Synthetic oligonucleotide
gtaccaccactacgcctacgacggcaa

SEQ ID NO: 7479 - DNA, 27 bp, Artificial Sequence
  Description of Artificial Sequence: Synthetic oligonucleotide
taccaccactacgcctacgacggcaag

SEQ ID NO: 7480 - DNA, 26 bp, Artificial Sequence
  Description of Artificial Sequence: Synthetic oligonucleotide
accaccactacgcctacgacggcaag

SEQ ID NO: 7481 - DNA, 25 bp, Artificial Sequence
  Description of Artificial Sequence: Synthetic oligonucleotide
ccaccactacgcctacgacggcaag

SEQ ID NO: 7482 - DNA, 27 bp, Artificial Sequence
  Description of Artificial Sequence: Synthetic oligonucleotide
caccactacgcctacgacggcaaggat

SEQ ID NO: 7483 - DNA, 29 bp, Artificial Sequence
  Description of Artificial Sequence: Synthetic oligonucleotide
accactacgcctacgacggcaaggattac

SEQ ID NO: 7484 - DNA, 28 bp, Artificial Sequence
  Description of Artificial Sequence: Synthetic oligonucleotide
ccactacgcctacgacggcaaggattac

SEQ ID NO: 7485 - DNA, 30 bp, Artificial Sequence
  Description of Artificial Sequence: Synthetic oligonucleotide
cactacgcctacgacggcaaggattacatc

SEQ ID NO: 7486 - DNA, 30 bp, Artificial Sequence
  Description of Artificial Sequence: Synthetic oligonucleotide
actacgcctacgacggcaaggattacatcg

SEQ ID NO: 7487 - DNA, 29 bp, Artificial Sequence
  Description of Artificial Sequence: Synthetic oligonucleotide
ctacgcctacgacggcaaggattacatcg

SEQ ID NO: 7488 - DNA, 23 bp, Artificial Sequence
  Description of Artificial Sequence: Synthetic oligonucleotide
cgaggccggttctcacaccgtcc

SEQ ID NO: 7489 - DNA, 23 bp, Artificial Sequence
  Description of Artificial Sequence: Synthetic oligonucleotide
gaggccggttctcacaccgtccg

SEQ ID NO: 7490 - DNA, 24 bp, Artificial Sequence
  Description of Artificial Sequence: Synthetic oligonucleotide
aggccggttctcacaccgtccgga

SEQ ID NO: 7491 - DNA, 23 bp, Artificial Sequence
  Description of Artificial Sequence: Synthetic oligonucleotide
ggccggttctcacaccgtccgga

SEQ ID NO: 7492 - DNA, 23 bp, Artificial Sequence
  Description of Artificial Sequence: Synthetic oligonucleotide
gccggttctcacaccgtccggag

SEQ ID NO: 7493 - DNA, 25 bp, Artificial Sequence
  Description of Artificial Sequence: Synthetic oligonucleotide
ccggttctcacaccgtccggaggat

SEQ ID NO: 7494 - DNA, 27 bp, Artificial Sequence
  Description of Artificial Sequence: Synthetic oligonucleotide
cggttctcacaccgtccggaggatgta

SEQ ID NO: 7495 - DNA, 28 bp, Artificial Sequence
  Description of Artificial Sequence: Synthetic oligonucleotide
ggttctcacaccgtccggaggatgtatg

SEQ ID NO: 7496 - DNA, 28 bp, Artificial Sequence
  Description of Artificial Sequence: Synthetic oligonucleotide
gttctcacaccgtccggaggatgtatgg

SEQ ID NO: 7497 - DNA, 28 bp, Artificial Sequence
  Description of Artificial Sequence: Synthetic oligonucleotide
ttctcacaccgtccggaggatgtatggc

SEQ ID NO: 7498 - DNA, 27 bp, Artificial Sequence
  Description of Artificial Sequence: Synthetic oligonucleotide
tctcacaccgtccggaggatgtatggc

SEQ ID NO: 7499 - DNA, 27 bp, Artificial Sequence
  Description of Artificial Sequence: Synthetic oligonucleotide
ctcacaccgtccggaggatgtatggct

SEQ ID NO: 7500 - DNA, 27 bp, Artificial Sequence
  Description of Artificial Sequence: Synthetic oligonucleotide
tcacaccgtccggaggatgtatggctg

SEQ ID NO: 7501 - DNA, 26 bp, Artificial Sequence
  Description of Artificial Sequence: Synthetic oligonucleotide
cacaccgtccggaggatgtatggctg

SEQ ID NO: 7502 - DNA, 26 bp, Artificial Sequence
  Description of Artificial Sequence: Synthetic oligonucleotide
acaccgtccggaggatgtatggctgc

SEQ ID NO: 7503 - DNA, 25 bp, Artificial Sequence
  Description of Artificial Sequence: Synthetic oligonucleotide
caccgtccggaggatgtatggctgc

SEQ ID NO: 7504 - DNA, 26 bp, Artificial Sequence
  Description of Artificial Sequence: Synthetic oligonucleotide
accgtccggaggatgtatggctgcga

SEQ ID NO: 7505 - DNA, 25 bp, Artificial Sequence
  Description of Artificial Sequence: Synthetic oligonucleotide
ccgtccggaggatgtatggctgcga

SEQ ID NO: 7506 - DNA, 25 bp, Artificial Sequence
  Description of Artificial Sequence: Synthetic oligonucleotide
cgtccggaggatgtatggctgcgac

SEQ ID NO: 7507 - DNA, 26 bp, Artificial Sequence
  Description of Artificial Sequence: Synthetic oligonucleotide
gtccggaggatgtatggctgcgacgt

SEQ ID NO: 7508 - DNA, 26 bp, Artificial Sequence
  Description of Artificial Sequence: Synthetic oligonucleotide
tccggaggatgtatggctgcgacgtg

SEQ ID NO: 7509 - DNA, 25 bp, Artificial Sequence
  Description of Artificial Sequence: Synthetic oligonucleotide
ccggaggatgtatggctgcgacgtg

SEQ ID NO: 7510 - DNA, 25 bp, Artificial Sequence
  Description of Artificial Sequence: Synthetic oligonucleotide
cggaggatgtatggctgcgacgtgg

SEQ ID NO: 7511 - DNA, 25 bp, Artificial Sequence
  Description of Artificial Sequence: Synthetic oligonucleotide
ggaggatgtatggctgcgacgtggg

SEQ ID NO: 7512 - DNA, 27 bp, Artificial Sequence
  Description of Artificial Sequence: Synthetic oligonucleotide
tgggctacgtggacgacacgcagttca

SEQ ID NO: 7513 - DNA, 27 bp, Artificial Sequence
  Description of Artificial Sequence: Synthetic oligonucleotide
gggctacgtggacgacacgcagttcat

SEQ ID NO: 7514 - DNA, 27 bp, Artificial Sequence
  Description of Artificial Sequence: Synthetic oligonucleotide
ggctacgtggacgacacgcagttcatg

SEQ ID NO: 7515 - DNA, 27 bp, Artificial Sequence
  Description of Artificial Sequence: Synthetic oligonucleotide
gctacgtggacgacacgcagttcatgc

SEQ ID NO: 7516 - DNA, 27 bp, Artificial Sequence
  Description of Artificial Sequence: Synthetic oligonucleotide
ctacgtggacgacacgcagttcatgcg

SEQ ID NO: 7517 - DNA, 27 bp, Artificial Sequence
  Description of Artificial Sequence: Synthetic oligonucleotide
tacgtggacgacacgcagttcatgcgg

SEQ ID NO: 7518 - DNA, 27 bp, Artificial Sequence
  Description of Artificial Sequence: Synthetic oligonucleotide
acgtggacgacacgcagttcatgcggt

SEQ ID NO: 7519 - DNA, 27 bp, Artificial Sequence
  Description of Artificial Sequence: Synthetic oligonucleotide
cgtggacgacacgcagttcatgcggtt

SEQ ID NO: 7520 - DNA, 27 bp, Artificial Sequence
  Description of Artificial Sequence: Synthetic oligonucleotide
gtggacgacacgcagttcatgcggttc

SEQ ID NO: 7521 - DNA, 27 bp, Artificial Sequence
  Description of Artificial Sequence: Synthetic oligonucleotide
tggacgacacgcagttcatgcggttcg

SEQ ID NO: 7522 - DNA, 27 bp, Artificial Sequence
  Description of Artificial Sequence: Synthetic oligonucleotide
ggacgacacgcagttcatgcggttcga

SEQ ID NO: 7523 - DNA, 27 bp, Artificial Sequence
  Description of Artificial Sequence: Synthetic oligonucleotide
gacgacacgcagttcatgcggttcgac

SEQ ID NO: 7524 - DNA, 28 bp, Artificial Sequence
  Description of Artificial Sequence: Synthetic oligonucleotide
acgacacgcagttcatgcggttcgacag

SEQ ID NO: 7525 - DNA, 27 bp, Artificial Sequence
  Description of Artificial Sequence: Synthetic oligonucleotide
cgacacgcagttcatgcggttcgacag

SEQ ID NO: 7526 - DNA, 27 bp, Artificial Sequence
  Description of Artificial Sequence: Synthetic oligonucleotide
gacacgcagttcatgcggttcgacagc

SEQ ID NO: 7527 - DNA, 27 bp, Artificial Sequence
  Description of Artificial Sequence: Synthetic oligonucleotide
acacgcagttcatgcggttcgacagcg

SEQ ID NO: 7528 - DNA, 27 bp, Artificial Sequence
  Description of Artificial Sequence: Synthetic oligonucleotide
cacgcagttcatgcggttcgacagcga

SEQ ID NO: 7529 - DNA, 27 bp, Artificial Sequence
  Description of Artificial Sequence: Synthetic oligonucleotide
acgcagttcatgcggttcgacagcgac

SEQ ID NO: 7530 - DNA, 26 bp, Artificial Sequence
  Description of Artificial Sequence: Synthetic oligonucleotide
cgcagttcatgcggttcgacagcgac

SEQ ID NO: 7531 - DNA, 26 bp, Artificial Sequence
  Description of Artificial Sequence: Synthetic oligonucleotide
gcagttcatgcggttcgacagcgacg

SEQ ID NO: 7532 - DNA, 26 bp, Artificial Sequence
  Description of Artificial Sequence: Synthetic oligonucleotide
cagttcatgcggttcgacagcgacgc

SEQ ID NO: 7533 - DNA, 26 bp, Artificial Sequence
  Description of Artificial Sequence: Synthetic oligonucleotide
agttcatgcggttcgacagcgacgcc

SEQ ID NO: 7534 - DNA, 25 bp, Artificial Sequence
  Description of Artificial Sequence: Synthetic oligonucleotide
gttcatgcggttcgacagcgacgcc

SEQ ID NO: 7535 - DNA, 25 bp, Artificial Sequence
  Description of Artificial Sequence: Synthetic oligonucleotide
ttcatgcggttcgacagcgacgccg

SEQ ID NO: 7536 - DNA, 24 bp, Artificial Sequence
  Description of Artificial Sequence: Synthetic oligonucleotide
tcatgcggttcgacagcgacgccg

SEQ ID NO: 7537 - DNA, 23 bp, Artificial Sequence
  Description of Artificial Sequence: Synthetic oligonucleotide
catgcggttcgacagcgacgccg

SEQ ID NO: 7538 - DNA, 23 bp, Artificial Sequence
  Description of Artificial Sequence: Synthetic oligonucleotide
atgcggttcgacagcgacgccgc

SEQ ID NO: 7539 - DNA, 29 bp, Artificial Sequence
  Description of Artificial Sequence: Synthetic oligonucleotide
gcagatacctggagaacgggaaggagatg

SEQ ID NO: 7540 - DNA, 29 bp, Artificial Sequence
  Description of Artificial Sequence: Synthetic oligonucleotide
cagatacctggagaacgggaaggagatgc

SEQ ID NO: 7541 - DNA, 30 bp, Artificial Sequence
  Description of Artificial Sequence: Synthetic oligonucleotide
agatacctggagaacgggaaggagatgctg

SEQ ID NO: 7542 - DNA, 29 bp, Artificial Sequence
  Description of Artificial Sequence: Synthetic oligonucleotide
gatacctggagaacgggaaggagatgctg

SEQ ID NO: 7543 - DNA, 29 bp, Artificial Sequence
  Description of Artificial Sequence: Synthetic oligonucleotide
atacctggagaacgggaaggagatgctgc

SEQ ID NO: 7544 - DNA, 28 bp, Artificial Sequence
  Description of Artificial Sequence: Synthetic oligonucleotide
tacctggagaacgggaaggagatgctgc

SEQ ID NO: 7545 - DNA, 27 bp, Artificial Sequence
  Description of Artificial Sequence: Synthetic oligonucleotide
acctggagaacgggaaggagatgctgc

SEQ ID NO: 7546 - DNA, 27 bp, Artificial Sequence
  Description of Artificial Sequence: Synthetic oligonucleotide
cctggagaacgggaaggagatgctgca

SEQ ID NO: 7547 - DNA, 27 bp, Artificial Sequence
  Description of Artificial Sequence: Synthetic oligonucleotide
ctggagaacgggaaggagatgctgcag

SEQ ID NO: 7548 - DNA, 27 bp, Artificial Sequence
  Description of Artificial Sequence: Synthetic oligonucleotide
tggagaacgggaaggagatgctgcagc

SEQ ID NO: 7549 - DNA, 26 bp, Artificial Sequence
  Description of Artificial Sequence: Synthetic oligonucleotide
ggagaacgggaaggagatgctgcagc

SEQ ID NO: 7550 - DNA, 26 bp, Artificial Sequence
  Description of Artificial Sequence: Synthetic oligonucleotide
gagaacgggaaggagatgctgcagcg

SEQ ID NO: 7551 - DNA, 27 bp, Artificial Sequence
  Description of Artificial Sequence: Synthetic oligonucleotide
agaacgggaaggagatgctgcagcgca

SEQ ID NO: 7552 - DNA, 26 bp, Artificial Sequence
  Description of Artificial Sequence: Synthetic oligonucleotide
gaacgggaaggagatgctgcagcgca

SEQ ID NO: 7553 - DNA, 26 bp, Artificial Sequence
  Description of Artificial Sequence: Synthetic oligonucleotide
aacgggaaggagatgctgcagcgcac

SEQ ID NO: 7554 - DNA, 25 bp, Artificial Sequence
  Description of Artificial Sequence: Synthetic oligonucleotide
acgggaaggagatgctgcagcgcac

SEQ ID NO: 7555 - DNA, 24 bp, Artificial Sequence
  Description of Artificial Sequence: Synthetic oligonucleotide
cgggaaggagatgctgcagcgcac

SEQ ID NO: 7556 - DNA, 24 bp, Artificial Sequence
  Description of Artificial Sequence: Synthetic oligonucleotide
gggaaggagatgctgcagcgcacg

SEQ ID NO: 7557 - DNA, 24 bp, Artificial Sequence
  Description of Artificial Sequence: Synthetic oligonucleotide
ggaaggagatgctgcagcgcacgg

SEQ ID NO: 7558 - DNA, 27 bp, Artificial Sequence
  Description of Artificial Sequence: Synthetic oligonucleotide
cggacatggcagctcagaccaccaagt

SEQ ID NO: 7559 - DNA, 28 bp, Artificial Sequence
  Description of Artificial Sequence: Synthetic oligonucleotide
ggacatggcagctcagaccaccaagtac

SEQ ID NO: 7560 - DNA, 30 bp, Artificial Sequence
  Description of Artificial Sequence: Synthetic oligonucleotide
gacatggcagctcagaccaccaagtacaag

SEQ ID NO: 7561 - DNA, 31 bp, Artificial Sequence
  Description of Artificial Sequence: Synthetic oligonucleotide
acatggcagctcagaccaccaagtacaagtg

SEQ ID NO: 7562 - DNA, 30 bp, Artificial Sequence
  Description of Artificial Sequence: Synthetic oligonucleotide
catggcagctcagaccaccaagtacaagtg

SEQ ID NO: 7563 - DNA, 30 bp, Artificial Sequence
  Description of Artificial Sequence: Synthetic oligonucleotide
atggcagctcagaccaccaagtacaagtgg

SEQ ID NO: 7564 - DNA, 29 bp, Artificial Sequence
  Description of Artificial Sequence: Synthetic oligonucleotide
tggcagctcagaccaccaagtacaagtgg

SEQ ID NO: 7565 - DNA, 28 bp, Artificial Sequence
  Description of Artificial Sequence: Synthetic oligonucleotide
ggcagctcagaccaccaagtacaagtgg

SEQ ID NO: 7566 - DNA, 28 bp, Artificial Sequence
  Description of Artificial Sequence: Synthetic oligonucleotide
gcagctcagaccaccaagtacaagtggg

SEQ ID NO: 7567 - DNA, 29 bp, Artificial Sequence
  Description of Artificial Sequence: Synthetic oligonucleotide
cagctcagaccaccaagtacaagtgggag

SEQ ID NO: 7568 - DNA, 29 bp, Artificial Sequence
  Description of Artificial Sequence: Synthetic oligonucleotide
agctcagaccaccaagtacaagtgggagg

SEQ ID NO: 7569 - DNA, 28 bp, Artificial Sequence
  Description of Artificial Sequence: Synthetic oligonucleotide
gctcagaccaccaagtacaagtgggagg

SEQ ID NO: 7570 - DNA, 28 bp, Artificial Sequence
  Description of Artificial Sequence: Synthetic oligonucleotide
ctcagaccaccaagtacaagtgggaggc

SEQ ID NO: 7571 - DNA, 28 bp, Artificial Sequence
  Description of Artificial Sequence: Synthetic oligonucleotide
tcagaccaccaagtacaagtgggaggcg

SEQ ID NO: 7572 - DNA, 27 bp, Artificial Sequence
  Description of Artificial Sequence: Synthetic oligonucleotide
cagaccaccaagtacaagtgggaggcg

SEQ ID NO: 7573 - DNA, 27 bp, Artificial Sequence
  Description of Artificial Sequence: Synthetic oligonucleotide
agaccaccaagtacaagtgggaggcgg

SEQ ID NO: 7574 - DNA, 26 bp, Artificial Sequence
  Description of Artificial Sequence: Synthetic oligonucleotide
gaccaccaagtacaagtgggaggcgg

SEQ ID NO: 7575 - DNA, 26 bp, Artificial Sequence
  Description of Artificial Sequence: Synthetic oligonucleotide
accaccaagtacaagtgggaggcggc

SEQ ID NO: 7576 - DNA, 25 bp, Artificial Sequence
  Description of Artificial Sequence: Synthetic oligonucleotide
ccaccaagtacaagtgggaggcggc

SEQ ID NO: 7577 - DNA, 25 bp, Artificial Sequence
  Description of Artificial Sequence: Synthetic oligonucleotide
caccaagtacaagtgggaggcggcc

SEQ ID NO: 7578 - DNA, 27 bp, Artificial Sequence
  Description of Artificial Sequence: Synthetic oligonucleotide
accaagtacaagtgggaggcggcccat

SEQ ID NO: 7579 - DNA, 26 bp, Artificial Sequence
  Description of Artificial Sequence: Synthetic oligonucleotide
ccaagtacaagtgggaggcggcccat

SEQ ID NO: 7580 - DNA, 27 bp, Artificial Sequence
  Description of Artificial Sequence: Synthetic oligonucleotide
caagtacaagtgggaggcggcccatgt

SEQ ID NO: 7581 - DNA, 27 bp, Artificial Sequence
  Description of Artificial Sequence: Synthetic oligonucleotide
aagtacaagtgggaggcggcccatgtg

SEQ ID NO: 7582 - DNA, 26 bp, Artificial Sequence
  Description of Artificial Sequence: Synthetic oligonucleotide
agtacaagtgggaggcggcccatgtg

SEQ ID NO: 7583 - DNA, 25 bp, Artificial Sequence
  Description of Artificial Sequence: Synthetic oligonucleotide
gtacaagtgggaggcggcccatgtg

SEQ ID NO: 7584 - DNA, 25 bp, Artificial Sequence
  Description of Artificial Sequence: Synthetic oligonucleotide
tacaagtgggaggcggcccatgtgg

SEQ ID NO: 7585 - DNA, 25 bp, Artificial Sequence
  Description of Artificial Sequence: Synthetic oligonucleotide
gcggctactacaaccagagcgaggg

SEQ ID NO: 7586 - DNA, 25 bp, Artificial Sequence
  Description of Artificial Sequence: Synthetic oligonucleotide
cggctactacaaccagagcgagggc

SEQ ID NO: 7587 - DNA, 25 bp, Artificial Sequence
  Description of Artificial Sequence: Synthetic oligonucleotide
ggctactacaaccagagcgagggcg

SEQ ID NO: 7588 - DNA, 27 bp, Artificial Sequence
  Description of Artificial Sequence: Synthetic oligonucleotide
gctactacaaccagagcgagggcggtt

SEQ ID NO: 7589 - DNA, 27 bp, Artificial Sequence
  Description of Artificial Sequence: Synthetic oligonucleotide
ctactacaaccagagcgagggcggttc

SEQ ID NO: 7590 - DNA, 28 bp, Artificial Sequence
  Description of Artificial Sequence: Synthetic oligonucleotide
tactacaaccagagcgagggcggttctc

SEQ ID NO: 7591 - DNA, 27 bp, Artificial Sequence
  Description of Artificial Sequence: Synthetic oligonucleotide
actacaaccagagcgagggcggttctc

SEQ ID NO: 7592 - DNA, 27 bp, Artificial Sequence
  Description of Artificial Sequence: Synthetic oligonucleotide
ctacaaccagagcgagggcggttctca

SEQ ID NO: 7593 - DNA, 27 bp, Artificial Sequence
  Description of Artificial Sequence: Synthetic oligonucleotide
tacaaccagagcgagggcggttctcac

SEQ ID NO: 7594 - DNA, 27 bp, Artificial Sequence
  Description of Artificial Sequence: Synthetic oligonucleotide
acaaccagagcgagggcggttctcaca

SEQ ID NO: 7595 - DNA, 26 bp, Artificial Sequence
  Description of Artificial Sequence: Synthetic oligonucleotide
caaccagagcgagggcggttctcaca

SEQ ID NO: 7596 - DNA, 26 bp, Artificial Sequence
  Description of Artificial Sequence: Synthetic oligonucleotide
aaccagagcgagggcggttctcacac

SEQ ID NO: 7597 - DNA, 25 bp, Artificial Sequence
  Description of Artificial Sequence: Synthetic oligonucleotide
accagagcgagggcggttctcacac

SEQ ID NO: 7598 - DNA, 24 bp, Artificial Sequence
  Description of Artificial Sequence: Synthetic oligonucleotide
ccagagcgagggcggttctcacac

SEQ ID NO: 7599 - DNA, 24 bp, Artificial Sequence
  Description of Artificial Sequence: Synthetic oligonucleotide
cagagcgagggcggttctcacacc

SEQ ID NO: 7600 - DNA, 25 bp, Artificial Sequence
  Description of Artificial Sequence: Synthetic oligonucleotide
agagcgagggcggttctcacaccgt

SEQ ID NO: 7601 - DNA, 24 bp, Artificial Sequence
  Description of Artificial Sequence: Synthetic oligonucleotide
gagcgagggcggttctcacaccgt

SEQ ID NO: 7602 - DNA, 24 bp, Artificial Sequence
  Description of Artificial Sequence: Synthetic oligonucleotide
agcgagggcggttctcacaccgtc

SEQ ID NO: 7603 - DNA, 23 bp, Artificial Sequence
  Description of Artificial Sequence: Synthetic oligonucleotide
gcgagggcggttctcacaccgtc

SEQ ID NO: 7604 - DNA, 24 bp, Artificial Sequence
  Description of Artificial Sequence: Synthetic oligonucleotide
cgagggcggttctcacaccgtcca

SEQ ID NO: 7605 - DNA, 25 bp, Artificial Sequence
  Description of Artificial Sequence: Synthetic oligonucleotide
gagggcggttctcacaccgtccaga

SEQ ID NO: 7606 - DNA, 25 bp, Artificial Sequence
  Description of Artificial Sequence: Synthetic oligonucleotide
agggcggttctcacaccgtccagag

SEQ ID NO: 7607 - DNA, 24 bp, Artificial Sequence
  Description of Artificial Sequence: Synthetic oligonucleotide
gggcggttctcacaccgtccagag

SEQ ID NO: 7608 - DNA, 26 bp, Artificial Sequence
  Description of Artificial Sequence: Synthetic oligonucleotide
ggcggttctcacaccgtccagaggat

SEQ ID NO: 7609 - DNA, 27 bp, Artificial Sequence
  Description of Artificial Sequence: Synthetic oligonucleotide
gcggttctcacaccgtccagaggatgt

SEQ ID NO: 7610 - DNA, 26 bp, Artificial Sequence
  Description of Artificial Sequence: Synthetic oligonucleotide
agtgggctacgtggacgacacgcagt

SEQ ID NO: 7611 - DNA, 25 bp, Artificial Sequence
  Description of Artificial Sequence: Synthetic oligonucleotide
gtgggctacgtggacgacacgcagt

SEQ ID NO: 7612 - DNA, 25 bp, Artificial Sequence
  Description of Artificial Sequence: Synthetic oligonucleotide
tgggctacgtggacgacacgcagtc

SEQ ID NO: 7613 - DNA, 24 bp, Artificial Sequence
  Description of Artificial Sequence: Synthetic oligonucleotide
gggctacgtggacgacacgcagtc

SEQ ID NO: 7614 - DNA, 24 bp, Artificial Sequence
  Description of Artificial Sequence: Synthetic oligonucleotide
ggctacgtggacgacacgcagtcc

SEQ ID NO: 7615 - DNA, 25 bp, Artificial Sequence
  Description of Artificial Sequence: Synthetic oligonucleotide
gctacgtggacgacacgcagtccgt

SEQ ID NO: 7616 - DNA, 25 bp, Artificial Sequence
  Description of Artificial Sequence: Synthetic oligonucleotide
ctacgtggacgacacgcagtccgtg

SEQ ID NO: 7617 - DNA, 25 bp, Artificial Sequence
  Description of Artificial Sequence: Synthetic oligonucleotide
tacgtggacgacacgcagtccgtgc

SEQ ID NO: 7618 - DNA, 24 bp, Artificial Sequence
  Description of Artificial Sequence: Synthetic oligonucleotide
acgtggacgacacgcagtccgtgc

SEQ ID NO: 7619 - DNA, 23 bp, Artificial Sequence
  Description of Artificial Sequence: Synthetic oligonucleotide
cgtggacgacacgcagtccgtgc

SEQ ID NO: 7620 - DNA, 23 bp, Artificial Sequence
  Description of Artificial Sequence: Synthetic oligonucleotide
gtggacgacacgcagtccgtgcg

SEQ ID NO: 7621 - DNA, 25 bp, Artificial Sequence
  Description of Artificial Sequence: Synthetic oligonucleotide
tggacgacacgcagtccgtgcggtt

SEQ ID NO: 7622 - DNA, 24 bp, Artificial Sequence
  Description of Artificial Sequence: Synthetic oligonucleotide
ggacgacacgcagtccgtgcggtt

SEQ ID NO: 7623 - DNA, 24 bp, Artificial Sequence
  Description of Artificial Sequence: Synthetic oligonucleotide
gacgacacgcagtccgtgcggttc

SEQ ID NO: 7624 - DNA, 25 bp, Artificial Sequence
  Description of Artificial Sequence: Synthetic oligonucleotide
acgacacgcagtccgtgcggttcga

SEQ ID NO: 7625 - DNA, 24 bp, Artificial Sequence
  Description of Artificial Sequence: Synthetic oligonucleotide
cgacacgcagtccgtgcggttcga

SEQ ID NO: 7626 - DNA, 25 bp, Artificial Sequence
  Description of Artificial Sequence: Synthetic oligonucleotide
gacacgcagtccgtgcggttcgaca

SEQ ID NO: 7627 - DNA, 25 bp, Artificial Sequence
  Description of Artificial Sequence: Synthetic oligonucleotide
acacgcagtccgtgcggttcgacag

SEQ ID NO: 7628 - DNA, 24 bp, Artificial Sequence
  Description of Artificial Sequence: Synthetic oligonucleotide
cacgcagtccgtgcggttcgacag

SEQ ID NO: 7629 - DNA, 24 bp, Artificial Sequence
  Description of Artificial Sequence: Synthetic oligonucleotide
acgcagtccgtgcggttcgacagc

SEQ ID NO: 7630 - DNA, 23 bp, Artificial Sequence
  Description of Artificial Sequence: Synthetic oligonucleotide
cgcagtccgtgcggttcgacagc

SEQ ID NO: 7631 - DNA, 24 bp, Artificial Sequence
  Description of Artificial Sequence: Synthetic oligonucleotide
gcagtccgtgcggttcgacagcga

SEQ ID NO: 7632 - DNA, 24 bp, Artificial Sequence
  Description of Artificial Sequence: Synthetic oligonucleotide
cagtccgtgcggttcgacagcgac

SEQ ID NO: 7633 - DNA, 24 bp, Artificial Sequence
  Description of Artificial Sequence: Synthetic oligonucleotide
agtccgtgcggttcgacagcgacg

SEQ ID NO: 7634 - DNA, 23 bp, Artificial Sequence
  Description of Artificial Sequence: Synthetic oligonucleotide
gtccgtgcggttcgacagcgacg

SEQ ID NO: 7635 - DNA, 23 bp, Artificial Sequence
  Description of Artificial Sequence: Synthetic oligonucleotide
tccgtgcggttcgacagcgacgc

SEQ ID NO: 7636 - DNA, 22 bp, Artificial Sequence
  Description of Artificial Sequence: Synthetic oligonucleotide
ccgtgcggttcgacagcgacgc

SEQ ID NO: 7637 - DNA, 27 bp, Artificial Sequence
  Description of Artificial Sequence: Synthetic oligonucleotide
gtggatagagcaggagggtccggacta

SEQ ID NO: 7638 - DNA, 29 bp, Artificial Sequence
  Description of Artificial Sequence: Synthetic oligonucleotide
tggatagagcaggagggtccggactattg

SEQ ID NO: 7639 - DNA, 28 bp, Artificial Sequence
  Description of Artificial Sequence: Synthetic oligonucleotide
ggatagagcaggagggtccggactattg

SEQ ID NO: 7640 - DNA, 28 bp, Artificial Sequence
  Description of Artificial Sequence: Synthetic oligonucleotide
gatagagcaggagggtccggactattgg

SEQ ID NO: 7641 - DNA, 28 bp, Artificial Sequence
  Description of Artificial Sequence: Synthetic oligonucleotide
atagagcaggagggtccggactattggg

SEQ ID NO: 7642 - DNA, 27 bp, Artificial Sequence
  Description of Artificial Sequence: Synthetic oligonucleotide
tagagcaggagggtccggactattggg

SEQ ID NO: 7643 - DNA, 27 bp, Artificial Sequence
  Description of Artificial Sequence: Synthetic oligonucleotide
agagcaggagggtccggactattggga

SEQ ID NO: 7644 - DNA, 26 bp, Artificial Sequence
  Description of Artificial Sequence: Synthetic oligonucleotide
gagcaggagggtccggactattggga

SEQ ID NO: 7645 - DNA, 26 bp, Artificial Sequence
  Description of Artificial Sequence: Synthetic oligonucleotide
agcaggagggtccggactattgggac

SEQ ID NO: 7646 - DNA, 25 bp, Artificial Sequence
  Description of Artificial Sequence: Synthetic oligonucleotide
gcaggagggtccggactattgggac

SEQ ID NO: 7647 - DNA, 25 bp, Artificial Sequence
  Description of Artificial Sequence: Synthetic oligonucleotide
caggagggtccggactattgggacg

SEQ ID NO: 7648 - DNA, 25 bp, Artificial Sequence
  Description of Artificial Sequence: Synthetic oligonucleotide
aggagggtccggactattgggacgg

SEQ ID NO: 7649 - DNA, 24 bp, Artificial Sequence
  Description of Artificial Sequence: Synthetic oligonucleotide
ggagggtccggactattgggacgg

SEQ ID NO: 7650 - DNA, 24 bp, Artificial Sequence
  Description of Artificial Sequence: Synthetic oligonucleotide
gagggtccggactattgggacggg

SEQ ID NO: 7651 - DNA, 25 bp, Artificial Sequence
  Description of Artificial Sequence: Synthetic oligonucleotide
agggtccggactattgggacgggga

SEQ ID NO: 7652 - DNA, 24 bp, Artificial Sequence
  Description of Artificial Sequence: Synthetic oligonucleotide
gggtccggactattgggacgggga

SEQ ID NO: 7653 - DNA, 25 bp, Artificial Sequence
  Description of Artificial Sequence: Synthetic oligonucleotide
ggtccggactattgggacggggaga

SEQ ID NO: 7654 - DNA, 26 bp, Artificial Sequence
  Description of Artificial Sequence: Synthetic oligonucleotide
gtccggactattgggacggggagaca

SEQ ID NO: 7655 - DNA, 26 bp, Artificial Sequence
  Description of Artificial Sequence: Synthetic oligonucleotide
tccggactattgggacggggagacac

SEQ ID NO: 7656 - DNA, 25 bp, Artificial Sequence
  Description of Artificial Sequence: Synthetic oligonucleotide
ccggactattgggacggggagacac

SEQ ID NO: 7657 - DNA, 25 bp, Artificial Sequence
  Description of Artificial Sequence: Synthetic oligonucleotide
cggactattgggacggggagacacg

SEQ ID NO: 7658 - DNA, 27 bp, Artificial Sequence
  Description of Artificial Sequence: Synthetic oligonucleotide
ggactattgggacggggagacacggaa

SEQ ID NO: 7659 - DNA, 28 bp, Artificial Sequence
  Description of Artificial Sequence: Synthetic oligonucleotide
gactattgggacggggagacacggaaag

SEQ ID NO: 7660 - DNA, 29 bp, Artificial Sequence
  Description of Artificial Sequence: Synthetic oligonucleotide
actattgggacggggagacacggaaagtg

SEQ ID NO: 7661 - DNA, 28 bp, Artificial Sequence
  Description of Artificial Sequence: Synthetic oligonucleotide
ctattgggacggggagacacggaaagtg

SEQ ID NO: 7662 - DNA, 24 bp, Artificial Sequence
  Description of Artificial Sequence: Synthetic oligonucleotide
agcctacctggagggcacgtgcct

SEQ ID NO: 7663 - DNA, 23 bp, Artificial Sequence
  Description of Artificial Sequence: Synthetic oligonucleotide
gcctacctggagggcacgtgcct

SEQ ID NO: 7664 - DNA, 23 bp, Artificial Sequence
  Description of Artificial Sequence: Synthetic oligonucleotide
cctacctggagggcacgtgcctg

SEQ ID NO: 7665 - DNA, 24 bp, Artificial Sequence
  Description of Artificial Sequence: Synthetic oligonucleotide
ctacctggagggcacgtgcctgga

SEQ ID NO: 7666 - DNA, 25 bp, Artificial Sequence
  Description of Artificial Sequence: Synthetic oligonucleotide
tacctggagggcacgtgcctggagt

SEQ ID NO: 7667 - DNA, 24 bp, Artificial Sequence
  Description of Artificial Sequence: Synthetic oligonucleotide
acctggagggcacgtgcctggagt

SEQ ID NO: 7668 - DNA, 23 bp, Artificial Sequence
  Description of Artificial Sequence: Synthetic oligonucleotide
cctggagggcacgtgcctggagt

SEQ ID NO: 7669 - DNA, 23 bp, Artificial Sequence
  Description of Artificial Sequence: Synthetic oligonucleotide
ctggagggcacgtgcctggagtg

SEQ ID NO: 7670 - DNA, 23 bp, Artificial Sequence
  Description of Artificial Sequence: Synthetic oligonucleotide
tggagggcacgtgcctggagtgg

SEQ ID NO: 7671 - DNA, 22 bp, Artificial Sequence
  Description of Artificial Sequence: Synthetic oligonucleotide
ggagggcacgtgcctggagtgg

SEQ ID NO: 7672 - DNA, 23 bp, Artificial Sequence
  Description of Artificial Sequence: Synthetic oligonucleotide
gagggcacgtgcctggagtggct

SEQ ID NO: 7673 - DNA, 23 bp, Artificial Sequence
  Description of Artificial Sequence: Synthetic oligonucleotide
agggcacgtgcctggagtggctc

SEQ ID NO: 7674 - DNA, 22 bp, Artificial Sequence
  Description of Artificial Sequence: Synthetic oligonucleotide
gggcacgtgcctggagtggctc

SEQ ID NO: 7675 - DNA, 22 bp, Artificial Sequence
  Description of Artificial Sequence: Synthetic oligonucleotide
ggcacgtgcctggagtggctcc

SEQ ID NO: 7676 - DNA, 22 bp, Artificial Sequence
  Description of Artificial Sequence: Synthetic oligonucleotide
gcacgtgcctggagtggctccg

SEQ ID NO: 7677 - DNA, 23 bp, Artificial Sequence
  Description of Artificial Sequence: Synthetic oligonucleotide
cacgtgcctggagtggctccgca

SEQ ID NO: 7678 - DNA, 26 bp, Artificial Sequence
  Description of Artificial Sequence: Synthetic oligonucleotide
acgtgcctggagtggctccgcagata

SEQ ID NO: 7679 - DNA, 25 bp, Artificial Sequence
  Description of Artificial Sequence: Synthetic oligonucleotide
cgtgcctggagtggctccgcagata

SEQ ID NO: 7680 - DNA, 25 bp, Artificial Sequence
  Description of Artificial Sequence: Synthetic oligonucleotide
gtgcctggagtggctccgcagatac

SEQ ID NO: 7681 - DNA, 26 bp, Artificial Sequence
  Description of Artificial Sequence: Synthetic oligonucleotide
tgcctggagtggctccgcagatacct

SEQ ID NO: 7682 - DNA, 25 bp, Artificial Sequence
  Description of Artificial Sequence: Synthetic oligonucleotide
gcctggagtggctccgcagatacct

SEQ ID NO: 7683 - DNA, 25 bp, Artificial Sequence
  Description of Artificial Sequence: Synthetic oligonucleotide
cctggagtggctccgcagatacctg

SEQ ID NO: 7684 - DNA, 26 bp, Artificial Sequence
  Description of Artificial Sequence: Synthetic oligonucleotide
ctggagtggctccgcagatacctgga

SEQ ID NO: 7685 - DNA, 27 bp, Artificial Sequence
  Description of Artificial Sequence: Synthetic oligonucleotide
ccgcttcatcgcagtgggctacgtgaa

SEQ ID NO: 7686 - DNA, 27 bp, Artificial Sequence
  Description of Artificial Sequence: Synthetic oligonucleotide
cgcttcatcgcagtgggctacgtgaac

SEQ ID NO: 7687 - DNA, 27 bp, Artificial Sequence
  Description of Artificial Sequence: Synthetic oligonucleotide
gcttcatcgcagtgggctacgtgaacg

SEQ ID NO: 7688 - DNA, 28 bp, Artificial Sequence
  Description of Artificial Sequence: Synthetic oligonucleotide
cttcatcgcagtgggctacgtgaacgac

SEQ ID NO: 7689 - DNA, 29 bp, Artificial Sequence
  Description of Artificial Sequence: Synthetic oligonucleotide
ttcatcgcagtgggctacgtgaacgacac

SEQ ID NO: 7690 - DNA, 28 bp, Artificial Sequence
  Description of Artificial Sequence: Synthetic oligonucleotide
tcatcgcagtgggctacgtgaacgacac

SEQ ID NO: 7691 - DNA, 27 bp, Artificial Sequence
  Description of Artificial Sequence: Synthetic oligonucleotide
catcgcagtgggctacgtgaacgacac

SEQ ID NO: 7692 - DNA, 27 bp, Artificial Sequence
  Description of Artificial Sequence: Synthetic oligonucleotide
atcgcagtgggctacgtgaacgacacg

SEQ ID NO: 7693 - DNA, 26 bp, Artificial Sequence
  Description of Artificial Sequence: Synthetic oligonucleotide
tcgcagtgggctacgtgaacgacacg

SEQ ID NO: 7694 - DNA, 25 bp, Artificial Sequence
  Description of Artificial Sequence: Synthetic oligonucleotide
cgcagtgggctacgtgaacgacacg

SEQ ID NO: 7695 - DNA, 26 bp, Artificial Sequence
  Description of Artificial Sequence: Synthetic oligonucleotide
gcagtgggctacgtgaacgacacgca

SEQ ID NO: 7696 - DNA, 27 bp, Artificial Sequence
  Description of Artificial Sequence: Synthetic oligonucleotide
cagtgggctacgtgaacgacacgcagt

SEQ ID NO: 7697 - DNA, 28 bp, Artificial Sequence
  Description of Artificial Sequence: Synthetic oligonucleotide
agtgggctacgtgaacgacacgcagttc

SEQ ID NO: 7698 - DNA, 27 bp, Artificial Sequence
  Description of Artificial Sequence: Synthetic oligonucleotide
gtgggctacgtgaacgacacgcagttc

SEQ ID NO: 7699 - DNA, 27 bp, Artificial Sequence
  Description of Artificial Sequence: Synthetic oligonucleotide
tgggctacgtgaacgacacgcagttcg

SEQ ID NO: 7700 - DNA, 27 bp, Artificial Sequence
  Description of Artificial Sequence: Synthetic oligonucleotide
gggctacgtgaacgacacgcagttcgt

SEQ ID NO: 7701 - DNA, 27 bp, Artificial Sequence
  Description of Artificial Sequence: Synthetic oligonucleotide
ggctacgtgaacgacacgcagttcgtg

SEQ ID NO: 7702 - DNA, 27 bp, Artificial Sequence
  Description of Artificial Sequence: Synthetic oligonucleotide
gctacgtgaacgacacgcagttcgtgc

SEQ ID NO: 7703 - DNA, 27 bp, Artificial Sequence
  Description of Artificial Sequence: Synthetic oligonucleotide
ctacgtgaacgacacgcagttcgtgcg

SEQ ID NO: 7704 - DNA, 27 bp, Artificial Sequence
  Description of Artificial Sequence: Synthetic oligonucleotide
tacgtgaacgacacgcagttcgtgcgg

SEQ ID NO: 7705 - DNA, 27 bp, Artificial Sequence
  Description of Artificial Sequence: Synthetic oligonucleotide
acgtgaacgacacgcagttcgtgcggt

SEQ ID NO: 7706 - DNA, 27 bp, Artificial Sequence
  Description of Artificial Sequence: Synthetic oligonucleotide
cgtgaacgacacgcagttcgtgcggtt

SEQ ID NO: 7707 - DNA, 27 bp, Artificial Sequence
  Description of Artificial Sequence: Synthetic oligonucleotide
gtgaacgacacgcagttcgtgcggttc

SEQ ID NO: 7708 - DNA, 27 bp, Artificial Sequence
  Description of Artificial Sequence: Synthetic oligonucleotide
tgaacgacacgcagttcgtgcggttcg

SEQ ID NO: 7709 - DNA, 27 bp, Artificial Sequence
  Description of Artificial Sequence: Synthetic oligonucleotide
gaacgacacgcagttcgtgcggttcga

SEQ ID NO: 7710 - DNA, 27 bp, Artificial Sequence
  Description of Artificial Sequence: Synthetic oligonucleotide
aacgacacgcagttcgtgcggttcgac

SEQ ID NO: 7711 - DNA, 27 bp, Artificial Sequence
  Description of Artificial Sequence: Synthetic oligonucleotide
acaccgtccagaggatgtatggctgcc

SEQ ID NO: 7712 - DNA, 27 bp, Artificial Sequence
  Description of Artificial Sequence: Synthetic oligonucleotide
caccgtccagaggatgtatggctgcca

SEQ ID NO: 7713 - DNA, 27 bp, Artificial Sequence
  Description of Artificial Sequence: Synthetic oligonucleotide
accgtccagaggatgtatggctgccac

SEQ ID NO: 7714 - DNA, 26 bp, Artificial Sequence
  Description of Artificial Sequence: Synthetic oligonucleotide
ccgtccagaggatgtatggctgccac

SEQ ID NO: 7715 - DNA, 27 bp, Artificial Sequence
  Description of Artificial Sequence: Synthetic oligonucleotide
cgtccagaggatgtatggctgccacgt

SEQ ID NO: 7716 - DNA, 27 bp, Artificial Sequence
  Description of Artificial Sequence: Synthetic oligonucleotide
gtccagaggatgtatggctgccacgtg

SEQ ID NO: 7717 - DNA, 27 bp, Artificial Sequence
  Description of Artificial Sequence: Synthetic oligonucleotide
tccagaggatgtatggctgccacgtgg

SEQ ID NO: 7718 - DNA, 26 bp, Artificial Sequence
  Description of Artificial Sequence: Synthetic oligonucleotide
ccagaggatgtatggctgccacgtgg

SEQ ID NO: 7719 - DNA, 26 bp, Artificial Sequence
  Description of Artificial Sequence: Synthetic oligonucleotide
cagaggatgtatggctgccacgtggg

SEQ ID NO: 7720 - DNA, 27 bp, Artificial Sequence
  Description of Artificial Sequence: Synthetic oligonucleotide
agaggatgtatggctgccacgtggggt

SEQ ID NO: 7721 - DNA, 26 bp, Artificial Sequence
  Description of Artificial Sequence: Synthetic oligonucleotide
gaggatgtatggctgccacgtggggt

SEQ ID NO: 7722 - DNA, 26 bp, Artificial Sequence
  Description of Artificial Sequence: Synthetic oligonucleotide
aggatgtatggctgccacgtggggtc

SEQ ID NO: 7723 - DNA, 25 bp, Artificial Sequence
  Description of Artificial Sequence: Synthetic oligonucleotide
ggatgtatggctgccacgtggggtc

SEQ ID NO: 7724 - DNA, 25 bp, Artificial Sequence
  Description of Artificial Sequence: Synthetic oligonucleotide
gatgtatggctgccacgtggggtcg

SEQ ID NO: 7725 - DNA, 26 bp, Artificial Sequence
  Description of Artificial Sequence: Synthetic oligonucleotide
atgtatggctgccacgtggggtcgga

SEQ ID NO: 7726 - DNA, 25 bp, Artificial Sequence
  Description of Artificial Sequence: Synthetic oligonucleotide
tgtatggctgccacgtggggtcgga

SEQ ID NO: 7727 - DNA, 24 bp, Artificial Sequence
  Description of Artificial Sequence: Synthetic oligonucleotide
gtatggctgccacgtggggtcgga

SEQ ID NO: 7728 - DNA, 25 bp, Artificial Sequence
  Description of Artificial Sequence: Synthetic oligonucleotide
tatggctgccacgtggggtcggact

SEQ ID NO: 7729 - DNA, 24 bp, Artificial Sequence
  Description of Artificial Sequence: Synthetic oligonucleotide
atggctgccacgtggggtcggact

SEQ ID NO: 7730 - DNA, 23 bp, Artificial Sequence
  Description of Artificial Sequence: Synthetic oligonucleotide
tggctgccacgtggggtcggact

SEQ ID NO: 7731 - DNA, 22 bp, Artificial Sequence
  Description of Artificial Sequence: Synthetic oligonucleotide
ggctgccacgtggggtcggact

SEQ ID NO: 7732 - DNA, 22 bp, Artificial Sequence
  Description of Artificial Sequence: Synthetic oligonucleotide
gctgccacgtggggtcggactg

SEQ ID NO: 7733 - DNA, 22 bp, Artificial Sequence
  Description of Artificial Sequence: Synthetic oligonucleotide
ctgccacgtggggtcggactgg

SEQ ID NO: 7734 - DNA, 22 bp, Artificial Sequence
  Description of Artificial Sequence: Synthetic oligonucleotide
tgccacgtggggtcggactggc

SEQ ID NO: 7735 - DNA, 21 bp, Artificial Sequence
  Description of Artificial Sequence: Synthetic oligonucleotide
gccacgtggggtcggactggc

SEQ ID NO: 7736 - DNA, 21 bp, Artificial Sequence
  Description of Artificial Sequence: Synthetic oligonucleotide
ccacgtggggtcggactggcg

SEQ ID NO: 7737 - DNA, 23 bp, Artificial Sequence
  Description of Artificial Sequence: Synthetic oligonucleotide
cacgtggggtcggactggcgctt

SEQ ID NO: 7738 - DNA, 25 bp, Artificial Sequence
  Description of Artificial Sequence: Synthetic oligonucleotide
cgtggatagagcaggagggtccgca

SEQ ID NO: 7739 - DNA, 27 bp, Artificial Sequence
  Description of Artificial Sequence: Synthetic oligonucleotide
gtggatagagcaggagggtccgcagta

SEQ ID NO: 7740 - DNA, 29 bp, Artificial Sequence
  Description of Artificial Sequence: Synthetic oligonucleotide
tggatagagcaggagggtccgcagtattg

SEQ ID NO: 7741 - DNA, 28 bp, Artificial Sequence
  Description of Artificial Sequence: Synthetic oligonucleotide
ggatagagcaggagggtccgcagtattg

SEQ ID NO: 7742 - DNA, 28 bp, Artificial Sequence
  Description of Artificial Sequence: Synthetic oligonucleotide
gatagagcaggagggtccgcagtattgg

SEQ ID NO: 7743 - DNA, 28 bp, Artificial Sequence
  Description of Artificial Sequence: Synthetic oligonucleotide
atagagcaggagggtccgcagtattggg

SEQ ID NO: 7744 - DNA, 27 bp, Artificial Sequence
  Description of Artificial Sequence: Synthetic oligonucleotide
tagagcaggagggtccgcagtattggg

SEQ ID NO: 7745 - DNA, 27 bp, Artificial Sequence
  Description of Artificial Sequence: Synthetic oligonucleotide
agagcaggagggtccgcagtattggga

SEQ ID NO: 7746 - DNA, 26 bp, Artificial Sequence
  Description of Artificial Sequence: Synthetic oligonucleotide
gagcaggagggtccgcagtattggga

SEQ ID NO: 7747 - DNA, 26 bp, Artificial Sequence
  Description of Artificial Sequence: Synthetic oligonucleotide
agcaggagggtccgcagtattgggac

SEQ ID NO: 7748 - DNA, 25 bp, Artificial Sequence
  Description of Artificial Sequence: Synthetic oligonucleotide
gcaggagggtccgcagtattgggac

SEQ ID NO: 7749 - DNA, 25 bp, Artificial Sequence
  Description of Artificial Sequence: Synthetic oligonucleotide
caggagggtccgcagtattgggacg

SEQ ID NO: 7750 - DNA, 25 bp, Artificial Sequence
  Description of Artificial Sequence: Synthetic oligonucleotide
aggagggtccgcagtattgggacgg

SEQ ID NO: 7751 - DNA, 24 bp, Artificial Sequence
  Description of Artificial Sequence: Synthetic oligonucleotide
ggagggtccgcagtattgggacgg

SEQ ID NO: 7752 - DNA, 24 bp, Artificial Sequence
  Description of Artificial Sequence: Synthetic oligonucleotide
gagggtccgcagtattgggacggg

SEQ ID NO: 7753 - DNA, 25 bp, Artificial Sequence
  Description of Artificial Sequence: Synthetic oligonucleotide
agggtccgcagtattgggacgggga

SEQ ID NO: 7754 - DNA, 24 bp, Artificial Sequence
  Description of Artificial Sequence: Synthetic oligonucleotide
gggtccgcagtattgggacgggga

SEQ ID NO: 7755 - DNA, 25 bp, Artificial Sequence
  Description of Artificial Sequence: Synthetic oligonucleotide
ggtccgcagtattgggacggggaga

SEQ ID NO: 7756 - DNA, 26 bp, Artificial Sequence
  Description of Artificial Sequence: Synthetic oligonucleotide
gtccgcagtattgggacggggagaca

SEQ ID NO: 7757 - DNA, 26 bp, Artificial Sequence
  Description of Artificial Sequence: Synthetic oligonucleotide
tccgcagtattgggacggggagacac

SEQ ID NO: 7758 - DNA, 25 bp, Artificial Sequence
  Description of Artificial Sequence: Synthetic oligonucleotide
ccgcagtattgggacggggagacac

SEQ ID NO: 7759 - DNA, 25 bp, Artificial Sequence
  Description of Artificial Sequence: Synthetic oligonucleotide
cgcagtattgggacggggagacacg

SEQ ID NO: 7760 - DNA, 27 bp, Artificial Sequence
  Description of Artificial Sequence: Synthetic oligonucleotide
gcagtattgggacggggagacacggaa

SEQ ID NO: 7761 - DNA, 28 bp, Artificial Sequence
  Description of Artificial Sequence: Synthetic oligonucleotide
cagtattgggacggggagacacggaaag

SEQ ID NO: 7762 - DNA, 27 bp, Artificial Sequence
  Description of Artificial Sequence: Synthetic oligonucleotide
tgcgcggctactacaaccagagcgaga

SEQ ID NO: 7763 - DNA, 26 bp, Artificial Sequence
  Description of Artificial Sequence: Synthetic oligonucleotide
gcgcggctactacaaccagagcgaga

SEQ ID NO: 7764 - DNA, 26 bp, Artificial Sequence
  Description of Artificial Sequence: Synthetic oligonucleotide
cgcggctactacaaccagagcgagac

SEQ ID NO: 7765 - DNA, 26 bp, Artificial Sequence
  Description of Artificial Sequence: Synthetic oligonucleotide
gcggctactacaaccagagcgagacc

SEQ ID NO: 7766 - DNA, 26 bp, Artificial Sequence
  Description of Artificial Sequence: Synthetic oligonucleotide
cggctactacaaccagagcgagaccg

SEQ ID NO: 7767 - DNA, 27 bp, Artificial Sequence
  Description of Artificial Sequence: Synthetic oligonucleotide
ggctactacaaccagagcgagaccggt

SEQ ID NO: 7768 - DNA, 28 bp, Artificial Sequence
  Description of Artificial Sequence: Synthetic oligonucleotide
gctactacaaccagagcgagaccggttc

SEQ ID NO: 7769 - DNA, 29 bp, Artificial Sequence
  Description of Artificial Sequence: Synthetic oligonucleotide
ctactacaaccagagcgagaccggttctc

SEQ ID NO: 7770 - DNA, 30 bp, Artificial Sequence
  Description of Artificial Sequence: Synthetic oligonucleotide
tactacaaccagagcgagaccggttctcac

SEQ ID NO: 7771 - DNA, 29 bp, Artificial Sequence
  Description of Artificial Sequence: Synthetic oligonucleotide
actacaaccagagcgagaccggttctcac

SEQ ID NO: 7772 - DNA, 28 bp, Artificial Sequence
  Description of Artificial Sequence: Synthetic oligonucleotide
ctacaaccagagcgagaccggttctcac

SEQ ID NO: 7773 - DNA, 29 bp, Artificial Sequence
  Description of Artificial Sequence: Synthetic oligonucleotide
tacaaccagagcgagaccggttctcacac

SEQ ID NO: 7774 - DNA, 28 bp, Artificial Sequence
  Description of Artificial Sequence: Synthetic oligonucleotide
acaaccagagcgagaccggttctcacac

SEQ ID NO: 7775 - DNA, 27 bp, Artificial Sequence
  Description of Artificial Sequence: Synthetic oligonucleotide
caaccagagcgagaccggttctcacac

SEQ ID NO: 7776 - DNA, 27 bp, Artificial Sequence
  Description of Artificial Sequence: Synthetic oligonucleotide
aaccagagcgagaccggttctcacacc

SEQ ID NO: 7777 - DNA, 26 bp, Artificial Sequence
  Description of Artificial Sequence: Synthetic oligonucleotide
accagagcgagaccggttctcacacc

SEQ ID NO: 7778 - DNA, 25 bp, Artificial Sequence
  Description of Artificial Sequence: Synthetic oligonucleotide
ccagagcgagaccggttctcacacc

SEQ ID NO: 7779 - DNA, 26 bp, Artificial Sequence
  Description of Artificial Sequence: Synthetic oligonucleotide
cagagcgagaccggttctcacaccgt

SEQ ID NO: 7780 - DNA, 26 bp, Artificial Sequence
  Description of Artificial Sequence: Synthetic oligonucleotide
agagcgagaccggttctcacaccgtc

SEQ ID NO: 7781 - DNA, 25 bp, Artificial Sequence
  Description of Artificial Sequence: Synthetic oligonucleotide
gagcgagaccggttctcacaccgtc

SEQ ID NO: 7782 - DNA, 26 bp, Artificial Sequence
  Description of Artificial Sequence: Synthetic oligonucleotide
agcgagaccggttctcacaccgtcca

SEQ ID NO: 7783 - DNA, 25 bp, Artificial Sequence
  Description of Artificial Sequence: Synthetic oligonucleotide
gcgagaccggttctcacaccgtcca

SEQ ID NO: 7784 - DNA, 26 bp, Artificial Sequence
  Description of Artificial Sequence: Synthetic oligonucleotide
cgagaccggttctcacaccgtccaga

SEQ ID NO: 7785 - DNA, 26 bp, Artificial Sequence
  Description of Artificial Sequence: Synthetic oligonucleotide
gagaccggttctcacaccgtccagag

SEQ ID NO: 7786 - DNA, 27 bp, Artificial Sequence
  Description of Artificial Sequence: Synthetic oligonucleotide
agaccggttctcacaccgtccagagga

SEQ ID NO: 7787 - DNA, 27 bp, Artificial Sequence
  Description of Artificial Sequence: Synthetic oligonucleotide
gaccggttctcacaccgtccagaggat

SEQ ID NO: 7788 - DNA, 27 bp, Artificial Sequence
  Description of Artificial Sequence: Synthetic oligonucleotide
accggttctcacaccgtccagaggatg

SEQ ID NO: 7789 - DNA, 29 bp, Artificial Sequence
  Description of Artificial Sequence: Synthetic oligonucleotide
tattgggacggggagacacggaaagtgag

SEQ ID NO: 7790 - DNA, 28 bp, Artificial Sequence
  Description of Artificial Sequence: Synthetic oligonucleotide
attgggacggggagacacggaaagtgag

SEQ ID NO: 7791 - DNA, 27 bp, Artificial Sequence
  Description of Artificial Sequence: Synthetic oligonucleotide
ttgggacggggagacacggaaagtgag

SEQ ID NO: 7792 - DNA, 26 bp, Artificial Sequence
  Description of Artificial Sequence: Synthetic oligonucleotide
tgggacggggagacacggaaagtgag

SEQ ID NO: 7793 - DNA, 25 bp, Artificial Sequence
  Description of Artificial Sequence: Synthetic oligonucleotide
gggacggggagacacggaaagtgag

SEQ ID NO: 7794 - DNA, 25 bp, Artificial Sequence
  Description of Artificial Sequence: Synthetic oligonucleotide
ggacggggagacacggaaagtgagg

SEQ ID NO: 7795 - DNA, 25 bp, Artificial Sequence
  Description of Artificial Sequence: Synthetic oligonucleotide
gacggggagacacggaaagtgaggg

SEQ ID NO: 7796 - DNA, 25 bp, Artificial Sequence
  Description of Artificial Sequence: Synthetic oligonucleotide
acggggagacacggaaagtgagggc

SEQ ID NO: 7797 - DNA, 24 bp, Artificial Sequence
  Description of Artificial Sequence: Synthetic oligonucleotide
cggggagacacggaaagtgagggc

SEQ ID NO: 7798 - DNA, 24 bp, Artificial Sequence
  Description of Artificial Sequence: Synthetic oligonucleotide
ggggagacacggaaagtgagggcc

SEQ ID NO: 7799 - DNA, 25 bp, Artificial Sequence
  Description of Artificial Sequence: Synthetic oligonucleotide
gggagacacggaaagtgagggccca

SEQ ID NO: 7800 - DNA, 26 bp, Artificial Sequence
  Description of Artificial Sequence: Synthetic oligonucleotide
ggagacacggaaagtgagggcccact

SEQ ID NO: 7801 - DNA, 27 bp, Artificial Sequence
  Description of Artificial Sequence: Synthetic oligonucleotide
gagacacggaaagtgagggcccactca

SEQ ID NO: 7802 - DNA, 27 bp, Artificial Sequence
  Description of Artificial Sequence: Synthetic oligonucleotide
agacacggaaagtgagggcccactcac

SEQ ID NO: 7803 - DNA, 27 bp, Artificial Sequence
  Description of Artificial Sequence: Synthetic oligonucleotide
gacacggaaagtgagggcccactcaca

SEQ ID NO: 7804 - DNA, 27 bp, Artificial Sequence
  Description of Artificial Sequence: Synthetic oligonucleotide
acacggaaagtgagggcccactcacag

SEQ ID NO: 7805 - DNA, 27 bp, Artificial Sequence
  Description of Artificial Sequence: Synthetic oligonucleotide
cacggaaagtgagggcccactcacaga

SEQ ID NO: 7806 - DNA, 27 bp, Artificial Sequence
  Description of Artificial Sequence: Synthetic oligonucleotide
acggaaagtgagggcccactcacagac

SEQ ID NO: 7807 - DNA, 27 bp, Artificial Sequence
  Description of Artificial Sequence: Synthetic oligonucleotide
cggaaagtgagggcccactcacagact

SEQ ID NO: 7808 - DNA, 27 bp, Artificial Sequence
  Description of Artificial Sequence: Synthetic oligonucleotide
ggaaagtgagggcccactcacagactc

SEQ ID NO: 7809 - DNA, 28 bp, Artificial Sequence
  Description of Artificial Sequence: Synthetic oligonucleotide
gaaagtgagggcccactcacagactcac

SEQ ID NO: 7810 - DNA, 28 bp, Artificial Sequence
  Description of Artificial Sequence: Synthetic oligonucleotide
aaagtgagggcccactcacagactcacc

SEQ ID NO: 7811 - DNA, 27 bp, Artificial Sequence
  Description of Artificial Sequence: Synthetic oligonucleotide
aagtgagggcccactcacagactcacc

SEQ ID NO: 7812 - DNA, 26 bp, Artificial Sequence
  Description of Artificial Sequence: Synthetic oligonucleotide
agtgagggcccactcacagactcacc

SEQ ID NO: 7813 - DNA, 25 bp, Artificial Sequence
  Description of Artificial Sequence: Synthetic oligonucleotide
gtgagggcccactcacagactcacc

SEQ ID NO: 7814 - DNA, 26 bp, Artificial Sequence
  Description of Artificial Sequence: Synthetic oligonucleotide
tgagggcccactcacagactcaccga

SEQ ID NO: 7815 - DNA, 25 bp, Artificial Sequence
  Description of Artificial Sequence: Synthetic oligonucleotide
gagggcccactcacagactcaccga

SEQ ID NO: 7816 - DNA, 26 bp, Artificial Sequence
  Description of Artificial Sequence: Synthetic oligonucleotide
agggcccactcacagactcaccgagt

SEQ ID NO: 7817 - DNA, 25 bp, Artificial Sequence
  Description of Artificial Sequence: Synthetic oligonucleotide
gggcccactcacagactcaccgagt

SEQ ID NO: 7818 - DNA, 28 bp, Artificial Sequence
  Description of Artificial Sequence: Synthetic oligonucleotide
tattgggacggggagacacggaaagtgg

SEQ ID NO: 7819 - DNA, 27 bp, Artificial Sequence
  Description of Artificial Sequence: Synthetic oligonucleotide
attgggacggggagacacggaaagtgg

SEQ ID NO: 7820 - DNA, 27 bp, Artificial Sequence
  Description of Artificial Sequence: Synthetic oligonucleotide
ttgggacggggagacacggaaagtgga

SEQ ID NO: 7821 - DNA, 26 bp, Artificial Sequence
  Description of Artificial Sequence: Synthetic oligonucleotide
tgggacggggagacacggaaagtgga

SEQ ID NO: 7822 - DNA, 25 bp, Artificial Sequence
  Description of Artificial Sequence: Synthetic oligonucleotide
gggacggggagacacggaaagtgga

SEQ ID NO: 7823 - DNA, 25 bp, Artificial Sequence
  Description of Artificial Sequence: Synthetic oligonucleotide
ggacggggagacacggaaagtggag

SEQ ID NO: 7824 - DNA, 25 bp, Artificial Sequence
  Description of Artificial Sequence: Synthetic oligonucleotide
gacggggagacacggaaagtggagg

SEQ ID NO: 7825 - DNA, 25 bp, Artificial Sequence
  Description of Artificial Sequence: Synthetic oligonucleotide
acggggagacacggaaagtggaggc

SEQ ID NO: 7826 - DNA, 24 bp, Artificial Sequence
  Description of Artificial Sequence: Synthetic oligonucleotide
cggggagacacggaaagtggaggc

SEQ ID NO: 7827 - DNA, 24 bp, Artificial Sequence
  Description of Artificial Sequence: Synthetic oligonucleotide
ggggagacacggaaagtggaggcc

SEQ ID NO: 7828 - DNA, 25 bp, Artificial Sequence
  Description of Artificial Sequence: Synthetic oligonucleotide
gggagacacggaaagtggaggccca

SEQ ID NO: 7829 - DNA, 26 bp, Artificial Sequence
  Description of Artificial Sequence: Synthetic oligonucleotide
ggagacacggaaagtggaggcccact

SEQ ID NO: 7830 - DNA, 27 bp, Artificial Sequence
  Description of Artificial Sequence: Synthetic oligonucleotide
gagacacggaaagtggaggcccactca

SEQ ID NO: 7831 - DNA, 27 bp, Artificial Sequence
  Description of Artificial Sequence: Synthetic oligonucleotide
agacacggaaagtggaggcccactcac

SEQ ID NO: 7832 - DNA, 27 bp, Artificial Sequence
  Description of Artificial Sequence: Synthetic oligonucleotide
gacacggaaagtggaggcccactcaca

SEQ ID NO: 7833 - DNA, 27 bp, Artificial Sequence
  Description of Artificial Sequence: Synthetic oligonucleotide
acacggaaagtggaggcccactcacag

SEQ ID NO: 7834 - DNA, 27 bp, Artificial Sequence
  Description of Artificial Sequence: Synthetic oligonucleotide
cacggaaagtggaggcccactcacaga

SEQ ID NO: 7835 - DNA, 27 bp, Artificial Sequence
  Description of Artificial Sequence: Synthetic oligonucleotide
acggaaagtggaggcccactcacagac

SEQ ID NO: 7836 - DNA, 27 bp, Artificial Sequence
  Description of Artificial Sequence: Synthetic oligonucleotide
cggaaagtggaggcccactcacagact

SEQ ID NO: 7837 - DNA, 27 bp, Artificial Sequence
  Description of Artificial Sequence: Synthetic oligonucleotide
ggaaagtggaggcccactcacagactc

SEQ ID NO: 7838 - DNA, 28 bp, Artificial Sequence
  Description of Artificial Sequence: Synthetic oligonucleotide
gaaagtggaggcccactcacagactcac

SEQ ID NO: 7839 - DNA, 28 bp, Artificial Sequence
  Description of Artificial Sequence: Synthetic oligonucleotide
aaagtggaggcccactcacagactcacc

SEQ ID NO: 7840 - DNA, 27 bp, Artificial Sequence
  Description of Artificial Sequence: Synthetic oligonucleotide
aagtggaggcccactcacagactcacc

SEQ ID NO: 7841 - DNA, 26 bp, Artificial Sequence
  Description of Artificial Sequence: Synthetic oligonucleotide
agtggaggcccactcacagactcacc

SEQ ID NO: 7842 - DNA, 25 bp, Artificial Sequence
  Description of Artificial Sequence: Synthetic oligonucleotide
gtggaggcccactcacagactcacc

SEQ ID NO: 7843 - DNA, 26 bp, Artificial Sequence
  Description of Artificial Sequence: Synthetic oligonucleotide
tggaggcccactcacagactcaccga

SEQ ID NO: 7844 - DNA, 25 bp, Artificial Sequence
  Description of Artificial Sequence: Synthetic oligonucleotide
ggaggcccactcacagactcaccga

SEQ ID NO: 7845 - DNA, 26 bp, Artificial Sequence
  Description of Artificial Sequence: Synthetic oligonucleotide
gaggcccactcacagactcaccgagt

SEQ ID NO: 7846 - DNA, 27 bp, Artificial Sequence
  Description of Artificial Sequence: Synthetic oligonucleotide
gagtattgggacggggagacacggaac

SEQ ID NO: 7847 - DNA, 27 bp, Artificial Sequence
  Description of Artificial Sequence: Synthetic oligonucleotide
agtattgggacggggagacacggaacg

SEQ ID NO: 7848 - DNA, 27 bp, Artificial Sequence
  Description of Artificial Sequence: Synthetic oligonucleotide
gtattgggacggggagacacggaacgt

SEQ ID NO: 7849 - DNA, 27 bp, Artificial Sequence
  Description of Artificial Sequence: Synthetic oligonucleotide
tattgggacggggagacacggaacgtg

SEQ ID NO: 7850 - DNA, 27 bp, Artificial Sequence
  Description of Artificial Sequence: Synthetic oligonucleotide
attgggacggggagacacggaacgtga

SEQ ID NO: 7851 - DNA, 27 bp, Artificial Sequence
  Description of Artificial Sequence: Synthetic oligonucleotide
ttgggacggggagacacggaacgtgaa

SEQ ID NO: 7852 - DNA, 26 bp, Artificial Sequence
  Description of Artificial Sequence: Synthetic oligonucleotide
tgggacggggagacacggaacgtgaa

SEQ ID NO: 7853 - DNA, 25 bp, Artificial Sequence
  Description of Artificial Sequence: Synthetic oligonucleotide
gggacggggagacacggaacgtgaa

SEQ ID NO: 7854 - DNA, 25 bp, Artificial Sequence
  Description of Artificial Sequence: Synthetic oligonucleotide
ggacggggagacacggaacgtgaag

SEQ ID NO: 7855 - DNA, 25 bp, Artificial Sequence
  Description of Artificial Sequence: Synthetic oligonucleotide
gacggggagacacggaacgtgaagg

SEQ ID NO: 7856 - DNA, 25 bp, Artificial Sequence
  Description of Artificial Sequence: Synthetic oligonucleotide
acggggagacacggaacgtgaaggc

SEQ ID NO: 7857 - DNA, 24 bp, Artificial Sequence
  Description of Artificial Sequence: Synthetic oligonucleotide
cggggagacacggaacgtgaaggc

SEQ ID NO: 7858 - DNA, 24 bp, Artificial Sequence
  Description of Artificial Sequence: Synthetic oligonucleotide
ggggagacacggaacgtgaaggcc

SEQ ID NO: 7859 - DNA, 25 bp, Artificial Sequence
  Description of Artificial Sequence: Synthetic oligonucleotide
gggagacacggaacgtgaaggccca

SEQ ID NO: 7860 - DNA, 26 bp, Artificial Sequence
  Description of Artificial Sequence: Synthetic oligonucleotide
ggagacacggaacgtgaaggcccact

SEQ ID NO: 7861 - DNA, 27 bp, Artificial Sequence
  Description of Artificial Sequence: Synthetic oligonucleotide
gagacacggaacgtgaaggcccactca

SEQ ID NO: 7862 - DNA, 27 bp, Artificial Sequence
  Description of Artificial Sequence: Synthetic oligonucleotide
agacacggaacgtgaaggcccactcac

SEQ ID NO: 7863 - DNA, 27 bp, Artificial Sequence
  Description of Artificial Sequence: Synthetic oligonucleotide
gacacggaacgtgaaggcccactcaca

SEQ ID NO: 7864 - DNA, 27 bp, Artificial Sequence
  Description of Artificial Sequence: Synthetic oligonucleotide
acacggaacgtgaaggcccactcacag

SEQ ID NO: 7865 - DNA, 27 bp, Artificial Sequence
  Description of Artificial Sequence: Synthetic oligonucleotide
cacggaacgtgaaggcccactcacaga

SEQ ID NO: 7866 - DNA, 27 bp, Artificial Sequence
  Description of Artificial Sequence: Synthetic oligonucleotide
acggaacgtgaaggcccactcacagac

SEQ ID NO: 7867 - DNA, 27 bp, Artificial Sequence
  Description of Artificial Sequence: Synthetic oligonucleotide
cggaacgtgaaggcccactcacagact

SEQ ID NO: 7868 - DNA, 27 bp, Artificial Sequence
  Description of Artificial Sequence: Synthetic oligonucleotide
ggaacgtgaaggcccactcacagactc

SEQ ID NO: 7869 - DNA, 28 bp, Artificial Sequence
  Description of Artificial Sequence: Synthetic oligonucleotide
gaacgtgaaggcccactcacagactcac

SEQ ID NO: 7870 - DNA, 28 bp, Artificial Sequence
  Description of Artificial Sequence: Synthetic oligonucleotide
aacgtgaaggcccactcacagactcacc

SEQ ID NO: 7871 - DNA, 27 bp, Artificial Sequence
  Description of Artificial Sequence: Synthetic oligonucleotide
acgtgaaggcccactcacagactcacc

SEQ ID NO: 7872 - DNA, 26 bp, Artificial Sequence
  Description of Artificial Sequence: Synthetic oligonucleotide
cgtgaaggcccactcacagactcacc

SEQ ID NO: 7873 - DNA, 27 bp, Artificial Sequence
  Description of Artificial Sequence: Synthetic oligonucleotide
gcttcatcgcagtgggctacgtggaca

SEQ ID NO: 7874 - DNA, 28 bp, Artificial Sequence
  Description of Artificial Sequence: Synthetic oligonucleotide
cttcatcgcagtgggctacgtggacaac

SEQ ID NO: 7875 - DNA, 29 bp, Artificial Sequence
  Description of Artificial Sequence: Synthetic oligonucleotide
ttcatcgcagtgggctacgtggacaacac

SEQ ID NO: 7876 - DNA, 28 bp, Artificial Sequence
  Description of Artificial Sequence: Synthetic oligonucleotide
tcatcgcagtgggctacgtggacaacac

SEQ ID NO: 7877 - DNA, 27 bp, Artificial Sequence
  Description of Artificial Sequence: Synthetic oligonucleotide
catcgcagtgggctacgtggacaacac

SEQ ID NO: 7878 - DNA, 27 bp, Artificial Sequence
  Description of Artificial Sequence: Synthetic oligonucleotide
atcgcagtgggctacgtggacaacacg

SEQ ID NO: 7879 - DNA, 26 bp, Artificial Sequence
  Description of Artificial Sequence: Synthetic oligonucleotide
tcgcagtgggctacgtggacaacacg

SEQ ID NO: 7880 - DNA, 25 bp, Artificial Sequence
  Description of Artificial Sequence: Synthetic oligonucleotide
cgcagtgggctacgtggacaacacg

SEQ ID NO: 7881 - DNA, 26 bp, Artificial Sequence
  Description of Artificial Sequence: Synthetic oligonucleotide
gcagtgggctacgtggacaacacgca

SEQ ID NO: 7882 - DNA, 27 bp, Artificial Sequence
  Description of Artificial Sequence: Synthetic oligonucleotide
cagtgggctacgtggacaacacgcagt

SEQ ID NO: 7883 - DNA, 28 bp, Artificial Sequence
  Description of Artificial Sequence: Synthetic oligonucleotide
agtgggctacgtggacaacacgcagttc

SEQ ID NO: 7884 - DNA, 27 bp, Artificial Sequence
  Description of Artificial Sequence: Synthetic oligonucleotide
gtgggctacgtggacaacacgcagttc

SEQ ID NO: 7885 - DNA, 27 bp, Artificial Sequence
  Description of Artificial Sequence: Synthetic oligonucleotide
tgggctacgtggacaacacgcagttcg

SEQ ID NO: 7886 - DNA, 27 bp, Artificial Sequence
  Description of Artificial Sequence: Synthetic oligonucleotide
gggctacgtggacaacacgcagttcgt

SEQ ID NO: 7887 - DNA, 27 bp, Artificial Sequence
  Description of Artificial Sequence: Synthetic oligonucleotide
ggctacgtggacaacacgcagttcgtg

SEQ ID NO: 7888 - DNA, 27 bp, Artificial Sequence
  Description of Artificial Sequence: Synthetic oligonucleotide
gctacgtggacaacacgcagttcgtgc

SEQ ID NO: 7889 - DNA, 27 bp, Artificial Sequence
  Description of Artificial Sequence: Synthetic oligonucleotide
ctacgtggacaacacgcagttcgtgcg

SEQ ID NO: 7890 - DNA, 27 bp, Artificial Sequence
  Description of Artificial Sequence: Synthetic oligonucleotide
tacgtggacaacacgcagttcgtgcgg

SEQ ID NO: 7891 - DNA, 27 bp, Artificial Sequence
  Description of Artificial Sequence: Synthetic oligonucleotide
acgtggacaacacgcagttcgtgcggt

SEQ ID NO: 7892 - DNA, 27 bp, Artificial Sequence
  Description of Artificial Sequence: Synthetic oligonucleotide
cgtggacaacacgcagttcgtgcggtt

SEQ ID NO: 7893 - DNA, 27 bp, Artificial Sequence
  Description of Artificial Sequence: Synthetic oligonucleotide
gtggacaacacgcagttcgtgcggttc

SEQ ID NO: 7894 - DNA, 27 bp, Artificial Sequence
  Description of Artificial Sequence: Synthetic oligonucleotide
tggacaacacgcagttcgtgcggttcg

SEQ ID NO: 7895 - DNA, 27 bp, Artificial Sequence
  Description of Artificial Sequence: Synthetic oligonucleotide
ggacaacacgcagttcgtgcggttcga

SEQ ID NO: 7896 - DNA, 27 bp, Artificial Sequence
  Description of Artificial Sequence: Synthetic oligonucleotide
gacaacacgcagttcgtgcggttcgac

SEQ ID NO: 7897 - DNA, 28 bp, Artificial Sequence
  Description of Artificial Sequence: Synthetic oligonucleotide
acaacacgcagttcgtgcggttcgacag

SEQ ID NO: 7898 - DNA, 27 bp, Artificial Sequence
  Description of Artificial Sequence: Synthetic oligonucleotide
caacacgcagttcgtgcggttcgacag

SEQ ID NO: 7899 - DNA, 27 bp, Artificial Sequence
  Description of Artificial Sequence: Synthetic oligonucleotide
aacacgcagttcgtgcggttcgacagc

SEQ ID NO: 7900 - DNA, 26 bp, Artificial Sequence
  Description of Artificial Sequence: Synthetic oligonucleotide
aaccagagcgaggccggttctcacag

SEQ ID NO: 7901 - DNA, 25 bp, Artificial Sequence
  Description of Artificial Sequence: Synthetic oligonucleotide
accagagcgaggccggttctcacag

SEQ ID NO: 7902 - DNA, 24 bp, Artificial Sequence
  Description of Artificial Sequence: Synthetic oligonucleotide
ccagagcgaggccggttctcacag

SEQ ID NO: 7903 - DNA, 24 bp, Artificial Sequence
  Description of Artificial Sequence: Synthetic oligonucleotide
cagagcgaggccggttctcacagc

SEQ ID NO: 7904 - DNA, 25 bp, Artificial Sequence
  Description of Artificial Sequence: Synthetic oligonucleotide
agagcgaggccggttctcacagcgt

SEQ ID NO: 7905 - DNA, 24 bp, Artificial Sequence
  Description of Artificial Sequence: Synthetic oligonucleotide
gagcgaggccggttctcacagcgt

SEQ ID NO: 7906 - DNA, 24 bp, Artificial Sequence
  Description of Artificial Sequence: Synthetic oligonucleotide
agcgaggccggttctcacagcgtc

SEQ ID NO: 7907 - DNA, 23 bp, Artificial Sequence
  Description of Artificial Sequence: Synthetic oligonucleotide
gcgaggccggttctcacagcgtc

SEQ ID NO: 7908 - DNA, 24 bp, Artificial Sequence
  Description of Artificial Sequence: Synthetic oligonucleotide
cgaggccggttctcacagcgtcca

SEQ ID NO: 7909 - DNA, 25 bp, Artificial Sequence
  Description of Artificial Sequence: Synthetic oligonucleotide
gaggccggttctcacagcgtccaga

SEQ ID NO: 7910 - DNA, 25 bp, Artificial Sequence
  Description of Artificial Sequence: Synthetic oligonucleotide
aggccggttctcacagcgtccagag

SEQ ID NO: 7911 - DNA, 24 bp, Artificial Sequence
  Description of Artificial Sequence: Synthetic oligonucleotide
ggccggttctcacagcgtccagag

SEQ ID NO: 7912 - DNA, 26 bp, Artificial Sequence
  Description of Artificial Sequence: Synthetic oligonucleotide
gccggttctcacagcgtccagaggat

SEQ ID NO: 7913 - DNA, 27 bp, Artificial Sequence
  Description of Artificial Sequence: Synthetic oligonucleotide
ccggttctcacagcgtccagaggatgt

SEQ ID NO: 7914 - DNA, 29 bp, Artificial Sequence
  Description of Artificial Sequence: Synthetic oligonucleotide
cggttctcacagcgtccagaggatgtatg

SEQ ID NO: 7915 - DNA, 29 bp, Artificial Sequence
  Description of Artificial Sequence: Synthetic oligonucleotide
ggttctcacagcgtccagaggatgtatgg

SEQ ID NO: 7916 - DNA, 29 bp, Artificial Sequence
  Description of Artificial Sequence: Synthetic oligonucleotide
gttctcacagcgtccagaggatgtatggc

SEQ ID NO: 7917 - DNA, 30 bp, Artificial Sequence
  Description of Artificial Sequence: Synthetic oligonucleotide
ttctcacagcgtccagaggatgtatggctg

SEQ ID NO: 7918 - DNA, 29 bp, Artificial Sequence
  Description of Artificial Sequence: Synthetic oligonucleotide
tctcacagcgtccagaggatgtatggctg

SEQ ID NO: 7919 - DNA, 28 bp, Artificial Sequence
  Description of Artificial Sequence: Synthetic oligonucleotide
ctcacagcgtccagaggatgtatggctg

SEQ ID NO: 7920 - DNA, 28 bp, Artificial Sequence
  Description of Artificial Sequence: Synthetic oligonucleotide
tcacagcgtccagaggatgtatggctgc

SEQ ID NO: 7921 - DNA, 27 bp, Artificial Sequence
  Description of Artificial Sequence: Synthetic oligonucleotide
cacagcgtccagaggatgtatggctgc

SEQ ID NO: 7922 - DNA, 27 bp, Artificial Sequence
  Description of Artificial Sequence: Synthetic oligonucleotide
acagcgtccagaggatgtatggctgcg

SEQ ID NO: 7923 - DNA, 27 bp, Artificial Sequence
  Description of Artificial Sequence: Synthetic oligonucleotide
cagcgtccagaggatgtatggctgcga

SEQ ID NO: 7924 - DNA, 27 bp, Artificial Sequence
  Description of Artificial Sequence: Synthetic oligonucleotide
agcgtccagaggatgtatggctgcgac

SEQ ID NO: 7925 - DNA, 26 bp, Artificial Sequence
  Description of Artificial Sequence: Synthetic oligonucleotide
gcgtccagaggatgtatggctgcgac

SEQ ID NO: 7926 - DNA, 27 bp, Artificial Sequence
  Description of Artificial Sequence: Synthetic oligonucleotide
cgtccagaggatgtatggctgcgacct

SEQ ID NO: 7927 - DNA, 27 bp, Artificial Sequence
  Description of Artificial Sequence: Synthetic oligonucleotide
gtccagaggatgtatggctgcgacctg

SEQ ID NO: 7928 - DNA, 27 bp, Artificial Sequence
  Description of Artificial Sequence: Synthetic oligonucleotide
tccagaggatgtatggctgcgacctgg

SEQ ID NO: 7929 - DNA, 26 bp, Artificial Sequence
  Description of Artificial Sequence: Synthetic oligonucleotide
ccagaggatgtatggctgcgacctgg

SEQ ID NO: 7930 - DNA, 26 bp, Artificial Sequence
  Description of Artificial Sequence: Synthetic oligonucleotide
cagaggatgtatggctgcgacctggg

SEQ ID NO: 7931 - DNA, 27 bp, Artificial Sequence
  Description of Artificial Sequence: Synthetic oligonucleotide
agaggatgtatggctgcgacctggggt

SEQ ID NO: 7932 - DNA, 26 bp, Artificial Sequence
  Description of Artificial Sequence: Synthetic oligonucleotide
gaggatgtatggctgcgacctggggt

SEQ ID NO: 7933 - DNA, 26 bp, Artificial Sequence
  Description of Artificial Sequence: Synthetic oligonucleotide
aggatgtatggctgcgacctggggtc

SEQ ID NO: 7934 - DNA, 25 bp, Artificial Sequence
  Description of Artificial Sequence: Synthetic oligonucleotide
ggatgtatggctgcgacctggggtc

SEQ ID NO: 7935 - DNA, 25 bp, Artificial Sequence
  Description of Artificial Sequence: Synthetic oligonucleotide
gatgtatggctgcgacctggggtcg

SEQ ID NO: 7936 - DNA, 26 bp, Artificial Sequence
  Description of Artificial Sequence: Synthetic oligonucleotide
atgtatggctgcgacctggggtcgga

SEQ ID NO: 7937 - DNA, 25 bp, Artificial Sequence
  Description of Artificial Sequence: Synthetic oligonucleotide
tgtatggctgcgacctggggtcgga

SEQ ID NO: 7938 - DNA, 24 bp, Artificial Sequence
  Description of Artificial Sequence: Synthetic oligonucleotide
gtatggctgcgacctggggtcgga

SEQ ID NO: 7939 - DNA, 25 bp, Artificial Sequence
  Description of Artificial Sequence: Synthetic oligonucleotide
tatggctgcgacctggggtcggact

SEQ ID NO: 7940 - DNA, 24 bp, Artificial Sequence
  Description of Artificial Sequence: Synthetic oligonucleotide
atggctgcgacctggggtcggact

SEQ ID NO: 7941 - DNA, 23 bp, Artificial Sequence
  Description of Artificial Sequence: Synthetic oligonucleotide
tggctgcgacctggggtcggact

SEQ ID NO: 7942 - DNA, 22 bp, Artificial Sequence
  Description of Artificial Sequence: Synthetic oligonucleotide
ggctgcgacctggggtcggact

SEQ ID NO: 7943 - DNA, 22 bp, Artificial Sequence
  Description of Artificial Sequence: Synthetic oligonucleotide
gctgcgacctggggtcggactg

SEQ ID NO: 7944 - DNA, 22 bp, Artificial Sequence
  Description of Artificial Sequence: Synthetic oligonucleotide
ctgcgacctggggtcggactgg

SEQ ID NO: 7945 - DNA, 22 bp, Artificial Sequence
  Description of Artificial Sequence: Synthetic oligonucleotide
tgcgacctggggtcggactggc

SEQ ID NO: 7946 - DNA, 21 bp, Artificial Sequence
  Description of Artificial Sequence: Synthetic oligonucleotide
gcgacctggggtcggactggc

SEQ ID NO: 7947 - DNA, 21 bp, Artificial Sequence
  Description of Artificial Sequence: Synthetic oligonucleotide
cgacctggggtcggactggcg

SEQ ID NO: 7948 - DNA, 23 bp, Artificial Sequence
  Description of Artificial Sequence: Synthetic oligonucleotide
gacctggggtcggactggcgctt

SEQ ID NO: 7949 - DNA, 23 bp, Artificial Sequence
  Description of Artificial Sequence: Synthetic oligonucleotide
acctggggtcggactggcgcttc

SEQ ID NO: 7950 - DNA, 22 bp, Artificial Sequence
  Description of Artificial Sequence: Synthetic oligonucleotide
cctggggtcggactggcgcttc

SEQ ID NO: 7951 - DNA, 23 bp, Artificial Sequence
  Description of Artificial Sequence: Synthetic oligonucleotide
ctggggtcggactggcgcttcct

SEQ ID NO: 7952 - DNA, 25 bp, Artificial Sequence
  Description of Artificial Sequence: Synthetic oligonucleotide
gccggttctcacaccgtccagagga

SEQ ID NO: 7953 - DNA, 25 bp, Artificial Sequence
  Description of Artificial Sequence: Synthetic oligonucleotide
ccggttctcacaccgtccagaggag

SEQ ID NO: 7954 - DNA, 27 bp, Artificial Sequence
  Description of Artificial Sequence: Synthetic oligonucleotide
cggttctcacaccgtccagaggaggta

SEQ ID NO: 7955 - DNA, 28 bp, Artificial Sequence
  Description of Artificial Sequence: Synthetic oligonucleotide
ggttctcacaccgtccagaggaggtatg

SEQ ID NO: 7956 - DNA, 28 bp, Artificial Sequence
  Description of Artificial Sequence: Synthetic oligonucleotide
gttctcacaccgtccagaggaggtatgg

SEQ ID NO: 7957 - DNA, 28 bp, Artificial Sequence
  Description of Artificial Sequence: Synthetic oligonucleotide
ttctcacaccgtccagaggaggtatggc

SEQ ID NO: 7958 - DNA, 27 bp, Artificial Sequence
  Description of Artificial Sequence: Synthetic oligonucleotide
tctcacaccgtccagaggaggtatggc

SEQ ID NO: 7959 - DNA, 27 bp, Artificial Sequence
  Description of Artificial Sequence: Synthetic oligonucleotide
ctcacaccgtccagaggaggtatggct

SEQ ID NO: 7960 - DNA, 27 bp, Artificial Sequence
  Description of Artificial Sequence: Synthetic oligonucleotide
tcacaccgtccagaggaggtatggctg

SEQ ID NO: 7961 - DNA, 26 bp, Artificial Sequence
  Description of Artificial Sequence: Synthetic oligonucleotide
cacaccgtccagaggaggtatggctg

SEQ ID NO: 7962 - DNA, 26 bp, Artificial Sequence
  Description of Artificial Sequence: Synthetic oligonucleotide
acaccgtccagaggaggtatggctgc

SEQ ID NO: 7963 - DNA, 25 bp, Artificial Sequence
  Description of Artificial Sequence: Synthetic oligonucleotide
caccgtccagaggaggtatggctgc

SEQ ID NO: 7964 - DNA, 26 bp, Artificial Sequence
  Description of Artificial Sequence: Synthetic oligonucleotide
accgtccagaggaggtatggctgcga

SEQ ID NO: 7965 - DNA, 25 bp, Artificial Sequence
  Description of Artificial Sequence: Synthetic oligonucleotide
ccgtccagaggaggtatggctgcga

SEQ ID NO: 7966 - DNA, 25 bp, Artificial Sequence
  Description of Artificial Sequence: Synthetic oligonucleotide
cgtccagaggaggtatggctgcgac

SEQ ID NO: 7967 - DNA, 26 bp, Artificial Sequence
  Description of Artificial Sequence: Synthetic oligonucleotide
gtccagaggaggtatggctgcgacgt

SEQ ID NO: 7968 - DNA, 26 bp, Artificial Sequence
  Description of Artificial Sequence: Synthetic oligonucleotide
tccagaggaggtatggctgcgacgtg

SEQ ID NO: 7969 - DNA, 25 bp, Artificial Sequence
  Description of Artificial Sequence: Synthetic oligonucleotide
ccagaggaggtatggctgcgacgtg

SEQ ID NO: 7970 - DNA, 25 bp, Artificial Sequence
  Description of Artificial Sequence: Synthetic oligonucleotide
cagaggaggtatggctgcgacgtgg

SEQ ID NO: 7971 - DNA, 25 bp, Artificial Sequence
  Description of Artificial Sequence: Synthetic oligonucleotide
agaggaggtatggctgcgacgtggg

SEQ ID NO: 7972 - DNA, 24 bp, Artificial Sequence
  Description of Artificial Sequence: Synthetic oligonucleotide
gaggaggtatggctgcgacgtggg

SEQ ID NO: 7973 - DNA, 25 bp, Artificial Sequence
  Description of Artificial Sequence: Synthetic oligonucleotide
aggaggtatggctgcgacgtggggt

SEQ ID NO: 7974 - DNA, 24 bp, Artificial Sequence
  Description of Artificial Sequence: Synthetic oligonucleotide
ggaggtatggctgcgacgtggggt

SEQ ID NO: 7975 - DNA, 24 bp, Artificial Sequence
  Description of Artificial Sequence: Synthetic oligonucleotide
gaggtatggctgcgacgtggggtc

SEQ ID NO: 7976 - DNA, 24 bp, Artificial Sequence
  Description of Artificial Sequence: Synthetic oligonucleotide
aggtatggctgcgacgtggggtcg

SEQ ID NO: 7977 - DNA, 23 bp, Artificial Sequence
  Description of Artificial Sequence: Synthetic oligonucleotide
ggtatggctgcgacgtggggtcg

SEQ ID NO: 7978 - DNA, 24 bp, Artificial Sequence
  Description of Artificial Sequence: Synthetic oligonucleotide
gccggttctcacaccgtccagagg

SEQ ID NO: 7979 - DNA, 25 bp, Artificial Sequence
  Description of Artificial Sequence: Synthetic oligonucleotide
ccggttctcacaccgtccagagggt

SEQ ID NO: 7980 - DNA, 27 bp, Artificial Sequence
  Description of Artificial Sequence: Synthetic oligonucleotide
cggttctcacaccgtccagagggtgta

SEQ ID NO: 7981 - DNA, 28 bp, Artificial Sequence
  Description of Artificial Sequence: Synthetic oligonucleotide
ggttctcacaccgtccagagggtgtatg

SEQ ID NO: 7982 - DNA, 28 bp, Artificial Sequence
  Description of Artificial Sequence: Synthetic oligonucleotide
gttctcacaccgtccagagggtgtatgg

SEQ ID NO: 7983 - DNA, 28 bp, Artificial Sequence
  Description of Artificial Sequence: Synthetic oligonucleotide
ttctcacaccgtccagagggtgtatggc

SEQ ID NO: 7984 - DNA, 27 bp, Artificial Sequence
  Description of Artificial Sequence: Synthetic oligonucleotide
tctcacaccgtccagagggtgtatggc

SEQ ID NO: 7985 - DNA, 27 bp, Artificial Sequence
  Description of Artificial Sequence: Synthetic oligonucleotide
ctcacaccgtccagagggtgtatggct

SEQ ID NO: 7986 - DNA, 27 bp, Artificial Sequence
  Description of Artificial Sequence: Synthetic oligonucleotide
tcacaccgtccagagggtgtatggctg

SEQ ID NO: 7987 - DNA, 26 bp, Artificial Sequence
  Description of Artificial Sequence: Synthetic oligonucleotide
cacaccgtccagagggtgtatggctg

SEQ ID NO: 7988 - DNA, 26 bp, Artificial Sequence
  Description of Artificial Sequence: Synthetic oligonucleotide
acaccgtccagagggtgtatggctgc

SEQ ID NO: 7989 - DNA, 25 bp, Artificial Sequence
  Description of Artificial Sequence: Synthetic oligonucleotide
caccgtccagagggtgtatggctgc

SEQ ID NO: 7990 - DNA, 26 bp, Artificial Sequence
  Description of Artificial Sequence: Synthetic oligonucleotide
accgtccagagggtgtatggctgcga

SEQ ID NO: 7991 - DNA, 25 bp, Artificial Sequence
  Description of Artificial Sequence: Synthetic oligonucleotide
ccgtccagagggtgtatggctgcga

SEQ ID NO: 7992 - DNA, 25 bp, Artificial Sequence
  Description of Artificial Sequence: Synthetic oligonucleotide
cgtccagagggtgtatggctgcgac

SEQ ID NO: 7993 - DNA, 26 bp, Artificial Sequence
  Description of Artificial Sequence: Synthetic oligonucleotide
gtccagagggtgtatggctgcgacgt

SEQ ID NO: 7994 - DNA, 26 bp, Artificial Sequence
  Description of Artificial Sequence: Synthetic oligonucleotide
tccagagggtgtatggctgcgacgtg

SEQ ID NO: 7995 - DNA, 25 bp, Artificial Sequence
  Description of Artificial Sequence: Synthetic oligonucleotide
ccagagggtgtatggctgcgacgtg

SEQ ID NO: 7996 - DNA, 25 bp, Artificial Sequence
  Description of Artificial Sequence: Synthetic oligonucleotide
cagagggtgtatggctgcgacgtgg

SEQ ID NO: 7997 - DNA, 25 bp, Artificial Sequence
  Description of Artificial Sequence: Synthetic oligonucleotide
agagggtgtatggctgcgacgtggg

SEQ ID NO: 7998 - DNA, 24 bp, Artificial Sequence
  Description of Artificial Sequence: Synthetic oligonucleotide
gagggtgtatggctgcgacgtggg

SEQ ID NO: 7999 - DNA, 25 bp, Artificial Sequence
  Description of Artificial Sequence: Synthetic oligonucleotide
agggtgtatggctgcgacgtggggt

SEQ ID NO: 8000 - DNA, 24 bp, Artificial Sequence
  Description of Artificial Sequence: Synthetic oligonucleotide
gggtgtatggctgcgacgtggggt

SEQ ID NO: 8001 - DNA, 24 bp, Artificial Sequence
  Description of Artificial Sequence: Synthetic oligonucleotide
ggtgtatggctgcgacgtggggtc

SEQ ID NO: 8002 - DNA, 24 bp, Artificial Sequence
  Description of Artificial Sequence: Synthetic oligonucleotide
gtgtatggctgcgacgtggggtcg

SEQ ID NO: 8003 - DNA, 22 bp, Artificial Sequence
  Description of Artificial Sequence: Synthetic oligonucleotide
ggtcggactggcgcttcctccc

SEQ ID NO: 8004 - DNA, 22 bp, Artificial Sequence
  Description of Artificial Sequence: Synthetic oligonucleotide
gtcggactggcgcttcctcccc

SEQ ID NO: 8005 - DNA, 22 bp, Artificial Sequence
  Description of Artificial Sequence: Synthetic oligonucleotide
tcggactggcgcttcctccccg

SEQ ID NO: 8006 - DNA, 21 bp, Artificial Sequence
  Description of Artificial Sequence: Synthetic oligonucleotide
cggactggcgcttcctccccg

SEQ ID NO: 8007 - DNA, 21 bp, Artificial Sequence
  Description of Artificial Sequence: Synthetic oligonucleotide
ggactggcgcttcctccccgg

SEQ ID NO: 8008 - DNA, 23 bp, Artificial Sequence
  Description of Artificial Sequence: Synthetic oligonucleotide
gactggcgcttcctccccgggta

SEQ ID NO: 8009 - DNA, 23 bp, Artificial Sequence
  Description of Artificial Sequence: Synthetic oligonucleotide
actggcgcttcctccccgggtac

SEQ ID NO: 8010 - DNA, 22 bp, Artificial Sequence
  Description of Artificial Sequence: Synthetic oligonucleotide
ctggcgcttcctccccgggtac

SEQ ID NO: 8011 - DNA, 23 bp, Artificial Sequence
  Description of Artificial Sequence: Synthetic oligonucleotide
tggcgcttcctccccgggtacca

SEQ ID NO: 8012 - DNA, 22 bp, Artificial Sequence
  Description of Artificial Sequence: Synthetic oligonucleotide
ggcgcttcctccccgggtacca

SEQ ID NO: 8013 - DNA, 22 bp, Artificial Sequence
  Description of Artificial Sequence: Synthetic oligonucleotide
gcgcttcctccccgggtaccac

SEQ ID NO: 8014 - DNA, 23 bp, Artificial Sequence
  Description of Artificial Sequence: Synthetic oligonucleotide
cgcttcctccccgggtaccacca

SEQ ID NO: 8015 - DNA, 25 bp, Artificial Sequence
  Description of Artificial Sequence: Synthetic oligonucleotide
gcttcctccccgggtaccaccagta

SEQ ID NO: 8016 - DNA, 25 bp, Artificial Sequence
  Description of Artificial Sequence: Synthetic oligonucleotide
cttcctccccgggtaccaccagtac

SEQ ID NO: 8017 - DNA, 25 bp, Artificial Sequence
  Description of Artificial Sequence: Synthetic oligonucleotide
ttcctccccgggtaccaccagtacg

SEQ ID NO: 8018 - DNA, 24 bp, Artificial Sequence
  Description of Artificial Sequence: Synthetic oligonucleotide
tcctccccgggtaccaccagtacg

SEQ ID NO: 8019 - DNA, 23 bp, Artificial Sequence
  Description of Artificial Sequence: Synthetic oligonucleotide
cctccccgggtaccaccagtacg

SEQ ID NO: 8020 - DNA, 23 bp, Artificial Sequence
  Description of Artificial Sequence: Synthetic oligonucleotide
ctccccgggtaccaccagtacgc

SEQ ID NO: 8021 - DNA, 25 bp, Artificial Sequence
  Description of Artificial Sequence: Synthetic oligonucleotide
tccccgggtaccaccagtacgccta

SEQ ID NO: 8022 - DNA, 24 bp, Artificial Sequence
  Description of Artificial Sequence: Synthetic oligonucleotide
ccccgggtaccaccagtacgccta

SEQ ID NO: 8023 - DNA, 24 bp, Artificial Sequence
  Description of Artificial Sequence: Synthetic oligonucleotide
cccgggtaccaccagtacgcctac

SEQ ID NO: 8024 - DNA, 25 bp, Artificial Sequence
  Description of Artificial Sequence: Synthetic oligonucleotide
ccgggtaccaccagtacgcctacga

SEQ ID NO: 8025 - DNA, 28 bp, Artificial Sequence
  Description of Artificial Sequence: Synthetic oligonucleotide
cagtacgcctacgacggcaaggattacg

SEQ ID NO: 8026 - DNA, 29 bp, Artificial Sequence
  Description of Artificial Sequence: Synthetic oligonucleotide
agtacgcctacgacggcaaggattacgtc

SEQ ID NO: 8027 - DNA, 28 bp, Artificial Sequence
  Description of Artificial Sequence: Synthetic oligonucleotide
gtacgcctacgacggcaaggattacgtc

SEQ ID NO: 8028 - DNA, 28 bp, Artificial Sequence
  Description of Artificial Sequence: Synthetic oligonucleotide
tacgcctacgacggcaaggattacgtcg

SEQ ID NO: 8029 - DNA, 27 bp, Artificial Sequence
  Description of Artificial Sequence: Synthetic oligonucleotide
acgcctacgacggcaaggattacgtcg

SEQ ID NO: 8030 - DNA, 26 bp, Artificial Sequence
  Description of Artificial Sequence: Synthetic oligonucleotide
cgcctacgacggcaaggattacgtcg

SEQ ID NO: 8031 - DNA, 26 bp, Artificial Sequence
  Description of Artificial Sequence: Synthetic oligonucleotide
gcctacgacggcaaggattacgtcgc

SEQ ID NO: 8032 - DNA, 26 bp, Artificial Sequence
  Description of Artificial Sequence: Synthetic oligonucleotide
cctacgacggcaaggattacgtcgcc

SEQ ID NO: 8033 - DNA, 27 bp, Artificial Sequence
  Description of Artificial Sequence: Synthetic oligonucleotide
ctacgacggcaaggattacgtcgccct

SEQ ID NO: 8034 - DNA, 27 bp, Artificial Sequence
  Description of Artificial Sequence: Synthetic oligonucleotide
tacgacggcaaggattacgtcgccctg

SEQ ID NO: 8035 - DNA, 27 bp, Artificial Sequence
  Description of Artificial Sequence: Synthetic oligonucleotide
acgacggcaaggattacgtcgccctga

SEQ ID NO: 8036 - DNA, 27 bp, Artificial Sequence
  Description of Artificial Sequence: Synthetic oligonucleotide
cgacggcaaggattacgtcgccctgaa

SEQ ID NO: 8037 - DNA, 28 bp, Artificial Sequence
  Description of Artificial Sequence: Synthetic oligonucleotide
gacggcaaggattacgtcgccctgaaag

SEQ ID NO: 8038 - DNA, 29 bp, Artificial Sequence
  Description of Artificial Sequence: Synthetic oligonucleotide
acggcaaggattacgtcgccctgaaagag

SEQ ID NO: 8039 - DNA, 28 bp, Artificial Sequence
  Description of Artificial Sequence: Synthetic oligonucleotide
cggcaaggattacgtcgccctgaaagag

SEQ ID NO: 8040 - DNA, 28 bp, Artificial Sequence
  Description of Artificial Sequence: Synthetic oligonucleotide
ggcaaggattacgtcgccctgaaagagg

SEQ ID NO: 8041 - DNA, 29 bp, Artificial Sequence
  Description of Artificial Sequence: Synthetic oligonucleotide
gcaaggattacgtcgccctgaaagaggac

SEQ ID NO: 8042 - DNA, 29 bp, Artificial Sequence
  Description of Artificial Sequence: Synthetic oligonucleotide
caaggattacgtcgccctgaaagaggacc

SEQ ID NO: 8043 - DNA, 30 bp, Artificial Sequence
  Description of Artificial Sequence: Synthetic oligonucleotide
aaggattacgtcgccctgaaagaggacctg

SEQ ID NO: 8044 - DNA, 29 bp, Artificial Sequence
  Description of Artificial Sequence: Synthetic oligonucleotide
aggattacgtcgccctgaaagaggacctg

SEQ ID NO: 8045 - DNA, 28 bp, Artificial Sequence
  Description of Artificial Sequence: Synthetic oligonucleotide
ggattacgtcgccctgaaagaggacctg

SEQ ID NO: 8046 - DNA, 28 bp, Artificial Sequence
  Description of Artificial Sequence: Synthetic oligonucleotide
gattacgtcgccctgaaagaggacctgc

SEQ ID NO: 8047 - DNA, 28 bp, Artificial Sequence
  Description of Artificial Sequence: Synthetic oligonucleotide
attacgtcgccctgaaagaggacctgcg

SEQ ID NO: 8048 - DNA, 27 bp, Artificial Sequence
  Description of Artificial Sequence: Synthetic oligonucleotide
ttacgtcgccctgaaagaggacctgcg

SEQ ID NO: 8049 - DNA, 26 bp, Artificial Sequence
  Description of Artificial Sequence: Synthetic oligonucleotide
tacgtcgccctgaaagaggacctgcg

SEQ ID NO: 8050 - DNA, 25 bp, Artificial Sequence
  Description of Artificial Sequence: Synthetic oligonucleotide
acgtcgccctgaaagaggacctgcg

SEQ ID NO: 8051 - DNA, 24 bp, Artificial Sequence
  Description of Artificial Sequence: Synthetic oligonucleotide
cgtcgccctgaaagaggacctgcg

SEQ ID NO: 8052 - DNA, 25 bp, Artificial Sequence
  Description of Artificial Sequence: Synthetic oligonucleotide
gtcgccctgaaagaggacctgcgct

SEQ ID NO: 8053 - DNA, 27 bp, Artificial Sequence
  Description of Artificial Sequence: Synthetic oligonucleotide
ctacgtggacgacacgcagttcgtgct

SEQ ID NO: 8054 - DNA, 27 bp, Artificial Sequence
  Description of Artificial Sequence: Synthetic oligonucleotide
tacgtggacgacacgcagttcgtgctg

SEQ ID NO: 8055 - DNA, 27 bp, Artificial Sequence
  Description of Artificial Sequence: Synthetic oligonucleotide
acgtggacgacacgcagttcgtgctgt

SEQ ID NO: 8056 - DNA, 27 bp, Artificial Sequence
  Description of Artificial Sequence: Synthetic oligonucleotide
cgtggacgacacgcagttcgtgctgtt

SEQ ID NO: 8057 - DNA, 27 bp, Artificial Sequence
  Description of Artificial Sequence: Synthetic oligonucleotide
gtggacgacacgcagttcgtgctgttc

SEQ ID NO: 8058 - DNA, 27 bp, Artificial Sequence
  Description of Artificial Sequence: Synthetic oligonucleotide
tggacgacacgcagttcgtgctgttcg

SEQ ID NO: 8059 - DNA, 27 bp, Artificial Sequence
  Description of Artificial Sequence: Synthetic oligonucleotide
ggacgacacgcagttcgtgctgttcga

SEQ ID NO: 8060 - DNA, 27 bp, Artificial Sequence
  Description of Artificial Sequence: Synthetic oligonucleotide
gacgacacgcagttcgtgctgttcgac

SEQ ID NO: 8061 - DNA, 28 bp, Artificial Sequence
  Description of Artificial Sequence: Synthetic oligonucleotide
acgacacgcagttcgtgctgttcgacag

SEQ ID NO: 8062 - DNA, 27 bp, Artificial Sequence
  Description of Artificial Sequence: Synthetic oligonucleotide
cgacacgcagttcgtgctgttcgacag

SEQ ID NO: 8063 - DNA, 27 bp, Artificial Sequence
  Description of Artificial Sequence: Synthetic oligonucleotide
gacacgcagttcgtgctgttcgacagc

SEQ ID NO: 8064 - DNA, 27 bp, Artificial Sequence
  Description of Artificial Sequence: Synthetic oligonucleotide
acacgcagttcgtgctgttcgacagcg

SEQ ID NO: 8065 - DNA, 27 bp, Artificial Sequence
  Description of Artificial Sequence: Synthetic oligonucleotide
cacgcagttcgtgctgttcgacagcga

SEQ ID NO: 8066 - DNA, 27 bp, Artificial Sequence
  Description of Artificial Sequence: Synthetic oligonucleotide
acgcagttcgtgctgttcgacagcgac

SEQ ID NO: 8067 - DNA, 26 bp, Artificial Sequence
  Description of Artificial Sequence: Synthetic oligonucleotide
cgcagttcgtgctgttcgacagcgac

SEQ ID NO: 8068 - DNA, 26 bp, Artificial Sequence
  Description of Artificial Sequence: Synthetic oligonucleotide
gcagttcgtgctgttcgacagcgacg

SEQ ID NO: 8069 - DNA, 26 bp, Artificial Sequence
  Description of Artificial Sequence: Synthetic oligonucleotide
cagttcgtgctgttcgacagcgacgc

SEQ ID NO: 8070 - DNA, 26 bp, Artificial Sequence
  Description of Artificial Sequence: Synthetic oligonucleotide
agttcgtgctgttcgacagcgacgcc

SEQ ID NO: 8071 - DNA, 25 bp, Artificial Sequence
  Description of Artificial Sequence: Synthetic oligonucleotide
gttcgtgctgttcgacagcgacgcc

SEQ ID NO: 8072 - DNA, 25 bp, Artificial Sequence
  Description of Artificial Sequence: Synthetic oligonucleotide
ttcgtgctgttcgacagcgacgccg

SEQ ID NO: 8073 - DNA, 24 bp, Artificial Sequence
  Description of Artificial Sequence: Synthetic oligonucleotide
tcgtgctgttcgacagcgacgccg

SEQ ID NO: 8074 - DNA, 23 bp, Artificial Sequence
  Description of Artificial Sequence: Synthetic oligonucleotide
cgtgctgttcgacagcgacgccg

SEQ ID NO: 8075 - DNA, 23 bp, Artificial Sequence
  Description of Artificial Sequence: Synthetic oligonucleotide
gtgctgttcgacagcgacgccgc

SEQ ID NO: 8076 - DNA, 24 bp, Artificial Sequence
  Description of Artificial Sequence: Synthetic oligonucleotide
tgctgttcgacagcgacgccgcga

SEQ ID NO: 8077 - DNA, 23 bp, Artificial Sequence
  Description of Artificial Sequence: Synthetic oligonucleotide
gctgttcgacagcgacgccgcga

SEQ ID NO: 8078 - DNA, 23 bp, Artificial Sequence
  Description of Artificial Sequence: Synthetic oligonucleotide
ctgttcgacagcgacgccgcgag

SEQ ID NO: 8079 - DNA, 23 bp, Artificial Sequence
  Description of Artificial Sequence: Synthetic oligonucleotide
tgttcgacagcgacgccgcgagc

SEQ ID NO: 8080 - DNA, 24 bp, Artificial Sequence
  Description of Artificial Sequence: Synthetic oligonucleotide
ggagccccgcttcatcgcagtgga

SEQ ID NO: 8081 - DNA, 26 bp, Artificial Sequence
  Description of Artificial Sequence: Synthetic oligonucleotide
gagccccgcttcatcgcagtggacta

SEQ ID NO: 8082 - DNA, 26 bp, Artificial Sequence
  Description of Artificial Sequence: Synthetic oligonucleotide
agccccgcttcatcgcagtggactac

SEQ ID NO: 8083 - DNA, 25 bp, Artificial Sequence
  Description of Artificial Sequence: Synthetic oligonucleotide
gccccgcttcatcgcagtggactac

SEQ ID NO: 8084 - DNA, 26 bp, Artificial Sequence
  Description of Artificial Sequence: Synthetic oligonucleotide
ccccgcttcatcgcagtggactacgt

SEQ ID NO: 8085 - DNA, 26 bp, Artificial Sequence
  Description of Artificial Sequence: Synthetic oligonucleotide
cccgcttcatcgcagtggactacgtg

SEQ ID NO: 8086 - DNA, 27 bp, Artificial Sequence
  Description of Artificial Sequence: Synthetic oligonucleotide
ccgcttcatcgcagtggactacgtgga

SEQ ID NO: 8087 - DNA, 27 bp, Artificial Sequence
  Description of Artificial Sequence: Synthetic oligonucleotide
cgcttcatcgcagtggactacgtggac

SEQ ID NO: 8088 - DNA, 27 bp, Artificial Sequence
  Description of Artificial Sequence: Synthetic oligonucleotide
gcttcatcgcagtggactacgtggacg

SEQ ID NO: 8089 - DNA, 28 bp, Artificial Sequence
  Description of Artificial Sequence: Synthetic oligonucleotide
cttcatcgcagtggactacgtggacgac

SEQ ID NO: 8090 - DNA, 29 bp, Artificial Sequence
  Description of Artificial Sequence: Synthetic oligonucleotide
ttcatcgcagtggactacgtggacgacac

SEQ ID NO: 8091 - DNA, 28 bp, Artificial Sequence
  Description of Artificial Sequence: Synthetic oligonucleotide
tcatcgcagtggactacgtggacgacac

SEQ ID NO: 8092 - DNA, 27 bp, Artificial Sequence
  Description of Artificial Sequence: Synthetic oligonucleotide
catcgcagtggactacgtggacgacac

SEQ ID NO: 8093 - DNA, 27 bp, Artificial Sequence
  Description of Artificial Sequence: Synthetic oligonucleotide
atcgcagtggactacgtggacgacacg

SEQ ID NO: 8094 - DNA, 26 bp, Artificial Sequence
  Description of Artificial Sequence: Synthetic oligonucleotide
tcgcagtggactacgtggacgacacg

SEQ ID NO: 8095 - DNA, 25 bp, Artificial Sequence
  Description of Artificial Sequence: Synthetic oligonucleotide
cgcagtggactacgtggacgacacg

SEQ ID NO: 8096 - DNA, 26 bp, Artificial Sequence
  Description of Artificial Sequence: Synthetic oligonucleotide
gcagtggactacgtggacgacacgca

SEQ ID NO: 8097 - DNA, 27 bp, Artificial Sequence
  Description of Artificial Sequence: Synthetic oligonucleotide
cagtggactacgtggacgacacgcagt

SEQ ID NO: 8098 - DNA, 28 bp, Artificial Sequence
  Description of Artificial Sequence: Synthetic oligonucleotide
agtggactacgtggacgacacgcagttc

SEQ ID NO: 8099 - DNA, 27 bp, Artificial Sequence
  Description of Artificial Sequence: Synthetic oligonucleotide
gtggactacgtggacgacacgcagttc

SEQ ID NO: 8100 - DNA, 27 bp, Artificial Sequence
  Description of Artificial Sequence: Synthetic oligonucleotide
tggactacgtggacgacacgcagttcg

SEQ ID NO: 8101 - DNA, 27 bp, Artificial Sequence
  Description of Artificial Sequence: Synthetic oligonucleotide
ggactacgtggacgacacgcagttcgt

SEQ ID NO: 8102 - DNA, 27 bp, Artificial Sequence
  Description of Artificial Sequence: Synthetic oligonucleotide
gactacgtggacgacacgcagttcgtg

SEQ ID NO: 8103 - DNA, 27 bp, Artificial Sequence
  Description of Artificial Sequence: Synthetic oligonucleotide
actacgtggacgacacgcagttcgtgc

SEQ ID NO: 8104 - DNA, 22 bp, Artificial Sequence
  Description of Artificial Sequence: Synthetic oligonucleotide
cgctcttggaccgcggcggaca

SEQ ID NO: 8105 - DNA, 22 bp, Artificial Sequence
  Description of Artificial Sequence: Synthetic oligonucleotide
gctcttggaccgcggcggacag

SEQ ID NO: 8106 - DNA, 22 bp, Artificial Sequence
  Description of Artificial Sequence: Synthetic oligonucleotide
ctcttggaccgcggcggacagg

SEQ ID NO: 8107 - DNA, 22 bp, Artificial Sequence
  Description of Artificial Sequence: Synthetic oligonucleotide
tcttggaccgcggcggacaggg

SEQ ID NO: 8108 - DNA, 21 bp, Artificial Sequence
  Description of Artificial Sequence: Synthetic oligonucleotide
cttggaccgcggcggacaggg

SEQ ID NO: 8109 - DNA, 22 bp, Artificial Sequence
  Description of Artificial Sequence: Synthetic oligonucleotide
ttggaccgcggcggacagggca

SEQ ID NO: 8110 - DNA, 21 bp, Artificial Sequence
  Description of Artificial Sequence: Synthetic oligonucleotide
tggaccgcggcggacagggca

SEQ ID NO: 8111 - DNA, 20 bp, Artificial Sequence
  Description of Artificial Sequence: Synthetic oligonucleotide
ggaccgcggcggacagggca

SEQ ID NO: 8112 - DNA, 20 bp, Artificial Sequence
  Description of Artificial Sequence: Synthetic oligonucleotide
gaccgcggcggacagggcag

SEQ ID NO: 8113 - DNA, 21 bp, Artificial Sequence
  Description of Artificial Sequence: Synthetic oligonucleotide
accgcggcggacagggcagct

SEQ ID NO: 8114 - DNA, 20 bp, Artificial Sequence
  Description of Artificial Sequence: Synthetic oligonucleotide
ccgcggcggacagggcagct

SEQ ID NO: 8115 - DNA, 21 bp, Artificial Sequence
  Description of Artificial Sequence: Synthetic oligonucleotide
cgcggcggacagggcagctca

SEQ ID NO: 8116 - DNA, 22 bp, Artificial Sequence
  Description of Artificial Sequence: Synthetic oligonucleotide
gcggcggacagggcagctcaga

SEQ ID NO: 8117 - DNA, 22 bp, Artificial Sequence
  Description of Artificial Sequence: Synthetic oligonucleotide
cggcggacagggcagctcagac

SEQ ID NO: 8118 - DNA, 23 bp, Artificial Sequence
  Description of Artificial Sequence: Synthetic oligonucleotide
ggcggacagggcagctcagacca

SEQ ID NO: 8119 - DNA, 23 bp, Artificial Sequence
  Description of Artificial Sequence: Synthetic oligonucleotide
gcggacagggcagctcagaccac

SEQ ID NO: 8120 - DNA, 25 bp, Artificial Sequence
  Description of Artificial Sequence: Synthetic oligonucleotide
cggacagggcagctcagaccaccaa

SEQ ID NO: 8121 - DNA, 25 bp, Artificial Sequence
  Description of Artificial Sequence: Synthetic oligonucleotide
ggacagggcagctcagaccaccaag

SEQ ID NO: 8122 - DNA, 26 bp, Artificial Sequence
  Description of Artificial Sequence: Synthetic oligonucleotide
gacagggcagctcagaccaccaagca

SEQ ID NO: 8123 - DNA, 27 bp, Artificial Sequence
  Description of Artificial Sequence: Synthetic oligonucleotide
acagggcagctcagaccaccaagcaca

SEQ ID NO: 8124 - DNA, 27 bp, Artificial Sequence
  Description of Artificial Sequence: Synthetic oligonucleotide
cagggcagctcagaccaccaagcacaa

SEQ ID NO: 8125 - DNA, 27 bp, Artificial Sequence
  Description of Artificial Sequence: Synthetic oligonucleotide
agggcagctcagaccaccaagcacaag

SEQ ID NO: 8126 - DNA, 27 bp, Artificial Sequence
  Description of Artificial Sequence: Synthetic oligonucleotide
gggcagctcagaccaccaagcacaagt

SEQ ID NO: 8127 - DNA, 35 bp, Artificial Sequence
  Description of Artificial Sequence: Synthetic oligonucleotide
tctcactccatgaggtatttcttcacatccgtgtg

SEQ ID NO: 8128 - DNA, 34 bp, Artificial Sequence
  Description of Artificial Sequence: Synthetic oligonucleotide
ctcactccatgaggtatttcttcacatccgtgtg

SEQ ID NO: 8129 - DNA, 34 bp, Artificial Sequence
  Description of Artificial Sequence: Synthetic oligonucleotide
tcactccatgaggtatttcttcacatccgtgtgc

SEQ ID NO: 8130 - DNA, 33 bp, Artificial Sequence
  Description of Artificial Sequence: Synthetic oligonucleotide
cactccatgaggtatttcttcacatccgtgtgc

SEQ ID NO: 8131 - DNA, 33 bp, Artificial Sequence
  Description of Artificial Sequence: Synthetic oligonucleotide
actccatgaggtatttcttcacatccgtgtgcc

SEQ ID NO: 8132 - DNA, 32 bp, Artificial Sequence
  Description of Artificial Sequence: Synthetic oligonucleotide
ctccatgaggtatttcttcacatccgtgtgcc

SEQ ID NO: 8133 - DNA, 32 bp, Artificial Sequence
  Description of Artificial Sequence: Synthetic oligonucleotide
tccatgaggtatttcttcacatccgtgtgccg

SEQ ID NO: 8134 - DNA, 31 bp, Artificial Sequence
  Description of Artificial Sequence: Synthetic oligonucleotide
ccatgaggtatttcttcacatccgtgtgccg

SEQ ID NO: 8135 - DNA, 31 bp, Artificial Sequence
  Description of Artificial Sequence: Synthetic oligonucleotide
catgaggtatttcttcacatccgtgtgccgg

SEQ ID NO: 8136 - DNA, 31 bp, Artificial Sequence
  Description of Artificial Sequence: Synthetic oligonucleotide
atgaggtatttcttcacatccgtgtgccggc

SEQ ID NO: 8137 - DNA, 30 bp, Artificial Sequence
  Description of Artificial Sequence: Synthetic oligonucleotide
tgaggtatttcttcacatccgtgtgccggc

SEQ ID NO: 8138 - DNA, 29 bp, Artificial Sequence
  Description of Artificial Sequence: Synthetic oligonucleotide
gaggtatttcttcacatccgtgtgccggc

SEQ ID NO: 8139 - DNA, 29 bp, Artificial Sequence
  Description of Artificial Sequence: Synthetic oligonucleotide
aggtatttcttcacatccgtgtgccggcc

SEQ ID NO: 8140 - DNA, 28 bp, Artificial Sequence
  Description of Artificial Sequence: Synthetic oligonucleotide
ggtatttcttcacatccgtgtgccggcc

SEQ ID NO: 8141 - DNA, 28 bp, Artificial Sequence
  Description of Artificial Sequence: Synthetic oligonucleotide
gtatttcttcacatccgtgtgccggccc

SEQ ID NO: 8142 - DNA, 28 bp, Artificial Sequence
  Description of Artificial Sequence: Synthetic oligonucleotide
tatttcttcacatccgtgtgccggcccg

SEQ ID NO: 8143 - DNA, 27 bp, Artificial Sequence
  Description of Artificial Sequence: Synthetic oligonucleotide
atttcttcacatccgtgtgccggcccg

SEQ ID NO: 8144 - DNA, 26 bp, Artificial Sequence
  Description of Artificial Sequence: Synthetic oligonucleotide
tttcttcacatccgtgtgccggcccg

SEQ ID NO: 8145 - DNA, 25 bp, Artificial Sequence
  Description of Artificial Sequence: Synthetic oligonucleotide
ttcttcacatccgtgtgccggcccg

SEQ ID NO: 8146 - DNA, 24 bp, Artificial Sequence
  Description of Artificial Sequence: Synthetic oligonucleotide
tcttcacatccgtgtgccggcccg

SEQ ID NO: 8147 - DNA, 23 bp, Artificial Sequence
  Description of Artificial Sequence: Synthetic oligonucleotide
cttcacatccgtgtgccggcccg

SEQ ID NO: 8148 - DNA, 23 bp, Artificial Sequence
  Description of Artificial Sequence: Synthetic oligonucleotide
ttcacatccgtgtgccggcccgg

SEQ ID NO: 8149 - DNA, 22 bp, Artificial Sequence
  Description of Artificial Sequence: Synthetic oligonucleotide
tcacatccgtgtgccggcccgg

SEQ ID NO: 8150 - DNA, 21 bp, Artificial Sequence
  Description of Artificial Sequence: Synthetic oligonucleotide
cacatccgtgtgccggcccgg

SEQ ID NO: 8151 - DNA, 21 bp, Artificial Sequence
  Description of Artificial Sequence: Synthetic oligonucleotide
acatccgtgtgccggcccggc

SEQ ID NO: 8152 - DNA, 20 bp, Artificial Sequence
  Description of Artificial Sequence: Synthetic oligonucleotide
catccgtgtgccggcccggc

SEQ ID NO: 8153 - DNA, 20 bp, Artificial Sequence
  Description of Artificial Sequence: Synthetic oligonucleotide
atccgtgtgccggcccggcc

SEQ ID NO: 8154 - DNA, 20 bp, Artificial Sequence
  Description of Artificial Sequence: Synthetic oligonucleotide
tccgtgtgccggcccggcct

SEQ ID NO: 8155 - DNA, 20 bp, Artificial Sequence
  Description of Artificial Sequence: Synthetic oligonucleotide
ccgtgtgccggcccggcctt

SEQ ID NO: 8156 - DNA, 20 bp, Artificial Sequence
  Description of Artificial Sequence: Synthetic oligonucleotide
cgtgtgccggcccggccgtt

SEQ ID NO: 8157 - DNA, 20 bp, Artificial Sequence
  Description of Artificial Sequence: Synthetic oligonucleotide
gtgtgccggcccggccgctt

SEQ ID NO: 8158 - DNA, 20 bp, Artificial Sequence
  Description of Artificial Sequence: Synthetic oligonucleotide
tgtgccggcccggccgcgtt

SEQ ID NO: 8159 - DNA, 20 bp, Artificial Sequence
  Description of Artificial Sequence: Synthetic oligonucleotide
gtgccggcccggccgcgttt

SEQ ID NO: 8160 - DNA, 20 bp, Artificial Sequence
  Description of Artificial Sequence: Synthetic oligonucleotide
tgccggcccggccgcggttt

SEQ ID NO: 8161 - DNA, 20 bp, Artificial Sequence
  Description of Artificial Sequence: Synthetic oligonucleotide
gccggcccggccgcggtttt

SEQ ID NO: 8162 - DNA, 21 bp, Artificial Sequence
  Description of Artificial Sequence: Synthetic oligonucleotide
cgctcttggaccgcggcggac

SEQ ID NO: 8163 - DNA, 22 bp, Artificial Sequence
  Description of Artificial Sequence: Synthetic oligonucleotide
gctcttggaccgcggcggacgt

SEQ ID NO: 8164 - DNA, 22 bp, Artificial Sequence
  Description of Artificial Sequence: Synthetic oligonucleotide
ctcttggaccgcggcggacgtg

SEQ ID NO: 8165 - DNA, 22 bp, Artificial Sequence
  Description of Artificial Sequence: Synthetic oligonucleotide
tcttggaccgcggcggacgtgg

SEQ ID NO: 8166 - DNA, 21 bp, Artificial Sequence
  Description of Artificial Sequence: Synthetic oligonucleotide
cttggaccgcggcggacgtgg

SEQ ID NO: 8167 - DNA, 22 bp, Artificial Sequence
  Description of Artificial Sequence: Synthetic oligonucleotide
ttggaccgcggcggacgtggca

SEQ ID NO: 8168 - DNA, 21 bp, Artificial Sequence
  Description of Artificial Sequence: Synthetic oligonucleotide
tggaccgcggcggacgtggca

SEQ ID NO: 8169 - DNA, 20 bp, Artificial Sequence
  Description of Artificial Sequence: Synthetic oligonucleotide
ggaccgcggcggacgtggca

SEQ ID NO: 8170 - DNA, 20 bp, Artificial Sequence
  Description of Artificial Sequence: Synthetic oligonucleotide
gaccgcggcggacgtggcag

SEQ ID NO: 8171 - DNA, 21 bp, Artificial Sequence
  Description of Artificial Sequence: Synthetic oligonucleotide
accgcggcggacgtggcagct

SEQ ID NO: 8172 - DNA, 20 bp, Artificial Sequence
  Description of Artificial Sequence: Synthetic oligonucleotide
ccgcggcggacgtggcagct

SEQ ID NO: 8173 - DNA, 21 bp, Artificial Sequence
  Description of Artificial Sequence: Synthetic oligonucleotide
cgcggcggacgtggcagctca

SEQ ID NO: 8174 - DNA, 22 bp, Artificial Sequence
  Description of Artificial Sequence: Synthetic oligonucleotide
gcggcggacgtggcagctcaga

SEQ ID NO: 8175 - DNA, 22 bp, Artificial Sequence
  Description of Artificial Sequence: Synthetic oligonucleotide
cggcggacgtggcagctcagac

SEQ ID NO: 8176 - DNA, 23 bp, Artificial Sequence
  Description of Artificial Sequence: Synthetic oligonucleotide
ggcggacgtggcagctcagacca

SEQ ID NO: 8177 - DNA, 23 bp, Artificial Sequence
  Description of Artificial Sequence: Synthetic oligonucleotide
gcggacgtggcagctcagaccac

SEQ ID NO: 8178 - DNA, 25 bp, Artificial Sequence
  Description of Artificial Sequence: Synthetic oligonucleotide
cggacgtggcagctcagaccaccaa

SEQ ID NO: 8179 - DNA, 25 bp, Artificial Sequence
  Description of Artificial Sequence: Synthetic oligonucleotide
ggacgtggcagctcagaccaccaag

SEQ ID NO: 8180 - DNA, 26 bp, Artificial Sequence
  Description of Artificial Sequence: Synthetic oligonucleotide
gacgtggcagctcagaccaccaagca

SEQ ID NO: 8181 - DNA, 27 bp, Artificial Sequence
  Description of Artificial Sequence: Synthetic oligonucleotide
acgtggcagctcagaccaccaagcaca

SEQ ID NO: 8182 - DNA, 27 bp, Artificial Sequence
  Description of Artificial Sequence: Synthetic oligonucleotide
cgtggcagctcagaccaccaagcacaa

SEQ ID NO: 8183 - DNA, 27 bp, Artificial Sequence
  Description of Artificial Sequence: Synthetic oligonucleotide
gtggcagctcagaccaccaagcacaag

SEQ ID NO: 8184 - DNA, 31 bp, Artificial Sequence
  Description of Artificial Sequence: Synthetic oligonucleotide
tacgacggcaaggattacatcgccctgtaag

SEQ ID NO: 8185 - DNA, 30 bp, Artificial Sequence
  Description of Artificial Sequence: Synthetic oligonucleotide
acgacggcaaggattacatcgccctgtaag

SEQ ID NO: 8186 - DNA, 29 bp, Artificial Sequence
  Description of Artificial Sequence: Synthetic oligonucleotide
cgacggcaaggattacatcgccctgtaag

SEQ ID NO: 8187 - DNA, 30 bp, Artificial Sequence
  Description of Artificial Sequence: Synthetic oligonucleotide
gacggcaaggattacatcgccctgtaagag

SEQ ID NO: 8188 - DNA, 30 bp, Artificial Sequence
  Description of Artificial Sequence: Synthetic oligonucleotide
acggcaaggattacatcgccctgtaagagg

SEQ ID NO: 8189 - DNA, 29 bp, Artificial Sequence
  Description of Artificial Sequence: Synthetic oligonucleotide
cggcaaggattacatcgccctgtaagagg

SEQ ID NO: 8190 - DNA, 30 bp, Artificial Sequence
  Description of Artificial Sequence: Synthetic oligonucleotide
ggcaaggattacatcgccctgtaagaggac

SEQ ID NO: 8191 - DNA, 30 bp, Artificial Sequence
  Description of Artificial Sequence: Synthetic oligonucleotide
gcaaggattacatcgccctgtaagaggacc

SEQ ID NO: 8192 - DNA, 31 bp, Artificial Sequence
  Description of Artificial Sequence: Synthetic oligonucleotide
caaggattacatcgccctgtaagaggacctg

SEQ ID NO: 8193 - DNA, 31 bp, Artificial Sequence
  Description of Artificial Sequence: Synthetic oligonucleotide
aaggattacatcgccctgtaagaggacctgc

SEQ ID NO: 8194 - DNA, 30 bp, Artificial Sequence
  Description of Artificial Sequence: Synthetic oligonucleotide
aggattacatcgccctgtaagaggacctgc

SEQ ID NO: 8195 - DNA, 29 bp, Artificial Sequence
  Description of Artificial Sequence: Synthetic oligonucleotide
ggattacatcgccctgtaagaggacctgc

SEQ ID NO: 8196 - DNA, 29 bp, Artificial Sequence
  Description of Artificial Sequence: Synthetic oligonucleotide
gattacatcgccctgtaagaggacctgcg

SEQ ID NO: 8197 - DNA, 29 bp, Artificial Sequence
  Description of Artificial Sequence: Synthetic oligonucleotide
attacatcgccctgtaagaggacctgcgc

SEQ ID NO: 8198 - DNA, 28 bp, Artificial Sequence
  Description of Artificial Sequence: Synthetic oligonucleotide
ttacatcgccctgtaagaggacctgcgc

SEQ ID NO: 8199 - DNA, 27 bp, Artificial Sequence
  Description of Artificial Sequence: Synthetic oligonucleotide
tacatcgccctgtaagaggacctgcgc

SEQ ID NO: 8200 - DNA, 27 bp, Artificial Sequence
  Description of Artificial Sequence: Synthetic oligonucleotide
acatcgccctgtaagaggacctgcgct

SEQ ID NO: 8201 - DNA, 26 bp, Artificial Sequence
  Description of Artificial Sequence: Synthetic oligonucleotide
catcgccctgtaagaggacctgcgct

SEQ ID NO: 8202 - DNA, 27 bp, Artificial Sequence
  Description of Artificial Sequence: Synthetic oligonucleotide
atcgccctgtaagaggacctgcgctct

SEQ ID NO: 8203 - DNA, 27 bp, Artificial Sequence
  Description of Artificial Sequence: Synthetic oligonucleotide
tcgccctgtaagaggacctgcgctctt

SEQ ID NO: 8204 - DNA, 26 bp, Artificial Sequence
  Description of Artificial Sequence: Synthetic oligonucleotide
cgccctgtaagaggacctgcgctctt

SEQ ID NO: 8205 - DNA, 26 bp, Artificial Sequence
  Description of Artificial Sequence: Synthetic oligonucleotide
gccctgtaagaggacctgcgctcttg

SEQ ID NO: 8206 - DNA, 27 bp, Artificial Sequence
  Description of Artificial Sequence: Synthetic oligonucleotide
ccctgtaagaggacctgcgctcttgga

SEQ ID NO: 8207 - DNA, 27 bp, Artificial Sequence
  Description of Artificial Sequence: Synthetic oligonucleotide
cctgtaagaggacctgcgctcttggac

SEQ ID NO: 8208 - DNA, 27 bp, Artificial Sequence
  Description of Artificial Sequence: Synthetic oligonucleotide
ctgtaagaggacctgcgctcttggacc

SEQ ID NO: 8209 - DNA, 27 bp, Artificial Sequence
  Description of Artificial Sequence: Synthetic oligonucleotide
tgtaagaggacctgcgctcttggaccg

SEQ ID NO: 8210 - DNA, 26 bp, Artificial Sequence
  Description of Artificial Sequence: Synthetic oligonucleotide
gtaagaggacctgcgctcttggaccg

SEQ ID NO: 8211 - DNA, 26 bp, Artificial Sequence
  Description of Artificial Sequence: Synthetic oligonucleotide
taagaggacctgcgctcttggaccgc

SEQ ID NO: 8212 - DNA, 24 bp, Artificial Sequence
  Description of Artificial Sequence: Synthetic oligonucleotide
gcgcttcctccgcgggtaccacta

SEQ ID NO: 8213 - DNA, 26 bp, Artificial Sequence
  Description of Artificial Sequence: Synthetic oligonucleotide
cgcttcctccgcgggtaccactagta

SEQ ID NO: 8214 - DNA, 26 bp, Artificial Sequence
  Description of Artificial Sequence: Synthetic oligonucleotide
gcttcctccgcgggtaccactagtac

SEQ ID NO: 8215 - DNA, 26 bp, Artificial Sequence
  Description of Artificial Sequence: Synthetic oligonucleotide
cttcctccgcgggtaccactagtacg

SEQ ID NO: 8216 - DNA, 26 bp, Artificial Sequence
  Description of Artificial Sequence: Synthetic oligonucleotide
ttcctccgcgggtaccactagtacgc

SEQ ID NO: 8217 - DNA, 25 bp, Artificial Sequence
  Description of Artificial Sequence: Synthetic oligonucleotide
tcctccgcgggtaccactagtacgc

SEQ ID NO: 8218 - DNA, 24 bp, Artificial Sequence
  Description of Artificial Sequence: Synthetic oligonucleotide
cctccgcgggtaccactagtacgc

SEQ ID NO: 8219 - DNA, 26 bp, Artificial Sequence
  Description of Artificial Sequence: Synthetic oligonucleotide
ctccgcgggtaccactagtacgccta

SEQ ID NO: 8220 - DNA, 26 bp, Artificial Sequence
  Description of Artificial Sequence: Synthetic oligonucleotide
tccgcgggtaccactagtacgcctac

SEQ ID NO: 8221 - DNA, 25 bp, Artificial Sequence
  Description of Artificial Sequence: Synthetic oligonucleotide
ccgcgggtaccactagtacgcctac

SEQ ID NO: 8222 - DNA, 26 bp, Artificial Sequence
  Description of Artificial Sequence: Synthetic oligonucleotide
cgcgggtaccactagtacgcctacga

SEQ ID NO: 8223 - DNA, 26 bp, Artificial Sequence
  Description of Artificial Sequence: Synthetic oligonucleotide
gcgggtaccactagtacgcctacgac

SEQ ID NO: 8224 - DNA, 26 bp, Artificial Sequence
  Description of Artificial Sequence: Synthetic oligonucleotide
cgggtaccactagtacgcctacgacg

SEQ ID NO: 8225 - DNA, 26 bp, Artificial Sequence
  Description of Artificial Sequence: Synthetic oligonucleotide
gggtaccactagtacgcctacgacgg

SEQ ID NO: 8226 - DNA, 27 bp, Artificial Sequence
  Description of Artificial Sequence: Synthetic oligonucleotide
ggtaccactagtacgcctacgacggca

SEQ ID NO: 8227 - DNA, 28 bp, Artificial Sequence
  Description of Artificial Sequence: Synthetic oligonucleotide
gtaccactagtacgcctacgacggcaag

SEQ ID NO: 8228 - DNA, 28 bp, Artificial Sequence
  Description of Artificial Sequence: Synthetic oligonucleotide
taccactagtacgcctacgacggcaagg

SEQ ID NO: 8229 - DNA, 27 bp, Artificial Sequence
  Description of Artificial Sequence: Synthetic oligonucleotide
accactagtacgcctacgacggcaagg

SEQ ID NO: 8230 - DNA, 27 bp, Artificial Sequence
  Description of Artificial Sequence: Synthetic oligonucleotide
ccactagtacgcctacgacggcaagga

SEQ ID NO: 8231 - DNA, 30 bp, Artificial Sequence
  Description of Artificial Sequence: Synthetic oligonucleotide
cactagtacgcctacgacggcaaggattac

SEQ ID NO: 8232 - DNA, 32 bp, Artificial Sequence
  Description of Artificial Sequence: Synthetic oligonucleotide
actagtacgcctacgacggcaaggattacatc

SEQ ID NO: 8233 - DNA, 31 bp, Artificial Sequence
  Description of Artificial Sequence: Synthetic oligonucleotide
ctagtacgcctacgacggcaaggattacatc

SEQ ID NO: 8234 - DNA, 31 bp, Artificial Sequence
  Description of Artificial Sequence: Synthetic oligonucleotide
tagtacgcctacgacggcaaggattacatcg

SEQ ID NO: 8235 - DNA, 24 bp, Artificial Sequence
  Description of Artificial Sequence: Synthetic oligonucleotide
gaggccggttctcacaccgtccag

SEQ ID NO: 8236 - DNA, 24 bp, Artificial Sequence
  Description of Artificial Sequence: Synthetic oligonucleotide
aggccggttctcacaccgtccagg

SEQ ID NO: 8237 - DNA, 23 bp, Artificial Sequence
  Description of Artificial Sequence: Synthetic oligonucleotide
ggccggttctcacaccgtccagg

SEQ ID NO: 8238 - DNA, 23 bp, Artificial Sequence
  Description of Artificial Sequence: Synthetic oligonucleotide
gccggttctcacaccgtccaggg

SEQ ID NO: 8239 - DNA, 25 bp, Artificial Sequence
  Description of Artificial Sequence: Synthetic oligonucleotide
ccggttctcacaccgtccaggggat

SEQ ID NO: 8240 - DNA, 27 bp, Artificial Sequence
  Description of Artificial Sequence: Synthetic oligonucleotide
cggttctcacaccgtccaggggatgta

SEQ ID NO: 8241 - DNA, 28 bp, Artificial Sequence
  Description of Artificial Sequence: Synthetic oligonucleotide
ggttctcacaccgtccaggggatgtatg

SEQ ID NO: 8242 - DNA, 28 bp, Artificial Sequence
  Description of Artificial Sequence: Synthetic oligonucleotide
gttctcacaccgtccaggggatgtatgg

SEQ ID NO: 8243 - DNA, 28 bp, Artificial Sequence
  Description of Artificial Sequence: Synthetic oligonucleotide
ttctcacaccgtccaggggatgtatggc

SEQ ID NO: 8244 - DNA, 27 bp, Artificial Sequence
  Description of Artificial Sequence: Synthetic oligonucleotide
tctcacaccgtccaggggatgtatggc

SEQ ID NO: 8245 - DNA, 27 bp, Artificial Sequence
  Description of Artificial Sequence: Synthetic oligonucleotide
ctcacaccgtccaggggatgtatggct

SEQ ID NO: 8246 - DNA, 27 bp, Artificial Sequence
  Description of Artificial Sequence: Synthetic oligonucleotide
tcacaccgtccaggggatgtatggctg

SEQ ID NO: 8247 - DNA, 26 bp, Artificial Sequence
  Description of Artificial Sequence: Synthetic oligonucleotide
cacaccgtccaggggatgtatggctg

SEQ ID NO: 8248 - DNA, 26 bp, Artificial Sequence
  Description of Artificial Sequence: Synthetic oligonucleotide
acaccgtccaggggatgtatggctgc

SEQ ID NO: 8249 - DNA, 25 bp, Artificial Sequence
  Description of Artificial Sequence: Synthetic oligonucleotide
caccgtccaggggatgtatggctgc

SEQ ID NO: 8250 - DNA, 26 bp, Artificial Sequence
  Description of Artificial Sequence: Synthetic oligonucleotide
accgtccaggggatgtatggctgcga

SEQ ID NO: 8251 - DNA, 25 bp, Artificial Sequence
  Description of Artificial Sequence: Synthetic oligonucleotide
ccgtccaggggatgtatggctgcga

SEQ ID NO: 8252 - DNA, 25 bp, Artificial Sequence
  Description of Artificial Sequence: Synthetic oligonucleotide
cgtccaggggatgtatggctgcgac

SEQ ID NO: 8253 - DNA, 26 bp, Artificial Sequence
  Description of Artificial Sequence: Synthetic oligonucleotide
gtccaggggatgtatggctgcgacgt

SEQ ID NO: 8254 - DNA, 26 bp, Artificial Sequence
  Description of Artificial Sequence: Synthetic oligonucleotide
tccaggggatgtatggctgcgacgtg

SEQ ID NO: 8255 - DNA, 25 bp, Artificial Sequence
  Description of Artificial Sequence: Synthetic oligonucleotide
ccaggggatgtatggctgcgacgtg

SEQ ID NO: 8256 - DNA, 25 bp, Artificial Sequence
  Description of Artificial Sequence: Synthetic oligonucleotide
caggggatgtatggctgcgacgtgg

SEQ ID NO: 8257 - DNA, 25 bp, Artificial Sequence
  Description of Artificial Sequence: Synthetic oligonucleotide
aggggatgtatggctgcgacgtggg

SEQ ID NO: 8258 - DNA, 24 bp, Artificial Sequence
  Description of Artificial Sequence: Synthetic oligonucleotide
ggggatgtatggctgcgacgtggg

SEQ ID NO: 8259 - DNA, 25 bp, Artificial Sequence
  Description of Artificial Sequence: Synthetic oligonucleotide
gggatgtatggctgcgacgtggggt

SEQ ID NO: 8260 - DNA, 32 bp, Artificial Sequence
  Description of Artificial Sequence: Synthetic oligonucleotide
accagtacgcctacgacggcaaggattaaatc

SEQ ID NO: 8261 - DNA, 31 bp, Artificial Sequence
  Description of Artificial Sequence: Synthetic oligonucleotide
ccagtacgcctacgacggcaaggattaaatc

SEQ ID NO: 8262 - DNA, 31 bp, Artificial Sequence
  Description of Artificial Sequence: Synthetic oligonucleotide
cagtacgcctacgacggcaaggattaaatcg

SEQ ID NO: 8263 - DNA, 31 bp, Artificial Sequence
  Description of Artificial Sequence: Synthetic oligonucleotide
agtacgcctacgacggcaaggattaaatcgc

SEQ ID NO: 8264 - DNA, 30 bp, Artificial Sequence
  Description of Artificial Sequence: Synthetic oligonucleotide
gtacgcctacgacggcaaggattaaatcgc

SEQ ID NO: 8265 - DNA, 30 bp, Artificial Sequence
  Description of Artificial Sequence: Synthetic oligonucleotide
tacgcctacgacggcaaggattaaatcgcc

SEQ ID NO: 8266 - DNA, 29 bp, Artificial Sequence
  Description of Artificial Sequence: Synthetic oligonucleotide
acgcctacgacggcaaggattaaatcgcc

SEQ ID NO: 8267 - DNA, 28 bp, Artificial Sequence
  Description of Artificial Sequence: Synthetic oligonucleotide
cgcctacgacggcaaggattaaatcgcc

SEQ ID NO: 8268 - DNA, 28 bp, Artificial Sequence
  Description of Artificial Sequence: Synthetic oligonucleotide
gcctacgacggcaaggattaaatcgccc

SEQ ID NO: 8269 - DNA, 29 bp, Artificial Sequence
  Description of Artificial Sequence: Synthetic oligonucleotide
cctacgacggcaaggattaaatcgccctg

SEQ ID NO: 8270 - DNA, 32 bp, Artificial Sequence
  Description of Artificial Sequence: Synthetic oligonucleotide
ctacgacggcaaggattaaatcgccctgaaag

SEQ ID NO: 8271 - DNA, 33 bp, Artificial Sequence
  Description of Artificial Sequence: Synthetic oligonucleotide
tacgacggcaaggattaaatcgccctgaaagag

SEQ ID NO: 8272 - DNA, 32 bp, Artificial Sequence
  Description of Artificial Sequence: Synthetic oligonucleotide
acgacggcaaggattaaatcgccctgaaagag

SEQ ID NO: 8273 - DNA, 31 bp, Artificial Sequence
  Description of Artificial Sequence: Synthetic oligonucleotide
cgacggcaaggattaaatcgccctgaaagag

SEQ ID NO: 8274 - DNA, 31 bp, Artificial Sequence
  Description of Artificial Sequence: Synthetic oligonucleotide
gacggcaaggattaaatcgccctgaaagagg

SEQ ID NO: 8275 - DNA, 32 bp, Artificial Sequence
  Description of Artificial Sequence: Synthetic oligonucleotide
acggcaaggattaaatcgccctgaaagaggac

SEQ ID NO: 8276 - DNA, 31 bp, Artificial Sequence
  Description of Artificial Sequence: Synthetic oligonucleotide
cggcaaggattaaatcgccctgaaagaggac

SEQ ID NO: 8277 - DNA, 31 bp, Artificial Sequence
  Description of Artificial Sequence: Synthetic oligonucleotide
ggcaaggattaaatcgccctgaaagaggacc

SEQ ID NO: 8278 - DNA, 32 bp, Artificial Sequence
  Description of Artificial Sequence: Synthetic oligonucleotide
gcaaggattaaatcgccctgaaagaggacctg

SEQ ID NO: 8279 - DNA, 32 bp, Artificial Sequence
  Description of Artificial Sequence: Synthetic oligonucleotide
caaggattaaatcgccctgaaagaggacctgc

SEQ ID NO: 8280 - DNA, 32 bp, Artificial Sequence
  Description of Artificial Sequence: Synthetic oligonucleotide
aaggattaaatcgccctgaaagaggacctgcg

SEQ ID NO: 8281 - DNA, 31 bp, Artificial Sequence
  Description of Artificial Sequence: Synthetic oligonucleotide
aggattaaatcgccctgaaagaggacctgcg

SEQ ID NO: 8282 - DNA, 30 bp, Artificial Sequence
  Description of Artificial Sequence: Synthetic oligonucleotide
ggattaaatcgccctgaaagaggacctgcg

SEQ ID NO: 8283 - DNA, 30 bp, Artificial Sequence
  Description of Artificial Sequence: Synthetic oligonucleotide
gattaaatcgccctgaaagaggacctgcgc

SEQ ID NO: 8284 - DNA, 31 bp, Artificial Sequence
  Description of Artificial Sequence: Synthetic oligonucleotide
attaaatcgccctgaaagaggacctgcgctc

SEQ ID NO: 8285 - DNA, 30 bp, Artificial Sequence
  Description of Artificial Sequence: Synthetic oligonucleotide
ttaaatcgccctgaaagaggacctgcgctc

SEQ ID NO: 8286 - DNA, 29 bp, Artificial Sequence
  Description of Artificial Sequence: Synthetic oligonucleotide
taaatcgccctgaaagaggacctgcgctc

SEQ ID NO: 8287 - DNA, 28 bp, Artificial Sequence
  Description of Artificial Sequence: Synthetic oligonucleotide
aaatcgccctgaaagaggacctgcgctc

SEQ ID NO: 8288 - DNA, 27 bp, Artificial Sequence
  Description of Artificial Sequence: Synthetic oligonucleotide
aatcgccctgaaagaggacctgcgctc

SEQ ID NO: 8289 - DNA, 23 bp, Artificial Sequence
  Description of Artificial Sequence: Synthetic oligonucleotide
gcggcccatgtggcggagcagta

SEQ ID NO: 8290 - DNA, 24 bp, Artificial Sequence
  Description of Artificial Sequence: Synthetic oligonucleotide
cggcccatgtggcggagcagtaga

SEQ ID NO: 8291 - DNA, 25 bp, Artificial Sequence
  Description of Artificial Sequence: Synthetic oligonucleotide
ggcccatgtggcggagcagtagaga

SEQ ID NO: 8292 - DNA, 25 bp, Artificial Sequence
  Description of Artificial Sequence: Synthetic oligonucleotide
gcccatgtggcggagcagtagagag

SEQ ID NO: 8293 - DNA, 25 bp, Artificial Sequence
  Description of Artificial Sequence: Synthetic oligonucleotide
cccatgtggcggagcagtagagagc

SEQ ID NO: 8294 - DNA, 27 bp, Artificial Sequence
  Description of Artificial Sequence: Synthetic oligonucleotide
ccatgtggcggagcagtagagagccta

SEQ ID NO: 8295 - DNA, 27 bp, Artificial Sequence
  Description of Artificial Sequence: Synthetic oligonucleotide
catgtggcggagcagtagagagcctac

SEQ ID NO: 8296 - DNA, 27 bp, Artificial Sequence
  Description of Artificial Sequence: Synthetic oligonucleotide
atgtggcggagcagtagagagcctacc

SEQ ID NO: 8297 - DNA, 27 bp, Artificial Sequence
  Description of Artificial Sequence: Synthetic oligonucleotide
tgtggcggagcagtagagagcctacct

SEQ ID NO: 8298 - DNA, 26 bp, Artificial Sequence
  Description of Artificial Sequence: Synthetic oligonucleotide
gtggcggagcagtagagagcctacct

SEQ ID NO: 8299 - DNA, 26 bp, Artificial Sequence
  Description of Artificial Sequence: Synthetic oligonucleotide
tggcggagcagtagagagcctacctg

SEQ ID NO: 8300 - DNA, 25 bp, Artificial Sequence
  Description of Artificial Sequence: Synthetic oligonucleotide
ggcggagcagtagagagcctacctg

SEQ ID NO: 8301 - DNA, 26 bp, Artificial Sequence
  Description of Artificial Sequence: Synthetic oligonucleotide
gcggagcagtagagagcctacctgga

SEQ ID NO: 8302 - DNA, 26 bp, Artificial Sequence
  Description of Artificial Sequence: Synthetic oligonucleotide
cggagcagtagagagcctacctggag

SEQ ID NO: 8303 - DNA, 26 bp, Artificial Sequence
  Description of Artificial Sequence: Synthetic oligonucleotide
ggagcagtagagagcctacctggagg

SEQ ID NO: 8304 - DNA, 26 bp, Artificial Sequence
  Description of Artificial Sequence: Synthetic oligonucleotide
gagcagtagagagcctacctggaggg

SEQ ID NO: 8305 - DNA, 27 bp, Artificial Sequence
  Description of Artificial Sequence: Synthetic oligonucleotide
agcagtagagagcctacctggagggca

SEQ ID NO: 8306 - DNA, 26 bp, Artificial Sequence
  Description of Artificial Sequence: Synthetic oligonucleotide
gcagtagagagcctacctggagggca

SEQ ID NO: 8307 - DNA, 26 bp, Artificial Sequence
  Description of Artificial Sequence: Synthetic oligonucleotide
cagtagagagcctacctggagggcac

SEQ ID NO: 8308 - DNA, 27 bp, Artificial Sequence
  Description of Artificial Sequence: Synthetic oligonucleotide
agtagagagcctacctggagggcacgt

SEQ ID NO: 8309 - DNA, 26 bp, Artificial Sequence
  Description of Artificial Sequence: Synthetic oligonucleotide
gtagagagcctacctggagggcacgt

SEQ ID NO: 8310 - DNA, 26 bp, Artificial Sequence
  Description of Artificial Sequence: Synthetic oligonucleotide
tagagagcctacctggagggcacgtg

SEQ ID NO: 8311 - DNA, 27 bp, Artificial Sequence
  Description of Artificial Sequence: Synthetic oligonucleotide
acctggagaacgggaaggagacgctgt

SEQ ID NO: 8312 - DNA, 27 bp, Artificial Sequence
  Description of Artificial Sequence: Synthetic oligonucleotide
cctggagaacgggaaggagacgctgta

SEQ ID NO: 8313 - DNA, 27 bp, Artificial Sequence
  Description of Artificial Sequence: Synthetic oligonucleotide
ctggagaacgggaaggagacgctgtag

SEQ ID NO: 8314 - DNA, 27 bp, Artificial Sequence
  Description of Artificial Sequence: Synthetic oligonucleotide
tggagaacgggaaggagacgctgtagc

SEQ ID NO: 8315 - DNA, 26 bp, Artificial Sequence
  Description of Artificial Sequence: Synthetic oligonucleotide
ggagaacgggaaggagacgctgtagc

SEQ ID NO: 8316 - DNA, 26 bp, Artificial Sequence
  Description of Artificial Sequence: Synthetic oligonucleotide
gagaacgggaaggagacgctgtagcg

SEQ ID NO: 8317 - DNA, 27 bp, Artificial Sequence
  Description of Artificial Sequence: Synthetic oligonucleotide
agaacgggaaggagacgctgtagcgca

SEQ ID NO: 8318 - DNA, 26 bp, Artificial Sequence
  Description of Artificial Sequence: Synthetic oligonucleotide
gaacgggaaggagacgctgtagcgca

SEQ ID NO: 8319 - DNA, 26 bp, Artificial Sequence
  Description of Artificial Sequence: Synthetic oligonucleotide
aacgggaaggagacgctgtagcgcac

SEQ ID NO: 8320 - DNA, 25 bp, Artificial Sequence
  Description of Artificial Sequence: Synthetic oligonucleotide
acgggaaggagacgctgtagcgcac

SEQ ID NO: 8321 - DNA, 24 bp, Artificial Sequence
  Description of Artificial Sequence: Synthetic oligonucleotide
cgggaaggagacgctgtagcgcac

SEQ ID NO: 8322 - DNA, 24 bp, Artificial Sequence
  Description of Artificial Sequence: Synthetic oligonucleotide
gggaaggagacgctgtagcgcacg

SEQ ID NO: 8323 - DNA, 25 bp, Artificial Sequence
  Description of Artificial Sequence: Synthetic oligonucleotide
ggaaggagacgctgtagcgcacgga

SEQ ID NO: 8324 - DNA, 25 bp, Artificial Sequence
  Description of Artificial Sequence: Synthetic oligonucleotide
gaaggagacgctgtagcgcacggac

SEQ ID NO: 8325 - DNA, 25 bp, Artificial Sequence
  Description of Artificial Sequence: Synthetic oligonucleotide
aaggagacgctgtagcgcacggacg

SEQ ID NO: 8326 - DNA, 24 bp, Artificial Sequence
  Description of Artificial Sequence: Synthetic oligonucleotide
aggagacgctgtagcgcacggacg

SEQ ID NO: 8327 - DNA, 23 bp, Artificial Sequence
  Description of Artificial Sequence: Synthetic oligonucleotide
ggagacgctgtagcgcacggacg

SEQ ID NO: 8328 - DNA, 23 bp, Artificial Sequence
  Description of Artificial Sequence: Synthetic oligonucleotide
gagacgctgtagcgcacggacgc

SEQ ID NO: 8329 - DNA, 23 bp, Artificial Sequence
  Description of Artificial Sequence: Synthetic oligonucleotide
agacgctgtagcgcacggacgcc

SEQ ID NO: 8330 - DNA, 22 bp, Artificial Sequence
  Description of Artificial Sequence: Synthetic oligonucleotide
gacgctgtagcgcacggacgcc

SEQ ID NO: 8331 - DNA, 22 bp, Artificial Sequence
  Description of Artificial Sequence: Synthetic oligonucleotide
acgctgtagcgcacggacgccc

SEQ ID NO: 8332 - DNA, 21 bp, Artificial Sequence
  Description of Artificial Sequence: Synthetic oligonucleotide
cgctgtagcgcacggacgccc

SEQ ID NO: 8333 - DNA, 21 bp, Artificial Sequence
  Description of Artificial Sequence: Synthetic oligonucleotide
gctgtagcgcacggacgcccc

SEQ ID NO: 8334 - DNA, 25 bp, Artificial Sequence
  Description of Artificial Sequence: Synthetic oligonucleotide
ctgtagcgcacggacgcccccaaaa

SEQ ID NO: 8335 - DNA, 25 bp, Artificial Sequence
  Description of Artificial Sequence: Synthetic oligonucleotide
tgtagcgcacggacgcccccaaaac

SEQ ID NO: 8336 - DNA, 24 bp, Artificial Sequence
  Description of Artificial Sequence: Synthetic oligonucleotide
gtagcgcacggacgcccccaaaac

SEQ ID NO: 8337 - DNA, 24 bp, Artificial Sequence
  Description of Artificial Sequence: Synthetic oligonucleotide
tagcgcacggacgcccccaaaacg

SEQ ID NO: 8338 - DNA, 27 bp, Artificial Sequence
  Description of Artificial Sequence: Synthetic oligonucleotide
ggagcagttgagagcctacctggagga

SEQ ID NO: 8339 - DNA, 27 bp, Artificial Sequence
  Description of Artificial Sequence: Synthetic oligonucleotide
gagcagttgagagcctacctggaggac

SEQ ID NO: 8340 - DNA, 28 bp, Artificial Sequence
  Description of Artificial Sequence: Synthetic oligonucleotide
agcagttgagagcctacctggaggacac

SEQ ID NO: 8341 - DNA, 27 bp, Artificial Sequence
  Description of Artificial Sequence: Synthetic oligonucleotide
gcagttgagagcctacctggaggacac

SEQ ID NO: 8342 - DNA, 27 bp, Artificial Sequence
  Description of Artificial Sequence: Synthetic oligonucleotide
cagttgagagcctacctggaggacacg

SEQ ID NO: 8343 - DNA, 28 bp, Artificial Sequence
  Description of Artificial Sequence: Synthetic oligonucleotide
agttgagagcctacctggaggacacgtg

SEQ ID NO: 8344 - DNA, 27 bp, Artificial Sequence
  Description of Artificial Sequence: Synthetic oligonucleotide
gttgagagcctacctggaggacacgtg

SEQ ID NO: 8345 - DNA, 27 bp, Artificial Sequence
  Description of Artificial Sequence: Synthetic oligonucleotide
ttgagagcctacctggaggacacgtgc

SEQ ID NO: 8346 - DNA, 26 bp, Artificial Sequence
  Description of Artificial Sequence: Synthetic oligonucleotide
tgagagcctacctggaggacacgtgc

SEQ ID NO: 8347 - DNA, 25 bp, Artificial Sequence
  Description of Artificial Sequence: Synthetic oligonucleotide
gagagcctacctggaggacacgtgc

SEQ ID NO: 8348 - DNA, 26 bp, Artificial Sequence
  Description of Artificial Sequence: Synthetic oligonucleotide
agagcctacctggaggacacgtgcgt

SEQ ID NO: 8349 - DNA, 25 bp, Artificial Sequence
  Description of Artificial Sequence: Synthetic oligonucleotide
gagcctacctggaggacacgtgcgt

SEQ ID NO: 8350 - DNA, 25 bp, Artificial Sequence
  Description of Artificial Sequence: Synthetic oligonucleotide
agcctacctggaggacacgtgcgtg

SEQ ID NO: 8351 - DNA, 24 bp, Artificial Sequence
  Description of Artificial Sequence: Synthetic oligonucleotide
gcctacctggaggacacgtgcgtg

SEQ ID NO: 8352 - DNA, 25 bp, Artificial Sequence
  Description of Artificial Sequence: Synthetic oligonucleotide
cctacctggaggacacgtgcgtgga

SEQ ID NO: 8353 - DNA, 26 bp, Artificial Sequence
  Description of Artificial Sequence: Synthetic oligonucleotide
ctacctggaggacacgtgcgtggagt

SEQ ID NO: 8354 - DNA, 26 bp, Artificial Sequence
  Description of Artificial Sequence: Synthetic oligonucleotide
tacctggaggacacgtgcgtggagtg

SEQ ID NO: 8355 - DNA, 25 bp, Artificial Sequence
  Description of Artificial Sequence: Synthetic oligonucleotide
acctggaggacacgtgcgtggagtg

SEQ ID NO: 8356 - DNA, 24 bp, Artificial Sequence
  Description of Artificial Sequence: Synthetic oligonucleotide
cctggaggacacgtgcgtggagtg

SEQ ID NO: 8357 - DNA, 24 bp, Artificial Sequence
  Description of Artificial Sequence: Synthetic oligonucleotide
ctggaggacacgtgcgtggagtgg

SEQ ID NO: 8358 - DNA, 25 bp, Artificial Sequence
  Description of Artificial Sequence: Synthetic oligonucleotide
tggaggacacgtgcgtggagtggct

SEQ ID NO: 8359 - DNA, 24 bp, Artificial Sequence
  Description of Artificial Sequence: Synthetic oligonucleotide
ggaggacacgtgcgtggagtggct

SEQ ID NO: 8360 - DNA, 24 bp, Artificial Sequence
  Description of Artificial Sequence: Synthetic oligonucleotide
gaggacacgtgcgtggagtggctc

SEQ ID NO: 8361 - DNA, 24 bp, Artificial Sequence
  Description of Artificial Sequence: Synthetic oligonucleotide
aggacacgtgcgtggagtggctcc

SEQ ID NO: 8362 - DNA, 23 bp, Artificial Sequence
  Description of Artificial Sequence: Synthetic oligonucleotide
ggacacgtgcgtggagtggctcc

SEQ ID NO: 8363 - DNA, 23 bp, Artificial Sequence
  Description of Artificial Sequence: Synthetic oligonucleotide
gacacgtgcgtggagtggctccg

SEQ ID NO: 8364 - DNA, 24 bp, Artificial Sequence
  Description of Artificial Sequence: Synthetic oligonucleotide
acacgtgcgtggagtggctccgca

SEQ ID NO: 8365 - DNA, 22 bp, Artificial Sequence
  Description of Artificial Sequence: Synthetic oligonucleotide
tggcgcttcctgcgcgggtacc

SEQ ID NO: 8366 - DNA, 21 bp, Artificial Sequence
  Description of Artificial Sequence: Synthetic oligonucleotide
ggcgcttcctgcgcgggtacc

SEQ ID NO: 8367 - DNA, 21 bp, Artificial Sequence
  Description of Artificial Sequence: Synthetic oligonucleotide
gcgcttcctgcgcgggtaccg

SEQ ID NO: 8368 - DNA, 21 bp, Artificial Sequence
  Description of Artificial Sequence: Synthetic oligonucleotide
cgcttcctgcgcgggtaccgc

SEQ ID NO: 8369 - DNA, 22 bp, Artificial Sequence
  Description of Artificial Sequence: Synthetic oligonucleotide
gcttcctgcgcgggtaccgcca

SEQ ID NO: 8370 - DNA, 24 bp, Artificial Sequence
  Description of Artificial Sequence: Synthetic oligonucleotide
cttcctgcgcgggtaccgccagta

SEQ ID NO: 8371 - DNA, 24 bp, Artificial Sequence
  Description of Artificial Sequence: Synthetic oligonucleotide
ttcctgcgcgggtaccgccagtac

SEQ ID NO: 8372 - DNA, 23 bp, Artificial Sequence
  Description of Artificial Sequence: Synthetic oligonucleotide
tcctgcgcgggtaccgccagtac

SEQ ID NO: 8373 - DNA, 22 bp, Artificial Sequence
  Description of Artificial Sequence: Synthetic oligonucleotide
cctgcgcgggtaccgccagtac

SEQ ID NO: 8374 - DNA, 22 bp, Artificial Sequence
  Description of Artificial Sequence: Synthetic oligonucleotide
ctgcgcgggtaccgccagtacg

SEQ ID NO: 8375 - DNA, 22 bp, Artificial Sequence
  Description of Artificial Sequence: Synthetic oligonucleotide
tgcgcgggtaccgccagtacgc

SEQ ID NO: 8376 - DNA, 21 bp, Artificial Sequence
  Description of Artificial Sequence: Synthetic oligonucleotide
gcgcgggtaccgccagtacgc

SEQ ID NO: 8377 - DNA, 23 bp, Artificial Sequence
  Description of Artificial Sequence: Synthetic oligonucleotide
cgcgggtaccgccagtacgccta

SEQ ID NO: 8378 - DNA, 23 bp, Artificial Sequence
  Description of Artificial Sequence: Synthetic oligonucleotide
gcgggtaccgccagtacgcctac

SEQ ID NO: 8379 - DNA, 24 bp, Artificial Sequence
  Description of Artificial Sequence: Synthetic oligonucleotide
cgggtaccgccagtacgcctacga

SEQ ID NO: 8380 - DNA, 24 bp, Artificial Sequence
  Description of Artificial Sequence: Synthetic oligonucleotide
gggtaccgccagtacgcctacgac

SEQ ID NO: 8381 - DNA, 24 bp, Artificial Sequence
  Description of Artificial Sequence: Synthetic oligonucleotide
ggtaccgccagtacgcctacgacg

SEQ ID NO: 8382 - DNA, 24 bp, Artificial Sequence
  Description of Artificial Sequence: Synthetic oligonucleotide
gtaccgccagtacgcctacgacgg

SEQ ID NO: 8383 - DNA, 26 bp, Artificial Sequence
  Description of Artificial Sequence: Synthetic oligonucleotide
taccgccagtacgcctacgacggcaa

SEQ ID NO: 8384 - DNA, 25 bp, Artificial Sequence
  Description of Artificial Sequence: Synthetic oligonucleotide
accgccagtacgcctacgacggcaa

SEQ ID NO: 8385 - DNA, 24 bp, Artificial Sequence
  Description of Artificial Sequence: Synthetic oligonucleotide
ccgccagtacgcctacgacggcaa

SEQ ID NO: 8386 - DNA, 24 bp, Artificial Sequence
  Description of Artificial Sequence: Synthetic oligonucleotide
cgccagtacgcctacgacggcaag

SEQ ID NO: 8387 - DNA, 27 bp, Artificial Sequence
  Description of Artificial Sequence: Synthetic oligonucleotide
gccagtacgcctacgacggcaaggatt

SEQ ID NO: 8388 - DNA, 27 bp, Artificial Sequence
  Description of Artificial Sequence: Synthetic oligonucleotide
cgtggatagagcaggagggtccggaat

SEQ ID NO: 8389 - DNA, 30 bp, Artificial Sequence
  Description of Artificial Sequence: Synthetic oligonucleotide
gtggatagagcaggagggtccggaatattg

SEQ ID NO: 8390 - DNA, 30 bp, Artificial Sequence
  Description of Artificial Sequence: Synthetic oligonucleotide
tggatagagcaggagggtccggaatattgg

SEQ ID NO: 8391 - DNA, 29 bp, Artificial Sequence
  Description of Artificial Sequence: Synthetic oligonucleotide
ggatagagcaggagggtccggaatattgg

SEQ ID NO: 8392 - DNA, 29 bp, Artificial Sequence
  Description of Artificial Sequence: Synthetic oligonucleotide
gatagagcaggagggtccggaatattggg

SEQ ID NO: 8393 - DNA, 30 bp, Artificial Sequence
  Description of Artificial Sequence: Synthetic oligonucleotide
atagagcaggagggtccggaatattgggac

SEQ ID NO: 8394 - DNA, 29 bp, Artificial Sequence
  Description of Artificial Sequence: Synthetic oligonucleotide
tagagcaggagggtccggaatattgggac

SEQ ID NO: 8395 - DNA, 28 bp, Artificial Sequence
  Description of Artificial Sequence: Synthetic oligonucleotide
agagcaggagggtccggaatattgggac

SEQ ID NO: 8396 - DNA, 27 bp, Artificial Sequence
  Description of Artificial Sequence: Synthetic oligonucleotide
gagcaggagggtccggaatattgggac

SEQ ID NO: 8397 - DNA, 27 bp, Artificial Sequence
  Description of Artificial Sequence: Synthetic oligonucleotide
agcaggagggtccggaatattgggacg

SEQ ID NO: 8398 - DNA, 26 bp, Artificial Sequence
  Description of Artificial Sequence: Synthetic oligonucleotide
gcaggagggtccggaatattgggacg

SEQ ID NO: 8399 - DNA, 26 bp, Artificial Sequence
  Description of Artificial Sequence: Synthetic oligonucleotide
caggagggtccggaatattgggacgg

SEQ ID NO: 8400 - DNA, 26 bp, Artificial Sequence
  Description of Artificial Sequence: Synthetic oligonucleotide
aggagggtccggaatattgggacggg

SEQ ID NO: 8401 - DNA, 25 bp, Artificial Sequence
  Description of Artificial Sequence: Synthetic oligonucleotide
ggagggtccggaatattgggacggg

SEQ ID NO: 8402 - DNA, 26 bp, Artificial Sequence
  Description of Artificial Sequence: Synthetic oligonucleotide
gagggtccggaatattgggacgggga

SEQ ID NO: 8403 - DNA, 27 bp, Artificial Sequence
  Description of Artificial Sequence: Synthetic oligonucleotide
agggtccggaatattgggacggggaga

SEQ ID NO: 8404 - DNA, 26 bp, Artificial Sequence
  Description of Artificial Sequence: Synthetic oligonucleotide
gggtccggaatattgggacggggaga

SEQ ID NO: 8405 - DNA, 27 bp, Artificial Sequence
  Description of Artificial Sequence: Synthetic oligonucleotide
ggtccggaatattgggacggggagaca

SEQ ID NO: 8406 - DNA, 27 bp, Artificial Sequence
  Description of Artificial Sequence: Synthetic oligonucleotide
gtccggaatattgggacggggagacac

SEQ ID NO: 8407 - DNA, 27 bp, Artificial Sequence
  Description of Artificial Sequence: Synthetic oligonucleotide
tccggaatattgggacggggagacacg

SEQ ID NO: 8408 - DNA, 26 bp, Artificial Sequence
  Description of Artificial Sequence: Synthetic oligonucleotide
ccggaatattgggacggggagacacg

SEQ ID NO: 8409 - DNA, 27 bp, Artificial Sequence
  Description of Artificial Sequence: Synthetic oligonucleotide
cggaatattgggacggggagacacgga

SEQ ID NO: 8410 - DNA, 29 bp, Artificial Sequence
  Description of Artificial Sequence: Synthetic oligonucleotide
ggaatattgggacggggagacacggaaag

SEQ ID NO: 8411 - DNA, 30 bp, Artificial Sequence
  Description of Artificial Sequence: Synthetic oligonucleotide
gaatattgggacggggagacacggaaagtg

SEQ ID NO: 8412 - DNA, 32 bp, Artificial Sequence
  Description of Artificial Sequence: Synthetic oligonucleotide
aatattgggacggggagacacggaaagtgaag

SEQ ID NO: 8413 - DNA, 31 bp, Artificial Sequence
  Description of Artificial Sequence: Synthetic oligonucleotide
atattgggacggggagacacggaaagtgaag

SEQ ID NO: 8414 - DNA, 24 bp, Artificial Sequence
  Description of Artificial Sequence: Synthetic oligonucleotide
gctcttggaccgcggcggacatga

SEQ ID NO: 8415 - DNA, 25 bp, Artificial Sequence
  Description of Artificial Sequence: Synthetic oligonucleotide
ctcttggaccgcggcggacatgaca

SEQ ID NO: 8416 - DNA, 25 bp, Artificial Sequence
  Description of Artificial Sequence: Synthetic oligonucleotide
tcttggaccgcggcggacatgacag

SEQ ID NO: 8417 - DNA, 24 bp, Artificial Sequence
  Description of Artificial Sequence: Synthetic oligonucleotide
cttggaccgcggcggacatgacag

SEQ ID NO: 8418 - DNA, 25 bp, Artificial Sequence
  Description of Artificial Sequence: Synthetic oligonucleotide
ttggaccgcggcggacatgacagct

SEQ ID NO: 8419 - DNA, 24 bp, Artificial Sequence
  Description of Artificial Sequence: Synthetic oligonucleotide
tggaccgcggcggacatgacagct

SEQ ID NO: 8420 - DNA, 23 bp, Artificial Sequence
  Description of Artificial Sequence: Synthetic oligonucleotide
ggaccgcggcggacatgacagct

SEQ ID NO: 8421 - DNA, 24 bp, Artificial Sequence
  Description of Artificial Sequence: Synthetic oligonucleotide
gaccgcggcggacatgacagctca

SEQ ID NO: 8422 - DNA, 25 bp, Artificial Sequence
  Description of Artificial Sequence: Synthetic oligonucleotide
accgcggcggacatgacagctcaga

SEQ ID NO: 8423 - DNA, 24 bp, Artificial Sequence
  Description of Artificial Sequence: Synthetic oligonucleotide
ccgcggcggacatgacagctcaga

SEQ ID NO: 8424 - DNA, 24 bp, Artificial Sequence
  Description of Artificial Sequence: Synthetic oligonucleotide
cgcggcggacatgacagctcagac

SEQ ID NO: 8425 - DNA, 25 bp, Artificial Sequence
  Description of Artificial Sequence: Synthetic oligonucleotide
gcggcggacatgacagctcagacca

SEQ ID NO: 8426 - DNA, 25 bp, Artificial Sequence
  Description of Artificial Sequence: Synthetic oligonucleotide
cggcggacatgacagctcagaccac

SEQ ID NO: 8427 - DNA, 27 bp, Artificial Sequence
  Description of Artificial Sequence: Synthetic oligonucleotide
ggcggacatgacagctcagaccaccaa

SEQ ID NO: 8428 - DNA, 27 bp, Artificial Sequence
  Description of Artificial Sequence: Synthetic oligonucleotide
gcggacatgacagctcagaccaccaag

SEQ ID NO: 8429 - DNA, 27 bp, Artificial Sequence
  Description of Artificial Sequence: Synthetic oligonucleotide
cggacatgacagctcagaccaccaagc

SEQ ID NO: 8430 - DNA, 28 bp, Artificial Sequence
  Description of Artificial Sequence: Synthetic oligonucleotide
ggacatgacagctcagaccaccaagcac

SEQ ID NO: 8431 - DNA, 30 bp, Artificial Sequence
  Description of Artificial Sequence: Synthetic oligonucleotide
gacatgacagctcagaccaccaagcacaag

SEQ ID NO: 8432 - DNA, 31 bp, Artificial Sequence
  Description of Artificial Sequence: Synthetic oligonucleotide
acatgacagctcagaccaccaagcacaagtg

SEQ ID NO: 8433 - DNA, 30 bp, Artificial Sequence
  Description of Artificial Sequence: Synthetic oligonucleotide
catgacagctcagaccaccaagcacaagtg

SEQ ID NO: 8434 - DNA, 30 bp, Artificial Sequence
  Description of Artificial Sequence: Synthetic oligonucleotide
atgacagctcagaccaccaagcacaagtgg

SEQ ID NO: 8435 - DNA, 29 bp, Artificial Sequence
  Description of Artificial Sequence: Synthetic oligonucleotide
tgacagctcagaccaccaagcacaagtgg

SEQ ID NO: 8436 - DNA, 28 bp, Artificial Sequence
  Description of Artificial Sequence: Synthetic oligonucleotide
gacagctcagaccaccaagcacaagtgg

SEQ ID NO: 8437 - DNA, 28 bp, Artificial Sequence
  Description of Artificial Sequence: Synthetic oligonucleotide
acagctcagaccaccaagcacaagtggg

SEQ ID NO: 8438 - DNA, 27 bp, Artificial Sequence
  Description of Artificial Sequence: Synthetic oligonucleotide
ccggttctcacaccgtccagaggatga

SEQ ID NO: 8439 - DNA, 29 bp, Artificial Sequence
  Description of Artificial Sequence: Synthetic oligonucleotide
cggttctcacaccgtccagaggatgaatg

SEQ ID NO: 8440 - DNA, 29 bp, Artificial Sequence
  Description of Artificial Sequence: Synthetic oligonucleotide
ggttctcacaccgtccagaggatgaatgg

SEQ ID NO: 8441 - DNA, 29 bp, Artificial Sequence
  Description of Artificial Sequence: Synthetic oligonucleotide
gttctcacaccgtccagaggatgaatggc

SEQ ID NO: 8442 - DNA, 30 bp, Artificial Sequence
  Description of Artificial Sequence: Synthetic oligonucleotide
ttctcacaccgtccagaggatgaatggctg

SEQ ID NO: 8443 - DNA, 29 bp, Artificial Sequence
  Description of Artificial Sequence: Synthetic oligonucleotide
tctcacaccgtccagaggatgaatggctg

SEQ ID NO: 8444 - DNA, 28 bp, Artificial Sequence
  Description of Artificial Sequence: Synthetic oligonucleotide
ctcacaccgtccagaggatgaatggctg

SEQ ID NO: 8445 - DNA, 28 bp, Artificial Sequence
  Description of Artificial Sequence: Synthetic oligonucleotide
tcacaccgtccagaggatgaatggctgc

SEQ ID NO: 8446 - DNA, 27 bp, Artificial Sequence
  Description of Artificial Sequence: Synthetic oligonucleotide
cacaccgtccagaggatgaatggctgc

SEQ ID NO: 8447 - DNA, 27 bp, Artificial Sequence
  Description of Artificial Sequence: Synthetic oligonucleotide
acaccgtccagaggatgaatggctgcg

SEQ ID NO: 8448 - DNA, 27 bp, Artificial Sequence
  Description of Artificial Sequence: Synthetic oligonucleotide
caccgtccagaggatgaatggctgcga

SEQ ID NO: 8449 - DNA, 27 bp, Artificial Sequence
  Description of Artificial Sequence: Synthetic oligonucleotide
accgtccagaggatgaatggctgcgac

SEQ ID NO: 8450 - DNA, 26 bp, Artificial Sequence
  Description of Artificial Sequence: Synthetic oligonucleotide
ccgtccagaggatgaatggctgcgac

SEQ ID NO: 8451 - DNA, 27 bp, Artificial Sequence
  Description of Artificial Sequence: Synthetic oligonucleotide
cgtccagaggatgaatggctgcgacgt

SEQ ID NO: 8452 - DNA, 27 bp, Artificial Sequence
  Description of Artificial Sequence: Synthetic oligonucleotide
gtccagaggatgaatggctgcgacgtg

SEQ ID NO: 8453 - DNA, 27 bp, Artificial Sequence
  Description of Artificial Sequence: Synthetic oligonucleotide
tccagaggatgaatggctgcgacgtgg

SEQ ID NO: 8454 - DNA, 26 bp, Artificial Sequence
  Description of Artificial Sequence: Synthetic oligonucleotide
ccagaggatgaatggctgcgacgtgg

SEQ ID NO: 8455 - DNA, 26 bp, Artificial Sequence
  Description of Artificial Sequence: Synthetic oligonucleotide
cagaggatgaatggctgcgacgtggg

SEQ ID NO: 8456 - DNA, 27 bp, Artificial Sequence
  Description of Artificial Sequence: Synthetic oligonucleotide
agaggatgaatggctgcgacgtggggt

SEQ ID NO: 8457 - DNA, 26 bp, Artificial Sequence
  Description of Artificial Sequence: Synthetic oligonucleotide
gaggatgaatggctgcgacgtggggt

SEQ ID NO: 8458 - DNA, 26 bp, Artificial Sequence
  Description of Artificial Sequence: Synthetic oligonucleotide
aggatgaatggctgcgacgtggggtc

SEQ ID NO: 8459 - DNA, 25 bp, Artificial Sequence
  Description of Artificial Sequence: Synthetic oligonucleotide
ggatgaatggctgcgacgtggggtc

SEQ ID NO: 8460 - DNA, 25 bp, Artificial Sequence
  Description of Artificial Sequence: Synthetic oligonucleotide
gatgaatggctgcgacgtggggtcg

SEQ ID NO: 8461 - DNA, 26 bp, Artificial Sequence
  Description of Artificial Sequence: Synthetic oligonucleotide
atgaatggctgcgacgtggggtcgga

SEQ ID NO: 8462 - DNA, 25 bp, Artificial Sequence
  Description of Artificial Sequence: Synthetic oligonucleotide
tgaatggctgcgacgtggggtcgga

SEQ ID NO: 8463 - DNA, 24 bp, Artificial Sequence
  Description of Artificial Sequence: Synthetic oligonucleotide
gaatggctgcgacgtggggtcgga

SEQ ID NO: 8464 - DNA, 25 bp, Artificial Sequence
  Description of Artificial Sequence: Synthetic oligonucleotide
aatggctgcgacgtggggtcggact

SEQ ID NO: 8465 - DNA, 23 bp, Artificial Sequence
  Description of Artificial Sequence: Synthetic oligonucleotide
aagtgggaggcggcccatgtggg

SEQ ID NO: 8466 - DNA, 22 bp, Artificial Sequence
  Description of Artificial Sequence: Synthetic oligonucleotide
agtgggaggcggcccatgtggg

SEQ ID NO: 8467 - DNA, 21 bp, Artificial Sequence
  Description of Artificial Sequence: Synthetic oligonucleotide
gtgggaggcggcccatgtggg

SEQ ID NO: 8468 - DNA, 21 bp, Artificial Sequence
  Description of Artificial Sequence: Synthetic oligonucleotide
tgggaggcggcccatgtgggg

SEQ ID NO: 8469 - DNA, 20 bp, Artificial Sequence
  Description of Artificial Sequence: Synthetic oligonucleotide
gggaggcggcccatgtgggg

SEQ ID NO: 8470 - DNA, 21 bp, Artificial Sequence
  Description of Artificial Sequence: Synthetic oligonucleotide
ggaggcggcccatgtggggga

SEQ ID NO: 8471 - DNA, 21 bp, Artificial Sequence
  Description of Artificial Sequence: Synthetic oligonucleotide
gaggcggcccatgtgggggag

SEQ ID NO: 8472 - DNA, 22 bp, Artificial Sequence
  Description of Artificial Sequence: Synthetic oligonucleotide
aggcggcccatgtgggggagca

SEQ ID NO: 8473 - DNA, 21 bp, Artificial Sequence
  Description of Artificial Sequence: Synthetic oligonucleotide
ggcggcccatgtgggggagca

SEQ ID NO: 8474 - DNA, 22 bp, Artificial Sequence
  Description of Artificial Sequence: Synthetic oligonucleotide
gcggcccatgtgggggagcagt

SEQ ID NO: 8475 - DNA, 22 bp, Artificial Sequence
  Description of Artificial Sequence: Synthetic oligonucleotide
cggcccatgtgggggagcagtg

SEQ ID NO: 8476 - DNA, 23 bp, Artificial Sequence
  Description of Artificial Sequence: Synthetic oligonucleotide
ggcccatgtgggggagcagtgga

SEQ ID NO: 8477 - DNA, 24 bp, Artificial Sequence
  Description of Artificial Sequence: Synthetic oligonucleotide
gcccatgtgggggagcagtggaga

SEQ ID NO: 8478 - DNA, 24 bp, Artificial Sequence
  Description of Artificial Sequence: Synthetic oligonucleotide
cccatgtgggggagcagtggagag

SEQ ID NO: 8479 - DNA, 24 bp, Artificial Sequence
  Description of Artificial Sequence: Synthetic oligonucleotide
ccatgtgggggagcagtggagagc

SEQ ID NO: 8480 - DNA, 26 bp, Artificial Sequence
  Description of Artificial Sequence: Synthetic oligonucleotide
catgtgggggagcagtggagagccta

SEQ ID NO: 8481 - DNA, 26 bp, Artificial Sequence
  Description of Artificial Sequence: Synthetic oligonucleotide
atgtgggggagcagtggagagcctac

SEQ ID NO: 8482 - DNA, 25 bp, Artificial Sequence
  Description of Artificial Sequence: Synthetic oligonucleotide
tgtgggggagcagtggagagcctac

SEQ ID NO: 8483 - DNA, 24 bp, Artificial Sequence
  Description of Artificial Sequence: Synthetic oligonucleotide
gtgggggagcagtggagagcctac

SEQ ID NO: 8484 - DNA, 25 bp, Artificial Sequence
  Description of Artificial Sequence: Synthetic oligonucleotide
tgggggagcagtggagagcctacct

SEQ ID NO: 8485 - DNA, 24 bp, Artificial Sequence
  Description of Artificial Sequence: Synthetic oligonucleotide
gggggagcagtggagagcctacct

SEQ ID NO: 8486 - DNA, 24 bp, Artificial Sequence
  Description of Artificial Sequence: Synthetic oligonucleotide
ggggagcagtggagagcctacctg

SEQ ID NO: 8487 - DNA, 25 bp, Artificial Sequence
  Description of Artificial Sequence: Synthetic oligonucleotide
gggagcagtggagagcctacctgga

SEQ ID NO: 8488 - DNA, 24 bp, Artificial Sequence
  Description of Artificial Sequence: Synthetic oligonucleotide
tacctggagggcacgtgcgtggag

SEQ ID NO: 8489 - DNA, 23 bp, Artificial Sequence
  Description of Artificial Sequence: Synthetic oligonucleotide
acctggagggcacgtgcgtggag

SEQ ID NO: 8490 - DNA, 22 bp, Artificial Sequence
  Description of Artificial Sequence: Synthetic oligonucleotide
cctggagggcacgtgcgtggag

SEQ ID NO: 8491 - DNA, 22 bp, Artificial Sequence
  Description of Artificial Sequence: Synthetic oligonucleotide
ctggagggcacgtgcgtggagc

SEQ ID NO: 8492 - DNA, 22 bp, Artificial Sequence
  Description of Artificial Sequence: Synthetic oligonucleotide
tggagggcacgtgcgtggagcg

SEQ ID NO: 8493 - DNA, 21 bp, Artificial Sequence
  Description of Artificial Sequence: Synthetic oligonucleotide
ggagggcacgtgcgtggagcg

SEQ ID NO: 8494 - DNA, 21 bp, Artificial Sequence
  Description of Artificial Sequence: Synthetic oligonucleotide
gagggcacgtgcgtggagcgg

SEQ ID NO: 8495 - DNA, 22 bp, Artificial Sequence
  Description of Artificial Sequence: Synthetic oligonucleotide
agggcacgtgcgtggagcggct

SEQ ID NO: 8496 - DNA, 21 bp, Artificial Sequence
  Description of Artificial Sequence: Synthetic oligonucleotide
gggcacgtgcgtggagcggct

SEQ ID NO: 8497 - DNA, 21 bp, Artificial Sequence
  Description of Artificial Sequence: Synthetic oligonucleotide
ggcacgtgcgtggagcggctc

SEQ ID NO: 8498 - DNA, 21 bp, Artificial Sequence
  Description of Artificial Sequence: Synthetic oligonucleotide
gcacgtgcgtggagcggctcc

SEQ ID NO: 8499 - DNA, 21 bp, Artificial Sequence
  Description of Artificial Sequence: Synthetic oligonucleotide
cacgtgcgtggagcggctccg

SEQ ID NO: 8500 - DNA, 22 bp, Artificial Sequence
  Description of Artificial Sequence: Synthetic oligonucleotide
acgtgcgtggagcggctccgca

SEQ ID NO: 8501 - DNA, 21 bp, Artificial Sequence
  Description of Artificial Sequence: Synthetic oligonucleotide
cgtgcgtggagcggctccgca

SEQ ID NO: 8502 - DNA, 24 bp, Artificial Sequence
  Description of Artificial Sequence: Synthetic oligonucleotide
gtgcgtggagcggctccgcagata

SEQ ID NO: 8503 - DNA, 24 bp, Artificial Sequence
  Description of Artificial Sequence: Synthetic oligonucleotide
tgcgtggagcggctccgcagatac

SEQ ID NO: 8504 - DNA, 23 bp, Artificial Sequence
  Description of Artificial Sequence: Synthetic oligonucleotide
gcgtggagcggctccgcagatac

SEQ ID NO: 8505 - DNA, 24 bp, Artificial Sequence
  Description of Artificial Sequence: Synthetic oligonucleotide
cgtggagcggctccgcagatacct

SEQ ID NO: 8506 - DNA, 24 bp, Artificial Sequence
  Description of Artificial Sequence: Synthetic oligonucleotide
gtggagcggctccgcagatacctg

SEQ ID NO: 8507 - DNA, 25 bp, Artificial Sequence
  Description of Artificial Sequence: Synthetic oligonucleotide
tggagcggctccgcagatacctgga

SEQ ID NO: 8508 - DNA, 24 bp, Artificial Sequence
  Description of Artificial Sequence: Synthetic oligonucleotide
ggagcggctccgcagatacctgga

SEQ ID NO: 8509 - DNA, 26 bp, Artificial Sequence
  Description of Artificial Sequence: Synthetic oligonucleotide
gagcggctccgcagatacctggagaa

SEQ ID NO: 8510 - DNA, 26 bp, Artificial Sequence
  Description of Artificial Sequence: Synthetic oligonucleotide
agcggctccgcagatacctggagaac

SEQ ID NO: 8511 - DNA, 25 bp, Artificial Sequence
  Description of Artificial Sequence: Synthetic oligonucleotide
gcggctccgcagatacctggagaac

SEQ ID NO: 8512 - DNA, 25 bp, Artificial Sequence
  Description of Artificial Sequence: Synthetic oligonucleotide
cggctccgcagatacctggagaacg

SEQ ID NO: 8513 - DNA, 28 bp, Artificial Sequence
  Description of Artificial Sequence: Synthetic oligonucleotide
acatggcagctcagaccaccaagcacag

SEQ ID NO: 8514 - DNA, 27 bp, Artificial Sequence
  Description of Artificial Sequence: Synthetic oligonucleotide
catggcagctcagaccaccaagcacag

SEQ ID NO: 8515 - DNA, 27 bp, Artificial Sequence
  Description of Artificial Sequence: Synthetic oligonucleotide
atggcagctcagaccaccaagcacagg

SEQ ID NO: 8516 - DNA, 27 bp, Artificial Sequence
  Description of Artificial Sequence: Synthetic oligonucleotide
tggcagctcagaccaccaagcacaggt

SEQ ID NO: 8517 - DNA, 26 bp, Artificial Sequence
  Description of Artificial Sequence: Synthetic oligonucleotide
ggcagctcagaccaccaagcacaggt

SEQ ID NO: 8518 - DNA, 26 bp, Artificial Sequence
  Description of Artificial Sequence: Synthetic oligonucleotide
gcagctcagaccaccaagcacaggtg

SEQ ID NO: 8519 - DNA, 26 bp, Artificial Sequence
  Description of Artificial Sequence: Synthetic oligonucleotide
cagctcagaccaccaagcacaggtgg

SEQ ID NO: 8520 - DNA, 27 bp, Artificial Sequence
  Description of Artificial Sequence: Synthetic oligonucleotide
agctcagaccaccaagcacaggtggga

SEQ ID NO: 8521 - DNA, 26 bp, Artificial Sequence
  Description of Artificial Sequence: Synthetic oligonucleotide
gctcagaccaccaagcacaggtggga

SEQ ID NO: 8522 - DNA, 26 bp, Artificial Sequence
  Description of Artificial Sequence: Synthetic oligonucleotide
ctcagaccaccaagcacaggtgggag

SEQ ID NO: 8523 - DNA, 26 bp, Artificial Sequence
  Description of Artificial Sequence: Synthetic oligonucleotide
tcagaccaccaagcacaggtgggagg

SEQ ID NO: 8524 - DNA, 25 bp, Artificial Sequence
  Description of Artificial Sequence: Synthetic oligonucleotide
cagaccaccaagcacaggtgggagg

SEQ ID NO: 8525 - DNA, 25 bp, Artificial Sequence
  Description of Artificial Sequence: Synthetic oligonucleotide
agaccaccaagcacaggtgggaggc

SEQ ID NO: 8526 - DNA, 24 bp, Artificial Sequence
  Description of Artificial Sequence: Synthetic oligonucleotide
gaccaccaagcacaggtgggaggc

SEQ ID NO: 8527 - DNA, 24 bp, Artificial Sequence
  Description of Artificial Sequence: Synthetic oligonucleotide
accaccaagcacaggtgggaggcg

SEQ ID NO: 8528 - DNA, 23 bp, Artificial Sequence
  Description of Artificial Sequence: Synthetic oligonucleotide
ccaccaagcacaggtgggaggcg

SEQ ID NO: 8529 - DNA, 23 bp, Artificial Sequence
  Description of Artificial Sequence: Synthetic oligonucleotide
caccaagcacaggtgggaggcgg

SEQ ID NO: 8530 - DNA, 23 bp, Artificial Sequence
  Description of Artificial Sequence: Synthetic oligonucleotide
accaagcacaggtgggaggcggc

SEQ ID NO: 8531 - DNA, 22 bp, Artificial Sequence
  Description of Artificial Sequence: Synthetic oligonucleotide
ccaagcacaggtgggaggcggc

SEQ ID NO: 8532 - DNA, 22 bp, Artificial Sequence
  Description of Artificial Sequence: Synthetic oligonucleotide
caagcacaggtgggaggcggcc

SEQ ID NO: 8533 - DNA, 24 bp, Artificial Sequence
  Description of Artificial Sequence: Synthetic oligonucleotide
aagcacaggtgggaggcggcccat

SEQ ID NO: 8534 - DNA, 23 bp, Artificial Sequence
  Description of Artificial Sequence: Synthetic oligonucleotide
agcacaggtgggaggcggcccat

SEQ ID NO: 8535 - DNA, 22 bp, Artificial Sequence
  Description of Artificial Sequence: Synthetic oligonucleotide
gcacaggtgggaggcggcccat

SEQ ID NO: 8536 - DNA, 23 bp, Artificial Sequence
  Description of Artificial Sequence: Synthetic oligonucleotide
cacaggtgggaggcggcccatgt

SEQ ID NO: 8537 - DNA, 23 bp, Artificial Sequence
  Description of Artificial Sequence: Synthetic oligonucleotide
acaggtgggaggcggcccatgtg

SEQ ID NO: 8538 - DNA, 22 bp, Artificial Sequence
  Description of Artificial Sequence: Synthetic oligonucleotide
caggtgggaggcggcccatgtg

SEQ ID NO: 8539 - DNA, 22 bp, Artificial Sequence
  Description of Artificial Sequence: Synthetic oligonucleotide
aggtgggaggcggcccatgtgg

SEQ ID NO: 8540 - DNA, 21 bp, Artificial Sequence
  Description of Artificial Sequence: Synthetic oligonucleotide
ggtgggaggcggcccatgtgg

SEQ ID NO: 8541 - DNA, 27 bp, Artificial Sequence
  Description of Artificial Sequence: Synthetic oligonucleotide
gctacgtggacgacacgcagttcgtgt

SEQ ID NO: 8542 - DNA, 27 bp, Artificial Sequence
  Description of Artificial Sequence: Synthetic oligonucleotide
ctacgtggacgacacgcagttcgtgtg

SEQ ID NO: 8543 - DNA, 27 bp, Artificial Sequence
  Description of Artificial Sequence: Synthetic oligonucleotide
tacgtggacgacacgcagttcgtgtgg

SEQ ID NO: 8544 - DNA, 27 bp, Artificial Sequence
  Description of Artificial Sequence: Synthetic oligonucleotide
acgtggacgacacgcagttcgtgtggt

SEQ ID NO: 8545 - DNA, 27 bp, Artificial Sequence
  Description of Artificial Sequence: Synthetic oligonucleotide
cgtggacgacacgcagttcgtgtggtt

SEQ ID NO: 8546 - DNA, 27 bp, Artificial Sequence
  Description of Artificial Sequence: Synthetic oligonucleotide
gtggacgacacgcagttcgtgtggttc

SEQ ID NO: 8547 - DNA, 27 bp, Artificial Sequence
  Description of Artificial Sequence: Synthetic oligonucleotide
tggacgacacgcagttcgtgtggttcg

SEQ ID NO: 8548 - DNA, 27 bp, Artificial Sequence
  Description of Artificial Sequence: Synthetic oligonucleotide
ggacgacacgcagttcgtgtggttcga

SEQ ID NO: 8549 - DNA, 27 bp, Artificial Sequence
  Description of Artificial Sequence: Synthetic oligonucleotide
gacgacacgcagttcgtgtggttcgac

SEQ ID NO: 8550 - DNA, 28 bp, Artificial Sequence
  Description of Artificial Sequence: Synthetic oligonucleotide
acgacacgcagttcgtgtggttcgacag

SEQ ID NO: 8551 - DNA, 27 bp, Artificial Sequence
  Description of Artificial Sequence: Synthetic oligonucleotide
cgacacgcagttcgtgtggttcgacag

SEQ ID NO: 8552 - DNA, 27 bp, Artificial Sequence
  Description of Artificial Sequence: Synthetic oligonucleotide
gacacgcagttcgtgtggttcgacagc

SEQ ID NO: 8553 - DNA, 27 bp, Artificial Sequence
  Description of Artificial Sequence: Synthetic oligonucleotide
acacgcagttcgtgtggttcgacagcg

SEQ ID NO: 8554 - DNA, 27 bp, Artificial Sequence
  Description of Artificial Sequence: Synthetic oligonucleotide
cacgcagttcgtgtggttcgacagcga

SEQ ID NO: 8555 - DNA, 27 bp, Artificial Sequence
  Description of Artificial Sequence: Synthetic oligonucleotide
acgcagttcgtgtggttcgacagcgac

SEQ ID NO: 8556 - DNA, 26 bp, Artificial Sequence
  Description of Artificial Sequence: Synthetic oligonucleotide
cgcagttcgtgtggttcgacagcgac

SEQ ID NO: 8557 - DNA, 26 bp, Artificial Sequence
  Description of Artificial Sequence: Synthetic oligonucleotide
gcagttcgtgtggttcgacagcgacg

SEQ ID NO: 8558 - DNA, 26 bp, Artificial Sequence
  Description of Artificial Sequence: Synthetic oligonucleotide
cagttcgtgtggttcgacagcgacgc

SEQ ID NO: 8559 - DNA, 26 bp, Artificial Sequence
  Description of Artificial Sequence: Synthetic oligonucleotide
agttcgtgtggttcgacagcgacgcc

SEQ ID NO: 8560 - DNA, 25 bp, Artificial Sequence
  Description of Artificial Sequence: Synthetic oligonucleotide
gttcgtgtggttcgacagcgacgcc

SEQ ID NO: 8561 - DNA, 25 bp, Artificial Sequence
  Description of Artificial Sequence: Synthetic oligonucleotide
ttcgtgtggttcgacagcgacgccg

SEQ ID NO: 8562 - DNA, 24 bp, Artificial Sequence
  Description of Artificial Sequence: Synthetic oligonucleotide
tcgtgtggttcgacagcgacgccg

SEQ ID NO: 8563 - DNA, 23 bp, Artificial Sequence
  Description of Artificial Sequence: Synthetic oligonucleotide
cgtgtggttcgacagcgacgccg

SEQ ID NO: 8564 - DNA, 23 bp, Artificial Sequence
  Description of Artificial Sequence: Synthetic oligonucleotide
gtgtggttcgacagcgacgccgc

SEQ ID NO: 8565 - DNA, 24 bp, Artificial Sequence
  Description of Artificial Sequence: Synthetic oligonucleotide
tgtggttcgacagcgacgccgcga

SEQ ID NO: 8566 - DNA, 23 bp, Artificial Sequence
  Description of Artificial Sequence: Synthetic oligonucleotide
gtggttcgacagcgacgccgcga

SEQ ID NO: 8567 - DNA, 23 bp, Artificial Sequence
  Description of Artificial Sequence: Synthetic oligonucleotide
tggttcgacagcgacgccgcgag

SEQ ID NO: 8568 - DNA, 33 bp, Artificial Sequence
  Description of Artificial Sequence: Synthetic oligonucleotide
gctgtcactccatgaggtatttcttcacatccg

SEQ ID NO: 8569 - DNA, 34 bp, Artificial Sequence
  Description of Artificial Sequence: Synthetic oligonucleotide
ctgtcactccatgaggtatttcttcacatccgtg

SEQ ID NO: 8570 - DNA, 35 bp, Artificial Sequence
  Description of Artificial Sequence: Synthetic oligonucleotide
tgtcactccatgaggtatttcttcacatccgtgtc

SEQ ID NO: 8571 - DNA, 34 bp, Artificial Sequence
  Description of Artificial Sequence: Synthetic oligonucleotide
gtcactccatgaggtatttcttcacatccgtgtc

SEQ ID NO: 8572 - DNA, 27 bp, Artificial Sequence
  Description of Artificial Sequence: Synthetic oligonucleotide
gcggagcagttgagagcctacctggat

SEQ ID NO: 8573 - DNA, 27 bp, Artificial Sequence
  Description of Artificial Sequence: Synthetic oligonucleotide
cggagcagttgagagcctacctggatg

SEQ ID NO: 8574 - DNA, 27 bp, Artificial Sequence
  Description of Artificial Sequence: Synthetic oligonucleotide
ggagcagttgagagcctacctggatgg

SEQ ID NO: 8575 - DNA, 27 bp, Artificial Sequence
  Description of Artificial Sequence: Synthetic oligonucleotide
gagcagttgagagcctacctggatggc

SEQ ID NO: 8576 - DNA, 28 bp, Artificial Sequence
  Description of Artificial Sequence: Synthetic oligonucleotide
agcagttgagagcctacctggatggcac

SEQ ID NO: 8577 - DNA, 27 bp, Artificial Sequence
  Description of Artificial Sequence: Synthetic oligonucleotide
gcagttgagagcctacctggatggcac

SEQ ID NO: 8578 - DNA, 27 bp, Artificial Sequence
  Description of Artificial Sequence: Synthetic oligonucleotide
cagttgagagcctacctggatggcacg

SEQ ID NO: 8579 - DNA, 28 bp, Artificial Sequence
  Description of Artificial Sequence: Synthetic oligonucleotide
agttgagagcctacctggatggcacgtg

SEQ ID NO: 8580 - DNA, 27 bp, Artificial Sequence
  Description of Artificial Sequence: Synthetic oligonucleotide
gttgagagcctacctggatggcacgtg

SEQ ID NO: 8581 - DNA, 27 bp, Artificial Sequence
  Description of Artificial Sequence: Synthetic oligonucleotide
ttgagagcctacctggatggcacgtgc

SEQ ID NO: 8582 - DNA, 26 bp, Artificial Sequence
  Description of Artificial Sequence: Synthetic oligonucleotide
tgagagcctacctggatggcacgtgc

SEQ ID NO: 8583 - DNA, 25 bp, Artificial Sequence
  Description of Artificial Sequence: Synthetic oligonucleotide
gagagcctacctggatggcacgtgc

SEQ ID NO: 8584 - DNA, 26 bp, Artificial Sequence
  Description of Artificial Sequence: Synthetic oligonucleotide
agagcctacctggatggcacgtgcgt

SEQ ID NO: 8585 - DNA, 25 bp, Artificial Sequence
  Description of Artificial Sequence: Synthetic oligonucleotide
gagcctacctggatggcacgtgcgt

SEQ ID NO: 8586 - DNA, 25 bp, Artificial Sequence
  Description of Artificial Sequence: Synthetic oligonucleotide
agcctacctggatggcacgtgcgtg

SEQ ID NO: 8587 - DNA, 24 bp, Artificial Sequence
  Description of Artificial Sequence: Synthetic oligonucleotide
gcctacctggatggcacgtgcgtg

SEQ ID NO: 8588 - DNA, 25 bp, Artificial Sequence
  Description of Artificial Sequence: Synthetic oligonucleotide
cctacctggatggcacgtgcgtgga

SEQ ID NO: 8589 - DNA, 26 bp, Artificial Sequence
  Description of Artificial Sequence: Synthetic oligonucleotide
ctacctggatggcacgtgcgtggagt

SEQ ID NO: 8590 - DNA, 26 bp, Artificial Sequence
  Description of Artificial Sequence: Synthetic oligonucleotide
tacctggatggcacgtgcgtggagtg

SEQ ID NO: 8591 - DNA, 25 bp, Artificial Sequence
  Description of Artificial Sequence: Synthetic oligonucleotide
acctggatggcacgtgcgtggagtg

SEQ ID NO: 8592 - DNA, 24 bp, Artificial Sequence
  Description of Artificial Sequence: Synthetic oligonucleotide
cctggatggcacgtgcgtggagtg

SEQ ID NO: 8593 - DNA, 24 bp, Artificial Sequence
  Description of Artificial Sequence: Synthetic oligonucleotide
ctggatggcacgtgcgtggagtgg

SEQ ID NO: 8594 - DNA, 25 bp, Artificial Sequence
  Description of Artificial Sequence: Synthetic oligonucleotide
tggatggcacgtgcgtggagtggct

SEQ ID NO: 8595 - DNA, 24 bp, Artificial Sequence
  Description of Artificial Sequence: Synthetic oligonucleotide
ggatggcacgtgcgtggagtggct

SEQ ID NO: 8596 - DNA, 24 bp, Artificial Sequence
  Description of Artificial Sequence: Synthetic oligonucleotide
gatggcacgtgcgtggagtggctc

SEQ ID NO: 8597 - DNA, 24 bp, Artificial Sequence
  Description of Artificial Sequence: Synthetic oligonucleotide
atggcacgtgcgtggagtggctcc

SEQ ID NO: 8598 - DNA, 23 bp, Artificial Sequence
  Description of Artificial Sequence: Synthetic oligonucleotide
tggcacgtgcgtggagtggctcc

SEQ ID NO: 8599 - DNA, 26 bp, Artificial Sequence
  Description of Artificial Sequence: Synthetic oligonucleotide
ggctacgtggacgacacgcagttcct

SEQ ID NO: 8600 - DNA, 26 bp, Artificial Sequence
  Description of Artificial Sequence: Synthetic oligonucleotide
gctacgtggacgacacgcagttcctg

SEQ ID NO: 8601 - DNA, 26 bp, Artificial Sequence
  Description of Artificial Sequence: Synthetic oligonucleotide
ctacgtggacgacacgcagttcctgc

SEQ ID NO: 8602 - DNA, 26 bp, Artificial Sequence
  Description of Artificial Sequence: Synthetic oligonucleotide
tacgtggacgacacgcagttcctgcg

SEQ ID NO: 8603 - DNA, 25 bp, Artificial Sequence
  Description of Artificial Sequence: Synthetic oligonucleotide
acgtggacgacacgcagttcctgcg

SEQ ID NO: 8604 - DNA, 24 bp, Artificial Sequence
  Description of Artificial Sequence: Synthetic oligonucleotide
cgtggacgacacgcagttcctgcg

SEQ ID NO: 8605 - DNA, 26 bp, Artificial Sequence
  Description of Artificial Sequence: Synthetic oligonucleotide
gtggacgacacgcagttcctgcggtt

SEQ ID NO: 8606 - DNA, 26 bp, Artificial Sequence
  Description of Artificial Sequence: Synthetic oligonucleotide
tggacgacacgcagttcctgcggttc

SEQ ID NO: 8607 - DNA, 25 bp, Artificial Sequence
  Description of Artificial Sequence: Synthetic oligonucleotide
ggacgacacgcagttcctgcggttc

SEQ ID NO: 8608 - DNA, 26 bp, Artificial Sequence
  Description of Artificial Sequence: Synthetic oligonucleotide
gacgacacgcagttcctgcggttcga

SEQ ID NO: 8609 - DNA, 27 bp, Artificial Sequence
  Description of Artificial Sequence: Synthetic oligonucleotide
acgacacgcagttcctgcggttcgaca

SEQ ID NO: 8610 - DNA, 26 bp, Artificial Sequence
  Description of Artificial Sequence: Synthetic oligonucleotide
cgacacgcagttcctgcggttcgaca

SEQ ID NO: 8611 - DNA, 26 bp, Artificial Sequence
  Description of Artificial Sequence: Synthetic oligonucleotide
gacacgcagttcctgcggttcgacag

SEQ ID NO: 8612 - DNA, 26 bp, Artificial Sequence
  Description of Artificial Sequence: Synthetic oligonucleotide
acacgcagttcctgcggttcgacagc

SEQ ID NO: 8613 - DNA, 25 bp, Artificial Sequence
  Description of Artificial Sequence: Synthetic oligonucleotide
cacgcagttcctgcggttcgacagc

SEQ ID NO: 8614 - DNA, 26 bp, Artificial Sequence
  Description of Artificial Sequence: Synthetic oligonucleotide
acgcagttcctgcggttcgacagcga

SEQ ID NO: 8615 - DNA, 25 bp, Artificial Sequence
  Description of Artificial Sequence: Synthetic oligonucleotide
cgcagttcctgcggttcgacagcga

SEQ ID NO: 8616 - DNA, 25 bp, Artificial Sequence
  Description of Artificial Sequence: Synthetic oligonucleotide
gcagttcctgcggttcgacagcgac

SEQ ID NO: 8617 - DNA, 25 bp, Artificial Sequence
  Description of Artificial Sequence: Synthetic oligonucleotide
cagttcctgcggttcgacagcgacg

SEQ ID NO: 8618 - DNA, 25 bp, Artificial Sequence
  Description of Artificial Sequence: Synthetic oligonucleotide
agttcctgcggttcgacagcgacgc

SEQ ID NO: 8619 - DNA, 24 bp, Artificial Sequence
  Description of Artificial Sequence: Synthetic oligonucleotide
gttcctgcggttcgacagcgacgc

SEQ ID NO: 8620 - DNA, 24 bp, Artificial Sequence
  Description of Artificial Sequence: Synthetic oligonucleotide
ttcctgcggttcgacagcgacgcc

SEQ ID NO: 8621 - DNA, 23 bp, Artificial Sequence
  Description of Artificial Sequence: Synthetic oligonucleotide
tcctgcggttcgacagcgacgcc

SEQ ID NO: 8622 - DNA, 22 bp, Artificial Sequence
  Description of Artificial Sequence: Synthetic oligonucleotide
cctgcggttcgacagcgacgcc

SEQ ID NO: 8623 - DNA, 22 bp, Artificial Sequence
  Description of Artificial Sequence: Synthetic oligonucleotide
ctgcggttcgacagcgacgccg

SEQ ID NO: 8624 - DNA, 25 bp, Artificial Sequence
  Description of Artificial Sequence: Synthetic oligonucleotide
ggtccggagtattgggacggggagt

SEQ ID NO: 8625 - DNA, 26 bp, Artificial Sequence
  Description of Artificial Sequence: Synthetic oligonucleotide
gtccggagtattgggacggggagtca

SEQ ID NO: 8626 - DNA, 26 bp, Artificial Sequence
  Description of Artificial Sequence: Synthetic oligonucleotide
tccggagtattgggacggggagtcac

SEQ ID NO: 8627 - DNA, 25 bp, Artificial Sequence
  Description of Artificial Sequence: Synthetic oligonucleotide
ccggagtattgggacggggagtcac

SEQ ID NO: 8628 - DNA, 25 bp, Artificial Sequence
  Description of Artificial Sequence: Synthetic oligonucleotide
cggagtattgggacggggagtcacg

SEQ ID NO: 8629 - DNA, 27 bp, Artificial Sequence
  Description of Artificial Sequence: Synthetic oligonucleotide
ggagtattgggacggggagtcacggaa

SEQ ID NO: 8630 - DNA, 28 bp, Artificial Sequence
  Description of Artificial Sequence: Synthetic oligonucleotide
gagtattgggacggggagtcacggaaag

SEQ ID NO: 8631 - DNA, 29 bp, Artificial Sequence
  Description of Artificial Sequence: Synthetic oligonucleotide
agtattgggacggggagtcacggaaagtg

SEQ ID NO: 8632 - DNA, 28 bp, Artificial Sequence
  Description of Artificial Sequence: Synthetic oligonucleotide
gtattgggacggggagtcacggaaagtg

SEQ ID NO: 8633 - DNA, 30 bp, Artificial Sequence
  Description of Artificial Sequence: Synthetic oligonucleotide
tattgggacggggagtcacggaaagtgaag

SEQ ID NO: 8634 - DNA, 29 bp, Artificial Sequence
  Description of Artificial Sequence: Synthetic oligonucleotide
attgggacggggagtcacggaaagtgaag

SEQ ID NO: 8635 - DNA, 28 bp, Artificial Sequence
  Description of Artificial Sequence: Synthetic oligonucleotide
ttgggacggggagtcacggaaagtgaag

SEQ ID NO: 8636 - DNA, 27 bp, Artificial Sequence
  Description of Artificial Sequence: Synthetic oligonucleotide
tgggacggggagtcacggaaagtgaag

SEQ ID NO: 8637 - DNA, 26 bp, Artificial Sequence
  Description of Artificial Sequence: Synthetic oligonucleotide
gggacggggagtcacggaaagtgaag

SEQ ID NO: 8638 - DNA, 26 bp, Artificial Sequence
  Description of Artificial Sequence: Synthetic oligonucleotide
ggacggggagtcacggaaagtgaagg

SEQ ID NO: 8639 - DNA, 26 bp, Artificial Sequence
  Description of Artificial Sequence: Synthetic oligonucleotide
gacggggagtcacggaaagtgaaggc

SEQ ID NO: 8640 - DNA, 26 bp, Artificial Sequence
  Description of Artificial Sequence: Synthetic oligonucleotide
acggggagtcacggaaagtgaaggcc

SEQ ID NO: 8641 - DNA, 25 bp, Artificial Sequence
  Description of Artificial Sequence: Synthetic oligonucleotide
cggggagtcacggaaagtgaaggcc

SEQ ID NO: 8642 - DNA, 26 bp, Artificial Sequence
  Description of Artificial Sequence: Synthetic oligonucleotide
ggggagtcacggaaagtgaaggccca

SEQ ID NO: 8643 - DNA, 27 bp, Artificial Sequence
  Description of Artificial Sequence: Synthetic oligonucleotide
gggagtcacggaaagtgaaggcccact

SEQ ID NO: 8644 - DNA, 27 bp, Artificial Sequence
  Description of Artificial Sequence: Synthetic oligonucleotide
ggagtcacggaaagtgaaggcccactc

SEQ ID NO: 8645 - DNA, 28 bp, Artificial Sequence
  Description of Artificial Sequence: Synthetic oligonucleotide
gagtcacggaaagtgaaggcccactcac

SEQ ID NO: 8646 - DNA, 29 bp, Artificial Sequence
  Description of Artificial Sequence: Synthetic oligonucleotide
agtcacggaaagtgaaggcccactcacag

SEQ ID NO: 8647 - DNA, 28 bp, Artificial Sequence
  Description of Artificial Sequence: Synthetic oligonucleotide
gtcacggaaagtgaaggcccactcacag

SEQ ID NO: 8648 - DNA, 29 bp, Artificial Sequence
  Description of Artificial Sequence: Synthetic oligonucleotide
tcacggaaagtgaaggcccactcacagac

SEQ ID NO: 8649 - DNA, 25 bp, Artificial Sequence
  Description of Artificial Sequence: Synthetic oligonucleotide
gcagttcgtgcggttcgacagcgag

SEQ ID NO: 8650 - DNA, 25 bp, Artificial Sequence
  Description of Artificial Sequence: Synthetic oligonucleotide
cagttcgtgcggttcgacagcgagg

SEQ ID NO: 8651 - DNA, 25 bp, Artificial Sequence
  Description of Artificial Sequence: Synthetic oligonucleotide
agttcgtgcggttcgacagcgaggc

SEQ ID NO: 8652 - DNA, 24 bp, Artificial Sequence
  Description of Artificial Sequence: Synthetic oligonucleotide
gttcgtgcggttcgacagcgaggc

SEQ ID NO: 8653 - DNA, 24 bp, Artificial Sequence
  Description of Artificial Sequence: Synthetic oligonucleotide
ttcgtgcggttcgacagcgaggcc

SEQ ID NO: 8654 - DNA, 23 bp, Artificial Sequence
  Description of Artificial Sequence: Synthetic oligonucleotide
tcgtgcggttcgacagcgaggcc

SEQ ID NO: 8655 - DNA, 22 bp, Artificial Sequence
  Description of Artificial Sequence: Synthetic oligonucleotide
cgtgcggttcgacagcgaggcc

SEQ ID NO: 8656 - DNA, 22 bp, Artificial Sequence
  Description of Artificial Sequence: Synthetic oligonucleotide
gtgcggttcgacagcgaggccg

SEQ ID NO: 8657 - DNA, 22 bp, Artificial Sequence
  Description of Artificial Sequence: Synthetic oligonucleotide
tgcggttcgacagcgaggccgc

SEQ ID NO: 8658 - DNA, 21 bp, Artificial Sequence
  Description of Artificial Sequence: Synthetic oligonucleotide
gcggttcgacagcgaggccgc

SEQ ID NO: 8659 - DNA, 22 bp, Artificial Sequence
  Description of Artificial Sequence: Synthetic oligonucleotide
cggttcgacagcgaggccgcga

SEQ ID NO: 8660 - DNA, 22 bp, Artificial Sequence
  Description of Artificial Sequence: Synthetic oligonucleotide
ggttcgacagcgaggccgcgag

SEQ ID NO: 8661 - DNA, 22 bp, Artificial Sequence
  Description of Artificial Sequence: Synthetic oligonucleotide
gttcgacagcgaggccgcgagc

SEQ ID NO: 8662 - DNA, 23 bp, Artificial Sequence
  Description of Artificial Sequence: Synthetic oligonucleotide
ttcgacagcgaggccgcgagcca

SEQ ID NO: 8663 - DNA, 22 bp, Artificial Sequence
  Description of Artificial Sequence: Synthetic oligonucleotide
tcgacagcgaggccgcgagcca

SEQ ID NO: 8664 - DNA, 21 bp, Artificial Sequence
  Description of Artificial Sequence: Synthetic oligonucleotide
cgacagcgaggccgcgagcca

SEQ ID NO: 8665 - DNA, 22 bp, Artificial Sequence
  Description of Artificial Sequence: Synthetic oligonucleotide
gacagcgaggccgcgagccaga

SEQ ID NO: 8666 - DNA, 22 bp, Artificial Sequence
  Description of Artificial Sequence: Synthetic oligonucleotide
acagcgaggccgcgagccagag

SEQ ID NO: 8667 - DNA, 21 bp, Artificial Sequence
  Description of Artificial Sequence: Synthetic oligonucleotide
cagcgaggccgcgagccagag

SEQ ID NO: 8668 - DNA, 23 bp, Artificial Sequence
  Description of Artificial Sequence: Synthetic oligonucleotide
agcgaggccgcgagccagaggat

SEQ ID NO: 8669 - DNA, 22 bp, Artificial Sequence
  Description of Artificial Sequence: Synthetic oligonucleotide
gcgaggccgcgagccagaggat

SEQ ID NO: 8670 - DNA, 22 bp, Artificial Sequence
  Description of Artificial Sequence: Synthetic oligonucleotide
cgaggccgcgagccagaggatg

SEQ ID NO: 8671 - DNA, 23 bp, Artificial Sequence
  Description of Artificial Sequence: Synthetic oligonucleotide
gaggccgcgagccagaggatgga

SEQ ID NO: 8672 - DNA, 23 bp, Artificial Sequence
  Description of Artificial Sequence: Synthetic oligonucleotide
aggccgcgagccagaggatggag

SEQ ID NO: 8673 - DNA, 22 bp, Artificial Sequence
  Description of Artificial Sequence: Synthetic oligonucleotide
ggccgcgagccagaggatggag

SEQ ID NO: 8674 - DNA, 27 bp, Artificial Sequence
  Description of Artificial Sequence: Synthetic oligonucleotide
tgcggagatcacactgacctggcagca

SEQ ID NO: 8675 - DNA, 26 bp, Artificial Sequence
  Description of Artificial Sequence: Synthetic oligonucleotide
gcggagatcacactgacctggcagca

SEQ ID NO: 8676 - DNA, 26 bp, Artificial Sequence
  Description of Artificial Sequence: Synthetic oligonucleotide
cggagatcacactgacctggcagcag

SEQ ID NO: 8677 - DNA, 27 bp, Artificial Sequence
  Description of Artificial Sequence: Synthetic oligonucleotide
ggagatcacactgacctggcagcagga

SEQ ID NO: 8678 - DNA, 28 bp, Artificial Sequence
  Description of Artificial Sequence: Synthetic oligonucleotide
gagatcacactgacctggcagcaggatg

SEQ ID NO: 8679 - DNA, 28 bp, Artificial Sequence
  Description of Artificial Sequence: Synthetic oligonucleotide
agatcacactgacctggcagcaggatgg

SEQ ID NO: 8680 - DNA, 27 bp, Artificial Sequence
  Description of Artificial Sequence: Synthetic oligonucleotide
gatcacactgacctggcagcaggatgg

SEQ ID NO: 8681 - DNA, 27 bp, Artificial Sequence
  Description of Artificial Sequence: Synthetic oligonucleotide
atcacactgacctggcagcaggatggg

SEQ ID NO: 8682 - DNA, 26 bp, Artificial Sequence
  Description of Artificial Sequence: Synthetic oligonucleotide
tcacactgacctggcagcaggatggg

SEQ ID NO: 8683 - DNA, 25 bp, Artificial Sequence
  Description of Artificial Sequence: Synthetic oligonucleotide
cacactgacctggcagcaggatggg

SEQ ID NO: 8684 - DNA, 26 bp, Artificial Sequence
  Description of Artificial Sequence: Synthetic oligonucleotide
acactgacctggcagcaggatgggga

SEQ ID NO: 8685 - DNA, 25 bp, Artificial Sequence
  Description of Artificial Sequence: Synthetic oligonucleotide
cactgacctggcagcaggatgggga

SEQ ID NO: 8686 - DNA, 25 bp, Artificial Sequence
  Description of Artificial Sequence: Synthetic oligonucleotide
actgacctggcagcaggatggggag

SEQ ID NO: 8687 - DNA, 24 bp, Artificial Sequence
  Description of Artificial Sequence: Synthetic oligonucleotide
ctgacctggcagcaggatggggag

SEQ ID NO: 8688 - DNA, 25 bp, Artificial Sequence
  Description of Artificial Sequence: Synthetic oligonucleotide
tgacctggcagcaggatggggagga

SEQ ID NO: 8689 - DNA, 24 bp, Artificial Sequence
  Description of Artificial Sequence: Synthetic oligonucleotide
gacctggcagcaggatggggagga

SEQ ID NO: 8690 - DNA, 24 bp, Artificial Sequence
  Description of Artificial Sequence: Synthetic oligonucleotide
acctggcagcaggatggggaggac

SEQ ID NO: 8691 - DNA, 23 bp, Artificial Sequence
  Description of Artificial Sequence: Synthetic oligonucleotide
cctggcagcaggatggggaggac

SEQ ID NO: 8692 - DNA, 24 bp, Artificial Sequence
  Description of Artificial Sequence: Synthetic oligonucleotide
ctggcagcaggatggggaggacca

SEQ ID NO: 8693 - DNA, 25 bp, Artificial Sequence
  Description of Artificial Sequence: Synthetic oligonucleotide
tggcagcaggatggggaggaccaga

SEQ ID NO: 8694 - DNA, 24 bp, Artificial Sequence
  Description of Artificial Sequence: Synthetic oligonucleotide
ggcagcaggatggggaggaccaga

SEQ ID NO: 8695 - DNA, 24 bp, Artificial Sequence
  Description of Artificial Sequence: Synthetic oligonucleotide
gcagcaggatggggaggaccagac

SEQ ID NO: 8696 - DNA, 24 bp, Artificial Sequence
  Description of Artificial Sequence: Synthetic oligonucleotide
cagcaggatggggaggaccagacc

SEQ ID NO: 8697 - DNA, 25 bp, Artificial Sequence
  Description of Artificial Sequence: Synthetic oligonucleotide
agcaggatggggaggaccagaccca

SEQ ID NO: 8698 - DNA, 24 bp, Artificial Sequence
  Description of Artificial Sequence: Synthetic oligonucleotide
gcaggatggggaggaccagaccca

SEQ ID NO: 8699 - DNA, 24 bp, Artificial Sequence
  Description of Artificial Sequence: Synthetic oligonucleotide
caggatggggaggaccagacccag

SEQ ID NO: 8700 - DNA, 25 bp, Artificial Sequence
  Description of Artificial Sequence: Synthetic oligonucleotide
aggatggggaggaccagacccagga

SEQ ID NO: 8701 - DNA, 32 bp, Artificial Sequence
  Description of Artificial Sequence: Synthetic oligonucleotide
gctctcactccatgaggtatttcaccacatcc

SEQ ID NO: 8702 - DNA, 32 bp, Artificial Sequence
  Description of Artificial Sequence: Synthetic oligonucleotide
ctctcactccatgaggtatttcaccacatccg

SEQ ID NO: 8703 - DNA, 33 bp, Artificial Sequence
  Description of Artificial Sequence: Synthetic oligonucleotide
tctcactccatgaggtatttcaccacatccgtg

SEQ ID NO: 8704 - DNA, 32 bp, Artificial Sequence
  Description of Artificial Sequence: Synthetic oligonucleotide
ctcactccatgaggtatttcaccacatccgtg

SEQ ID NO: 8705 - DNA, 33 bp, Artificial Sequence
  Description of Artificial Sequence: Synthetic oligonucleotide
tcactccatgaggtatttcaccacatccgtgtc

SEQ ID NO: 8706 - DNA, 32 bp, Artificial Sequence
  Description of Artificial Sequence: Synthetic oligonucleotide
cactccatgaggtatttcaccacatccgtgtc

SEQ ID NO: 8707 - DNA, 32 bp, Artificial Sequence
  Description of Artificial Sequence: Synthetic oligonucleotide
actccatgaggtatttcaccacatccgtgtcc

SEQ ID NO: 8708 - DNA, 31 bp, Artificial Sequence
  Description of Artificial Sequence: Synthetic oligonucleotide
ctccatgaggtatttcaccacatccgtgtcc

SEQ ID NO: 8709 - DNA, 31 bp, Artificial Sequence
  Description of Artificial Sequence: Synthetic oligonucleotide
tccatgaggtatttcaccacatccgtgtccc

SEQ ID NO: 8710 - DNA, 30 bp, Artificial Sequence
  Description of Artificial Sequence: Synthetic oligonucleotide
ccatgaggtatttcaccacatccgtgtccc

SEQ ID NO: 8711 - DNA, 30 bp, Artificial Sequence
  Description of Artificial Sequence: Synthetic oligonucleotide
catgaggtatttcaccacatccgtgtcccg

SEQ ID NO: 8712 - DNA, 30 bp, Artificial Sequence
  Description of Artificial Sequence: Synthetic oligonucleotide
atgaggtatttcaccacatccgtgtcccgg

SEQ ID NO: 8713 - DNA, 29 bp, Artificial Sequence
  Description of Artificial Sequence: Synthetic oligonucleotide
tgaggtatttcaccacatccgtgtcccgg

SEQ ID NO: 8714 - DNA, 28 bp, Artificial Sequence
  Description of Artificial Sequence: Synthetic oligonucleotide
gaggtatttcaccacatccgtgtcccgg

SEQ ID NO: 8715 - DNA, 28 bp, Artificial Sequence
  Description of Artificial Sequence: Synthetic oligonucleotide
aggtatttcaccacatccgtgtcccggc

SEQ ID NO: 8716 - DNA, 27 bp, Artificial Sequence
  Description of Artificial Sequence: Synthetic oligonucleotide
ggtatttcaccacatccgtgtcccggc

SEQ ID NO: 8717 - DNA, 27 bp, Artificial Sequence
  Description of Artificial Sequence: Synthetic oligonucleotide
gtatttcaccacatccgtgtcccggcc

SEQ ID NO: 8718 - DNA, 27 bp, Artificial Sequence
  Description of Artificial Sequence: Synthetic oligonucleotide
tatttcaccacatccgtgtcccggccc

SEQ ID NO: 8719 - DNA, 26 bp, Artificial Sequence
  Description of Artificial Sequence: Synthetic oligonucleotide
atttcaccacatccgtgtcccggccc

SEQ ID NO: 8720 - DNA, 25 bp, Artificial Sequence
  Description of Artificial Sequence: Synthetic oligonucleotide
tttcaccacatccgtgtcccggccc

SEQ ID NO: 8721 - DNA, 24 bp, Artificial Sequence
  Description of Artificial Sequence: Synthetic oligonucleotide
ttcaccacatccgtgtcccggccc

SEQ ID NO: 8722 - DNA, 23 bp, Artificial Sequence
  Description of Artificial Sequence: Synthetic oligonucleotide
tcaccacatccgtgtcccggccc

SEQ ID NO: 8723 - DNA, 22 bp, Artificial Sequence
  Description of Artificial Sequence: Synthetic oligonucleotide
caccacatccgtgtcccggccc

SEQ ID NO: 8724 - DNA, 22 bp, Artificial Sequence
  Description of Artificial Sequence: Synthetic oligonucleotide
accacatccgtgtcccggcccg

SEQ ID NO: 8725 - DNA, 32 bp, Artificial Sequence
  Description of Artificial Sequence: Synthetic oligonucleotide
tccatgaggtatttctacacctccgtgtcctg

SEQ ID NO: 8726 - DNA, 31 bp, Artificial Sequence
  Description of Artificial Sequence: Synthetic oligonucleotide
ccatgaggtatttctacacctccgtgtcctg

SEQ ID NO: 8727 - DNA, 31 bp, Artificial Sequence
  Description of Artificial Sequence: Synthetic oligonucleotide
catgaggtatttctacacctccgtgtcctgg

SEQ ID NO: 8728 - DNA, 31 bp, Artificial Sequence
  Description of Artificial Sequence: Synthetic oligonucleotide
atgaggtatttctacacctccgtgtcctggc

SEQ ID NO: 8729 - DNA, 30 bp, Artificial Sequence
  Description of Artificial Sequence: Synthetic oligonucleotide
tgaggtatttctacacctccgtgtcctggc

SEQ ID NO: 8730 - DNA, 29 bp, Artificial Sequence
  Description of Artificial Sequence: Synthetic oligonucleotide
gaggtatttctacacctccgtgtcctggc

SEQ ID NO: 8731 - DNA, 29 bp, Artificial Sequence
  Description of Artificial Sequence: Synthetic oligonucleotide
aggtatttctacacctccgtgtcctggcc

SEQ ID NO: 8732 - DNA, 28 bp, Artificial Sequence
  Description of Artificial Sequence: Synthetic oligonucleotide
ggtatttctacacctccgtgtcctggcc

SEQ ID NO: 8733 - DNA, 28 bp, Artificial Sequence
  Description of Artificial Sequence: Synthetic oligonucleotide
gtatttctacacctccgtgtcctggccc

SEQ ID NO: 8734 - DNA, 28 bp, Artificial Sequence
  Description of Artificial Sequence: Synthetic oligonucleotide
tatttctacacctccgtgtcctggcccg

SEQ ID NO: 8735 - DNA, 27 bp, Artificial Sequence
  Description of Artificial Sequence: Synthetic oligonucleotide
atttctacacctccgtgtcctggcccg

SEQ ID NO: 8736 - DNA, 26 bp, Artificial Sequence
  Description of Artificial Sequence: Synthetic oligonucleotide
tttctacacctccgtgtcctggcccg

SEQ ID NO: 8737 - DNA, 25 bp, Artificial Sequence
  Description of Artificial Sequence: Synthetic oligonucleotide
ttctacacctccgtgtcctggcccg

SEQ ID NO: 8738 - DNA, 24 bp, Artificial Sequence
  Description of Artificial Sequence: Synthetic oligonucleotide
tctacacctccgtgtcctggcccg

SEQ ID NO: 8739 - DNA, 23 bp, Artificial Sequence
  Description of Artificial Sequence: Synthetic oligonucleotide
ctacacctccgtgtcctggcccg

SEQ ID NO: 8740 - DNA, 23 bp, Artificial Sequence
  Description of Artificial Sequence: Synthetic oligonucleotide
tacacctccgtgtcctggcccgg

SEQ ID NO: 8741 - DNA, 22 bp, Artificial Sequence
  Description of Artificial Sequence: Synthetic oligonucleotide
acacctccgtgtcctggcccgg

SEQ ID NO: 8742 - DNA, 21 bp, Artificial Sequence
  Description of Artificial Sequence: Synthetic oligonucleotide
cacctccgtgtcctggcccgg

SEQ ID NO: 8743 - DNA, 21 bp, Artificial Sequence
  Description of Artificial Sequence: Synthetic oligonucleotide
acctccgtgtcctggcccggc

SEQ ID NO: 8744 - DNA, 20 bp, Artificial Sequence
  Description of Artificial Sequence: Synthetic oligonucleotide
cctccgtgtcctggcccggc

SEQ ID NO: 8745 - DNA, 20 bp, Artificial Sequence
  Description of Artificial Sequence: Synthetic oligonucleotide
ctccgtgtcctggcccggcc

SEQ ID NO: 8746 - DNA, 22 bp, Artificial Sequence
  Description of Artificial Sequence: Synthetic oligonucleotide
tggcgcttcctccgcgggtacc

SEQ ID NO: 8747 - DNA, 25 bp, Artificial Sequence
  Description of Artificial Sequence: Synthetic oligonucleotide
tcttggaccgcggcggacatggcat

SEQ ID NO: 8748 - DNA, 24 bp, Artificial Sequence
  Description of Artificial Sequence: Synthetic oligonucleotide
cttggaccgcggcggacatggcat

SEQ ID NO: 8749 - DNA, 25 bp, Artificial Sequence
  Description of Artificial Sequence: Synthetic oligonucleotide
ttggaccgcggcggacatggcatct

SEQ ID NO: 8750 - DNA, 24 bp, Artificial Sequence
  Description of Artificial Sequence: Synthetic oligonucleotide
tggaccgcggcggacatggcatct

SEQ ID NO: 8751 - DNA, 23 bp, Artificial Sequence
  Description of Artificial Sequence: Synthetic oligonucleotide
ggaccgcggcggacatggcatct

SEQ ID NO: 8752 - DNA, 24 bp, Artificial Sequence
  Description of Artificial Sequence: Synthetic oligonucleotide
gaccgcggcggacatggcatctca

SEQ ID NO: 8753 - DNA, 25 bp, Artificial Sequence
  Description of Artificial Sequence: Synthetic oligonucleotide
accgcggcggacatggcatctcaga

SEQ ID NO: 8754 - DNA, 24 bp, Artificial Sequence
  Description of Artificial Sequence: Synthetic oligonucleotide
ccgcggcggacatggcatctcaga

SEQ ID NO: 8755 - DNA, 24 bp, Artificial Sequence
  Description of Artificial Sequence: Synthetic oligonucleotide
cgcggcggacatggcatctcagac

SEQ ID NO: 8756 - DNA, 25 bp, Artificial Sequence
  Description of Artificial Sequence: Synthetic oligonucleotide
gcggcggacatggcatctcagacca

SEQ ID NO: 8757 - DNA, 25 bp, Artificial Sequence
  Description of Artificial Sequence: Synthetic oligonucleotide
cggcggacatggcatctcagaccac

SEQ ID NO: 8758 - DNA, 27 bp, Artificial Sequence
  Description of Artificial Sequence: Synthetic oligonucleotide
ggcggacatggcatctcagaccaccaa

SEQ ID NO: 8759 - DNA, 27 bp, Artificial Sequence
  Description of Artificial Sequence: Synthetic oligonucleotide
gcggacatggcatctcagaccaccaag

SEQ ID NO: 8760 - DNA, 27 bp, Artificial Sequence
  Description of Artificial Sequence: Synthetic oligonucleotide
cggacatggcatctcagaccaccaagc

SEQ ID NO: 8761 - DNA, 28 bp, Artificial Sequence
  Description of Artificial Sequence: Synthetic oligonucleotide
ggacatggcatctcagaccaccaagcac

SEQ ID NO: 8762 - DNA, 30 bp, Artificial Sequence
  Description of Artificial Sequence: Synthetic oligonucleotide
gacatggcatctcagaccaccaagcacaag

SEQ ID NO: 8763 - DNA, 31 bp, Artificial Sequence
  Description of Artificial Sequence: Synthetic oligonucleotide
acatggcatctcagaccaccaagcacaagtg

SEQ ID NO: 8764 - DNA, 30 bp, Artificial Sequence
  Description of Artificial Sequence: Synthetic oligonucleotide
catggcatctcagaccaccaagcacaagtg

SEQ ID NO: 8765 - DNA, 30 bp, Artificial Sequence
  Description of Artificial Sequence: Synthetic oligonucleotide
atggcatctcagaccaccaagcacaagtgg

SEQ ID NO: 8766 - DNA, 29 bp, Artificial Sequence
  Description of Artificial Sequence: Synthetic oligonucleotide
tggcatctcagaccaccaagcacaagtgg

SEQ ID NO: 8767 - DNA, 28 bp, Artificial Sequence
  Description of Artificial Sequence: Synthetic oligonucleotide
ggcatctcagaccaccaagcacaagtgg

SEQ ID NO: 8768 - DNA, 28 bp, Artificial Sequence
  Description of Artificial Sequence: Synthetic oligonucleotide
gcatctcagaccaccaagcacaagtggg

SEQ ID NO: 8769 - DNA, 29 bp, Artificial Sequence
  Description of Artificial Sequence: Synthetic oligonucleotide
catctcagaccaccaagcacaagtgggag

SEQ ID NO: 8770 - DNA, 29 bp, Artificial Sequence
  Description of Artificial Sequence: Synthetic oligonucleotide
atctcagaccaccaagcacaagtgggagg

SEQ ID NO: 8771 - DNA, 28 bp, Artificial Sequence
  Description of Artificial Sequence: Synthetic oligonucleotide
tctcagaccaccaagcacaagtgggagg

SEQ ID NO: 8772 - DNA, 26 bp, Artificial Sequence
  Description of Artificial Sequence: Synthetic oligonucleotide
caggagggtccggagtattgggacgt

SEQ ID NO: 8773 - DNA, 26 bp, Artificial Sequence
  Description of Artificial Sequence: Synthetic oligonucleotide
aggagggtccggagtattgggacgtg

SEQ ID NO: 8774 - DNA, 25 bp, Artificial Sequence
  Description of Artificial Sequence: Synthetic oligonucleotide
ggagggtccggagtattgggacgtg

SEQ ID NO: 8775 - DNA, 26 bp, Artificial Sequence
  Description of Artificial Sequence: Synthetic oligonucleotide
gagggtccggagtattgggacgtgga

SEQ ID NO: 8776 - DNA, 27 bp, Artificial Sequence
  Description of Artificial Sequence: Synthetic oligonucleotide
agggtccggagtattgggacgtggaga

SEQ ID NO: 8777 - DNA, 26 bp, Artificial Sequence
  Description of Artificial Sequence: Synthetic oligonucleotide
gggtccggagtattgggacgtggaga

SEQ ID NO: 8778 - DNA, 27 bp, Artificial Sequence
  Description of Artificial Sequence: Synthetic oligonucleotide
ggtccggagtattgggacgtggagaca

SEQ ID NO: 8779 - DNA, 27 bp, Artificial Sequence
  Description of Artificial Sequence: Synthetic oligonucleotide
gtccggagtattgggacgtggagacac

SEQ ID NO: 8780 - DNA, 27 bp, Artificial Sequence
  Description of Artificial Sequence: Synthetic oligonucleotide
tccggagtattgggacgtggagacacg

SEQ ID NO: 8781 - DNA, 26 bp, Artificial Sequence
  Description of Artificial Sequence: Synthetic oligonucleotide
ccggagtattgggacgtggagacacg

SEQ ID NO: 8782 - DNA, 27 bp, Artificial Sequence
  Description of Artificial Sequence: Synthetic oligonucleotide
cggagtattgggacgtggagacacgga

SEQ ID NO: 8783 - DNA, 29 bp, Artificial Sequence
  Description of Artificial Sequence: Synthetic oligonucleotide
ggagtattgggacgtggagacacggaaag

SEQ ID NO: 8784 - DNA, 30 bp, Artificial Sequence
  Description of Artificial Sequence: Synthetic oligonucleotide
gagtattgggacgtggagacacggaaagtg

SEQ ID NO: 8785 - DNA, 32 bp, Artificial Sequence
  Description of Artificial Sequence: Synthetic oligonucleotide
agtattgggacgtggagacacggaaagtgaag

SEQ ID NO: 8786 - DNA, 31 bp, Artificial Sequence
  Description of Artificial Sequence: Synthetic oligonucleotide
gtattgggacgtggagacacggaaagtgaag

SEQ ID NO: 8787 - DNA, 31 bp, Artificial Sequence
  Description of Artificial Sequence: Synthetic oligonucleotide
tattgggacgtggagacacggaaagtgaagg

SEQ ID NO: 8788 - DNA, 30 bp, Artificial Sequence
  Description of Artificial Sequence: Synthetic oligonucleotide
attgggacgtggagacacggaaagtgaagg

SEQ ID NO: 8789 - DNA, 29 bp, Artificial Sequence
  Description of Artificial Sequence: Synthetic oligonucleotide
ttgggacgtggagacacggaaagtgaagg

SEQ ID NO: 8790 - DNA, 28 bp, Artificial Sequence
  Description of Artificial Sequence: Synthetic oligonucleotide
tgggacgtggagacacggaaagtgaagg

SEQ ID NO: 8791 - DNA, 27 bp, Artificial Sequence
  Description of Artificial Sequence: Synthetic oligonucleotide
gggacgtggagacacggaaagtgaagg

SEQ ID NO: 8792 - DNA, 27 bp, Artificial Sequence
  Description of Artificial Sequence: Synthetic oligonucleotide
ggacgtggagacacggaaagtgaaggc

SEQ ID NO: 8793 - DNA, 27 bp, Artificial Sequence
  Description of Artificial Sequence: Synthetic oligonucleotide
gacgtggagacacggaaagtgaaggcc

SEQ ID NO: 8794 - DNA, 27 bp, Artificial Sequence
  Description of Artificial Sequence: Synthetic oligonucleotide
acgtggagacacggaaagtgaaggccc

SEQ ID NO: 8795 - DNA, 27 bp, Artificial Sequence
  Description of Artificial Sequence: Synthetic oligonucleotide
cgtggagacacggaaagtgaaggccca

SEQ ID NO: 8796 - DNA, 27 bp, Artificial Sequence
  Description of Artificial Sequence: Synthetic oligonucleotide
gtggagacacggaaagtgaaggcccac

SEQ ID NO: 8797 - DNA, 28 bp, Artificial Sequence
  Description of Artificial Sequence: Synthetic oligonucleotide
tggagacacggaaagtgaaggcccactc

SEQ ID NO: 8798 - DNA, 25 bp, Artificial Sequence
  Description of Artificial Sequence: Synthetic oligonucleotide
caagcccctcaccctgagatgggct

SEQ ID NO: 8799 - DNA, 26 bp, Artificial Sequence
  Description of Artificial Sequence: Synthetic oligonucleotide
aagcccctcaccctgagatgggctgt

SEQ ID NO: 8800 - DNA, 25 bp, Artificial Sequence
  Description of Artificial Sequence: Synthetic oligonucleotide
agcccctcaccctgagatgggctgt

SEQ ID NO: 8801 - DNA, 24 bp, Artificial Sequence
  Description of Artificial Sequence: Synthetic oligonucleotide
gcccctcaccctgagatgggctgt

SEQ ID NO: 8802 - DNA, 26 bp, Artificial Sequence
  Description of Artificial Sequence: Synthetic oligonucleotide
cccctcaccctgagatgggctgtgat

SEQ ID NO: 8803 - DNA, 27 bp, Artificial Sequence
  Description of Artificial Sequence: Synthetic oligonucleotide
ccctcaccctgagatgggctgtgatgt

SEQ ID NO: 8804 - DNA, 27 bp, Artificial Sequence
  Description of Artificial Sequence: Synthetic oligonucleotide
cctcaccctgagatgggctgtgatgtg

SEQ ID NO: 8805 - DNA, 27 bp, Artificial Sequence
  Description of Artificial Sequence: Synthetic oligonucleotide
ctcaccctgagatgggctgtgatgtgg

SEQ ID NO: 8806 - DNA, 28 bp, Artificial Sequence
  Description of Artificial Sequence: Synthetic oligonucleotide
tcaccctgagatgggctgtgatgtggag

SEQ ID NO: 8807 - DNA, 27 bp, Artificial Sequence
  Description of Artificial Sequence: Synthetic oligonucleotide
caccctgagatgggctgtgatgtggag

SEQ ID NO: 8808 - DNA, 27 bp, Artificial Sequence
  Description of Artificial Sequence: Synthetic oligonucleotide
accctgagatgggctgtgatgtggagg

SEQ ID NO: 8809 - DNA, 27 bp, Artificial Sequence
  Description of Artificial Sequence: Synthetic oligonucleotide
ccctgagatgggctgtgatgtggagga

SEQ ID NO: 8810 - DNA, 27 bp, Artificial Sequence
  Description of Artificial Sequence: Synthetic oligonucleotide
cctgagatgggctgtgatgtggaggag

SEQ ID NO: 8811 - DNA, 27 bp, Artificial Sequence
  Description of Artificial Sequence: Synthetic oligonucleotide
ctgagatgggctgtgatgtggaggagg

SEQ ID NO: 8812 - DNA, 29 bp, Artificial Sequence
  Description of Artificial Sequence: Synthetic oligonucleotide
tgagatgggctgtgatgtggaggaggaag

SEQ ID NO: 8813 - DNA, 28 bp, Artificial Sequence
  Description of Artificial Sequence: Synthetic oligonucleotide
gagatgggctgtgatgtggaggaggaag

SEQ ID NO: 8814 - DNA, 29 bp, Artificial Sequence
  Description of Artificial Sequence: Synthetic oligonucleotide
agatgggctgtgatgtggaggaggaagag

SEQ ID NO: 8815 - DNA, 28 bp, Artificial Sequence
  Description of Artificial Sequence: Synthetic oligonucleotide
gatgggctgtgatgtggaggaggaagag

SEQ ID NO: 8816 - DNA, 28 bp, Artificial Sequence
  Description of Artificial Sequence: Synthetic oligonucleotide
atgggctgtgatgtggaggaggaagagc

SEQ ID NO: 8817 - DNA, 27 bp, Artificial Sequence
  Description of Artificial Sequence: Synthetic oligonucleotide
tgggctgtgatgtggaggaggaagagc

SEQ ID NO: 8818 - DNA, 27 bp, Artificial Sequence
  Description of Artificial Sequence: Synthetic oligonucleotide
gggctgtgatgtggaggaggaagagct

SEQ ID NO: 8819 - DNA, 27 bp, Artificial Sequence
  Description of Artificial Sequence: Synthetic oligonucleotide
ggctgtgatgtggaggaggaagagctc

SEQ ID NO: 8820 - DNA, 27 bp, Artificial Sequence
  Description of Artificial Sequence: Synthetic oligonucleotide
caagcacaagtgggagacggcccatgt

SEQ ID NO: 8821 - DNA, 27 bp, Artificial Sequence
  Description of Artificial Sequence: Synthetic oligonucleotide
aagcacaagtgggagacggcccatgtg

SEQ ID NO: 8822 - DNA, 26 bp, Artificial Sequence
  Description of Artificial Sequence: Synthetic oligonucleotide
agcacaagtgggagacggcccatgtg

SEQ ID NO: 8823 - DNA, 25 bp, Artificial Sequence
  Description of Artificial Sequence: Synthetic oligonucleotide
gcacaagtgggagacggcccatgtg

SEQ ID NO: 8824 - DNA, 25 bp, Artificial Sequence
  Description of Artificial Sequence: Synthetic oligonucleotide
cacaagtgggagacggcccatgtgg

SEQ ID NO: 8825 - DNA, 25 bp, Artificial Sequence
  Description of Artificial Sequence: Synthetic oligonucleotide
acaagtgggagacggcccatgtggc

SEQ ID NO: 8826 - DNA, 24 bp, Artificial Sequence
  Description of Artificial Sequence: Synthetic oligonucleotide
caagtgggagacggcccatgtggc

SEQ ID NO: 8827 - DNA, 24 bp, Artificial Sequence
  Description of Artificial Sequence: Synthetic oligonucleotide
aagtgggagacggcccatgtggcg

SEQ ID NO: 8828 - DNA, 23 bp, Artificial Sequence
  Description of Artificial Sequence: Synthetic oligonucleotide
agtgggagacggcccatgtggcg

SEQ ID NO: 8829 - DNA, 22 bp, Artificial Sequence
  Description of Artificial Sequence: Synthetic oligonucleotide
gtgggagacggcccatgtggcg

SEQ ID NO: 8830 - DNA, 23 bp, Artificial Sequence
  Description of Artificial Sequence: Synthetic oligonucleotide
tgggagacggcccatgtggcgga

SEQ ID NO: 8831 - DNA, 22 bp, Artificial Sequence
  Description of Artificial Sequence: Synthetic oligonucleotide
gggagacggcccatgtggcgga

SEQ ID NO: 8832 - DNA, 22 bp, Artificial Sequence
  Description of Artificial Sequence: Synthetic oligonucleotide
ggagacggcccatgtggcggag

SEQ ID NO: 8833 - DNA, 23 bp, Artificial Sequence
  Description of Artificial Sequence: Synthetic oligonucleotide
gagacggcccatgtggcggagca

SEQ ID NO: 8834 - DNA, 25 bp, Artificial Sequence
  Description of Artificial Sequence: Synthetic oligonucleotide
agacggcccatgtggcggagcagtt

SEQ ID NO: 8835 - DNA, 24 bp, Artificial Sequence
  Description of Artificial Sequence: Synthetic oligonucleotide
gacggcccatgtggcggagcagtt

SEQ ID NO: 8836 - DNA, 25 bp, Artificial Sequence
  Description of Artificial Sequence: Synthetic oligonucleotide
acggcccatgtggcggagcagttga

SEQ ID NO: 8837 - DNA, 28 bp, Artificial Sequence
  Description of Artificial Sequence: Synthetic oligonucleotide
gagacacggaaagtgaaggcccactcag

SEQ ID NO: 8838 - DNA, 29 bp, Artificial Sequence
  Description of Artificial Sequence: Synthetic oligonucleotide
agacacggaaagtgaaggcccactcagac

SEQ ID NO: 8839 - DNA, 28 bp, Artificial Sequence
  Description of Artificial Sequence: Synthetic oligonucleotide
gacacggaaagtgaaggcccactcagac

SEQ ID NO: 8840 - DNA, 29 bp, Artificial Sequence
  Description of Artificial Sequence: Synthetic oligonucleotide
acacggaaagtgaaggcccactcagactc

SEQ ID NO: 8841 - DNA, 28 bp, Artificial Sequence
  Description of Artificial Sequence: Synthetic oligonucleotide
cacggaaagtgaaggcccactcagactc

SEQ ID NO: 8842 - DNA, 29 bp, Artificial Sequence
  Description of Artificial Sequence: Synthetic oligonucleotide
acggaaagtgaaggcccactcagactcac

SEQ ID NO: 8843 - DNA, 28 bp, Artificial Sequence
  Description of Artificial Sequence: Synthetic oligonucleotide
cggaaagtgaaggcccactcagactcac

SEQ ID NO: 8844 - DNA, 28 bp, Artificial Sequence
  Description of Artificial Sequence: Synthetic oligonucleotide
ggaaagtgaaggcccactcagactcacc

SEQ ID NO: 8845 - DNA, 28 bp, Artificial Sequence
  Description of Artificial Sequence: Synthetic oligonucleotide
gaaagtgaaggcccactcagactcaccg

SEQ ID NO: 8846 - DNA, 29 bp, Artificial Sequence
  Description of Artificial Sequence: Synthetic oligonucleotide
aaagtgaaggcccactcagactcaccgag

SEQ ID NO: 8847 - DNA, 28 bp, Artificial Sequence
  Description of Artificial Sequence: Synthetic oligonucleotide
aagtgaaggcccactcagactcaccgag

SEQ ID NO: 8848 - DNA, 27 bp, Artificial Sequence
  Description of Artificial Sequence: Synthetic oligonucleotide
agtgaaggcccactcagactcaccgag

SEQ ID NO: 8849 - DNA, 27 bp, Artificial Sequence
  Description of Artificial Sequence: Synthetic oligonucleotide
gtgaaggcccactcagactcaccgagt

SEQ ID NO: 8850 - DNA, 27 bp, Artificial Sequence
  Description of Artificial Sequence: Synthetic oligonucleotide
tgaaggcccactcagactcaccgagtg

SEQ ID NO: 8851 - DNA, 26 bp, Artificial Sequence
  Description of Artificial Sequence: Synthetic oligonucleotide
gaaggcccactcagactcaccgagtg

SEQ ID NO: 8852 - DNA, 27 bp, Artificial Sequence
  Description of Artificial Sequence: Synthetic oligonucleotide
aaggcccactcagactcaccgagtgga

SEQ ID NO: 8853 - DNA, 26 bp, Artificial Sequence
  Description of Artificial Sequence: Synthetic oligonucleotide
aggcccactcagactcaccgagtgga

SEQ ID NO: 8854 - DNA, 25 bp, Artificial Sequence
  Description of Artificial Sequence: Synthetic oligonucleotide
ggcccactcagactcaccgagtgga

SEQ ID NO: 8855 - DNA, 25 bp, Artificial Sequence
  Description of Artificial Sequence: Synthetic oligonucleotide
gcccactcagactcaccgagtggac

SEQ ID NO: 8856 - DNA, 26 bp, Artificial Sequence
  Description of Artificial Sequence: Synthetic oligonucleotide
cccactcagactcaccgagtggacct

SEQ ID NO: 8857 - DNA, 26 bp, Artificial Sequence
  Description of Artificial Sequence: Synthetic oligonucleotide
ccactcagactcaccgagtggacctg

SEQ ID NO: 8858 - DNA, 26 bp, Artificial Sequence
  Description of Artificial Sequence: Synthetic oligonucleotide
cactcagactcaccgagtggacctgg

SEQ ID NO: 8859 - DNA, 26 bp, Artificial Sequence
  Description of Artificial Sequence: Synthetic oligonucleotide
actcagactcaccgagtggacctggg

SEQ ID NO: 8860 - DNA, 25 bp, Artificial Sequence
  Description of Artificial Sequence: Synthetic oligonucleotide
ctcagactcaccgagtggacctggg

SEQ ID NO: 8861 - DNA, 26 bp, Artificial Sequence
  Description of Artificial Sequence: Synthetic oligonucleotide
tcagactcaccgagtggacctgggga

SEQ ID NO: 8862 - DNA, 30 bp, Artificial Sequence
  Description of Artificial Sequence: Synthetic oligonucleotide
gacggcaaggattacatcgccctgaaagac

SEQ ID NO: 8863 - DNA, 30 bp, Artificial Sequence
  Description of Artificial Sequence: Synthetic oligonucleotide
acggcaaggattacatcgccctgaaagacg

SEQ ID NO: 8864 - DNA, 29 bp, Artificial Sequence
  Description of Artificial Sequence: Synthetic oligonucleotide
cggcaaggattacatcgccctgaaagacg

SEQ ID NO: 8865 - DNA, 30 bp, Artificial Sequence
  Description of Artificial Sequence: Synthetic oligonucleotide
ggcaaggattacatcgccctgaaagacgac

SEQ ID NO: 8866 - DNA, 30 bp, Artificial Sequence
  Description of Artificial Sequence: Synthetic oligonucleotide
gcaaggattacatcgccctgaaagacgacc

SEQ ID NO: 8867 - DNA, 31 bp, Artificial Sequence
  Description of Artificial Sequence: Synthetic oligonucleotide
caaggattacatcgccctgaaagacgacctg

SEQ ID NO: 8868 - DNA, 31 bp, Artificial Sequence
  Description of Artificial Sequence: Synthetic oligonucleotide
aaggattacatcgccctgaaagacgacctgc

SEQ ID NO: 8869 - DNA, 30 bp, Artificial Sequence
  Description of Artificial Sequence: Synthetic oligonucleotide
aggattacatcgccctgaaagacgacctgc

SEQ ID NO: 8870 - DNA, 29 bp, Artificial Sequence
  Description of Artificial Sequence: Synthetic oligonucleotide
ggattacatcgccctgaaagacgacctgc

SEQ ID NO: 8871 - DNA, 29 bp, Artificial Sequence
  Description of Artificial Sequence: Synthetic oligonucleotide
gattacatcgccctgaaagacgacctgcg

SEQ ID NO: 8872 - DNA, 29 bp, Artificial Sequence
  Description of Artificial Sequence: Synthetic oligonucleotide
attacatcgccctgaaagacgacctgcgc

SEQ ID NO: 8873 - DNA, 28 bp, Artificial Sequence
  Description of Artificial Sequence: Synthetic oligonucleotide
ttacatcgccctgaaagacgacctgcgc

SEQ ID NO: 8874 - DNA, 27 bp, Artificial Sequence
  Description of Artificial Sequence: Synthetic oligonucleotide
tacatcgccctgaaagacgacctgcgc

SEQ ID NO: 8875 - DNA, 27 bp, Artificial Sequence
  Description of Artificial Sequence: Synthetic oligonucleotide
acatcgccctgaaagacgacctgcgct

SEQ ID NO: 8876 - DNA, 26 bp, Artificial Sequence
  Description of Artificial Sequence: Synthetic oligonucleotide
catcgccctgaaagacgacctgcgct

SEQ ID NO: 8877 - DNA, 27 bp, Artificial Sequence
  Description of Artificial Sequence: Synthetic oligonucleotide
atcgccctgaaagacgacctgcgctct

SEQ ID NO: 8878 - DNA, 27 bp, Artificial Sequence
  Description of Artificial Sequence: Synthetic oligonucleotide
tcgccctgaaagacgacctgcgctctt

SEQ ID NO: 8879 - DNA, 26 bp, Artificial Sequence
  Description of Artificial Sequence: Synthetic oligonucleotide
cgccctgaaagacgacctgcgctctt

SEQ ID NO: 8880 - DNA, 26 bp, Artificial Sequence
  Description of Artificial Sequence: Synthetic oligonucleotide
gccctgaaagacgacctgcgctcttg

SEQ ID NO: 8881 - DNA, 27 bp, Artificial Sequence
  Description of Artificial Sequence: Synthetic oligonucleotide
ccctgaaagacgacctgcgctcttgga

SEQ ID NO: 8882 - DNA, 27 bp, Artificial Sequence
  Description of Artificial Sequence: Synthetic oligonucleotide
cctgaaagacgacctgcgctcttggac

SEQ ID NO: 8883 - DNA, 27 bp, Artificial Sequence
  Description of Artificial Sequence: Synthetic oligonucleotide
ctgaaagacgacctgcgctcttggacc

SEQ ID NO: 8884 - DNA, 27 bp, Artificial Sequence
  Description of Artificial Sequence: Synthetic oligonucleotide
tgaaagacgacctgcgctcttggaccg

SEQ ID NO: 8885 - DNA, 26 bp, Artificial Sequence
  Description of Artificial Sequence: Synthetic oligonucleotide
gaaagacgacctgcgctcttggaccg

SEQ ID NO: 8886 - DNA, 26 bp, Artificial Sequence
  Description of Artificial Sequence: Synthetic oligonucleotide
aaagacgacctgcgctcttggaccgc

SEQ ID NO: 8887 - DNA, 25 bp, Artificial Sequence
  Description of Artificial Sequence: Synthetic oligonucleotide
aagacgacctgcgctcttggaccgc

SEQ ID NO: 8888 - DNA, 24 bp, Artificial Sequence
  Description of Artificial Sequence: Synthetic oligonucleotide
agacgacctgcgctcttggaccgc

SEQ ID NO: 8889 - DNA, 23 bp, Artificial Sequence
  Description of Artificial Sequence: Synthetic oligonucleotide
gacgacctgcgctcttggaccgc

SEQ ID NO: 8890 - DNA, 23 bp, Artificial Sequence
  Description of Artificial Sequence: Synthetic oligonucleotide
acgacctgcgctcttggaccgcg

SEQ ID NO: 8891 - DNA, 22 bp, Artificial Sequence
  Description of Artificial Sequence: Synthetic oligonucleotide
cgacctgcgctcttggaccgcg

SEQ ID NO: 8892 - DNA, 24 bp, Artificial Sequence
  Description of Artificial Sequence: Synthetic oligonucleotide
gccctgagcttctaccctgcggag

SEQ ID NO: 8893 - DNA, 25 bp, Artificial Sequence
  Description of Artificial Sequence: Synthetic oligonucleotide
ccctgagcttctaccctgcggaggt

SEQ ID NO: 8894 - DNA, 26 bp, Artificial Sequence
  Description of Artificial Sequence: Synthetic oligonucleotide
cctgagcttctaccctgcggaggtca

SEQ ID NO: 8895 - DNA, 27 bp, Artificial Sequence
  Description of Artificial Sequence: Synthetic oligonucleotide
ctgagcttctaccctgcggaggtcaca

SEQ ID NO: 8896 - DNA, 27 bp, Artificial Sequence
  Description of Artificial Sequence: Synthetic oligonucleotide
tgagcttctaccctgcggaggtcacac

SEQ ID NO: 8897 - DNA, 27 bp, Artificial Sequence
  Description of Artificial Sequence: Synthetic oligonucleotide
gagcttctaccctgcggaggtcacact

SEQ ID NO: 8898 - DNA, 27 bp, Artificial Sequence
  Description of Artificial Sequence: Synthetic oligonucleotide
agcttctaccctgcggaggtcacactg

SEQ ID NO: 8899 - DNA, 27 bp, Artificial Sequence
  Description of Artificial Sequence: Synthetic oligonucleotide
gcttctaccctgcggaggtcacactga

SEQ ID NO: 8900 - DNA, 27 bp, Artificial Sequence
  Description of Artificial Sequence: Synthetic oligonucleotide
cttctaccctgcggaggtcacactgac

SEQ ID NO: 8901 - DNA, 27 bp, Artificial Sequence
  Description of Artificial Sequence: Synthetic oligonucleotide
ttctaccctgcggaggtcacactgacc

SEQ ID NO: 8902 - DNA, 27 bp, Artificial Sequence
  Description of Artificial Sequence: Synthetic oligonucleotide
tctaccctgcggaggtcacactgacct

SEQ ID NO: 8903 - DNA, 26 bp, Artificial Sequence
  Description of Artificial Sequence: Synthetic oligonucleotide
ctaccctgcggaggtcacactgacct

SEQ ID NO: 8904 - DNA, 26 bp, Artificial Sequence
  Description of Artificial Sequence: Synthetic oligonucleotide
taccctgcggaggtcacactgacctg

SEQ ID NO: 8905 - DNA, 25 bp, Artificial Sequence
  Description of Artificial Sequence: Synthetic oligonucleotide
accctgcggaggtcacactgacctg

SEQ ID NO: 8906 - DNA, 24 bp, Artificial Sequence
  Description of Artificial Sequence: Synthetic oligonucleotide
ccctgcggaggtcacactgacctg

SEQ ID NO: 8907 - DNA, 24 bp, Artificial Sequence
  Description of Artificial Sequence: Synthetic oligonucleotide
cctgcggaggtcacactgacctgg

SEQ ID NO: 8908 - DNA, 25 bp, Artificial Sequence
  Description of Artificial Sequence: Synthetic oligonucleotide
ctgcggaggtcacactgacctggca

SEQ ID NO: 8909 - DNA, 25 bp, Artificial Sequence
  Description of Artificial Sequence: Synthetic oligonucleotide
tgcggaggtcacactgacctggcag

SEQ ID NO: 8910 - DNA, 24 bp, Artificial Sequence
  Description of Artificial Sequence: Synthetic oligonucleotide
gcggaggtcacactgacctggcag

SEQ ID NO: 8911 - DNA, 24 bp, Artificial Sequence
  Description of Artificial Sequence: Synthetic oligonucleotide
cggaggtcacactgacctggcagc

SEQ ID NO: 8912 - DNA, 24 bp, Artificial Sequence
  Description of Artificial Sequence: Synthetic oligonucleotide
ggaggtcacactgacctggcagcg

SEQ ID NO: 8913 - DNA, 24 bp, Artificial Sequence
  Description of Artificial Sequence: Synthetic oligonucleotide
gaggtcacactgacctggcagcgg

SEQ ID NO: 8914 - DNA, 26 bp, Artificial Sequence
  Description of Artificial Sequence: Synthetic oligonucleotide
aggtcacactgacctggcagcgggat

SEQ ID NO: 8915 - DNA, 25 bp, Artificial Sequence
  Description of Artificial Sequence: Synthetic oligonucleotide
ggtcacactgacctggcagcgggat

SEQ ID NO: 8916 - DNA, 25 bp, Artificial Sequence
  Description of Artificial Sequence: Synthetic oligonucleotide
gtcacactgacctggcagcgggatg

SEQ ID NO: 8917 - DNA, 26 bp, Artificial Sequence
  Description of Artificial Sequence: Synthetic oligonucleotide
gtggtgccttctggacaggagcagag

SEQ ID NO: 8918 - DNA, 27 bp, Artificial Sequence
  Description of Artificial Sequence: Synthetic oligonucleotide
tggtgccttctggacaggagcagagct

SEQ ID NO: 8919 - DNA, 27 bp, Artificial Sequence
  Description of Artificial Sequence: Synthetic oligonucleotide
ggtgccttctggacaggagcagagcta

SEQ ID NO: 8920 - DNA, 27 bp, Artificial Sequence
  Description of Artificial Sequence: Synthetic oligonucleotide
gtgccttctggacaggagcagagctac

SEQ ID NO: 8921 - DNA, 28 bp, Artificial Sequence
  Description of Artificial Sequence: Synthetic oligonucleotide
tgccttctggacaggagcagagctacac

SEQ ID NO: 8922 - DNA, 27 bp, Artificial Sequence
  Description of Artificial Sequence: Synthetic oligonucleotide
gccttctggacaggagcagagctacac

SEQ ID NO: 8923 - DNA, 27 bp, Artificial Sequence
  Description of Artificial Sequence: Synthetic oligonucleotide
ccttctggacaggagcagagctacacc

SEQ ID NO: 8924 - DNA, 28 bp, Artificial Sequence
  Description of Artificial Sequence: Synthetic oligonucleotide
cttctggacaggagcagagctacacctg

SEQ ID NO: 8925 - DNA, 28 bp, Artificial Sequence
  Description of Artificial Sequence: Synthetic oligonucleotide
ttctggacaggagcagagctacacctgc

SEQ ID NO: 8926 - DNA, 27 bp, Artificial Sequence
  Description of Artificial Sequence: Synthetic oligonucleotide
tctggacaggagcagagctacacctgc

SEQ ID NO: 8927 - DNA, 26 bp, Artificial Sequence
  Description of Artificial Sequence: Synthetic oligonucleotide
ctggacaggagcagagctacacctgc

SEQ ID NO: 8928 - DNA, 27 bp, Artificial Sequence
  Description of Artificial Sequence: Synthetic oligonucleotide
tggacaggagcagagctacacctgcca

SEQ ID NO: 8929 - DNA, 27 bp, Artificial Sequence
  Description of Artificial Sequence: Synthetic oligonucleotide
ggacaggagcagagctacacctgccat

SEQ ID NO: 8930 - DNA, 27 bp, Artificial Sequence
  Description of Artificial Sequence: Synthetic oligonucleotide
gacaggagcagagctacacctgccatg

SEQ ID NO: 8931 - DNA, 28 bp, Artificial Sequence
  Description of Artificial Sequence: Synthetic oligonucleotide
acaggagcagagctacacctgccatgtg

SEQ ID NO: 8932 - DNA, 27 bp, Artificial Sequence
  Description of Artificial Sequence: Synthetic oligonucleotide
caggagcagagctacacctgccatgtg

SEQ ID NO: 8933 - DNA, 27 bp, Artificial Sequence
  Description of Artificial Sequence: Synthetic oligonucleotide
aggagcagagctacacctgccatgtgc

SEQ ID NO: 8934 - DNA, 27 bp, Artificial Sequence
  Description of Artificial Sequence: Synthetic oligonucleotide
ggagcagagctacacctgccatgtgca

SEQ ID NO: 8935 - DNA, 27 bp, Artificial Sequence
  Description of Artificial Sequence: Synthetic oligonucleotide
gagcagagctacacctgccatgtgcag

SEQ ID NO: 8936 - DNA, 27 bp, Artificial Sequence
  Description of Artificial Sequence: Synthetic oligonucleotide
agcagagctacacctgccatgtgcagc

SEQ ID NO: 8937 - DNA, 27 bp, Artificial Sequence
  Description of Artificial Sequence: Synthetic oligonucleotide
gcagagctacacctgccatgtgcagca

SEQ ID NO: 8938 - DNA, 28 bp, Artificial Sequence
  Description of Artificial Sequence: Synthetic oligonucleotide
cagagctacacctgccatgtgcagcatg

SEQ ID NO: 8939 - DNA, 29 bp, Artificial Sequence
  Description of Artificial Sequence: Synthetic oligonucleotide
agagctacacctgccatgtgcagcatgag

SEQ ID NO: 8940 - DNA, 28 bp, Artificial Sequence
  Description of Artificial Sequence: Synthetic oligonucleotide
gagctacacctgccatgtgcagcatgag

SEQ ID NO: 8941 - DNA, 28 bp, Artificial Sequence
  Description of Artificial Sequence: Synthetic oligonucleotide
agctacacctgccatgtgcagcatgagg

SEQ ID NO: 8942 - DNA, 27 bp, Artificial Sequence
  Description of Artificial Sequence: Synthetic oligonucleotide
gctacacctgccatgtgcagcatgagg

SEQ ID NO: 8943 - DNA, 27 bp, Artificial Sequence
  Description of Artificial Sequence: Synthetic oligonucleotide
ctacacctgccatgtgcagcatgaggg

SEQ ID NO: 8944 - DNA, 26 bp, Artificial Sequence
  Description of Artificial Sequence: Synthetic oligonucleotide
gactggcgcttcctccgcgggtataa

SEQ ID NO: 8945 - DNA, 26 bp, Artificial Sequence
  Description of Artificial Sequence: Synthetic oligonucleotide
actggcgcttcctccgcgggtataac

SEQ ID NO: 8946 - DNA, 25 bp, Artificial Sequence
  Description of Artificial Sequence: Synthetic oligonucleotide
ctggcgcttcctccgcgggtataac

SEQ ID NO: 8947 - DNA, 26 bp, Artificial Sequence
  Description of Artificial Sequence: Synthetic oligonucleotide
tggcgcttcctccgcgggtataacca

SEQ ID NO: 8948 - DNA, 25 bp, Artificial Sequence
  Description of Artificial Sequence: Synthetic oligonucleotide
ggcgcttcctccgcgggtataacca

SEQ ID NO: 8949 - DNA, 27 bp, Artificial Sequence
  Description of Artificial Sequence: Synthetic oligonucleotide
gcgcttcctccgcgggtataaccagtt

SEQ ID NO: 8950 - DNA, 27 bp, Artificial Sequence
  Description of Artificial Sequence: Synthetic oligonucleotide
cgcttcctccgcgggtataaccagttc

SEQ ID NO: 8951 - DNA, 27 bp, Artificial Sequence
  Description of Artificial Sequence: Synthetic oligonucleotide
gcttcctccgcgggtataaccagttcg

SEQ ID NO: 8952 - DNA, 27 bp, Artificial Sequence
  Description of Artificial Sequence: Synthetic oligonucleotide
cttcctccgcgggtataaccagttcgc

SEQ ID NO: 8953 - DNA, 27 bp, Artificial Sequence
  Description of Artificial Sequence: Synthetic oligonucleotide
ttcctccgcgggtataaccagttcgcc

SEQ ID NO: 8954 - DNA, 27 bp, Artificial Sequence
  Description of Artificial Sequence: Synthetic oligonucleotide
tcctccgcgggtataaccagttcgcct

SEQ ID NO: 8955 - DNA, 27 bp, Artificial Sequence
  Description of Artificial Sequence: Synthetic oligonucleotide
cctccgcgggtataaccagttcgccta

SEQ ID NO: 8956 - DNA, 27 bp, Artificial Sequence
  Description of Artificial Sequence: Synthetic oligonucleotide
ctccgcgggtataaccagttcgcctac

SEQ ID NO: 8957 - DNA, 27 bp, Artificial Sequence
  Description of Artificial Sequence: Synthetic oligonucleotide
tccgcgggtataaccagttcgcctacg

SEQ ID NO: 8958 - DNA, 27 bp, Artificial Sequence
  Description of Artificial Sequence: Synthetic oligonucleotide
ccgcgggtataaccagttcgcctacga

SEQ ID NO: 8959 - DNA, 27 bp, Artificial Sequence
  Description of Artificial Sequence: Synthetic oligonucleotide
cgcgggtataaccagttcgcctacgac

SEQ ID NO: 8960 - DNA, 27 bp, Artificial Sequence
  Description of Artificial Sequence: Synthetic oligonucleotide
gcgggtataaccagttcgcctacgacg

SEQ ID NO: 8961 - DNA, 27 bp, Artificial Sequence
  Description of Artificial Sequence: Synthetic oligonucleotide
cgggtataaccagttcgcctacgacgg

SEQ ID NO: 8962 - DNA, 27 bp, Artificial Sequence
  Description of Artificial Sequence: Synthetic oligonucleotide
gggtataaccagttcgcctacgacggc

SEQ ID NO: 8963 - DNA, 29 bp, Artificial Sequence
  Description of Artificial Sequence: Synthetic oligonucleotide
ggtataaccagttcgcctacgacggcaag

SEQ ID NO: 8964 - DNA, 29 bp, Artificial Sequence
  Description of Artificial Sequence: Synthetic oligonucleotide
gtataaccagttcgcctacgacggcaagg

SEQ ID NO: 8965 - DNA, 33 bp, Artificial Sequence
  Description of Artificial Sequence: Synthetic oligonucleotide
tataaccagttcgcctacgacggcaaggattac

SEQ ID NO: 8966 - DNA, 32 bp, Artificial Sequence
  Description of Artificial Sequence: Synthetic oligonucleotide
ataaccagttcgcctacgacggcaaggattac

SEQ ID NO: 8967 - DNA, 31 bp, Artificial Sequence
  Description of Artificial Sequence: Synthetic oligonucleotide
taaccagttcgcctacgacggcaaggattac

SEQ ID NO: 8968 - DNA, 30 bp, Artificial Sequence
  Description of Artificial Sequence: Synthetic oligonucleotide
aaccagttcgcctacgacggcaaggattac

SEQ ID NO: 8969 - DNA, 29 bp, Artificial Sequence
  Description of Artificial Sequence: Synthetic oligonucleotide
accagttcgcctacgacggcaaggattac

SEQ ID NO: 8970 - DNA, 28 bp, Artificial Sequence
  Description of Artificial Sequence: Synthetic oligonucleotide
ccagttcgcctacgacggcaaggattac

SEQ ID NO: 8971 - DNA, 30 bp, Artificial Sequence
  Description of Artificial Sequence: Synthetic oligonucleotide
cagttcgcctacgacggcaaggattacatc

SEQ ID NO: 8972 - DNA, 30 bp, Artificial Sequence
  Description of Artificial Sequence: Synthetic oligonucleotide
agttcgcctacgacggcaaggattacatcg

SEQ ID NO: 8973 - DNA, 29 bp, Artificial Sequence
  Description of Artificial Sequence: Synthetic oligonucleotide
gttcgcctacgacggcaaggattacatcg

SEQ ID NO: 8974 - DNA, 29 bp, Artificial Sequence
  Description of Artificial Sequence: Synthetic oligonucleotide
ttcgcctacgacggcaaggattacatcgc

SEQ ID NO: 8975 - DNA, 28 bp, Artificial Sequence
  Description of Artificial Sequence: Synthetic oligonucleotide
tcgcctacgacggcaaggattacatcgc

SEQ ID NO: 8976 - DNA, 27 bp, Artificial Sequence
  Description of Artificial Sequence: Synthetic oligonucleotide
tgcggagatcacactgacctggcagct

SEQ ID NO: 8977 - DNA, 26 bp, Artificial Sequence
  Description of Artificial Sequence: Synthetic oligonucleotide
gcggagatcacactgacctggcagct

SEQ ID NO: 8978 - DNA, 26 bp, Artificial Sequence
  Description of Artificial Sequence: Synthetic oligonucleotide
cggagatcacactgacctggcagctg

SEQ ID NO: 8979 - DNA, 27 bp, Artificial Sequence
  Description of Artificial Sequence: Synthetic oligonucleotide
ggagatcacactgacctggcagctgga

SEQ ID NO: 8980 - DNA, 28 bp, Artificial Sequence
  Description of Artificial Sequence: Synthetic oligonucleotide
gagatcacactgacctggcagctggatg

SEQ ID NO: 8981 - DNA, 28 bp, Artificial Sequence
  Description of Artificial Sequence: Synthetic oligonucleotide
agatcacactgacctggcagctggatgg

SEQ ID NO: 8982 - DNA, 27 bp, Artificial Sequence
  Description of Artificial Sequence: Synthetic oligonucleotide
gatcacactgacctggcagctggatgg

SEQ ID NO: 8983 - DNA, 27 bp, Artificial Sequence
  Description of Artificial Sequence: Synthetic oligonucleotide
atcacactgacctggcagctggatggg

SEQ ID NO: 8984 - DNA, 26 bp, Artificial Sequence
  Description of Artificial Sequence: Synthetic oligonucleotide
tcacactgacctggcagctggatggg

SEQ ID NO: 8985 - DNA, 25 bp, Artificial Sequence
  Description of Artificial Sequence: Synthetic oligonucleotide
cacactgacctggcagctggatggg

SEQ ID NO: 8986 - DNA, 26 bp, Artificial Sequence
  Description of Artificial Sequence: Synthetic oligonucleotide
acactgacctggcagctggatgggga

SEQ ID NO: 8987 - DNA, 25 bp, Artificial Sequence
  Description of Artificial Sequence: Synthetic oligonucleotide
cactgacctggcagctggatgggga

SEQ ID NO: 8988 - DNA, 25 bp, Artificial Sequence
  Description of Artificial Sequence: Synthetic oligonucleotide
actgacctggcagctggatggggag

SEQ ID NO: 8989 - DNA, 24 bp, Artificial Sequence
  Description of Artificial Sequence: Synthetic oligonucleotide
ctgacctggcagctggatggggag

SEQ ID NO: 8990 - DNA, 25 bp, Artificial Sequence
  Description of Artificial Sequence: Synthetic oligonucleotide
tgacctggcagctggatggggagga

SEQ ID NO: 8991 - DNA, 24 bp, Artificial Sequence
  Description of Artificial Sequence: Synthetic oligonucleotide
gacctggcagctggatggggagga

SEQ ID NO: 8992 - DNA, 24 bp, Artificial Sequence
  Description of Artificial Sequence: Synthetic oligonucleotide
acctggcagctggatggggaggac

SEQ ID NO: 8993 - DNA, 23 bp, Artificial Sequence
  Description of Artificial Sequence: Synthetic oligonucleotide
cctggcagctggatggggaggac

SEQ ID NO: 8994 - DNA, 24 bp, Artificial Sequence
  Description of Artificial Sequence: Synthetic oligonucleotide
ctggcagctggatggggaggacca

SEQ ID NO: 8995 - DNA, 25 bp, Artificial Sequence
  Description of Artificial Sequence: Synthetic oligonucleotide
tggcagctggatggggaggaccaga

SEQ ID NO: 8996 - DNA, 24 bp, Artificial Sequence
  Description of Artificial Sequence: Synthetic oligonucleotide
ggcagctggatggggaggaccaga

SEQ ID NO: 8997 - DNA, 24 bp, Artificial Sequence
  Description of Artificial Sequence: Synthetic oligonucleotide
gcagctggatggggaggaccagac

SEQ ID NO: 8998 - DNA, 24 bp, Artificial Sequence
  Description of Artificial Sequence: Synthetic oligonucleotide
cagctggatggggaggaccagacc

SEQ ID NO: 8999 - DNA, 25 bp, Artificial Sequence
  Description of Artificial Sequence: Synthetic oligonucleotide
agctggatggggaggaccagaccca

SEQ ID NO: 9000 - DNA, 24 bp, Artificial Sequence
  Description of Artificial Sequence: Synthetic oligonucleotide
gctggatggggaggaccagaccca

SEQ ID NO: 9001 - DNA, 24 bp, Artificial Sequence
  Description of Artificial Sequence: Synthetic oligonucleotide
ctggatggggaggaccagacccag

SEQ ID NO: 9002 - DNA, 25 bp, Artificial Sequence
  Description of Artificial Sequence: Synthetic oligonucleotide
tggatggggaggaccagacccagga

SEQ ID NO: 9003 - DNA, 25 bp, Artificial Sequence
  Description of Artificial Sequence: Synthetic oligonucleotide
ggaccctgcgcggctactacaacga

SEQ ID NO: 9004 - DNA, 26 bp, Artificial Sequence
  Description of Artificial Sequence: Synthetic oligonucleotide
gaccctgcgcggctactacaacgaga

SEQ ID NO: 9005 - DNA, 26 bp, Artificial Sequence
  Description of Artificial Sequence: Synthetic oligonucleotide
accctgcgcggctactacaacgagag

SEQ ID NO: 9006 - DNA, 25 bp, Artificial Sequence
  Description of Artificial Sequence: Synthetic oligonucleotide
ccctgcgcggctactacaacgagag

SEQ ID NO: 9007 - DNA, 25 bp, Artificial Sequence
  Description of Artificial Sequence: Synthetic oligonucleotide
cctgcgcggctactacaacgagagc

SEQ ID NO: 9008 - DNA, 26 bp, Artificial Sequence
  Description of Artificial Sequence: Synthetic oligonucleotide
ctgcgcggctactacaacgagagcga

SEQ ID NO: 9009 - DNA, 26 bp, Artificial Sequence
  Description of Artificial Sequence: Synthetic oligonucleotide
tgcgcggctactacaacgagagcgag

SEQ ID NO: 9010 - DNA, 25 bp, Artificial Sequence
  Description of Artificial Sequence: Synthetic oligonucleotide
gcgcggctactacaacgagagcgag

SEQ ID NO: 9011 - DNA, 25 bp, Artificial Sequence
  Description of Artificial Sequence: Synthetic oligonucleotide
cgcggctactacaacgagagcgagg

SEQ ID NO: 9012 - DNA, 25 bp, Artificial Sequence
  Description of Artificial Sequence: Synthetic oligonucleotide
gcggctactacaacgagagcgaggc

SEQ ID NO: 9013 - DNA, 25 bp, Artificial Sequence
  Description of Artificial Sequence: Synthetic oligonucleotide
cggctactacaacgagagcgaggcc

SEQ ID NO: 9014 - DNA, 25 bp, Artificial Sequence
  Description of Artificial Sequence: Synthetic oligonucleotide
ggctactacaacgagagcgaggccg

SEQ ID NO: 9015 - DNA, 27 bp, Artificial Sequence
  Description of Artificial Sequence: Synthetic oligonucleotide
gctactacaacgagagcgaggccggtt

SEQ ID NO: 9016 - DNA, 27 bp, Artificial Sequence
  Description of Artificial Sequence: Synthetic oligonucleotide
ctactacaacgagagcgaggccggttc

SEQ ID NO: 9017 - DNA, 28 bp, Artificial Sequence
  Description of Artificial Sequence: Synthetic oligonucleotide
tactacaacgagagcgaggccggttctc

SEQ ID NO: 9018 - DNA, 27 bp, Artificial Sequence
  Description of Artificial Sequence: Synthetic oligonucleotide
actacaacgagagcgaggccggttctc

SEQ ID NO: 9019 - DNA, 27 bp, Artificial Sequence
  Description of Artificial Sequence: Synthetic oligonucleotide
ctacaacgagagcgaggccggttctca

SEQ ID NO: 9020 - DNA, 27 bp, Artificial Sequence
  Description of Artificial Sequence: Synthetic oligonucleotide
tacaacgagagcgaggccggttctcac

SEQ ID NO: 9021 - DNA, 27 bp, Artificial Sequence
  Description of Artificial Sequence: Synthetic oligonucleotide
acaacgagagcgaggccggttctcaca

SEQ ID NO: 9022 - DNA, 26 bp, Artificial Sequence
  Description of Artificial Sequence: Synthetic oligonucleotide
caacgagagcgaggccggttctcaca

SEQ ID NO: 9023 - DNA, 26 bp, Artificial Sequence
  Description of Artificial Sequence: Synthetic oligonucleotide
aacgagagcgaggccggttctcacac

SEQ ID NO: 9024 - DNA, 25 bp, Artificial Sequence
  Description of Artificial Sequence: Synthetic oligonucleotide
acgagagcgaggccggttctcacac

SEQ ID NO: 9025 - DNA, 24 bp, Artificial Sequence
  Description of Artificial Sequence: Synthetic oligonucleotide
cgagagcgaggccggttctcacac

SEQ ID NO: 9026 - DNA, 24 bp, Artificial Sequence
  Description of Artificial Sequence: Synthetic oligonucleotide
gagagcgaggccggttctcacacc

SEQ ID NO: 9027 - DNA, 29 bp, Artificial Sequence
  Description of Artificial Sequence: Synthetic oligonucleotide
ggagacacggaaagtgaaggcccacttac

SEQ ID NO: 9028 - DNA, 30 bp, Artificial Sequence
  Description of Artificial Sequence: Synthetic oligonucleotide
gagacacggaaagtgaaggcccacttacag

SEQ ID NO: 9029 - DNA, 31 bp, Artificial Sequence
  Description of Artificial Sequence: Synthetic oligonucleotide
agacacggaaagtgaaggcccacttacagac

SEQ ID NO: 9030 - DNA, 30 bp, Artificial Sequence
  Description of Artificial Sequence: Synthetic oligonucleotide
gacacggaaagtgaaggcccacttacagac

SEQ ID NO: 9031 - DNA, 31 bp, Artificial Sequence
  Description of Artificial Sequence: Synthetic oligonucleotide
acacggaaagtgaaggcccacttacagactc

SEQ ID NO: 9032 - DNA, 30 bp, Artificial Sequence
  Description of Artificial Sequence: Synthetic oligonucleotide
cacggaaagtgaaggcccacttacagactc

SEQ ID NO: 9033 - DNA, 31 bp, Artificial Sequence
  Description of Artificial Sequence: Synthetic oligonucleotide
acggaaagtgaaggcccacttacagactcac

SEQ ID NO: 9034 - DNA, 30 bp, Artificial Sequence
  Description of Artificial Sequence: Synthetic oligonucleotide
cggaaagtgaaggcccacttacagactcac

SEQ ID NO: 9035 - DNA, 30 bp, Artificial Sequence
  Description of Artificial Sequence: Synthetic oligonucleotide
ggaaagtgaaggcccacttacagactcacc

SEQ ID NO: 9036 - DNA, 30 bp, Artificial Sequence
  Description of Artificial Sequence: Synthetic oligonucleotide
gaaagtgaaggcccacttacagactcaccg

SEQ ID NO: 9037 - DNA, 31 bp, Artificial Sequence
  Description of Artificial Sequence: Synthetic oligonucleotide
aaagtgaaggcccacttacagactcaccgag

SEQ ID NO: 9038 - DNA, 30 bp, Artificial Sequence
  Description of Artificial Sequence: Synthetic oligonucleotide
aagtgaaggcccacttacagactcaccgag

SEQ ID NO: 9039 - DNA, 29 bp, Artificial Sequence
  Description of Artificial Sequence: Synthetic oligonucleotide
agtgaaggcccacttacagactcaccgag

SEQ ID NO: 9040 - DNA, 28 bp, Artificial Sequence
  Description of Artificial Sequence: Synthetic oligonucleotide
gtgaaggcccacttacagactcaccgag

SEQ ID NO: 9041 - DNA, 29 bp, Artificial Sequence
  Description of Artificial Sequence: Synthetic oligonucleotide
tgaaggcccacttacagactcaccgagtg

SEQ ID NO: 9042 - DNA, 28 bp, Artificial Sequence
  Description of Artificial Sequence: Synthetic oligonucleotide
gaaggcccacttacagactcaccgagtg

SEQ ID NO: 9043 - DNA, 28 bp, Artificial Sequence
  Description of Artificial Sequence: Synthetic oligonucleotide
aaggcccacttacagactcaccgagtgg

SEQ ID NO: 9044 - DNA, 27 bp, Artificial Sequence
  Description of Artificial Sequence: Synthetic oligonucleotide
aggcccacttacagactcaccgagtgg

SEQ ID NO: 9045 - DNA, 27 bp, Artificial Sequence
  Description of Artificial Sequence: Synthetic oligonucleotide
ggcccacttacagactcaccgagtgga

SEQ ID NO: 9046 - DNA, 27 bp, Artificial Sequence
  Description of Artificial Sequence: Synthetic oligonucleotide
gcccacttacagactcaccgagtggac

SEQ ID NO: 9047 - DNA, 27 bp, Artificial Sequence
  Description of Artificial Sequence: Synthetic oligonucleotide
cccacttacagactcaccgagtggacc

SEQ ID NO: 9048 - DNA, 28 bp, Artificial Sequence
  Description of Artificial Sequence: Synthetic oligonucleotide
ccacttacagactcaccgagtggacctg

SEQ ID NO: 9049 - DNA, 28 bp, Artificial Sequence
  Description of Artificial Sequence: Synthetic oligonucleotide
cacttacagactcaccgagtggacctgg

SEQ ID NO: 9050 - DNA, 28 bp, Artificial Sequence
  Description of Artificial Sequence: Synthetic oligonucleotide
acttacagactcaccgagtggacctggg

SEQ ID NO: 9051 - DNA, 27 bp, Artificial Sequence
  Description of Artificial Sequence: Synthetic oligonucleotide
cttacagactcaccgagtggacctggg

SEQ ID NO: 9052 - DNA, 27 bp, Artificial Sequence
  Description of Artificial Sequence: Synthetic oligonucleotide
ttacagactcaccgagtggacctgggg

SEQ ID NO: 9053 - DNA, 27 bp, Artificial Sequence
  Description of Artificial Sequence: Synthetic oligonucleotide
tacagactcaccgagtggacctgggga

SEQ ID NO: 9054 - DNA, 22 bp, Artificial Sequence
  Description of Artificial Sequence: Synthetic oligonucleotide
gctcttggaccgcggcggacac

SEQ ID NO: 9055 - DNA, 22 bp, Artificial Sequence
  Description of Artificial Sequence: Synthetic oligonucleotide
ctcttggaccgcggcggacacg

SEQ ID NO: 9056 - DNA, 22 bp, Artificial Sequence
  Description of Artificial Sequence: Synthetic oligonucleotide
tcttggaccgcggcggacacgg

SEQ ID NO: 9057 - DNA, 21 bp, Artificial Sequence
  Description of Artificial Sequence: Synthetic oligonucleotide
cttggaccgcggcggacacgg

SEQ ID NO: 9058 - DNA, 22 bp, Artificial Sequence
  Description of Artificial Sequence: Synthetic oligonucleotide
ttggaccgcggcggacacggca

SEQ ID NO: 9059 - DNA, 21 bp, Artificial Sequence
  Description of Artificial Sequence: Synthetic oligonucleotide
tggaccgcggcggacacggca

SEQ ID NO: 9060 - DNA, 20 bp, Artificial Sequence
  Description of Artificial Sequence: Synthetic oligonucleotide
ggaccgcggcggacacggca

SEQ ID NO: 9061 - DNA, 20 bp, Artificial Sequence
  Description of Artificial Sequence: Synthetic oligonucleotide
gaccgcggcggacacggcag

SEQ ID NO: 9062 - DNA, 21 bp, Artificial Sequence
  Description of Artificial Sequence: Synthetic oligonucleotide
accgcggcggacacggcagct

SEQ ID NO: 9063 - DNA, 20 bp, Artificial Sequence
  Description of Artificial Sequence: Synthetic oligonucleotide
ccgcggcggacacggcagct

SEQ ID NO: 9064 - DNA, 21 bp, Artificial Sequence
  Description of Artificial Sequence: Synthetic oligonucleotide
cgcggcggacacggcagctca

SEQ ID NO: 9065 - DNA, 22 bp, Artificial Sequence
  Description of Artificial Sequence: Synthetic oligonucleotide
gcggcggacacggcagctcaga

SEQ ID NO: 9066 - DNA, 22 bp, Artificial Sequence
  Description of Artificial Sequence: Synthetic oligonucleotide
cggcggacacggcagctcagac

SEQ ID NO: 9067 - DNA, 23 bp, Artificial Sequence
  Description of Artificial Sequence: Synthetic oligonucleotide
ggcggacacggcagctcagacca

SEQ ID NO: 9068 - DNA, 23 bp, Artificial Sequence
  Description of Artificial Sequence: Synthetic oligonucleotide
gcggacacggcagctcagaccac

SEQ ID NO: 9069 - DNA, 25 bp, Artificial Sequence
  Description of Artificial Sequence: Synthetic oligonucleotide
cggacacggcagctcagaccaccaa

SEQ ID NO: 9070 - DNA, 25 bp, Artificial Sequence
  Description of Artificial Sequence: Synthetic oligonucleotide
ggacacggcagctcagaccaccaag

SEQ ID NO: 9071 - DNA, 26 bp, Artificial Sequence
  Description of Artificial Sequence: Synthetic oligonucleotide
gacacggcagctcagaccaccaagca

SEQ ID NO: 9072 - DNA, 27 bp, Artificial Sequence
  Description of Artificial Sequence: Synthetic oligonucleotide
acacggcagctcagaccaccaagcaca

SEQ ID NO: 9073 - DNA, 27 bp, Artificial Sequence
  Description of Artificial Sequence: Synthetic oligonucleotide
cacggcagctcagaccaccaagcacaa

SEQ ID NO: 9074 - DNA, 27 bp, Artificial Sequence
  Description of Artificial Sequence: Synthetic oligonucleotide
acggcagctcagaccaccaagcacaag

SEQ ID NO: 9075 - DNA, 27 bp, Artificial Sequence
  Description of Artificial Sequence: Synthetic oligonucleotide
cggcagctcagaccaccaagcacaagt

SEQ ID NO: 9076 - DNA, 23 bp, Artificial Sequence
  Description of Artificial Sequence: Synthetic oligonucleotide
gcggcccatgaggcggagcagtt

SEQ ID NO: 9077 - DNA, 27 bp, Artificial Sequence
  Description of Artificial Sequence: Synthetic oligonucleotide
ggtccggagtattgggacggggagata

SEQ ID NO: 9078 - DNA, 27 bp, Artificial Sequence
  Description of Artificial Sequence: Synthetic oligonucleotide
gtccggagtattgggacggggagatac

SEQ ID NO: 9079 - DNA, 27 bp, Artificial Sequence
  Description of Artificial Sequence: Synthetic oligonucleotide
tccggagtattgggacggggagatacg

SEQ ID NO: 9080 - DNA, 26 bp, Artificial Sequence
  Description of Artificial Sequence: Synthetic oligonucleotide
ccggagtattgggacggggagatacg

SEQ ID NO: 9081 - DNA, 27 bp, Artificial Sequence
  Description of Artificial Sequence: Synthetic oligonucleotide
cggagtattgggacggggagatacgga

SEQ ID NO: 9082 - DNA, 29 bp, Artificial Sequence
  Description of Artificial Sequence: Synthetic oligonucleotide
ggagtattgggacggggagatacggaaag

SEQ ID NO: 9083 - DNA, 30 bp, Artificial Sequence
  Description of Artificial Sequence: Synthetic oligonucleotide
gagtattgggacggggagatacggaaagtg

SEQ ID NO: 9084 - DNA, 32 bp, Artificial Sequence
  Description of Artificial Sequence: Synthetic oligonucleotide
agtattgggacggggagatacggaaagtgaag

SEQ ID NO: 9085 - DNA, 31 bp, Artificial Sequence
  Description of Artificial Sequence: Synthetic oligonucleotide
gtattgggacggggagatacggaaagtgaag

SEQ ID NO: 9086 - DNA, 31 bp, Artificial Sequence
  Description of Artificial Sequence: Synthetic oligonucleotide
tattgggacggggagatacggaaagtgaagg

SEQ ID NO: 9087 - DNA, 30 bp, Artificial Sequence
  Description of Artificial Sequence: Synthetic oligonucleotide
attgggacggggagatacggaaagtgaagg

SEQ ID NO: 9088 - DNA, 29 bp, Artificial Sequence
  Description of Artificial Sequence: Synthetic oligonucleotide
ttgggacggggagatacggaaagtgaagg

SEQ ID NO: 9089 - DNA, 28 bp, Artificial Sequence
  Description of Artificial Sequence: Synthetic oligonucleotide
tgggacggggagatacggaaagtgaagg

SEQ ID NO: 9090 - DNA, 27 bp, Artificial Sequence
  Description of Artificial Sequence: Synthetic oligonucleotide
gggacggggagatacggaaagtgaagg

SEQ ID NO: 9091 - DNA, 27 bp, Artificial Sequence
  Description of Artificial Sequence: Synthetic oligonucleotide
ggacggggagatacggaaagtgaaggc

SEQ ID NO: 9092 - DNA, 27 bp, Artificial Sequence
  Description of Artificial Sequence: Synthetic oligonucleotide
gacggggagatacggaaagtgaaggcc

SEQ ID NO: 9093 - DNA, 27 bp, Artificial Sequence
  Description of Artificial Sequence: Synthetic oligonucleotide
acggggagatacggaaagtgaaggccc

SEQ ID NO: 9094 - DNA, 27 bp, Artificial Sequence
  Description of Artificial Sequence: Synthetic oligonucleotide
cggggagatacggaaagtgaaggccca

SEQ ID NO: 9095 - DNA, 27 bp, Artificial Sequence
  Description of Artificial Sequence: Synthetic oligonucleotide
ggggagatacggaaagtgaaggcccac

SEQ ID NO: 9096 - DNA, 28 bp, Artificial Sequence
  Description of Artificial Sequence: Synthetic oligonucleotide
gggagatacggaaagtgaaggcccactc

SEQ ID NO: 9097 - DNA, 29 bp, Artificial Sequence
  Description of Artificial Sequence: Synthetic oligonucleotide
ggagatacggaaagtgaaggcccactcac

SEQ ID NO: 9098 - DNA, 30 bp, Artificial Sequence
  Description of Artificial Sequence: Synthetic oligonucleotide
gagatacggaaagtgaaggcccactcacag

SEQ ID NO: 9099 - DNA, 31 bp, Artificial Sequence
  Description of Artificial Sequence: Synthetic oligonucleotide
agatacggaaagtgaaggcccactcacagac

SEQ ID NO: 9100 - DNA, 30 bp, Artificial Sequence
  Description of Artificial Sequence: Synthetic oligonucleotide
gatacggaaagtgaaggcccactcacagac

SEQ ID NO: 9101 - DNA, 31 bp, Artificial Sequence
  Description of Artificial Sequence: Synthetic oligonucleotide
atacggaaagtgaaggcccactcacagactc

SEQ ID NO: 9102 - DNA, 30 bp, Artificial Sequence
  Description of Artificial Sequence: Synthetic oligonucleotide
tacggaaagtgaaggcccactcacagactc

SEQ ID NO: 9103 - DNA, 29 bp, Artificial Sequence
  Description of Artificial Sequence: Synthetic oligonucleotide
tgaaggcccactcacagactcaccgaatg

SEQ ID NO: 9104 - DNA, 28 bp, Artificial Sequence
  Description of Artificial Sequence: Synthetic oligonucleotide
gaaggcccactcacagactcaccgaatg

SEQ ID NO: 9105 - DNA, 28 bp, Artificial Sequence
  Description of Artificial Sequence: Synthetic oligonucleotide
aaggcccactcacagactcaccgaatgg

SEQ ID NO: 9106 - DNA, 27 bp, Artificial Sequence
  Description of Artificial Sequence: Synthetic oligonucleotide
aggcccactcacagactcaccgaatgg

SEQ ID NO: 9107 - DNA, 27 bp, Artificial Sequence
  Description of Artificial Sequence: Synthetic oligonucleotide
ggcccactcacagactcaccgaatgga

SEQ ID NO: 9108 - DNA, 27 bp, Artificial Sequence
  Description of Artificial Sequence: Synthetic oligonucleotide
gcccactcacagactcaccgaatggac

SEQ ID NO: 9109 - DNA, 27 bp, Artificial Sequence
  Description of Artificial Sequence: Synthetic oligonucleotide
cccactcacagactcaccgaatggacc

SEQ ID NO: 9110 - DNA, 28 bp, Artificial Sequence
  Description of Artificial Sequence: Synthetic oligonucleotide
ccactcacagactcaccgaatggacctg

SEQ ID NO: 9111 - DNA, 28 bp, Artificial Sequence
  Description of Artificial Sequence: Synthetic oligonucleotide
cactcacagactcaccgaatggacctgg

SEQ ID NO: 9112 - DNA, 28 bp, Artificial Sequence
  Description of Artificial Sequence: Synthetic oligonucleotide
actcacagactcaccgaatggacctggg

SEQ ID NO: 9113 - DNA, 27 bp, Artificial Sequence
  Description of Artificial Sequence: Synthetic oligonucleotide
ctcacagactcaccgaatggacctggg

SEQ ID NO: 9114 - DNA, 27 bp, Artificial Sequence
  Description of Artificial Sequence: Synthetic oligonucleotide
tcacagactcaccgaatggacctgggg

SEQ ID NO: 9115 - DNA, 27 bp, Artificial Sequence
  Description of Artificial Sequence: Synthetic oligonucleotide
cacagactcaccgaatggacctgggga

SEQ ID NO: 9116 - DNA, 27 bp, Artificial Sequence
  Description of Artificial Sequence: Synthetic oligonucleotide
acagactcaccgaatggacctggggac

SEQ ID NO: 9117 - DNA, 26 bp, Artificial Sequence
  Description of Artificial Sequence: Synthetic oligonucleotide
cagactcaccgaatggacctggggac

SEQ ID NO: 9118 - DNA, 26 bp, Artificial Sequence
  Description of Artificial Sequence: Synthetic oligonucleotide
agactcaccgaatggacctggggacc

SEQ ID NO: 9119 - DNA, 25 bp, Artificial Sequence
  Description of Artificial Sequence: Synthetic oligonucleotide
gactcaccgaatggacctggggacc

SEQ ID NO: 9120 - DNA, 26 bp, Artificial Sequence
  Description of Artificial Sequence: Synthetic oligonucleotide
actcaccgaatggacctggggaccct

SEQ ID NO: 9121 - DNA, 25 bp, Artificial Sequence
  Description of Artificial Sequence: Synthetic oligonucleotide
ctcaccgaatggacctggggaccct

SEQ ID NO: 9122 - DNA, 25 bp, Artificial Sequence
  Description of Artificial Sequence: Synthetic oligonucleotide
tcaccgaatggacctggggaccctg

SEQ ID NO: 9123 - DNA, 24 bp, Artificial Sequence
  Description of Artificial Sequence: Synthetic oligonucleotide
caccgaatggacctggggaccctg

SEQ ID NO: 9124 - DNA, 24 bp, Artificial Sequence
  Description of Artificial Sequence: Synthetic oligonucleotide
accgaatggacctggggaccctgc

SEQ ID NO: 9125 - DNA, 23 bp, Artificial Sequence
  Description of Artificial Sequence: Synthetic oligonucleotide
ccgaatggacctggggaccctgc

SEQ ID NO: 9126 - DNA, 23 bp, Artificial Sequence
  Description of Artificial Sequence: Synthetic oligonucleotide
cgaatggacctggggaccctgcg

SEQ ID NO: 9127 - DNA, 23 bp, Artificial Sequence
  Description of Artificial Sequence: Synthetic oligonucleotide
gaatggacctggggaccctgcgc

SEQ ID NO: 9128 - DNA, 23 bp, Artificial Sequence
  Description of Artificial Sequence: Synthetic oligonucleotide
aatggacctggggaccctgcgcg

SEQ ID NO: 9129 - DNA, 22 bp, Artificial Sequence
  Description of Artificial Sequence: Synthetic oligonucleotide
atggacctggggaccctgcgcg

SEQ ID NO: 9130 - DNA, 26 bp, Artificial Sequence
  Description of Artificial Sequence: Synthetic oligonucleotide
gcccatgtggcggagcagttgagagt

SEQ ID NO: 9131 - DNA, 27 bp, Artificial Sequence
  Description of Artificial Sequence: Synthetic oligonucleotide
cccatgtggcggagcagttgagagtct

SEQ ID NO: 9132 - DNA, 28 bp, Artificial Sequence
  Description of Artificial Sequence: Synthetic oligonucleotide
ccatgtggcggagcagttgagagtctac

SEQ ID NO: 9133 - DNA, 28 bp, Artificial Sequence
  Description of Artificial Sequence: Synthetic oligonucleotide
catgtggcggagcagttgagagtctacc

SEQ ID NO: 9134 - DNA, 29 bp, Artificial Sequence
  Description of Artificial Sequence: Synthetic oligonucleotide
atgtggcggagcagttgagagtctacctg

SEQ ID NO: 9135 - DNA, 28 bp, Artificial Sequence
  Description of Artificial Sequence: Synthetic oligonucleotide
tgtggcggagcagttgagagtctacctg

SEQ ID NO: 9136 - DNA, 27 bp, Artificial Sequence
  Description of Artificial Sequence: Synthetic oligonucleotide
gtggcggagcagttgagagtctacctg

SEQ ID NO: 9137 - DNA, 27 bp, Artificial Sequence
  Description of Artificial Sequence: Synthetic oligonucleotide
tggcggagcagttgagagtctacctgg

SEQ ID NO: 9138 - DNA, 27 bp, Artificial Sequence
  Description of Artificial Sequence: Synthetic oligonucleotide
ggcggagcagttgagagtctacctgga

SEQ ID NO: 9139 - DNA, 27 bp, Artificial Sequence
  Description of Artificial Sequence: Synthetic oligonucleotide
gcggagcagttgagagtctacctggag

SEQ ID NO: 9140 - DNA, 27 bp, Artificial Sequence
  Description of Artificial Sequence: Synthetic oligonucleotide
cggagcagttgagagtctacctggagg

SEQ ID NO: 9141 - DNA, 27 bp, Artificial Sequence
  Description of Artificial Sequence: Synthetic oligonucleotide
ggagcagttgagagtctacctggaggg

SEQ ID NO: 9142 - DNA, 27 bp, Artificial Sequence
  Description of Artificial Sequence: Synthetic oligonucleotide
gagcagttgagagtctacctggagggc

SEQ ID NO: 9143 - DNA, 28 bp, Artificial Sequence
  Description of Artificial Sequence: Synthetic oligonucleotide
agcagttgagagtctacctggagggcac

SEQ ID NO: 9144 - DNA, 27 bp, Artificial Sequence
  Description of Artificial Sequence: Synthetic oligonucleotide
gcagttgagagtctacctggagggcac

SEQ ID NO: 9145 - DNA, 27 bp, Artificial Sequence
  Description of Artificial Sequence: Synthetic oligonucleotide
cagttgagagtctacctggagggcacg

SEQ ID NO: 9146 - DNA, 28 bp, Artificial Sequence
  Description of Artificial Sequence: Synthetic oligonucleotide
agttgagagtctacctggagggcacgtg

SEQ ID NO: 9147 - DNA, 27 bp, Artificial Sequence
  Description of Artificial Sequence: Synthetic oligonucleotide
gttgagagtctacctggagggcacgtg

SEQ ID NO: 9148 - DNA, 27 bp, Artificial Sequence
  Description of Artificial Sequence: Synthetic oligonucleotide
ttgagagtctacctggagggcacgtgc

SEQ ID NO: 9149 - DNA, 26 bp, Artificial Sequence
  Description of Artificial Sequence: Synthetic oligonucleotide
tgagagtctacctggagggcacgtgc

SEQ ID NO: 9150 - DNA, 27 bp, Artificial Sequence
  Description of Artificial Sequence: Synthetic oligonucleotide
agaccaccaagcacaagtgggaggcgt

SEQ ID NO: 9151 - DNA, 26 bp, Artificial Sequence
  Description of Artificial Sequence: Synthetic oligonucleotide
gaccaccaagcacaagtgggaggcgt

SEQ ID NO: 9152 - DNA, 26 bp, Artificial Sequence
  Description of Artificial Sequence: Synthetic oligonucleotide
accaccaagcacaagtgggaggcgtc

SEQ ID NO: 9153 - DNA, 25 bp, Artificial Sequence
  Description of Artificial Sequence: Synthetic oligonucleotide
ccaccaagcacaagtgggaggcgtc

SEQ ID NO: 9154 - DNA, 25 bp, Artificial Sequence
  Description of Artificial Sequence: Synthetic oligonucleotide
caccaagcacaagtgggaggcgtcc

SEQ ID NO: 9155 - DNA, 27 bp, Artificial Sequence
  Description of Artificial Sequence: Synthetic oligonucleotide
accaagcacaagtgggaggcgtcccat

SEQ ID NO: 9156 - DNA, 26 bp, Artificial Sequence
  Description of Artificial Sequence: Synthetic oligonucleotide
ccaagcacaagtgggaggcgtcccat

SEQ ID NO: 9157 - DNA, 27 bp, Artificial Sequence
  Description of Artificial Sequence: Synthetic oligonucleotide
caagcacaagtgggaggcgtcccatgt

SEQ ID NO: 9158 - DNA, 27 bp, Artificial Sequence
  Description of Artificial Sequence: Synthetic oligonucleotide
aagcacaagtgggaggcgtcccatgtg

SEQ ID NO: 9159 - DNA, 26 bp, Artificial Sequence
  Description of Artificial Sequence: Synthetic oligonucleotide
agcacaagtgggaggcgtcccatgtg

SEQ ID NO: 9160 - DNA, 25 bp, Artificial Sequence
  Description of Artificial Sequence: Synthetic oligonucleotide
gcacaagtgggaggcgtcccatgtg

SEQ ID NO: 9161 - DNA, 25 bp, Artificial Sequence
  Description of Artificial Sequence: Synthetic oligonucleotide
cacaagtgggaggcgtcccatgtgg

SEQ ID NO: 9162 - DNA, 25 bp, Artificial Sequence
  Description of Artificial Sequence: Synthetic oligonucleotide
acaagtgggaggcgtcccatgtggc

SEQ ID NO: 9163 - DNA, 24 bp, Artificial Sequence
  Description of Artificial Sequence: Synthetic oligonucleotide
caagtgggaggcgtcccatgtggc

SEQ ID NO: 9164 - DNA, 24 bp, Artificial Sequence
  Description of Artificial Sequence: Synthetic oligonucleotide
aagtgggaggcgtcccatgtggcg

SEQ ID NO: 9165 - DNA, 23 bp, Artificial Sequence
  Description of Artificial Sequence: Synthetic oligonucleotide
agtgggaggcgtcccatgtggcg

SEQ ID NO: 9166 - DNA, 22 bp, Artificial Sequence
  Description of Artificial Sequence: Synthetic oligonucleotide
gtgggaggcgtcccatgtggcg

SEQ ID NO: 9167 - DNA, 23 bp, Artificial Sequence
  Description of Artificial Sequence: Synthetic oligonucleotide
tgggaggcgtcccatgtggcgga

SEQ ID NO: 9168 - DNA, 22 bp, Artificial Sequence
  Description of Artificial Sequence: Synthetic oligonucleotide
gggaggcgtcccatgtggcgga

SEQ ID NO: 9169 - DNA, 22 bp, Artificial Sequence
  Description of Artificial Sequence: Synthetic oligonucleotide
ggaggcgtcccatgtggcggag

SEQ ID NO: 9170 - DNA, 23 bp, Artificial Sequence
  Description of Artificial Sequence: Synthetic oligonucleotide
gaggcgtcccatgtggcggagca

SEQ ID NO: 9171 - DNA, 25 bp, Artificial Sequence
  Description of Artificial Sequence: Synthetic oligonucleotide
aggcgtcccatgtggcggagcagtt

SEQ ID NO: 9172 - DNA, 24 bp, Artificial Sequence
  Description of Artificial Sequence: Synthetic oligonucleotide
ggcgtcccatgtggcggagcagtt

SEQ ID NO: 9173 - DNA, 25 bp, Artificial Sequence
  Description of Artificial Sequence: Synthetic oligonucleotide
gcgtcccatgtggcggagcagttga

SEQ ID NO: 9174 - DNA, 26 bp, Artificial Sequence
  Description of Artificial Sequence: Synthetic oligonucleotide
cgtcccatgtggcggagcagttgaga

SEQ ID NO: 9175 - DNA, 26 bp, Artificial Sequence
  Description of Artificial Sequence: Synthetic oligonucleotide
gtcccatgtggcggagcagttgagag

SEQ ID NO: 9176 - DNA, 26 bp, Artificial Sequence
  Description of Artificial Sequence: Synthetic oligonucleotide
tcccatgtggcggagcagttgagagc

SEQ ID NO: 9177 - DNA, 30 bp, Artificial Sequence
  Description of Artificial Sequence: Synthetic oligonucleotide
ccaaaacgcatatgactcaccacgctgtcc

SEQ ID NO: 9178 - DNA, 30 bp, Artificial Sequence
  Description of Artificial Sequence: Synthetic oligonucleotide
caaaacgcatatgactcaccacgctgtccc

SEQ ID NO: 9179 - DNA, 31 bp, Artificial Sequence
  Description of Artificial Sequence: Synthetic oligonucleotide
aaaacgcatatgactcaccacgctgtccctg

SEQ ID NO: 9180 - DNA, 30 bp, Artificial Sequence
  Description of Artificial Sequence: Synthetic oligonucleotide
aaacgcatatgactcaccacgctgtccctg

SEQ ID NO: 9181 - DNA, 29 bp, Artificial Sequence
  Description of Artificial Sequence: Synthetic oligonucleotide
aacgcatatgactcaccacgctgtccctg

SEQ ID NO: 9182 - DNA, 28 bp, Artificial Sequence
  Description of Artificial Sequence: Synthetic oligonucleotide
acgcatatgactcaccacgctgtccctg

SEQ ID NO: 9183 - DNA, 27 bp, Artificial Sequence
  Description of Artificial Sequence: Synthetic oligonucleotide
cgcatatgactcaccacgctgtccctg

SEQ ID NO: 9184 - DNA, 28 bp, Artificial Sequence
  Description of Artificial Sequence: Synthetic oligonucleotide
gcatatgactcaccacgctgtccctgac

SEQ ID NO: 9185 - DNA, 28 bp, Artificial Sequence
  Description of Artificial Sequence: Synthetic oligonucleotide
catatgactcaccacgctgtccctgacc

SEQ ID NO: 9186 - DNA, 30 bp, Artificial Sequence
  Description of Artificial Sequence: Synthetic oligonucleotide
atatgactcaccacgctgtccctgaccatg

SEQ ID NO: 9187 - DNA, 29 bp, Artificial Sequence
  Description of Artificial Sequence: Synthetic oligonucleotide
tatgactcaccacgctgtccctgaccatg

SEQ ID NO: 9188 - DNA, 28 bp, Artificial Sequence
  Description of Artificial Sequence: Synthetic oligonucleotide
atgactcaccacgctgtccctgaccatg

SEQ ID NO: 9189 - DNA, 27 bp, Artificial Sequence
  Description of Artificial Sequence: Synthetic oligonucleotide
tgactcaccacgctgtccctgaccatg

SEQ ID NO: 9190 - DNA, 27 bp, Artificial Sequence
  Description of Artificial Sequence: Synthetic oligonucleotide
gactcaccacgctgtccctgaccatga

SEQ ID NO: 9191 - DNA, 28 bp, Artificial Sequence
  Description of Artificial Sequence: Synthetic oligonucleotide
actcaccacgctgtccctgaccatgaag

SEQ ID NO: 9192 - DNA, 27 bp, Artificial Sequence
  Description of Artificial Sequence: Synthetic oligonucleotide
ctcaccacgctgtccctgaccatgaag

SEQ ID NO: 9193 - DNA, 27 bp, Artificial Sequence
  Description of Artificial Sequence: Synthetic oligonucleotide
tcaccacgctgtccctgaccatgaagc

SEQ ID NO: 9194 - DNA, 26 bp, Artificial Sequence
  Description of Artificial Sequence: Synthetic oligonucleotide
caccacgctgtccctgaccatgaagc

SEQ ID NO: 9195 - DNA, 27 bp, Artificial Sequence
  Description of Artificial Sequence: Synthetic oligonucleotide
accacgctgtccctgaccatgaagcca

SEQ ID NO: 9196 - DNA, 26 bp, Artificial Sequence
  Description of Artificial Sequence: Synthetic oligonucleotide
ccacgctgtccctgaccatgaagcca

SEQ ID NO: 9197 - DNA, 26 bp, Artificial Sequence
  Description of Artificial Sequence: Synthetic oligonucleotide
cacgctgtccctgaccatgaagccac

SEQ ID NO: 9198 - DNA, 26 bp, Artificial Sequence
  Description of Artificial Sequence: Synthetic oligonucleotide
acgctgtccctgaccatgaagccacc

SEQ ID NO: 9199 - DNA, 25 bp, Artificial Sequence
  Description of Artificial Sequence: Synthetic oligonucleotide
cgctgtccctgaccatgaagccacc

SEQ ID NO: 9200 - DNA, 26 bp, Artificial Sequence
  Description of Artificial Sequence: Synthetic oligonucleotide
gctgtccctgaccatgaagccaccct

SEQ ID NO: 9201 - DNA, 27 bp, Artificial Sequence
  Description of Artificial Sequence: Synthetic oligonucleotide
ctgtccctgaccatgaagccaccctga

SEQ ID NO: 9202 - DNA, 27 bp, Artificial Sequence
  Description of Artificial Sequence: Synthetic oligonucleotide
tgtccctgaccatgaagccaccctgag

SEQ ID NO: 9203 - DNA, 26 bp, Artificial Sequence
  Description of Artificial Sequence: Synthetic oligonucleotide
gtccctgaccatgaagccaccctgag

SEQ ID NO: 9204 - DNA, 27 bp, Artificial Sequence
  Description of Artificial Sequence: Synthetic oligonucleotide
tccctgaccatgaagccaccctgaggt

SEQ ID NO: 9205 - DNA, 26 bp, Artificial Sequence
  Description of Artificial Sequence: Synthetic oligonucleotide
ccctgaccatgaagccaccctgaggt

SEQ ID NO: 9206 - DNA, 26 bp, Artificial Sequence
  Description of Artificial Sequence: Synthetic oligonucleotide
cctgaccatgaagccaccctgaggtg

SEQ ID NO: 9207 - DNA, 28 bp, Artificial Sequence
  Description of Artificial Sequence: Synthetic oligonucleotide
tgagcttctaccctgcggagatcacacg

SEQ ID NO: 9208 - DNA, 27 bp, Artificial Sequence
  Description of Artificial Sequence: Synthetic oligonucleotide
gagcttctaccctgcggagatcacacg

SEQ ID NO: 9209 - DNA, 27 bp, Artificial Sequence
  Description of Artificial Sequence: Synthetic oligonucleotide
agcttctaccctgcggagatcacacgg

SEQ ID NO: 9210 - DNA, 27 bp, Artificial Sequence
  Description of Artificial Sequence: Synthetic oligonucleotide
gcttctaccctgcggagatcacacgga

SEQ ID NO: 9211 - DNA, 27 bp, Artificial Sequence
  Description of Artificial Sequence: Synthetic oligonucleotide
cttctaccctgcggagatcacacggac

SEQ ID NO: 9212 - DNA, 27 bp, Artificial Sequence
  Description of Artificial Sequence: Synthetic oligonucleotide
ttctaccctgcggagatcacacggacc

SEQ ID NO: 9213 - DNA, 27 bp, Artificial Sequence
  Description of Artificial Sequence: Synthetic oligonucleotide
tctaccctgcggagatcacacggacct

SEQ ID NO: 9214 - DNA, 26 bp, Artificial Sequence
  Description of Artificial Sequence: Synthetic oligonucleotide
ctaccctgcggagatcacacggacct

SEQ ID NO: 9215 - DNA, 26 bp, Artificial Sequence
  Description of Artificial Sequence: Synthetic oligonucleotide
taccctgcggagatcacacggacctg

SEQ ID NO: 9216 - DNA, 25 bp, Artificial Sequence
  Description of Artificial Sequence: Synthetic oligonucleotide
accctgcggagatcacacggacctg

SEQ ID NO: 9217 - DNA, 24 bp, Artificial Sequence
  Description of Artificial Sequence: Synthetic oligonucleotide
ccctgcggagatcacacggacctg

SEQ ID NO: 9218 - DNA, 24 bp, Artificial Sequence
  Description of Artificial Sequence: Synthetic oligonucleotide
cctgcggagatcacacggacctgg

SEQ ID NO: 9219 - DNA, 25 bp, Artificial Sequence
  Description of Artificial Sequence: Synthetic oligonucleotide
ctgcggagatcacacggacctggca

SEQ ID NO: 9220 - DNA, 25 bp, Artificial Sequence
  Description of Artificial Sequence: Synthetic oligonucleotide
tgcggagatcacacggacctggcag

SEQ ID NO: 9221 - DNA, 24 bp, Artificial Sequence
  Description of Artificial Sequence: Synthetic oligonucleotide
gcggagatcacacggacctggcag

SEQ ID NO: 9222 - DNA, 24 bp, Artificial Sequence
  Description of Artificial Sequence: Synthetic oligonucleotide
cggagatcacacggacctggcagc

SEQ ID NO: 9223 - DNA, 24 bp, Artificial Sequence
  Description of Artificial Sequence: Synthetic oligonucleotide
ggagatcacacggacctggcagcg

SEQ ID NO: 9224 - DNA, 24 bp, Artificial Sequence
  Description of Artificial Sequence: Synthetic oligonucleotide
gagatcacacggacctggcagcgg

SEQ ID NO: 9225 - DNA, 26 bp, Artificial Sequence
  Description of Artificial Sequence: Synthetic oligonucleotide
agatcacacggacctggcagcgggat

SEQ ID NO: 9226 - DNA, 25 bp, Artificial Sequence
  Description of Artificial Sequence: Synthetic oligonucleotide
gatcacacggacctggcagcgggat

SEQ ID NO: 9227 - DNA, 25 bp, Artificial Sequence
  Description of Artificial Sequence: Synthetic oligonucleotide
atcacacggacctggcagcgggatg

SEQ ID NO: 9228 - DNA, 24 bp, Artificial Sequence
  Description of Artificial Sequence: Synthetic oligonucleotide
tcacacggacctggcagcgggatg

SEQ ID NO: 9229 - DNA, 23 bp, Artificial Sequence
  Description of Artificial Sequence: Synthetic oligonucleotide
cacacggacctggcagcgggatg

SEQ ID NO: 9230 - DNA, 23 bp, Artificial Sequence
  Description of Artificial Sequence: Synthetic oligonucleotide
acacggacctggcagcgggatgg

SEQ ID NO: 9231 - DNA, 22 bp, Artificial Sequence
  Description of Artificial Sequence: Synthetic oligonucleotide
cacggacctggcagcgggatgg

SEQ ID NO: 9232 - DNA, 22 bp, Artificial Sequence
  Description of Artificial Sequence: Synthetic oligonucleotide
acggacctggcagcgggatggg

SEQ ID NO: 9233 - DNA, 21 bp, Artificial Sequence
  Description of Artificial Sequence: Synthetic oligonucleotide
cggacctggcagcgggatggg

SEQ ID NO: 9234 - DNA, 22 bp, Artificial Sequence
  Description of Artificial Sequence: Synthetic oligonucleotide
ggacctggcagcgggatgggga

SEQ ID NO: 9235 - DNA, 30 bp, Artificial Sequence
  Description of Artificial Sequence: Synthetic oligonucleotide
acggacgcccccaaaacgcatatgactaac

SEQ ID NO: 9236 - DNA, 29 bp, Artificial Sequence
  Description of Artificial Sequence: Synthetic oligonucleotide
cggacgcccccaaaacgcatatgactaac

SEQ ID NO: 9237 - DNA, 29 bp, Artificial Sequence
  Description of Artificial Sequence: Synthetic oligonucleotide
ggacgcccccaaaacgcatatgactaacc

SEQ ID NO: 9238 - DNA, 30 bp, Artificial Sequence
  Description of Artificial Sequence: Synthetic oligonucleotide
gacgcccccaaaacgcatatgactaaccac

SEQ ID NO: 9239 - DNA, 30 bp, Artificial Sequence
  Description of Artificial Sequence: Synthetic oligonucleotide
acgcccccaaaacgcatatgactaaccacg

SEQ ID NO: 9240 - DNA, 29 bp, Artificial Sequence
  Description of Artificial Sequence: Synthetic oligonucleotide
cgcccccaaaacgcatatgactaaccacg

SEQ ID NO: 9241 - DNA, 29 bp, Artificial Sequence
  Description of Artificial Sequence: Synthetic oligonucleotide
gcccccaaaacgcatatgactaaccacgc

SEQ ID NO: 9242 - DNA, 30 bp, Artificial Sequence
  Description of Artificial Sequence: Synthetic oligonucleotide
cccccaaaacgcatatgactaaccacgctg

SEQ ID NO: 9243 - DNA, 31 bp, Artificial Sequence
  Description of Artificial Sequence: Synthetic oligonucleotide
ccccaaaacgcatatgactaaccacgctgtc

SEQ ID NO: 9244 - DNA, 32 bp, Artificial Sequence
  Description of Artificial Sequence: Synthetic oligonucleotide
cccaaaacgcatatgactaaccacgctgtctc

SEQ ID NO: 9245 - DNA, 33 bp, Artificial Sequence
  Description of Artificial Sequence: Synthetic oligonucleotide
ccaaaacgcatatgactaaccacgctgtctctg

SEQ ID NO: 9246 - DNA, 34 bp, Artificial Sequence
  Description of Artificial Sequence: Synthetic oligonucleotide
caaaacgcatatgactaaccacgctgtctctgac

SEQ ID NO: 9247 - DNA, 34 bp, Artificial Sequence
  Description of Artificial Sequence: Synthetic oligonucleotide
aaaacgcatatgactaaccacgctgtctctgacc

SEQ ID NO: 9248 - DNA, 33 bp, Artificial Sequence
  Description of Artificial Sequence: Synthetic oligonucleotide
aaacgcatatgactaaccacgctgtctctgacc

SEQ ID NO: 9249 - DNA, 32 bp, Artificial Sequence
  Description of Artificial Sequence: Synthetic oligonucleotide
aacgcatatgactaaccacgctgtctctgacc

SEQ ID NO: 9250 - DNA, 31 bp, Artificial Sequence
  Description of Artificial Sequence: Synthetic oligonucleotide
acgcatatgactaaccacgctgtctctgacc

SEQ ID NO: 9251 - DNA, 30 bp, Artificial Sequence
  Description of Artificial Sequence: Synthetic oligonucleotide
cgcatatgactaaccacgctgtctctgacc

SEQ ID NO: 9252 - DNA, 32 bp, Artificial Sequence
  Description of Artificial Sequence: Synthetic oligonucleotide
gcatatgactaaccacgctgtctctgaccatg

SEQ ID NO: 9253 - DNA, 34 bp, Artificial Sequence
  Description of Artificial Sequence: Synthetic oligonucleotide
catatgactaaccacgctgtctctgaccatgaag

SEQ ID NO: 9254 - DNA, 34 bp, Artificial Sequence
  Description of Artificial Sequence: Synthetic oligonucleotide
atatgactaaccacgctgtctctgaccatgaagc

SEQ ID NO: 9255 - DNA, 33 bp, Artificial Sequence
  Description of Artificial Sequence: Synthetic oligonucleotide
tatgactaaccacgctgtctctgaccatgaagc

SEQ ID NO: 9256 - DNA, 32 bp, Artificial Sequence
  Description of Artificial Sequence: Synthetic oligonucleotide
atgactaaccacgctgtctctgaccatgaagc

SEQ ID NO: 9257 - DNA, 31 bp, Artificial Sequence
  Description of Artificial Sequence: Synthetic oligonucleotide
tgactaaccacgctgtctctgaccatgaagc

SEQ ID NO: 9258 - DNA, 30 bp, Artificial Sequence
  Description of Artificial Sequence: Synthetic oligonucleotide
gactaaccacgctgtctctgaccatgaagc

SEQ ID NO: 9259 - DNA, 30 bp, Artificial Sequence
  Description of Artificial Sequence: Synthetic oligonucleotide
actaaccacgctgtctctgaccatgaagcc

SEQ ID NO: 9260 - DNA, 29 bp, Artificial Sequence
  Description of Artificial Sequence: Synthetic oligonucleotide
ctaaccacgctgtctctgaccatgaagcc

SEQ ID NO: 9261 - DNA, 30 bp, Artificial Sequence
  Description of Artificial Sequence: Synthetic oligonucleotide
taaccacgctgtctctgaccatgaagccac

SEQ ID NO: 9262 - DNA, 29 bp, Artificial Sequence
  Description of Artificial Sequence: Synthetic oligonucleotide
aaccacgctgtctctgaccatgaagccac

SEQ ID NO: 9263 - DNA, 25 bp, Artificial Sequence
  Description of Artificial Sequence: Synthetic oligonucleotide
aagcacaagtgggaggcggcccatg

SEQ ID NO: 9264 - DNA, 24 bp, Artificial Sequence
  Description of Artificial Sequence: Synthetic oligonucleotide
agcacaagtgggaggcggcccatg

SEQ ID NO: 9265 - DNA, 23 bp, Artificial Sequence
  Description of Artificial Sequence: Synthetic oligonucleotide
gcacaagtgggaggcggcccatg

SEQ ID NO: 9266 - DNA, 23 bp, Artificial Sequence
  Description of Artificial Sequence: Synthetic oligonucleotide
cacaagtgggaggcggcccatgc

SEQ ID NO: 9267 - DNA, 23 bp, Artificial Sequence
  Description of Artificial Sequence: Synthetic oligonucleotide
acaagtgggaggcggcccatgcg

SEQ ID NO: 9268 - DNA, 21 bp, Artificial Sequence
  Description of Artificial Sequence: Synthetic oligonucleotide
ggcccatgcggcggagcagca

SEQ ID NO: 9269 - DNA, 22 bp, Artificial Sequence
  Description of Artificial Sequence: Synthetic oligonucleotide
gcccatgcggcggagcagcaga

SEQ ID NO: 9270 - DNA, 23 bp, Artificial Sequence
  Description of Artificial Sequence: Synthetic oligonucleotide
cccatgcggcggagcagcagaga

SEQ ID NO: 9271 - DNA, 23 bp, Artificial Sequence
  Description of Artificial Sequence: Synthetic oligonucleotide
ccatgcggcggagcagcagagag

SEQ ID NO: 9272 - DNA, 23 bp, Artificial Sequence
  Description of Artificial Sequence: Synthetic oligonucleotide
catgcggcggagcagcagagagc

SEQ ID NO: 9273 - DNA, 25 bp, Artificial Sequence
  Description of Artificial Sequence: Synthetic oligonucleotide
atgcggcggagcagcagagagccta

SEQ ID NO: 9274 - DNA, 24 bp, Artificial Sequence
  Description of Artificial Sequence: Synthetic oligonucleotide
tgcggcggagcagcagagagccta

SEQ ID NO: 9275 - DNA, 23 bp, Artificial Sequence
  Description of Artificial Sequence: Synthetic oligonucleotide
gcggcggagcagcagagagccta

SEQ ID NO: 9276 - DNA, 23 bp, Artificial Sequence
  Description of Artificial Sequence: Synthetic oligonucleotide
cggcggagcagcagagagcctac

SEQ ID NO: 9277 - DNA, 25 bp, Artificial Sequence
  Description of Artificial Sequence: Synthetic oligonucleotide
ggagtattgggacggggagacacgg

SEQ ID NO: 9278 - DNA, 27 bp, Artificial Sequence
  Description of Artificial Sequence: Synthetic oligonucleotide
gagtattgggacggggagacacggcaa

SEQ ID NO: 9279 - DNA, 27 bp, Artificial Sequence
  Description of Artificial Sequence: Synthetic oligonucleotide
agtattgggacggggagacacggcaag

SEQ ID NO: 9280 - DNA, 27 bp, Artificial Sequence
  Description of Artificial Sequence: Synthetic oligonucleotide
gtattgggacggggagacacggcaagt

SEQ ID NO: 9281 - DNA, 27 bp, Artificial Sequence
  Description of Artificial Sequence: Synthetic oligonucleotide
tattgggacggggagacacggcaagtg

SEQ ID NO: 9282 - DNA, 27 bp, Artificial Sequence
  Description of Artificial Sequence: Synthetic oligonucleotide
attgggacggggagacacggcaagtga

SEQ ID NO: 9283 - DNA, 27 bp, Artificial Sequence
  Description of Artificial Sequence: Synthetic oligonucleotide
ttgggacggggagacacggcaagtgaa

SEQ ID NO: 9284 - DNA, 26 bp, Artificial Sequence
  Description of Artificial Sequence: Synthetic oligonucleotide
tgggacggggagacacggcaagtgaa

SEQ ID NO: 9285 - DNA, 25 bp, Artificial Sequence
  Description of Artificial Sequence: Synthetic oligonucleotide
gggacggggagacacggcaagtgaa

SEQ ID NO: 9286 - DNA, 25 bp, Artificial Sequence
  Description of Artificial Sequence: Synthetic oligonucleotide
ggacggggagacacggcaagtgaag

SEQ ID NO: 9287 - DNA, 25 bp, Artificial Sequence
  Description of Artificial Sequence: Synthetic oligonucleotide
gacggggagacacggcaagtgaagg

SEQ ID NO: 9288 - DNA, 25 bp, Artificial Sequence
  Description of Artificial Sequence: Synthetic oligonucleotide
acggggagacacggcaagtgaaggc

SEQ ID NO: 9289 - DNA, 24 bp, Artificial Sequence
  Description of Artificial Sequence: Synthetic oligonucleotide
cggggagacacggcaagtgaaggc

SEQ ID NO: 9290 - DNA, 24 bp, Artificial Sequence
  Description of Artificial Sequence: Synthetic oligonucleotide
ggggagacacggcaagtgaaggcc

SEQ ID NO: 9291 - DNA, 25 bp, Artificial Sequence
  Description of Artificial Sequence: Synthetic oligonucleotide
gggagacacggcaagtgaaggccca

SEQ ID NO: 9292 - DNA, 26 bp, Artificial Sequence
  Description of Artificial Sequence: Synthetic oligonucleotide
ggagacacggcaagtgaaggcccact

SEQ ID NO: 9293 - DNA, 27 bp, Artificial Sequence
  Description of Artificial Sequence: Synthetic oligonucleotide
gagacacggcaagtgaaggcccactca

SEQ ID NO: 9294 - DNA, 27 bp, Artificial Sequence
  Description of Artificial Sequence: Synthetic oligonucleotide
agacacggcaagtgaaggcccactcac

SEQ ID NO: 9295 - DNA, 27 bp, Artificial Sequence
  Description of Artificial Sequence: Synthetic oligonucleotide
gacacggcaagtgaaggcccactcaca

SEQ ID NO: 9296 - DNA, 27 bp, Artificial Sequence
  Description of Artificial Sequence: Synthetic oligonucleotide
acacggcaagtgaaggcccactcacag

SEQ ID NO: 9297 - DNA, 27 bp, Artificial Sequence
  Description of Artificial Sequence: Synthetic oligonucleotide
cacggcaagtgaaggcccactcacaga

SEQ ID NO: 9298 - DNA, 27 bp, Artificial Sequence
  Description of Artificial Sequence: Synthetic oligonucleotide
acggcaagtgaaggcccactcacagac

SEQ ID NO: 9299 - DNA, 27 bp, Artificial Sequence
  Description of Artificial Sequence: Synthetic oligonucleotide
cggcaagtgaaggcccactcacagact

SEQ ID NO: 9300 - DNA, 27 bp, Artificial Sequence
  Description of Artificial Sequence: Synthetic oligonucleotide
ggcaagtgaaggcccactcacagactc

SEQ ID NO: 9301 - DNA, 28 bp, Artificial Sequence
  Description of Artificial Sequence: Synthetic oligonucleotide
gcaagtgaaggcccactcacagactcac

SEQ ID NO: 9302 - DNA, 28 bp, Artificial Sequence
  Description of Artificial Sequence: Synthetic oligonucleotide
caagtgaaggcccactcacagactcacc

SEQ ID NO: 9303 - DNA, 23 bp, Artificial Sequence
  Description of Artificial Sequence: Synthetic oligonucleotide
ccagacctgggcgggctctcagt

SEQ ID NO: 9304 - DNA, 23 bp, Artificial Sequence
  Description of Artificial Sequence: Synthetic oligonucleotide
cagacctgggcgggctctcagtc

SEQ ID NO: 9305 - DNA, 25 bp, Artificial Sequence
  Description of Artificial Sequence: Synthetic oligonucleotide
agacctgggcgggctctcagtccat

SEQ ID NO: 9306 - DNA, 24 bp, Artificial Sequence
  Description of Artificial Sequence: Synthetic oligonucleotide
gacctgggcgggctctcagtccat

SEQ ID NO: 9307 - DNA, 25 bp, Artificial Sequence
  Description of Artificial Sequence: Synthetic oligonucleotide
acctgggcgggctctcagtccatga

SEQ ID NO: 9308 - DNA, 24 bp, Artificial Sequence
  Description of Artificial Sequence: Synthetic oligonucleotide
cctgggcgggctctcagtccatga

SEQ ID NO: 9309 - DNA, 24 bp, Artificial Sequence
  Description of Artificial Sequence: Synthetic oligonucleotide
ctgggcgggctctcagtccatgag

SEQ ID NO: 9310 - DNA, 27 bp, Artificial Sequence
  Description of Artificial Sequence: Synthetic oligonucleotide
tgggcgggctctcagtccatgaggtat

SEQ ID NO: 9311 - DNA, 27 bp, Artificial Sequence
  Description of Artificial Sequence: Synthetic oligonucleotide
gggcgggctctcagtccatgaggtatt

SEQ ID NO: 9312 - DNA, 28 bp, Artificial Sequence
  Description of Artificial Sequence: Synthetic oligonucleotide
ggcgggctctcagtccatgaggtatttc

SEQ ID NO: 9313 - DNA, 30 bp, Artificial Sequence
  Description of Artificial Sequence: Synthetic oligonucleotide
gcgggctctcagtccatgaggtatttcttc

SEQ ID NO: 9314 - DNA, 31 bp, Artificial Sequence
  Description of Artificial Sequence: Synthetic oligonucleotide
cgggctctcagtccatgaggtatttcttcac

SEQ ID NO: 9315 - DNA, 33 bp, Artificial Sequence
  Description of Artificial Sequence: Synthetic oligonucleotide
gggctctcagtccatgaggtatttcttcacatc

SEQ ID NO: 9316 - DNA, 33 bp, Artificial Sequence
  Description of Artificial Sequence: Synthetic oligonucleotide
ggctctcagtccatgaggtatttcttcacatcc

SEQ ID NO: 9317 - DNA, 33 bp, Artificial Sequence
  Description of Artificial Sequence: Synthetic oligonucleotide
gctctcagtccatgaggtatttcttcacatccg

SEQ ID NO: 9318 - DNA, 34 bp, Artificial Sequence
  Description of Artificial Sequence: Synthetic oligonucleotide
ctctcagtccatgaggtatttcttcacatccgtg

SEQ ID NO: 9319 - DNA, 35 bp, Artificial Sequence
  Description of Artificial Sequence: Synthetic oligonucleotide
tctcagtccatgaggtatttcttcacatccgtgtc

SEQ ID NO: 9320 - DNA, 34 bp, Artificial Sequence
  Description of Artificial Sequence: Synthetic oligonucleotide
ctcagtccatgaggtatttcttcacatccgtgtc

SEQ ID NO: 9321 - DNA, 34 bp, Artificial Sequence
  Description of Artificial Sequence: Synthetic oligonucleotide
tcagtccatgaggtatttcttcacatccgtgtcc

SEQ ID NO: 9322 - DNA, 33 bp, Artificial Sequence
  Description of Artificial Sequence: Synthetic oligonucleotide
cagtccatgaggtatttcttcacatccgtgtcc

SEQ ID NO: 9323 - DNA, 33 bp, Artificial Sequence
  Description of Artificial Sequence: Synthetic oligonucleotide
agtccatgaggtatttcttcacatccgtgtccc

SEQ ID NO: 9324 - DNA, 32 bp, Artificial Sequence
  Description of Artificial Sequence: Synthetic oligonucleotide
gtccatgaggtatttcttcacatccgtgtccc

SEQ ID NO: 9325 - DNA, 22 bp, Artificial Sequence
  Description of Artificial Sequence: Synthetic oligonucleotide
tgcggttcgacagcgacgccgg

SEQ ID NO: 9326 - DNA, 21 bp, Artificial Sequence
  Description of Artificial Sequence: Synthetic oligonucleotide
gcggttcgacagcgacgccgg

SEQ ID NO: 9327 - DNA, 22 bp, Artificial Sequence
  Description of Artificial Sequence: Synthetic oligonucleotide
cggttcgacagcgacgccggga

SEQ ID NO: 9328 - DNA, 22 bp, Artificial Sequence
  Description of Artificial Sequence: Synthetic oligonucleotide
ggttcgacagcgacgccgggag

SEQ ID NO: 9329 - DNA, 22 bp, Artificial Sequence
  Description of Artificial Sequence: Synthetic oligonucleotide
gttcgacagcgacgccgggagc

SEQ ID NO: 9330 - DNA, 23 bp, Artificial Sequence
  Description of Artificial Sequence: Synthetic oligonucleotide
ttcgacagcgacgccgggagcca

SEQ ID NO: 9331 - DNA, 22 bp, Artificial Sequence
  Description of Artificial Sequence: Synthetic oligonucleotide
tcgacagcgacgccgggagcca

SEQ ID NO: 9332 - DNA, 21 bp, Artificial Sequence
  Description of Artificial Sequence: Synthetic oligonucleotide
cgacagcgacgccgggagcca

SEQ ID NO: 9333 - DNA, 22 bp, Artificial Sequence
  Description of Artificial Sequence: Synthetic oligonucleotide
gacagcgacgccgggagccaga

SEQ ID NO: 9334 - DNA, 22 bp, Artificial Sequence
  Description of Artificial Sequence: Synthetic oligonucleotide
acagcgacgccgggagccagag

SEQ ID NO: 9335 - DNA, 21 bp, Artificial Sequence
  Description of Artificial Sequence: Synthetic oligonucleotide
cagcgacgccgggagccagag

SEQ ID NO: 9336 - DNA, 23 bp, Artificial Sequence
  Description of Artificial Sequence: Synthetic oligonucleotide
agcgacgccgggagccagaggat

SEQ ID NO: 9337 - DNA, 22 bp, Artificial Sequence
  Description of Artificial Sequence: Synthetic oligonucleotide
gcgacgccgggagccagaggat

SEQ ID NO: 9338 - DNA, 22 bp, Artificial Sequence
  Description of Artificial Sequence: Synthetic oligonucleotide
cgacgccgggagccagaggatg

SEQ ID NO: 9339 - DNA, 23 bp, Artificial Sequence
  Description of Artificial Sequence: Synthetic oligonucleotide
gacgccgggagccagaggatgga

SEQ ID NO: 9340 - DNA, 23 bp, Artificial Sequence
  Description of Artificial Sequence: Synthetic oligonucleotide
acgccgggagccagaggatggag

SEQ ID NO: 9341 - DNA, 22 bp, Artificial Sequence
  Description of Artificial Sequence: Synthetic oligonucleotide
cgccgggagccagaggatggag

SEQ ID NO: 9342 - DNA, 22 bp, Artificial Sequence
  Description of Artificial Sequence: Synthetic oligonucleotide
gccgggagccagaggatggagc

SEQ ID NO: 9343 - DNA, 22 bp, Artificial Sequence
  Description of Artificial Sequence: Synthetic oligonucleotide
ccgggagccagaggatggagcc

SEQ ID NO: 9344 - DNA, 22 bp, Artificial Sequence
  Description of Artificial Sequence: Synthetic oligonucleotide
cgggagccagaggatggagccg

SEQ ID NO: 9345 - DNA, 22 bp, Artificial Sequence
  Description of Artificial Sequence: Synthetic oligonucleotide
gggagccagaggatggagccgc

SEQ ID NO: 9346 - DNA, 22 bp, Artificial Sequence
  Description of Artificial Sequence: Synthetic oligonucleotide
ggagccagaggatggagccgcg

SEQ ID NO: 9347 - DNA, 24 bp, Artificial Sequence
  Description of Artificial Sequence: Synthetic oligonucleotide
gaccgcggcggacatggcagctta

SEQ ID NO: 9348 - DNA, 25 bp, Artificial Sequence
  Description of Artificial Sequence: Synthetic oligonucleotide
accgcggcggacatggcagcttaga

SEQ ID NO: 9349 - DNA, 24 bp, Artificial Sequence
  Description of Artificial Sequence: Synthetic oligonucleotide
ccgcggcggacatggcagcttaga

SEQ ID NO: 9350 - DNA, 24 bp, Artificial Sequence
  Description of Artificial Sequence: Synthetic oligonucleotide
cgcggcggacatggcagcttagac

SEQ ID NO: 9351 - DNA, 25 bp, Artificial Sequence
  Description of Artificial Sequence: Synthetic oligonucleotide
gcggcggacatggcagcttagacca

SEQ ID NO: 9352 - DNA, 25 bp, Artificial Sequence
  Description of Artificial Sequence: Synthetic oligonucleotide
cggcggacatggcagcttagaccac

SEQ ID NO: 9353 - DNA, 27 bp, Artificial Sequence
  Description of Artificial Sequence: Synthetic oligonucleotide
ggcggacatggcagcttagaccaccaa

SEQ ID NO: 9354 - DNA, 27 bp, Artificial Sequence
  Description of Artificial Sequence: Synthetic oligonucleotide
gcggacatggcagcttagaccaccaag

SEQ ID NO: 9355 - DNA, 27 bp, Artificial Sequence
  Description of Artificial Sequence: Synthetic oligonucleotide
cggacatggcagcttagaccaccaagc

SEQ ID NO: 9356 - DNA, 28 bp, Artificial Sequence
  Description of Artificial Sequence: Synthetic oligonucleotide
ggacatggcagcttagaccaccaagcac

SEQ ID NO: 9357 - DNA, 30 bp, Artificial Sequence
  Description of Artificial Sequence: Synthetic oligonucleotide
gacatggcagcttagaccaccaagcacaag

SEQ ID NO: 9358 - DNA, 31 bp, Artificial Sequence
  Description of Artificial Sequence: Synthetic oligonucleotide
acatggcagcttagaccaccaagcacaagtg

SEQ ID NO: 9359 - DNA, 30 bp, Artificial Sequence
  Description of Artificial Sequence: Synthetic oligonucleotide
catggcagcttagaccaccaagcacaagtg

SEQ ID NO: 9360 - DNA, 30 bp, Artificial Sequence
  Description of Artificial Sequence: Synthetic oligonucleotide
atggcagcttagaccaccaagcacaagtgg

SEQ ID NO: 9361 - DNA, 29 bp, Artificial Sequence
  Description of Artificial Sequence: Synthetic oligonucleotide
tggcagcttagaccaccaagcacaagtgg

SEQ ID NO: 9362 - DNA, 28 bp, Artificial Sequence
  Description of Artificial Sequence: Synthetic oligonucleotide
ggcagcttagaccaccaagcacaagtgg

SEQ ID NO: 9363 - DNA, 28 bp, Artificial Sequence
  Description of Artificial Sequence: Synthetic oligonucleotide
gcagcttagaccaccaagcacaagtggg

SEQ ID NO: 9364 - DNA, 29 bp, Artificial Sequence
  Description of Artificial Sequence: Synthetic oligonucleotide
cagcttagaccaccaagcacaagtgggag

SEQ ID NO: 9365 - DNA, 29 bp, Artificial Sequence
  Description of Artificial Sequence: Synthetic oligonucleotide
agcttagaccaccaagcacaagtgggagg

SEQ ID NO: 9366 - DNA, 28 bp, Artificial Sequence
  Description of Artificial Sequence: Synthetic oligonucleotide
gcttagaccaccaagcacaagtgggagg

SEQ ID NO: 9367 - DNA, 28 bp, Artificial Sequence
  Description of Artificial Sequence: Synthetic oligonucleotide
cttagaccaccaagcacaagtgggaggc

SEQ ID NO: 9368 - DNA, 28 bp, Artificial Sequence
  Description of Artificial Sequence: Synthetic oligonucleotide
ttagaccaccaagcacaagtgggaggcg

SEQ ID NO: 9369 - DNA, 27 bp, Artificial Sequence
  Description of Artificial Sequence: Synthetic oligonucleotide
tagaccaccaagcacaagtgggaggcg

SEQ ID NO: 9370 - DNA, 27 bp, Artificial Sequence
  Description of Artificial Sequence: Synthetic oligonucleotide
cggttctcacaccgtccagaggatgtc

SEQ ID NO: 9371 - DNA, 28 bp, Artificial Sequence
  Description of Artificial Sequence: Synthetic oligonucleotide
ggttctcacaccgtccagaggatgtctg

SEQ ID NO: 9372 - DNA, 28 bp, Artificial Sequence
  Description of Artificial Sequence: Synthetic oligonucleotide
gttctcacaccgtccagaggatgtctgg

SEQ ID NO: 9373 - DNA, 28 bp, Artificial Sequence
  Description of Artificial Sequence: Synthetic oligonucleotide
ttctcacaccgtccagaggatgtctggc

SEQ ID NO: 9374 - DNA, 27 bp, Artificial Sequence
  Description of Artificial Sequence: Synthetic oligonucleotide
tctcacaccgtccagaggatgtctggc

SEQ ID NO: 9375 - DNA, 27 bp, Artificial Sequence
  Description of Artificial Sequence: Synthetic oligonucleotide
ctcacaccgtccagaggatgtctggct

SEQ ID NO: 9376 - DNA, 27 bp, Artificial Sequence
  Description of Artificial Sequence: Synthetic oligonucleotide
tcacaccgtccagaggatgtctggctg

SEQ ID NO: 9377 - DNA, 26 bp, Artificial Sequence
  Description of Artificial Sequence: Synthetic oligonucleotide
cacaccgtccagaggatgtctggctg

SEQ ID NO: 9378 - DNA, 26 bp, Artificial Sequence
  Description of Artificial Sequence: Synthetic oligonucleotide
acaccgtccagaggatgtctggctgc

SEQ ID NO: 9379 - DNA, 25 bp, Artificial Sequence
  Description of Artificial Sequence: Synthetic oligonucleotide
caccgtccagaggatgtctggctgc

SEQ ID NO: 9380 - DNA, 26 bp, Artificial Sequence
  Description of Artificial Sequence: Synthetic oligonucleotide
accgtccagaggatgtctggctgcga

SEQ ID NO: 9381 - DNA, 25 bp, Artificial Sequence
  Description of Artificial Sequence: Synthetic oligonucleotide
ccgtccagaggatgtctggctgcga

SEQ ID NO: 9382 - DNA, 25 bp, Artificial Sequence
  Description of Artificial Sequence: Synthetic oligonucleotide
cgtccagaggatgtctggctgcgac

SEQ ID NO: 9383 - DNA, 26 bp, Artificial Sequence
  Description of Artificial Sequence: Synthetic oligonucleotide
gtccagaggatgtctggctgcgacgt

SEQ ID NO: 9384 - DNA, 26 bp, Artificial Sequence
  Description of Artificial Sequence: Synthetic oligonucleotide
tccagaggatgtctggctgcgacgtg

SEQ ID NO: 9385 - DNA, 25 bp, Artificial Sequence
  Description of Artificial Sequence: Synthetic oligonucleotide
ccagaggatgtctggctgcgacgtg

SEQ ID NO: 9386 - DNA, 25 bp, Artificial Sequence
  Description of Artificial Sequence: Synthetic oligonucleotide
cagaggatgtctggctgcgacgtgg

SEQ ID NO: 9387 - DNA, 25 bp, Artificial Sequence
  Description of Artificial Sequence: Synthetic oligonucleotide
agaggatgtctggctgcgacgtggg

SEQ ID NO: 9388 - DNA, 24 bp, Artificial Sequence
  Description of Artificial Sequence: Synthetic oligonucleotide
gaggatgtctggctgcgacgtggg

SEQ ID NO: 9389 - DNA, 25 bp, Artificial Sequence
  Description of Artificial Sequence: Synthetic oligonucleotide
aggatgtctggctgcgacgtggggt

SEQ ID NO: 9390 - DNA, 24 bp, Artificial Sequence
  Description of Artificial Sequence: Synthetic oligonucleotide
ggatgtctggctgcgacgtggggt

SEQ ID NO: 9391 - DNA, 24 bp, Artificial Sequence
  Description of Artificial Sequence: Synthetic oligonucleotide
gatgtctggctgcgacgtggggtc

SEQ ID NO: 9392 - DNA, 24 bp, Artificial Sequence
  Description of Artificial Sequence: Synthetic oligonucleotide
atgtctggctgcgacgtggggtcg

SEQ ID NO: 9393 - DNA, 23 bp, Artificial Sequence
  Description of Artificial Sequence: Synthetic oligonucleotide
tgtctggctgcgacgtggggtcg

SEQ ID NO: 9394 - DNA, 22 bp, Artificial Sequence
  Description of Artificial Sequence: Synthetic oligonucleotide
gtctggctgcgacgtggggtcg

SEQ ID NO: 9395 - DNA, 23 bp, Artificial Sequence
  Description of Artificial Sequence: Synthetic oligonucleotide
tctggctgcgacgtggggtcgga

SEQ ID NO: 9396 - DNA, 22 bp, Artificial Sequence
  Description of Artificial Sequence: Synthetic oligonucleotide
ctggctgcgacgtggggtcgga

SEQ ID NO: 9397 - DNA, 27 bp, Artificial Sequence
  Description of Artificial Sequence: Synthetic oligonucleotide
gggagacacggaaagtgaaggcccagt

SEQ ID NO: 9398 - DNA, 27 bp, Artificial Sequence
  Description of Artificial Sequence: Synthetic oligonucleotide
ggagacacggaaagtgaaggcccagtc

SEQ ID NO: 9399 - DNA, 28 bp, Artificial Sequence
  Description of Artificial Sequence: Synthetic oligonucleotide
gagacacggaaagtgaaggcccagtcac

SEQ ID NO: 9400 - DNA, 29 bp, Artificial Sequence
  Description of Artificial Sequence: Synthetic oligonucleotide
agacacggaaagtgaaggcccagtcacag

SEQ ID NO: 9401 - DNA, 28 bp, Artificial Sequence
  Description of Artificial Sequence: Synthetic oligonucleotide
gacacggaaagtgaaggcccagtcacag

SEQ ID NO: 9402 - DNA, 29 bp, Artificial Sequence
  Description of Artificial Sequence: Synthetic oligonucleotide
acacggaaagtgaaggcccagtcacagac

SEQ ID NO: 9403 - DNA, 28 bp, Artificial Sequence
  Description of Artificial Sequence: Synthetic oligonucleotide
cacggaaagtgaaggcccagtcacagac

SEQ ID NO: 9404 - DNA, 29 bp, Artificial Sequence
  Description of Artificial Sequence: Synthetic oligonucleotide
acggaaagtgaaggcccagtcacagactc

SEQ ID NO: 9405 - DNA, 28 bp, Artificial Sequence
  Description of Artificial Sequence: Synthetic oligonucleotide
cggaaagtgaaggcccagtcacagactc

SEQ ID NO: 9406 - DNA, 29 bp, Artificial Sequence
  Description of Artificial Sequence: Synthetic oligonucleotide
ggaaagtgaaggcccagtcacagactcac

SEQ ID NO: 9407 - DNA, 29 bp, Artificial Sequence
  Description of Artificial Sequence: Synthetic oligonucleotide
gaaagtgaaggcccagtcacagactcacc

SEQ ID NO: 9408 - DNA, 29 bp, Artificial Sequence
  Description of Artificial Sequence: Synthetic oligonucleotide
aaagtgaaggcccagtcacagactcaccg

SEQ ID NO: 9409 - DNA, 28 bp, Artificial Sequence
  Description of Artificial Sequence: Synthetic oligonucleotide
aagtgaaggcccagtcacagactcaccg

SEQ ID NO: 9410 - DNA, 27 bp, Artificial Sequence
  Description of Artificial Sequence: Synthetic oligonucleotide
agtgaaggcccagtcacagactcaccg

SEQ ID NO: 9411 - DNA, 29 bp, Artificial Sequence
  Description of Artificial Sequence: Synthetic oligonucleotide
acggaaagtgaaggcccagtcacagactg

SEQ ID NO: 9412 - DNA, 28 bp, Artificial Sequence
  Description of Artificial Sequence: Synthetic oligonucleotide
cggaaagtgaaggcccagtcacagactg

SEQ ID NO: 9413 - DNA, 29 bp, Artificial Sequence
  Description of Artificial Sequence: Synthetic oligonucleotide
ggaaagtgaaggcccagtcacagactgac

SEQ ID NO: 9414 - DNA, 29 bp, Artificial Sequence
  Description of Artificial Sequence: Synthetic oligonucleotide
gaaagtgaaggcccagtcacagactgacc

SEQ ID NO: 9415 - DNA, 29 bp, Artificial Sequence
  Description of Artificial Sequence: Synthetic oligonucleotide
aaagtgaaggcccagtcacagactgaccg

SEQ ID NO: 9416 - DNA, 28 bp, Artificial Sequence
  Description of Artificial Sequence: Synthetic oligonucleotide
aagtgaaggcccagtcacagactgaccg

SEQ ID NO: 9417 - DNA, 27 bp, Artificial Sequence
  Description of Artificial Sequence: Synthetic oligonucleotide
agtgaaggcccagtcacagactgaccg

SEQ ID NO: 9418 - DNA, 27 bp, Artificial Sequence
  Description of Artificial Sequence: Synthetic oligonucleotide
gtgaaggcccagtcacagactgaccga

SEQ ID NO: 9419 - DNA, 23 bp, Artificial Sequence
  Description of Artificial Sequence: Synthetic oligonucleotide
acggcccatgaggcggagcagca

SEQ ID NO: 9420 - DNA, 24 bp, Artificial Sequence
  Description of Artificial Sequence: Synthetic oligonucleotide
cagcagagagcctacctggagggc

SEQ ID NO: 9421 - DNA, 24 bp, Artificial Sequence
  Description of Artificial Sequence: Synthetic oligonucleotide
agcagagagcctacctggagggcc

SEQ ID NO: 9422 - DNA, 23 bp, Artificial Sequence
  Description of Artificial Sequence: Synthetic oligonucleotide
gcagagagcctacctggagggcc

SEQ ID NO: 9423 - DNA, 23 bp, Artificial Sequence
  Description of Artificial Sequence: Synthetic oligonucleotide
cagagagcctacctggagggccg

SEQ ID NO: 9424 - DNA, 24 bp, Artificial Sequence
  Description of Artificial Sequence: Synthetic oligonucleotide
agagagcctacctggagggccggt

SEQ ID NO: 9425 - DNA, 27 bp, Artificial Sequence
  Description of Artificial Sequence: Synthetic oligonucleotide
ggacatggcggctcagatcaccaagca

SEQ ID NO: 9426 - DNA, 27 bp, Artificial Sequence
  Description of Artificial Sequence: Synthetic oligonucleotide
gacatggcggctcagatcaccaagcac

SEQ ID NO: 9427 - DNA, 29 bp, Artificial Sequence
  Description of Artificial Sequence: Synthetic oligonucleotide
acatggcggctcagatcaccaagcacaag

SEQ ID NO: 9428 - DNA, 28 bp, Artificial Sequence
  Description of Artificial Sequence: Synthetic oligonucleotide
catggcggctcagatcaccaagcacaag

SEQ ID NO: 9429 - DNA, 29 bp, Artificial Sequence
  Description of Artificial Sequence: Synthetic oligonucleotide
atggcggctcagatcaccaagcacaagtg

SEQ ID NO: 9430 - DNA, 28 bp, Artificial Sequence
  Description of Artificial Sequence: Synthetic oligonucleotide
tggcggctcagatcaccaagcacaagtg

SEQ ID NO: 9431 - DNA, 27 bp, Artificial Sequence
  Description of Artificial Sequence: Synthetic oligonucleotide
ggcggctcagatcaccaagcacaagtg

SEQ ID NO: 9432 - DNA, 27 bp, Artificial Sequence
  Description of Artificial Sequence: Synthetic oligonucleotide
gcggctcagatcaccaagcacaagtgg

SEQ ID NO: 9433 - DNA, 27 bp, Artificial Sequence
  Description of Artificial Sequence: Synthetic oligonucleotide
cggctcagatcaccaagcacaagtggg

SEQ ID NO: 9434 - DNA, 28 bp, Artificial Sequence
  Description of Artificial Sequence: Synthetic oligonucleotide
ggctcagatcaccaagcacaagtgggag

SEQ ID NO: 9435 - DNA, 28 bp, Artificial Sequence
  Description of Artificial Sequence: Synthetic oligonucleotide
gctcagatcaccaagcacaagtgggagg

SEQ ID NO: 9436 - DNA, 28 bp, Artificial Sequence
  Description of Artificial Sequence: Synthetic oligonucleotide
ctcagatcaccaagcacaagtgggaggc

SEQ ID NO: 9437 - DNA, 28 bp, Artificial Sequence
  Description of Artificial Sequence: Synthetic oligonucleotide
tcagatcaccaagcacaagtgggaggcg

SEQ ID NO: 9438 - DNA, 27 bp, Artificial Sequence
  Description of Artificial Sequence: Synthetic oligonucleotide
cagatcaccaagcacaagtgggaggcg

SEQ ID NO: 9439 - DNA, 27 bp, Artificial Sequence
  Description of Artificial Sequence: Synthetic oligonucleotide
agatcaccaagcacaagtgggaggcgg

SEQ ID NO: 9440 - DNA, 26 bp, Artificial Sequence
  Description of Artificial Sequence: Synthetic oligonucleotide
gatcaccaagcacaagtgggaggcgg

SEQ ID NO: 9441 - DNA, 26 bp, Artificial Sequence
  Description of Artificial Sequence: Synthetic oligonucleotide
atcaccaagcacaagtgggaggcggc

SEQ ID NO: 9442 - DNA, 25 bp, Artificial Sequence
  Description of Artificial Sequence: Synthetic oligonucleotide
tcaccaagcacaagtgggaggcggc

SEQ ID NO: 9443 - DNA, 25 bp, Artificial Sequence
  Description of Artificial Sequence: Synthetic oligonucleotide
gcttcctccgcgggtaccagcagta

SEQ ID NO: 9444 - DNA, 25 bp, Artificial Sequence
  Description of Artificial Sequence: Synthetic oligonucleotide
cttcctccgcgggtaccagcagtac

SEQ ID NO: 9445 - DNA, 25 bp, Artificial Sequence
  Description of Artificial Sequence: Synthetic oligonucleotide
ttcctccgcgggtaccagcagtacg

SEQ ID NO: 9446 - DNA, 24 bp, Artificial Sequence
  Description of Artificial Sequence: Synthetic oligonucleotide
tcctccgcgggtaccagcagtacg

SEQ ID NO: 9447 - DNA, 23 bp, Artificial Sequence
  Description of Artificial Sequence: Synthetic oligonucleotide
cctccgcgggtaccagcagtacg

SEQ ID NO: 9448 - DNA, 23 bp, Artificial Sequence
  Description of Artificial Sequence: Synthetic oligonucleotide
ctccgcgggtaccagcagtacgc

SEQ ID NO: 9449 - DNA, 25 bp, Artificial Sequence
  Description of Artificial Sequence: Synthetic oligonucleotide
tccgcgggtaccagcagtacgccta

SEQ ID NO: 9450 - DNA, 24 bp, Artificial Sequence
  Description of Artificial Sequence: Synthetic oligonucleotide
ccgcgggtaccagcagtacgccta

SEQ ID NO: 9451 - DNA, 24 bp, Artificial Sequence
  Description of Artificial Sequence: Synthetic oligonucleotide
cgcgggtaccagcagtacgcctac

SEQ ID NO: 9452 - DNA, 25 bp, Artificial Sequence
  Description of Artificial Sequence: Synthetic oligonucleotide
gcgggtaccagcagtacgcctacga

SEQ ID NO: 9453 - DNA, 25 bp, Artificial Sequence
  Description of Artificial Sequence: Synthetic oligonucleotide
cgggtaccagcagtacgcctacgac

SEQ ID NO: 9454 - DNA, 25 bp, Artificial Sequence
  Description of Artificial Sequence: Synthetic oligonucleotide
gggtaccagcagtacgcctacgacg

SEQ ID NO: 9455 - DNA, 25 bp, Artificial Sequence
  Description of Artificial Sequence: Synthetic oligonucleotide
ggtaccagcagtacgcctacgacgg

SEQ ID NO: 9456 - DNA, 27 bp, Artificial Sequence
  Description of Artificial Sequence: Synthetic oligonucleotide
gtaccagcagtacgcctacgacggcaa

SEQ ID NO: 9457 - DNA, 27 bp, Artificial Sequence
  Description of Artificial Sequence: Synthetic oligonucleotide
taccagcagtacgcctacgacggcaag

SEQ ID NO: 9458 - DNA, 26 bp, Artificial Sequence
  Description of Artificial Sequence: Synthetic oligonucleotide
accagcagtacgcctacgacggcaag

SEQ ID NO: 9459 - DNA, 25 bp, Artificial Sequence
  Description of Artificial Sequence: Synthetic oligonucleotide
ccagcagtacgcctacgacggcaag

SEQ ID NO: 9460 - DNA, 27 bp, Artificial Sequence
  Description of Artificial Sequence: Synthetic oligonucleotide
cagcagtacgcctacgacggcaaggat

SEQ ID NO: 9461 - DNA, 29 bp, Artificial Sequence
  Description of Artificial Sequence: Synthetic oligonucleotide
agcagtacgcctacgacggcaaggattac

SEQ ID NO: 9462 - DNA, 28 bp, Artificial Sequence
  Description of Artificial Sequence: Synthetic oligonucleotide
gcagtacgcctacgacggcaaggattac

SEQ ID NO: 9463 - DNA, 22 bp, Artificial Sequence
  Description of Artificial Sequence: Synthetic oligonucleotide
cgcggggagccccgcttcatct

SEQ ID NO: 9464 - DNA, 23 bp, Artificial Sequence
  Description of Artificial Sequence: Synthetic oligonucleotide
gcggggagccccgcttcatctca

SEQ ID NO: 9465 - DNA, 24 bp, Artificial Sequence
  Description of Artificial Sequence: Synthetic oligonucleotide
cggggagccccgcttcatctcagt

SEQ ID NO: 9466 - DNA, 24 bp, Artificial Sequence
  Description of Artificial Sequence: Synthetic oligonucleotide
ggggagccccgcttcatctcagtg

SEQ ID NO: 9467 - DNA, 24 bp, Artificial Sequence
  Description of Artificial Sequence: Synthetic oligonucleotide
gggagccccgcttcatctcagtgg

SEQ ID NO: 9468 - DNA, 24 bp, Artificial Sequence
  Description of Artificial Sequence: Synthetic oligonucleotide
ggagccccgcttcatctcagtggg

SEQ ID NO: 9469 - DNA, 26 bp, Artificial Sequence
  Description of Artificial Sequence: Synthetic oligonucleotide
gagccccgcttcatctcagtgggcta

SEQ ID NO: 9470 - DNA, 26 bp, Artificial Sequence
  Description of Artificial Sequence: Synthetic oligonucleotide
agccccgcttcatctcagtgggctac

SEQ ID NO: 9471 - DNA, 25 bp, Artificial Sequence
  Description of Artificial Sequence: Synthetic oligonucleotide
gccccgcttcatctcagtgggctac

SEQ ID NO: 9472 - DNA, 26 bp, Artificial Sequence
  Description of Artificial Sequence: Synthetic oligonucleotide
ccccgcttcatctcagtgggctacgt

SEQ ID NO: 9473 - DNA, 26 bp, Artificial Sequence
  Description of Artificial Sequence: Synthetic oligonucleotide
cccgcttcatctcagtgggctacgtg

SEQ ID NO: 9474 - DNA, 27 bp, Artificial Sequence
  Description of Artificial Sequence: Synthetic oligonucleotide
ccgcttcatctcagtgggctacgtgga

SEQ ID NO: 9475 - DNA, 27 bp, Artificial Sequence
  Description of Artificial Sequence: Synthetic oligonucleotide
cgcttcatctcagtgggctacgtggac

SEQ ID NO: 9476 - DNA, 27 bp, Artificial Sequence
  Description of Artificial Sequence: Synthetic oligonucleotide
gcttcatctcagtgggctacgtggacg

SEQ ID NO: 9477 - DNA, 28 bp, Artificial Sequence
  Description of Artificial Sequence: Synthetic oligonucleotide
cttcatctcagtgggctacgtggacgac

SEQ ID NO: 9478 - DNA, 29 bp, Artificial Sequence
  Description of Artificial Sequence: Synthetic oligonucleotide
ttcatctcagtgggctacgtggacgacac

SEQ ID NO: 9479 - DNA, 28 bp, Artificial Sequence
  Description of Artificial Sequence: Synthetic oligonucleotide
tcatctcagtgggctacgtggacgacac

SEQ ID NO: 9480 - DNA, 27 bp, Artificial Sequence
  Description of Artificial Sequence: Synthetic oligonucleotide
catctcagtgggctacgtggacgacac

SEQ ID NO: 9481 - DNA, 27 bp, Artificial Sequence
  Description of Artificial Sequence: Synthetic oligonucleotide
atctcagtgggctacgtggacgacacg

SEQ ID NO: 9482 - DNA, 26 bp, Artificial Sequence
  Description of Artificial Sequence: Synthetic oligonucleotide
tctcagtgggctacgtggacgacacg

SEQ ID NO: 9483 - DNA, 25 bp, Artificial Sequence
  Description of Artificial Sequence: Synthetic oligonucleotide
ctcagtgggctacgtggacgacacg

SEQ ID NO: 9484 - DNA, 26 bp, Artificial Sequence
  Description of Artificial Sequence: Synthetic oligonucleotide
tcagtgggctacgtggacgacacgca

SEQ ID NO: 9485 - DNA, 23 bp, Artificial Sequence
  Description of Artificial Sequence: Synthetic oligonucleotide
gagctcgtggagaccaggcctgc

SEQ ID NO: 9486 - DNA, 24 bp, Artificial Sequence
  Description of Artificial Sequence: Synthetic oligonucleotide
agctcgtggagaccaggcctgcca

SEQ ID NO: 9487 - DNA, 23 bp, Artificial Sequence
  Description of Artificial Sequence: Synthetic oligonucleotide
gctcgtggagaccaggcctgcca

SEQ ID NO: 9488 - DNA, 23 bp, Artificial Sequence
  Description of Artificial Sequence: Synthetic oligonucleotide
ctcgtggagaccaggcctgccag

SEQ ID NO: 9489 - DNA, 23 bp, Artificial Sequence
  Description of Artificial Sequence: Synthetic oligonucleotide
tcgtggagaccaggcctgccagg

SEQ ID NO: 9490 - DNA, 22 bp, Artificial Sequence
  Description of Artificial Sequence: Synthetic oligonucleotide
cgtggagaccaggcctgccagg

SEQ ID NO: 9491 - DNA, 22 bp, Artificial Sequence
  Description of Artificial Sequence: Synthetic oligonucleotide
gtggagaccaggcctgccaggg

SEQ ID NO: 9492 - DNA, 24 bp, Artificial Sequence
  Description of Artificial Sequence: Synthetic oligonucleotide
tggagaccaggcctgccaggggat

SEQ ID NO: 9493 - DNA, 23 bp, Artificial Sequence
  Description of Artificial Sequence: Synthetic oligonucleotide
ggagaccaggcctgccaggggat

SEQ ID NO: 9494 - DNA, 23 bp, Artificial Sequence
  Description of Artificial Sequence: Synthetic oligonucleotide
gagaccaggcctgccaggggatg

SEQ ID NO: 9495 - DNA, 25 bp, Artificial Sequence
  Description of Artificial Sequence: Synthetic oligonucleotide
agaccaggcctgccaggggatggaa

SEQ ID NO: 9496 - DNA, 24 bp, Artificial Sequence
  Description of Artificial Sequence: Synthetic oligonucleotide
gaccaggcctgccaggggatggaa

SEQ ID NO: 9497 - DNA, 24 bp, Artificial Sequence
  Description of Artificial Sequence: Synthetic oligonucleotide
accaggcctgccaggggatggaac

SEQ ID NO: 9498 - DNA, 23 bp, Artificial Sequence
  Description of Artificial Sequence: Synthetic oligonucleotide
ccaggcctgccaggggatggaac

SEQ ID NO: 9499 - DNA, 25 bp, Artificial Sequence
  Description of Artificial Sequence: Synthetic oligonucleotide
caggcctgccaggggatggaacctt

SEQ ID NO: 9500 - DNA, 25 bp, Artificial Sequence
  Description of Artificial Sequence: Synthetic oligonucleotide
aggcctgccaggggatggaaccttc

SEQ ID NO: 9501 - DNA, 24 bp, Artificial Sequence
  Description of Artificial Sequence: Synthetic oligonucleotide
ggcctgccaggggatggaaccttc

SEQ ID NO: 9502 - DNA, 25 bp, Artificial Sequence
  Description of Artificial Sequence: Synthetic oligonucleotide
gcctgccaggggatggaaccttcca

SEQ ID NO: 9503 - DNA, 27 bp, Artificial Sequence
  Description of Artificial Sequence: Synthetic oligonucleotide
cctgccaggggatggaaccttccagaa

SEQ ID NO: 9504 - DNA, 27 bp, Artificial Sequence
  Description of Artificial Sequence: Synthetic oligonucleotide
ctgccaggggatggaaccttccagaag

SEQ ID NO: 9505 - DNA, 28 bp, Artificial Sequence
  Description of Artificial Sequence: Synthetic oligonucleotide
tgccaggggatggaaccttccagaagtg

SEQ ID NO: 9506 - DNA, 27 bp, Artificial Sequence
  Description of Artificial Sequence: Synthetic oligonucleotide
gccaggggatggaaccttccagaagtg

SEQ ID NO: 9507 - DNA, 27 bp, Artificial Sequence
  Description of Artificial Sequence: Synthetic oligonucleotide
ccaggggatggaaccttccagaagtgg

SEQ ID NO: 9508 - DNA, 26 bp, Artificial Sequence
  Description of Artificial Sequence: Synthetic oligonucleotide
caggagggtccggagtattgggacca

SEQ ID NO: 9509 - DNA, 26 bp, Artificial Sequence
  Description of Artificial Sequence: Synthetic oligonucleotide
aggagggtccggagtattgggaccag

SEQ ID NO: 9510 - DNA, 25 bp, Artificial Sequence
  Description of Artificial Sequence: Synthetic oligonucleotide
ggagggtccggagtattgggaccag

SEQ ID NO: 9511 - DNA, 26 bp, Artificial Sequence
  Description of Artificial Sequence: Synthetic oligonucleotide
gagggtccggagtattgggaccagga

SEQ ID NO: 9512 - DNA, 27 bp, Artificial Sequence
  Description of Artificial Sequence: Synthetic oligonucleotide
agggtccggagtattgggaccaggaga

SEQ ID NO: 9513 - DNA, 26 bp, Artificial Sequence
  Description of Artificial Sequence: Synthetic oligonucleotide
gggtccggagtattgggaccaggaga

SEQ ID NO: 9514 - DNA, 27 bp, Artificial Sequence
  Description of Artificial Sequence: Synthetic oligonucleotide
ggtccggagtattgggaccaggagaca

SEQ ID NO: 9515 - DNA, 27 bp, Artificial Sequence
  Description of Artificial Sequence: Synthetic oligonucleotide
gtccggagtattgggaccaggagacac

SEQ ID NO: 9516 - DNA, 27 bp, Artificial Sequence
  Description of Artificial Sequence: Synthetic oligonucleotide
tccggagtattgggaccaggagacacg

SEQ ID NO: 9517 - DNA, 29 bp, Artificial Sequence
  Description of Artificial Sequence: Synthetic oligonucleotide
ggagtattgggaccaggagacacggaaag

SEQ ID NO: 9518 - DNA, 30 bp, Artificial Sequence
  Description of Artificial Sequence: Synthetic oligonucleotide
gagtattgggaccaggagacacggaaagtg

SEQ ID NO: 9519 - DNA, 32 bp, Artificial Sequence
  Description of Artificial Sequence: Synthetic oligonucleotide
agtattgggaccaggagacacggaaagtgaag

SEQ ID NO: 9520 - DNA, 31 bp, Artificial Sequence
  Description of Artificial Sequence: Synthetic oligonucleotide
gtattgggaccaggagacacggaaagtgaag

SEQ ID NO: 9521 - DNA, 31 bp, Artificial Sequence
  Description of Artificial Sequence: Synthetic oligonucleotide
tattgggaccaggagacacggaaagtgaagg

SEQ ID NO: 9522 - DNA, 30 bp, Artificial Sequence
  Description of Artificial Sequence: Synthetic oligonucleotide
attgggaccaggagacacggaaagtgaagg

SEQ ID NO: 9523 - DNA, 29 bp, Artificial Sequence
  Description of Artificial Sequence: Synthetic oligonucleotide
ttgggaccaggagacacggaaagtgaagg

SEQ ID NO: 9524 - DNA, 28 bp, Artificial Sequence
  Description of Artificial Sequence: Synthetic oligonucleotide
tgggaccaggagacacggaaagtgaagg

SEQ ID NO: 9525 - DNA, 27 bp, Artificial Sequence
  Description of Artificial Sequence: Synthetic oligonucleotide
gggaccaggagacacggaaagtgaagg

SEQ ID NO: 9526 - DNA, 27 bp, Artificial Sequence
  Description of Artificial Sequence: Synthetic oligonucleotide
ggaccaggagacacggaaagtgaaggc

SEQ ID NO: 9527 - DNA, 27 bp, Artificial Sequence
  Description of Artificial Sequence: Synthetic oligonucleotide
gaccaggagacacggaaagtgaaggcc

SEQ ID NO: 9528 - DNA, 27 bp, Artificial Sequence
  Description of Artificial Sequence: Synthetic oligonucleotide
accaggagacacggaaagtgaaggccc

SEQ ID NO: 9529 - DNA, 27 bp, Artificial Sequence
  Description of Artificial Sequence: Synthetic oligonucleotide
ccaggagacacggaaagtgaaggccca

SEQ ID NO: 9530 - DNA, 27 bp, Artificial Sequence
  Description of Artificial Sequence: Synthetic oligonucleotide
caggagacacggaaagtgaaggcccac

SEQ ID NO: 9531 - DNA, 28 bp, Artificial Sequence
  Description of Artificial Sequence: Synthetic oligonucleotide
aggagacacggaaagtgaaggcccactc

SEQ ID NO: 9532 - DNA, 26 bp, Artificial Sequence
  Description of Artificial Sequence: Synthetic oligonucleotide
caggagggtccggagtattgggacga

SEQ ID NO: 9533 - DNA, 26 bp, Artificial Sequence
  Description of Artificial Sequence: Synthetic oligonucleotide
aggagggtccggagtattgggacgag

SEQ ID NO: 9534 - DNA, 25 bp, Artificial Sequence
  Description of Artificial Sequence: Synthetic oligonucleotide
ggagggtccggagtattgggacgag

SEQ ID NO: 9535 - DNA, 26 bp, Artificial Sequence
  Description of Artificial Sequence: Synthetic oligonucleotide
gagggtccggagtattgggacgagga

SEQ ID NO: 9536 - DNA, 27 bp, Artificial Sequence
  Description of Artificial Sequence: Synthetic oligonucleotide
agggtccggagtattgggacgaggaga

SEQ ID NO: 9537 - DNA, 26 bp, Artificial Sequence
  Description of Artificial Sequence: Synthetic oligonucleotide
gggtccggagtattgggacgaggaga

SEQ ID NO: 9538 - DNA, 27 bp, Artificial Sequence
  Description of Artificial Sequence: Synthetic oligonucleotide
ggtccggagtattgggacgaggagaca

SEQ ID NO: 9539 - DNA, 27 bp, Artificial Sequence
  Description of Artificial Sequence: Synthetic oligonucleotide
gtccggagtattgggacgaggagacag

SEQ ID NO: 9540 - DNA, 27 bp, Artificial Sequence
  Description of Artificial Sequence: Synthetic oligonucleotide
tccggagtattgggacgaggagacagg

SEQ ID NO: 9541 - DNA, 29 bp, Artificial Sequence
  Description of Artificial Sequence: Synthetic oligonucleotide
agggaaagtgaaggcccactcacagactc

SEQ ID NO: 9542 - DNA, 28 bp, Artificial Sequence
  Description of Artificial Sequence: Synthetic oligonucleotide
gggaaagtgaaggcccactcacagactc

SEQ ID NO: 9543 - DNA, 29 bp, Artificial Sequence
  Description of Artificial Sequence: Synthetic oligonucleotide
acacggaaagtgaaggcccactcacagag

SEQ ID NO: 9544 - DNA, 28 bp, Artificial Sequence
  Description of Artificial Sequence: Synthetic oligonucleotide
cacggaaagtgaaggcccactcacagag

SEQ ID NO: 9545 - DNA, 29 bp, Artificial Sequence
  Description of Artificial Sequence: Synthetic oligonucleotide
acggaaagtgaaggcccactcacagagtc

SEQ ID NO: 9546 - DNA, 28 bp, Artificial Sequence
  Description of Artificial Sequence: Synthetic oligonucleotide
cggaaagtgaaggcccactcacagagtc

SEQ ID NO: 9547 - DNA, 29 bp, Artificial Sequence
  Description of Artificial Sequence: Synthetic oligonucleotide
ggaaagtgaaggcccactcacagagtcac

SEQ ID NO: 9548 - DNA, 29 bp, Artificial Sequence
  Description of Artificial Sequence: Synthetic oligonucleotide
gaaagtgaaggcccactcacagagtcacc

SEQ ID NO: 9549 - DNA, 29 bp, Artificial Sequence
  Description of Artificial Sequence: Synthetic oligonucleotide
aaagtgaaggcccactcacagagtcaccg

SEQ ID NO: 9550 - DNA, 28 bp, Artificial Sequence
  Description of Artificial Sequence: Synthetic oligonucleotide
aagtgaaggcccactcacagagtcaccg

SEQ ID NO: 9551 - DNA, 27 bp, Artificial Sequence
  Description of Artificial Sequence: Synthetic oligonucleotide
agtgaaggcccactcacagagtcaccg

SEQ ID NO: 9552 - DNA, 27 bp, Artificial Sequence
  Description of Artificial Sequence: Synthetic oligonucleotide
gtgaaggcccactcacagagtcaccga

SEQ ID NO: 9553 - DNA, 27 bp, Artificial Sequence
  Description of Artificial Sequence: Synthetic oligonucleotide
tgaaggcccactcacagagtcaccgag

SEQ ID NO: 9554 - DNA, 27 bp, Artificial Sequence
  Description of Artificial Sequence: Synthetic oligonucleotide
gaaggcccactcacagagtcaccgagt

SEQ ID NO: 9555 - DNA, 27 bp, Artificial Sequence
  Description of Artificial Sequence: Synthetic oligonucleotide
aaggcccactcacagagtcaccgagtg

SEQ ID NO: 9556 - DNA, 26 bp, Artificial Sequence
  Description of Artificial Sequence: Synthetic oligonucleotide
aggcccactcacagagtcaccgagtg

SEQ ID NO: 9557 - DNA, 25 bp, Artificial Sequence
  Description of Artificial Sequence: Synthetic oligonucleotide
ggcccactcacagagtcaccgagtg

SEQ ID NO: 9558 - DNA, 26 bp, Artificial Sequence
  Description of Artificial Sequence: Synthetic oligonucleotide
gcccactcacagagtcaccgagtgga

SEQ ID NO: 9559 - DNA, 26 bp, Artificial Sequence
  Description of Artificial Sequence: Synthetic oligonucleotide
cccactcacagagtcaccgagtggac

SEQ ID NO: 9560 - DNA, 27 bp, Artificial Sequence
  Description of Artificial Sequence: Synthetic oligonucleotide
ccactcacagagtcaccgagtggacct

SEQ ID NO: 9561 - DNA, 27 bp, Artificial Sequence
  Description of Artificial Sequence: Synthetic oligonucleotide
cactcacagagtcaccgagtggacctg

SEQ ID NO: 9562 - DNA, 27 bp, Artificial Sequence
  Description of Artificial Sequence: Synthetic oligonucleotide
actcacagagtcaccgagtggacctgg

SEQ ID NO: 9563 - DNA, 26 bp, Artificial Sequence
  Description of Artificial Sequence: Synthetic oligonucleotide
ctcacagagtcaccgagtggacctgg

SEQ ID NO: 9564 - DNA, 26 bp, Artificial Sequence
  Description of Artificial Sequence: Synthetic oligonucleotide
tcacagagtcaccgagtggacctggg

SEQ ID NO: 9565 - DNA, 25 bp, Artificial Sequence
  Description of Artificial Sequence: Synthetic oligonucleotide
cacagagtcaccgagtggacctggg

SEQ ID NO: 9566 - DNA, 26 bp, Artificial Sequence
  Description of Artificial Sequence: Synthetic oligonucleotide
acagagtcaccgagtggacctgggga

SEQ ID NO: 9567 - DNA, 25 bp, Artificial Sequence
  Description of Artificial Sequence: Synthetic oligonucleotide
cagagtcaccgagtggacctgggga

SEQ ID NO: 9568 - DNA, 25 bp, Artificial Sequence
  Description of Artificial Sequence: Synthetic oligonucleotide
agagtcaccgagtggacctggggac

SEQ ID NO: 9569 - DNA, 24 bp, Artificial Sequence
  Description of Artificial Sequence: Synthetic oligonucleotide
gagtcaccgagtggacctggggac

SEQ ID NO: 9570 - DNA, 24 bp, Artificial Sequence
  Description of Artificial Sequence: Synthetic oligonucleotide
agtcaccgagtggacctggggacc

SEQ ID NO: 9571 - DNA, 23 bp, Artificial Sequence
  Description of Artificial Sequence: Synthetic oligonucleotide
gtcaccgagtggacctggggacc

SEQ ID NO: 9572 - DNA, 23 bp, Artificial Sequence
  Description of Artificial Sequence: Synthetic oligonucleotide
ccatgtggcggagcagcggagag

SEQ ID NO: 9573 - DNA, 23 bp, Artificial Sequence
  Description of Artificial Sequence: Synthetic oligonucleotide
catgtggcggagcagcggagagc

SEQ ID NO: 9574 - DNA, 25 bp, Artificial Sequence
  Description of Artificial Sequence: Synthetic oligonucleotide
atgtggcggagcagcggagagccta

SEQ ID NO: 9575 - DNA, 24 bp, Artificial Sequence
  Description of Artificial Sequence: Synthetic oligonucleotide
tgtggcggagcagcggagagccta

SEQ ID NO: 9576 - DNA, 23 bp, Artificial Sequence
  Description of Artificial Sequence: Synthetic oligonucleotide
gtggcggagcagcggagagccta

SEQ ID NO: 9577 - DNA, 23 bp, Artificial Sequence
  Description of Artificial Sequence: Synthetic oligonucleotide
tggcggagcagcggagagcctac

SEQ ID NO: 9578 - DNA, 22 bp, Artificial Sequence
  Description of Artificial Sequence: Synthetic oligonucleotide
ggcggagcagcggagagcctac

SEQ ID NO: 9579 - DNA, 23 bp, Artificial Sequence
  Description of Artificial Sequence: Synthetic oligonucleotide
gcggagcagcggagagcctacct

SEQ ID NO: 9580 - DNA, 23 bp, Artificial Sequence
  Description of Artificial Sequence: Synthetic oligonucleotide
cggagcagcggagagcctacctg

SEQ ID NO: 9581 - DNA, 24 bp, Artificial Sequence
  Description of Artificial Sequence: Synthetic oligonucleotide
ggagcagcggagagcctacctgga

SEQ ID NO: 9582 - DNA, 24 bp, Artificial Sequence
  Description of Artificial Sequence: Synthetic oligonucleotide
gagcagcggagagcctacctggag

SEQ ID NO: 9583 - DNA, 24 bp, Artificial Sequence
  Description of Artificial Sequence: Synthetic oligonucleotide
agcagcggagagcctacctggagg

SEQ ID NO: 9584 - DNA, 23 bp, Artificial Sequence
  Description of Artificial Sequence: Synthetic oligonucleotide
gcagcggagagcctacctggagg

SEQ ID NO: 9585 - DNA, 23 bp, Artificial Sequence
  Description of Artificial Sequence: Synthetic oligonucleotide
cagcggagagcctacctggaggg

SEQ ID NO: 9586 - DNA, 24 bp, Artificial Sequence
  Description of Artificial Sequence: Synthetic oligonucleotide
agcggagagcctacctggagggca

SEQ ID NO: 9587 - DNA, 23 bp, Artificial Sequence
  Description of Artificial Sequence: Synthetic oligonucleotide
gcggagagcctacctggagggca

SEQ ID NO: 9588 - DNA, 23 bp, Artificial Sequence
  Description of Artificial Sequence: Synthetic oligonucleotide
cggagagcctacctggagggcac

SEQ ID NO: 9589 - DNA, 34 bp, Artificial Sequence
  Description of Artificial Sequence: Synthetic oligonucleotide
ctcccactccatgaggtatttcttcacatccatg

SEQ ID NO: 9590 - DNA, 35 bp, Artificial Sequence
  Description of Artificial Sequence: Synthetic oligonucleotide
tcccactccatgaggtatttcttcacatccatgtc

SEQ ID NO: 9591 - DNA, 34 bp, Artificial Sequence
  Description of Artificial Sequence: Synthetic oligonucleotide
cccactccatgaggtatttcttcacatccatgtc

SEQ ID NO: 9592 - DNA, 34 bp, Artificial Sequence
  Description of Artificial Sequence: Synthetic oligonucleotide
ccactccatgaggtatttcttcacatccatgtcc

SEQ ID NO: 9593 - DNA, 34 bp, Artificial Sequence
  Description of Artificial Sequence: Synthetic oligonucleotide
cactccatgaggtatttcttcacatccatgtccc

SEQ ID NO: 9594 - DNA, 34 bp, Artificial Sequence
  Description of Artificial Sequence: Synthetic oligonucleotide
actccatgaggtatttcttcacatccatgtcccg

SEQ ID NO: 9595 - DNA, 33 bp, Artificial Sequence
  Description of Artificial Sequence: Synthetic oligonucleotide
ctccatgaggtatttcttcacatccatgtcccg

SEQ ID NO: 9596 - DNA, 33 bp, Artificial Sequence
  Description of Artificial Sequence: Synthetic oligonucleotide
tccatgaggtatttcttcacatccatgtcccgg

SEQ ID NO: 9597 - DNA, 32 bp, Artificial Sequence
  Description of Artificial Sequence: Synthetic oligonucleotide
ccatgaggtatttcttcacatccatgtcccgg

SEQ ID NO: 9598 - DNA, 32 bp, Artificial Sequence
  Description of Artificial Sequence: Synthetic oligonucleotide
catgaggtatttcttcacatccatgtcccggc

SEQ ID NO: 9599 - DNA, 32 bp, Artificial Sequence
  Description of Artificial Sequence: Synthetic oligonucleotide
atgaggtatttcttcacatccatgtcccggcc

SEQ ID NO: 9600 - DNA, 31 bp, Artificial Sequence
  Description of Artificial Sequence: Synthetic oligonucleotide
tgaggtatttcttcacatccatgtcccggcc

SEQ ID NO: 9601 - DNA, 30 bp, Artificial Sequence
  Description of Artificial Sequence: Synthetic oligonucleotide
gaggtatttcttcacatccatgtcccggcc

SEQ ID NO: 9602 - DNA, 30 bp, Artificial Sequence
  Description of Artificial Sequence: Synthetic oligonucleotide
aggtatttcttcacatccatgtcccggccc

SEQ ID NO: 9603 - DNA, 29 bp, Artificial Sequence
  Description of Artificial Sequence: Synthetic oligonucleotide
ggtatttcttcacatccatgtcccggccc

SEQ ID NO: 9604 - DNA, 29 bp, Artificial Sequence
  Description of Artificial Sequence: Synthetic oligonucleotide
gtatttcttcacatccatgtcccggcccg

SEQ ID NO: 9605 - DNA, 29 bp, Artificial Sequence
  Description of Artificial Sequence: Synthetic oligonucleotide
tatttcttcacatccatgtcccggcccgg

SEQ ID NO: 9606 - DNA, 28 bp, Artificial Sequence
  Description of Artificial Sequence: Synthetic oligonucleotide
atttcttcacatccatgtcccggcccgg

SEQ ID NO: 9607 - DNA, 27 bp, Artificial Sequence
  Description of Artificial Sequence: Synthetic oligonucleotide
tttcttcacatccatgtcccggcccgg

SEQ ID NO: 9608 - DNA, 26 bp, Artificial Sequence
  Description of Artificial Sequence: Synthetic oligonucleotide
ttcttcacatccatgtcccggcccgg

SEQ ID NO: 9609 - DNA, 25 bp, Artificial Sequence
  Description of Artificial Sequence: Synthetic oligonucleotide
tcttcacatccatgtcccggcccgg

SEQ ID NO: 9610 - DNA, 24 bp, Artificial Sequence
  Description of Artificial Sequence: Synthetic oligonucleotide
cttcacatccatgtcccggcccgg

SEQ ID NO: 9611 - DNA, 24 bp, Artificial Sequence
  Description of Artificial Sequence: Synthetic oligonucleotide
ttcacatccatgtcccggcccggc

SEQ ID NO: 9612 - DNA, 23 bp, Artificial Sequence
  Description of Artificial Sequence: Synthetic oligonucleotide
tcacatccatgtcccggcccggc

SEQ ID NO: 9613 - DNA, 22 bp, Artificial Sequence
  Description of Artificial Sequence: Synthetic oligonucleotide
cacatccatgtcccggcccggc

SEQ ID NO: 9614 - DNA, 22 bp, Artificial Sequence
  Description of Artificial Sequence: Synthetic oligonucleotide
acatccatgtcccggcccggcc

SEQ ID NO: 9615 - DNA, 21 bp, Artificial Sequence
  Description of Artificial Sequence: Synthetic oligonucleotide
catccatgtcccggcccggcc

SEQ ID NO: 9616 - DNA, 21 bp, Artificial Sequence
  Description of Artificial Sequence: Synthetic oligonucleotide
atccatgtcccggcccggccg

SEQ ID NO: 9617 - DNA, 23 bp, Artificial Sequence
  Description of Artificial Sequence: Synthetic oligonucleotide
acgggcgcttcctccgcgggtat

SEQ ID NO: 9618 - DNA, 22 bp, Artificial Sequence
  Description of Artificial Sequence: Synthetic oligonucleotide
cgggcgcttcctccgcgggtat

SEQ ID NO: 9619 - DNA, 24 bp, Artificial Sequence
  Description of Artificial Sequence: Synthetic oligonucleotide
gggcgcttcctccgcgggtatgaa

SEQ ID NO: 9620 - DNA, 25 bp, Artificial Sequence
  Description of Artificial Sequence: Synthetic oligonucleotide
ggcgcttcctccgcgggtatgaaca

SEQ ID NO: 9621 - DNA, 25 bp, Artificial Sequence
  Description of Artificial Sequence: Synthetic oligonucleotide
gcgcttcctccgcgggtatgaacag

SEQ ID NO: 9622 - DNA, 26 bp, Artificial Sequence
  Description of Artificial Sequence: Synthetic oligonucleotide
cgcttcctccgcgggtatgaacagca

SEQ ID NO: 9623 - DNA, 26 bp, Artificial Sequence
  Description of Artificial Sequence: Synthetic oligonucleotide
gcttcctccgcgggtatgaacagcac

SEQ ID NO: 9624 - DNA, 26 bp, Artificial Sequence
  Description of Artificial Sequence: Synthetic oligonucleotide
cttcctccgcgggtatgaacagcacg

SEQ ID NO: 9625 - DNA, 26 bp, Artificial Sequence
  Description of Artificial Sequence: Synthetic oligonucleotide
ttcctccgcgggtatgaacagcacgc

SEQ ID NO: 9626 - DNA, 25 bp, Artificial Sequence
  Description of Artificial Sequence: Synthetic oligonucleotide
tcctccgcgggtatgaacagcacgc

SEQ ID NO: 9627 - DNA, 24 bp, Artificial Sequence
  Description of Artificial Sequence: Synthetic oligonucleotide
cctccgcgggtatgaacagcacgc

SEQ ID NO: 9628 - DNA, 26 bp, Artificial Sequence
  Description of Artificial Sequence: Synthetic oligonucleotide
ctccgcgggtatgaacagcacgccta

SEQ ID NO: 9629 - DNA, 26 bp, Artificial Sequence
  Description of Artificial Sequence: Synthetic oligonucleotide
tccgcgggtatgaacagcacgcctac

SEQ ID NO: 9630 - DNA, 25 bp, Artificial Sequence
  Description of Artificial Sequence: Synthetic oligonucleotide
ccgcgggtatgaacagcacgcctac

SEQ ID NO: 9631 - DNA, 26 bp, Artificial Sequence
  Description of Artificial Sequence: Synthetic oligonucleotide
cgcgggtatgaacagcacgcctacga

SEQ ID NO: 9632 - DNA, 26 bp, Artificial Sequence
  Description of Artificial Sequence: Synthetic oligonucleotide
gcgggtatgaacagcacgcctacgac

SEQ ID NO: 9633 - DNA, 26 bp, Artificial Sequence
  Description of Artificial Sequence: Synthetic oligonucleotide
cgggtatgaacagcacgcctacgacg

SEQ ID NO: 9634 - DNA, 26 bp, Artificial Sequence
  Description of Artificial Sequence: Synthetic oligonucleotide
gggtatgaacagcacgcctacgacgg

SEQ ID NO: 9635 - DNA, 27 bp, Artificial Sequence
  Description of Artificial Sequence: Synthetic oligonucleotide
ggtatgaacagcacgcctacgacggca

SEQ ID NO: 9636 - DNA, 28 bp, Artificial Sequence
  Description of Artificial Sequence: Synthetic oligonucleotide
gtatgaacagcacgcctacgacggcaag

SEQ ID NO: 9637 - DNA, 28 bp, Artificial Sequence
  Description of Artificial Sequence: Synthetic oligonucleotide
tatgaacagcacgcctacgacggcaagg

SEQ ID NO: 9638 - DNA, 27 bp, Artificial Sequence
  Description of Artificial Sequence: Synthetic oligonucleotide
atgaacagcacgcctacgacggcaagg

SEQ ID NO: 9639 - DNA, 27 bp, Artificial Sequence
  Description of Artificial Sequence: Synthetic oligonucleotide
tgaacagcacgcctacgacggcaagga

SEQ ID NO: 9640 - DNA, 27 bp, Artificial Sequence
  Description of Artificial Sequence: Synthetic oligonucleotide
gaacagcacgcctacgacggcaaggat

SEQ ID NO: 9641 - DNA, 29 bp, Artificial Sequence
  Description of Artificial Sequence: Synthetic oligonucleotide
aacagcacgcctacgacggcaaggattac

SEQ ID NO: 9642 - DNA, 28 bp, Artificial Sequence
  Description of Artificial Sequence: Synthetic oligonucleotide
acagcacgcctacgacggcaaggattac

SEQ ID NO: 9643 - DNA, 27 bp, Artificial Sequence
  Description of Artificial Sequence: Synthetic oligonucleotide
cagcacgcctacgacggcaaggattac

SEQ ID NO: 9644 - DNA, 29 bp, Artificial Sequence
  Description of Artificial Sequence: Synthetic oligonucleotide
agcacgcctacgacggcaaggattacatc

SEQ ID NO: 9645 - DNA, 28 bp, Artificial Sequence
  Description of Artificial Sequence: Synthetic oligonucleotide
gcacgcctacgacggcaaggattacatc

SEQ ID NO: 9646 - DNA, 28 bp, Artificial Sequence
  Description of Artificial Sequence: Synthetic oligonucleotide
cacgcctacgacggcaaggattacatcg

SEQ ID NO: 9647 - DNA, 23 bp, Artificial Sequence
  Description of Artificial Sequence: Synthetic oligonucleotide
ctggggaccctgcgcggctagta

SEQ ID NO: 9648 - DNA, 25 bp, Artificial Sequence
  Description of Artificial Sequence: Synthetic oligonucleotide
tggggaccctgcgcggctagtacaa

SEQ ID NO: 9649 - DNA, 24 bp, Artificial Sequence
  Description of Artificial Sequence: Synthetic oligonucleotide
ggggaccctgcgcggctagtacaa

SEQ ID NO: 9650 - DNA, 24 bp, Artificial Sequence
  Description of Artificial Sequence: Synthetic oligonucleotide
gggaccctgcgcggctagtacaac

SEQ ID NO: 9651 - DNA, 25 bp, Artificial Sequence
  Description of Artificial Sequence: Synthetic oligonucleotide
ggaccctgcgcggctagtacaacca

SEQ ID NO: 9652 - DNA, 26 bp, Artificial Sequence
  Description of Artificial Sequence: Synthetic oligonucleotide
gaccctgcgcggctagtacaaccaga

SEQ ID NO: 9653 - DNA, 26 bp, Artificial Sequence
  Description of Artificial Sequence: Synthetic oligonucleotide
accctgcgcggctagtacaaccagag

SEQ ID NO: 9654 - DNA, 25 bp, Artificial Sequence
  Description of Artificial Sequence: Synthetic oligonucleotide
ccctgcgcggctagtacaaccagag

SEQ ID NO: 9655 - DNA, 25 bp, Artificial Sequence
  Description of Artificial Sequence: Synthetic oligonucleotide
cctgcgcggctagtacaaccagagc

SEQ ID NO: 9656 - DNA, 26 bp, Artificial Sequence
  Description of Artificial Sequence: Synthetic oligonucleotide
ctgcgcggctagtacaaccagagcga

SEQ ID NO: 9657 - DNA, 26 bp, Artificial Sequence
  Description of Artificial Sequence: Synthetic oligonucleotide
tgcgcggctagtacaaccagagcgag

SEQ ID NO: 9658 - DNA, 25 bp, Artificial Sequence
  Description of Artificial Sequence: Synthetic oligonucleotide
gcgcggctagtacaaccagagcgag

SEQ ID NO: 9659 - DNA, 25 bp, Artificial Sequence
  Description of Artificial Sequence: Synthetic oligonucleotide
cgcggctagtacaaccagagcgagg

SEQ ID NO: 9660 - DNA, 25 bp, Artificial Sequence
  Description of Artificial Sequence: Synthetic oligonucleotide
gcggctagtacaaccagagcgaggc

SEQ ID NO: 9661 - DNA, 25 bp, Artificial Sequence
  Description of Artificial Sequence: Synthetic oligonucleotide
cggctagtacaaccagagcgaggcc

SEQ ID NO: 9662 - DNA, 25 bp, Artificial Sequence
  Description of Artificial Sequence: Synthetic oligonucleotide
ggctagtacaaccagagcgaggccg

SEQ ID NO: 9663 - DNA, 27 bp, Artificial Sequence
  Description of Artificial Sequence: Synthetic oligonucleotide
gctagtacaaccagagcgaggccggtt

SEQ ID NO: 9664 - DNA, 27 bp, Artificial Sequence
  Description of Artificial Sequence: Synthetic oligonucleotide
ctagtacaaccagagcgaggccggttc

SEQ ID NO: 9665 - DNA, 28 bp, Artificial Sequence
  Description of Artificial Sequence: Synthetic oligonucleotide
tagtacaaccagagcgaggccggttctc

SEQ ID NO: 9666 - DNA, 27 bp, Artificial Sequence
  Description of Artificial Sequence: Synthetic oligonucleotide
agtacaaccagagcgaggccggttctc

SEQ ID NO: 9667 - DNA, 27 bp, Artificial Sequence
  Description of Artificial Sequence: Synthetic oligonucleotide
gtacaaccagagcgaggccggttctca

SEQ ID NO: 9668 - DNA, 30 bp, Artificial Sequence
  Description of Artificial Sequence: Synthetic oligonucleotide
ccggttctcacaccctccagatgatgtatg

SEQ ID NO: 9669 - DNA, 30 bp, Artificial Sequence
  Description of Artificial Sequence: Synthetic oligonucleotide
cggttctcacaccctccagatgatgtatgg

SEQ ID NO: 9670 - DNA, 30 bp, Artificial Sequence
  Description of Artificial Sequence: Synthetic oligonucleotide
ggttctcacaccctccagatgatgtatggc

SEQ ID NO: 9671 - DNA, 31 bp, Artificial Sequence
  Description of Artificial Sequence: Synthetic oligonucleotide
gttctcacaccctccagatgatgtatggctg

SEQ ID NO: 9672 - DNA, 31 bp, Artificial Sequence
  Description of Artificial Sequence: Synthetic oligonucleotide
ttctcacaccctccagatgatgtatggctgc

SEQ ID NO: 9673 - DNA, 30 bp, Artificial Sequence
  Description of Artificial Sequence: Synthetic oligonucleotide
tctcacaccctccagatgatgtatggctgc

SEQ ID NO: 9674 - DNA, 29 bp, Artificial Sequence
  Description of Artificial Sequence: Synthetic oligonucleotide
ctcacaccctccagatgatgtatggctgc

SEQ ID NO: 9675 - DNA, 29 bp, Artificial Sequence
  Description of Artificial Sequence: Synthetic oligonucleotide
tcacaccctccagatgatgtatggctgcg

SEQ ID NO: 9676 - DNA, 28 bp, Artificial Sequence
  Description of Artificial Sequence: Synthetic oligonucleotide
cacaccctccagatgatgtatggctgcg

SEQ ID NO: 9677 - DNA, 29 bp, Artificial Sequence
  Description of Artificial Sequence: Synthetic oligonucleotide
acaccctccagatgatgtatggctgcgac

SEQ ID NO: 9678 - DNA, 28 bp, Artificial Sequence
  Description of Artificial Sequence: Synthetic oligonucleotide
caccctccagatgatgtatggctgcgac

SEQ ID NO: 9679 - DNA, 28 bp, Artificial Sequence
  Description of Artificial Sequence: Synthetic oligonucleotide
accctccagatgatgtatggctgcgacg

SEQ ID NO: 9680 - DNA, 27 bp, Artificial Sequence
  Description of Artificial Sequence: Synthetic oligonucleotide
ccctccagatgatgtatggctgcgacg

SEQ ID NO: 9681 - DNA, 28 bp, Artificial Sequence
  Description of Artificial Sequence: Synthetic oligonucleotide
cctccagatgatgtatggctgcgacgtg

SEQ ID NO: 9682 - DNA, 28 bp, Artificial Sequence
  Description of Artificial Sequence: Synthetic oligonucleotide
ctccagatgatgtatggctgcgacgtgg

SEQ ID NO: 9683 - DNA, 20 bp, Artificial Sequence
  Description of Artificial Sequence: Synthetic oligonucleotide
tgtcccggcccggccgcgat

SEQ ID NO: 9684 - DNA, 20 bp, Artificial Sequence
  Description of Artificial Sequence: Synthetic oligonucleotide
gtcccggcccggccgcgatt

SEQ ID NO: 9685 - DNA, 20 bp, Artificial Sequence
  Description of Artificial Sequence: Synthetic oligonucleotide
tcccggcccggccgcgagtt

SEQ ID NO: 9686 - DNA, 20 bp, Artificial Sequence
  Description of Artificial Sequence: Synthetic oligonucleotide
cccggcccggccgcgagttt

SEQ ID NO: 9687 - DNA, 20 bp, Artificial Sequence
  Description of Artificial Sequence: Synthetic oligonucleotide
ccggcccggccgcgaggatt

SEQ ID NO: 9688 - DNA, 20 bp, Artificial Sequence
  Description of Artificial Sequence: Synthetic oligonucleotide
cggcccggccgcgaggagtt

SEQ ID NO: 9689 - DNA, 20 bp, Artificial Sequence
  Description of Artificial Sequence: Synthetic oligonucleotide
ggcccggccgcgaggagctt

SEQ ID NO: 9690 - DNA, 20 bp, Artificial Sequence
  Description of Artificial Sequence: Synthetic oligonucleotide
gcccggccgcgaggagcctt

SEQ ID NO: 9691 - DNA, 20 bp, Artificial Sequence
  Description of Artificial Sequence: Synthetic oligonucleotide
cccggccgcgaggagccctt

SEQ ID NO: 9692 - DNA, 20 bp, Artificial Sequence
  Description of Artificial Sequence: Synthetic oligonucleotide
ccggccgcgaggagcccctt

SEQ ID NO: 9693 - DNA, 20 bp, Artificial Sequence
  Description of Artificial Sequence: Synthetic oligonucleotide
cggccgcgaggagccccgtt

SEQ ID NO: 9694 - DNA, 20 bp, Artificial Sequence
  Description of Artificial Sequence: Synthetic oligonucleotide
ggccgcgaggagccccgctt

SEQ ID NO: 9695 - DNA, 22 bp, Artificial Sequence
  Description of Artificial Sequence: Synthetic oligonucleotide
gccgcgaggagccccgcttcat

SEQ ID NO: 9696 - DNA, 22 bp, Artificial Sequence
  Description of Artificial Sequence: Synthetic oligonucleotide
ccgcgaggagccccgcttcatc

SEQ ID NO: 9697 - DNA, 22 bp, Artificial Sequence
  Description of Artificial Sequence: Synthetic oligonucleotide
cgcgaggagccccgcttcatcg

SEQ ID NO: 9698 - DNA, 23 bp, Artificial Sequence
  Description of Artificial Sequence: Synthetic oligonucleotide
gcgaggagccccgcttcatcgca

SEQ ID NO: 9699 - DNA, 24 bp, Artificial Sequence
  Description of Artificial Sequence: Synthetic oligonucleotide
cgaggagccccgcttcatcgcagt

SEQ ID NO: 9700 - DNA, 24 bp, Artificial Sequence
  Description of Artificial Sequence: Synthetic oligonucleotide
gaggagccccgcttcatcgcagtg

SEQ ID NO: 9701 - DNA, 24 bp, Artificial Sequence
  Description of Artificial Sequence: Synthetic oligonucleotide
aggagccccgcttcatcgcagtgg

SEQ ID NO: 9702 - DNA, 25 bp, Artificial Sequence
  Description of Artificial Sequence: Synthetic oligonucleotide
gcttcctccgcgggtaccaccagtt

SEQ ID NO: 9703 - DNA, 25 bp, Artificial Sequence
  Description of Artificial Sequence: Synthetic oligonucleotide
cttcctccgcgggtaccaccagttc

SEQ ID NO: 9704 - DNA, 25 bp, Artificial Sequence
  Description of Artificial Sequence: Synthetic oligonucleotide
ttcctccgcgggtaccaccagttcg

SEQ ID NO: 9705 - DNA, 24 bp, Artificial Sequence
  Description of Artificial Sequence: Synthetic oligonucleotide
tcctccgcgggtaccaccagttcg

SEQ ID NO: 9706 - DNA, 23 bp, Artificial Sequence
  Description of Artificial Sequence: Synthetic oligonucleotide
cctccgcgggtaccaccagttcg

SEQ ID NO: 9707 - DNA, 23 bp, Artificial Sequence
  Description of Artificial Sequence: Synthetic oligonucleotide
ctccgcgggtaccaccagttcgc

SEQ ID NO: 9708 - DNA, 25 bp, Artificial Sequence
  Description of Artificial Sequence: Synthetic oligonucleotide
tccgcgggtaccaccagttcgccta

SEQ ID NO: 9709 - DNA, 24 bp, Artificial Sequence
  Description of Artificial Sequence: Synthetic oligonucleotide
ccgcgggtaccaccagttcgccta

SEQ ID NO: 9710 - DNA, 24 bp, Artificial Sequence
  Description of Artificial Sequence: Synthetic oligonucleotide
cgcgggtaccaccagttcgcctac

SEQ ID NO: 9711 - DNA, 25 bp, Artificial Sequence
  Description of Artificial Sequence: Synthetic oligonucleotide
gcgggtaccaccagttcgcctacga

SEQ ID NO: 9712 - DNA, 25 bp, Artificial Sequence
  Description of Artificial Sequence: Synthetic oligonucleotide
cgggtaccaccagttcgcctacgac

SEQ ID NO: 9713 - DNA, 25 bp, Artificial Sequence
  Description of Artificial Sequence: Synthetic oligonucleotide
gggtaccaccagttcgcctacgacg

SEQ ID NO: 9714 - DNA, 25 bp, Artificial Sequence
  Description of Artificial Sequence: Synthetic oligonucleotide
ggtaccaccagttcgcctacgacgg

SEQ ID NO: 9715 - DNA, 27 bp, Artificial Sequence
  Description of Artificial Sequence: Synthetic oligonucleotide
gtaccaccagttcgcctacgacggcaa

SEQ ID NO: 9716 - DNA, 27 bp, Artificial Sequence
  Description of Artificial Sequence: Synthetic oligonucleotide
taccaccagttcgcctacgacggcaag

SEQ ID NO: 9717 - DNA, 26 bp, Artificial Sequence
  Description of Artificial Sequence: Synthetic oligonucleotide
accaccagttcgcctacgacggcaag

SEQ ID NO: 9718 - DNA, 25 bp, Artificial Sequence
  Description of Artificial Sequence: Synthetic oligonucleotide
ccaccagttcgcctacgacggcaag

SEQ ID NO: 9719 - DNA, 27 bp, Artificial Sequence
  Description of Artificial Sequence: Synthetic oligonucleotide
caccagttcgcctacgacggcaaggat

SEQ ID NO: 9720 - DNA, 24 bp, Artificial Sequence
  Description of Artificial Sequence: Synthetic oligonucleotide
cgccgtggatagagcaggagggtg

SEQ ID NO: 9721 - DNA, 24 bp, Artificial Sequence
  Description of Artificial Sequence: Synthetic oligonucleotide
gccgtggatagagcaggagggtgc

SEQ ID NO: 9722 - DNA, 24 bp, Artificial Sequence
  Description of Artificial Sequence: Synthetic oligonucleotide
ccgtggatagagcaggagggtgcg

SEQ ID NO: 9723 - DNA, 25 bp, Artificial Sequence
  Description of Artificial Sequence: Synthetic oligonucleotide
cgtggatagagcaggagggtgcgga

SEQ ID NO: 9724 - DNA, 27 bp, Artificial Sequence
  Description of Artificial Sequence: Synthetic oligonucleotide
gtggatagagcaggagggtgcggagta

SEQ ID NO: 9725 - DNA, 29 bp, Artificial Sequence
  Description of Artificial Sequence: Synthetic oligonucleotide
tggatagagcaggagggtgcggagtattg

SEQ ID NO: 9726 - DNA, 28 bp, Artificial Sequence
  Description of Artificial Sequence: Synthetic oligonucleotide
ggatagagcaggagggtgcggagtattg

SEQ ID NO: 9727 - DNA, 28 bp, Artificial Sequence
  Description of Artificial Sequence: Synthetic oligonucleotide
gatagagcaggagggtgcggagtattgg

SEQ ID NO: 9728 - DNA, 28 bp, Artificial Sequence
  Description of Artificial Sequence: Synthetic oligonucleotide
atagagcaggagggtgcggagtattggg

SEQ ID NO: 9729 - DNA, 27 bp, Artificial Sequence
  Description of Artificial Sequence: Synthetic oligonucleotide
tagagcaggagggtgcggagtattggg

SEQ ID NO: 9730 - DNA, 27 bp, Artificial Sequence
  Description of Artificial Sequence: Synthetic oligonucleotide
agagcaggagggtgcggagtattggga

SEQ ID NO: 9731 - DNA, 26 bp, Artificial Sequence
  Description of Artificial Sequence: Synthetic oligonucleotide
gagcaggagggtgcggagtattggga

SEQ ID NO: 9732 - DNA, 26 bp, Artificial Sequence
  Description of Artificial Sequence: Synthetic oligonucleotide
agcaggagggtgcggagtattgggac

SEQ ID NO: 9733 - DNA, 25 bp, Artificial Sequence
  Description of Artificial Sequence: Synthetic oligonucleotide
gcaggagggtgcggagtattgggac

SEQ ID NO: 9734 - DNA, 25 bp, Artificial Sequence
  Description of Artificial Sequence: Synthetic oligonucleotide
caggagggtgcggagtattgggacg

SEQ ID NO: 9735 - DNA, 25 bp, Artificial Sequence
  Description of Artificial Sequence: Synthetic oligonucleotide
aggagggtgcggagtattgggacgg

SEQ ID NO: 9736 - DNA, 24 bp, Artificial Sequence
  Description of Artificial Sequence: Synthetic oligonucleotide
ggagggtgcggagtattgggacgg

SEQ ID NO: 9737 - DNA, 24 bp, Artificial Sequence
  Description of Artificial Sequence: Synthetic oligonucleotide
gagggtgcggagtattgggacggg

SEQ ID NO: 9738 - DNA, 25 bp, Artificial Sequence
  Description of Artificial Sequence: Synthetic oligonucleotide
agggtgcggagtattgggacgggga

SEQ ID NO: 9739 - DNA, 24 bp, Artificial Sequence
  Description of Artificial Sequence: Synthetic oligonucleotide
gggtgcggagtattgggacgggga

SEQ ID NO: 9740 - DNA, 25 bp, Artificial Sequence
  Description of Artificial Sequence: Synthetic oligonucleotide
ggtgcggagtattgggacggggaga

SEQ ID NO: 9741 - DNA, 26 bp, Artificial Sequence
  Description of Artificial Sequence: Synthetic oligonucleotide
gtgcggagtattgggacggggagaca

SEQ ID NO: 9742 - DNA, 26 bp, Artificial Sequence
  Description of Artificial Sequence: Synthetic oligonucleotide
tgcggagtattgggacggggagacac

SEQ ID NO: 9743 - DNA, 25 bp, Artificial Sequence
  Description of Artificial Sequence: Synthetic oligonucleotide
gcggagtattgggacggggagacac

SEQ ID NO: 9744 - DNA, 27 bp, Artificial Sequence
  Description of Artificial Sequence: Synthetic oligonucleotide
gggagacacggaatgtgaaggcccagt

SEQ ID NO: 9745 - DNA, 22 bp, Artificial Sequence
  Description of Artificial Sequence: Synthetic oligonucleotide
acagcgacgccgcgagccggat

SEQ ID NO: 9746 - DNA, 21 bp, Artificial Sequence
  Description of Artificial Sequence: Synthetic oligonucleotide
cagcgacgccgcgagccggat

SEQ ID NO: 9747 - DNA, 23 bp, Artificial Sequence
  Description of Artificial Sequence: Synthetic oligonucleotide
agcgacgccgcgagccggatgat

SEQ ID NO: 9748 - DNA, 22 bp, Artificial Sequence
  Description of Artificial Sequence: Synthetic oligonucleotide
gcgacgccgcgagccggatgat

SEQ ID NO: 9749 - DNA, 22 bp, Artificial Sequence
  Description of Artificial Sequence: Synthetic oligonucleotide
cgacgccgcgagccggatgatg

SEQ ID NO: 9750 - DNA, 23 bp, Artificial Sequence
  Description of Artificial Sequence: Synthetic oligonucleotide
gacgccgcgagccggatgatgga

SEQ ID NO: 9751 - DNA, 23 bp, Artificial Sequence
  Description of Artificial Sequence: Synthetic oligonucleotide
acgccgcgagccggatgatggag

SEQ ID NO: 9752 - DNA, 22 bp, Artificial Sequence
  Description of Artificial Sequence: Synthetic oligonucleotide
cgccgcgagccggatgatggag

SEQ ID NO: 9753 - DNA, 22 bp, Artificial Sequence
  Description of Artificial Sequence: Synthetic oligonucleotide
gccgcgagccggatgatggagc

SEQ ID NO: 9754 - DNA, 22 bp, Artificial Sequence
  Description of Artificial Sequence: Synthetic oligonucleotide
ccgcgagccggatgatggagcc

SEQ ID NO: 9755 - DNA, 22 bp, Artificial Sequence
  Description of Artificial Sequence: Synthetic oligonucleotide
cgcgagccggatgatggagccg

SEQ ID NO: 9756 - DNA, 22 bp, Artificial Sequence
  Description of Artificial Sequence: Synthetic oligonucleotide
gcgagccggatgatggagccgc

SEQ ID NO: 9757 - DNA, 22 bp, Artificial Sequence
  Description of Artificial Sequence: Synthetic oligonucleotide
cgagccggatgatggagccgcg

SEQ ID NO: 9758 - DNA, 22 bp, Artificial Sequence
  Description of Artificial Sequence: Synthetic oligonucleotide
gagccggatgatggagccgcgg

SEQ ID NO: 9759 - DNA, 22 bp, Artificial Sequence
  Description of Artificial Sequence: Synthetic oligonucleotide
agccggatgatggagccgcggg

SEQ ID NO: 9760 - DNA, 21 bp, Artificial Sequence
  Description of Artificial Sequence: Synthetic oligonucleotide
gccggatgatggagccgcggg

SEQ ID NO: 9761 - DNA, 21 bp, Artificial Sequence
  Description of Artificial Sequence: Synthetic oligonucleotide
ccggatgatggagccgcgggc

SEQ ID NO: 9762 - DNA, 21 bp, Artificial Sequence
  Description of Artificial Sequence: Synthetic oligonucleotide
cggatgatggagccgcgggcg

SEQ ID NO: 9763 - DNA, 21 bp, Artificial Sequence
  Description of Artificial Sequence: Synthetic oligonucleotide
ggatgatggagccgcgggcgc

SEQ ID NO: 9764 - DNA, 21 bp, Artificial Sequence
  Description of Artificial Sequence: Synthetic oligonucleotide
gatgatggagccgcgggcgcc

SEQ ID NO: 9765 - DNA, 22 bp, Artificial Sequence
  Description of Artificial Sequence: Synthetic oligonucleotide
atgatggagccgcgggcgccgt

SEQ ID NO: 9766 - DNA, 21 bp, Artificial Sequence
  Description of Artificial Sequence: Synthetic oligonucleotide
tgatggagccgcgggcgccgt

SEQ ID NO: 9767 - DNA, 20 bp, Artificial Sequence
  Description of Artificial Sequence: Synthetic oligonucleotide
tggggccggacgggcgcctt

SEQ ID NO: 9768 - DNA, 20 bp, Artificial Sequence
  Description of Artificial Sequence: Synthetic oligonucleotide
ggggccggacgggcgccttt

SEQ ID NO: 9769 - DNA, 20 bp, Artificial Sequence
  Description of Artificial Sequence: Synthetic oligonucleotide
gggccggacgggcgcctctt

SEQ ID NO: 9770 - DNA, 20 bp, Artificial Sequence
  Description of Artificial Sequence: Synthetic oligonucleotide
ggccggacgggcgcctcctt

SEQ ID NO: 9771 - DNA, 20 bp, Artificial Sequence
  Description of Artificial Sequence: Synthetic oligonucleotide
gccggacgggcgcctcctct

SEQ ID NO: 9772 - DNA, 20 bp, Artificial Sequence
  Description of Artificial Sequence: Synthetic oligonucleotide
ccggacgggcgcctcctcct

SEQ ID NO: 9773 - DNA, 20 bp, Artificial Sequence
  Description of Artificial Sequence: Synthetic oligonucleotide
cggacgggcgcctcctccgt

SEQ ID NO: 9774 - DNA, 20 bp, Artificial Sequence
  Description of Artificial Sequence: Synthetic oligonucleotide
ggacgggcgcctcctccgct

SEQ ID NO: 9775 - DNA, 20 bp, Artificial Sequence
  Description of Artificial Sequence: Synthetic oligonucleotide
gacgggcgcctcctccgcgt

SEQ ID NO: 9776 - DNA, 20 bp, Artificial Sequence
  Description of Artificial Sequence: Synthetic oligonucleotide
acgggcgcctcctccgcggt

SEQ ID NO: 9777 - DNA, 20 bp, Artificial Sequence
  Description of Artificial Sequence: Synthetic oligonucleotide
cgggcgcctcctccgcggtt

SEQ ID NO: 9778 - DNA, 20 bp, Artificial Sequence
  Description of Artificial Sequence: Synthetic oligonucleotide
gggcgcctcctccgcgggta

SEQ ID NO: 9779 - DNA, 20 bp, Artificial Sequence
  Description of Artificial Sequence: Synthetic oligonucleotide
ggcgcctcctccgcgggtac

SEQ ID NO: 9780 - DNA, 21 bp, Artificial Sequence
  Description of Artificial Sequence: Synthetic oligonucleotide
gcgcctcctccgcgggtacca

SEQ ID NO: 9781 - DNA, 21 bp, Artificial Sequence
  Description of Artificial Sequence: Synthetic oligonucleotide
cgcctcctccgcgggtaccag

SEQ ID NO: 9782 - DNA, 22 bp, Artificial Sequence
  Description of Artificial Sequence: Synthetic oligonucleotide
gcctcctccgcgggtaccagca

SEQ ID NO: 9783 - DNA, 22 bp, Artificial Sequence
  Description of Artificial Sequence: Synthetic oligonucleotide
cctcctccgcgggtaccagcag

SEQ ID NO: 9784 - DNA, 23 bp, Artificial Sequence
  Description of Artificial Sequence: Synthetic oligonucleotide
ctcctccgcgggtaccagcagga

SEQ ID NO: 9785 - DNA, 26 bp, Artificial Sequence
  Description of Artificial Sequence: Synthetic oligonucleotide
aggaccagacccaggacacggagctt

SEQ ID NO: 9786 - DNA, 25 bp, Artificial Sequence
  Description of Artificial Sequence: Synthetic oligonucleotide
ggaccagacccaggacacggagctt

SEQ ID NO: 9787 - DNA, 26 bp, Artificial Sequence
  Description of Artificial Sequence: Synthetic oligonucleotide
gaccagacccaggacacggagcttgt

SEQ ID NO: 9788 - DNA, 26 bp, Artificial Sequence
  Description of Artificial Sequence: Synthetic oligonucleotide
accagacccaggacacggagcttgtg

SEQ ID NO: 9789 - DNA, 25 bp, Artificial Sequence
  Description of Artificial Sequence: Synthetic oligonucleotide
ccagacccaggacacggagcttgtg

SEQ ID NO: 9790 - DNA, 26 bp, Artificial Sequence
  Description of Artificial Sequence: Synthetic oligonucleotide
cagacccaggacacggagcttgtgga

SEQ ID NO: 9791 - DNA, 27 bp, Artificial Sequence
  Description of Artificial Sequence: Synthetic oligonucleotide
agacccaggacacggagcttgtggaga

SEQ ID NO: 9792 - DNA, 26 bp, Artificial Sequence
  Description of Artificial Sequence: Synthetic oligonucleotide
gacccaggacacggagcttgtggaga

SEQ ID NO: 9793 - DNA, 26 bp, Artificial Sequence
  Description of Artificial Sequence: Synthetic oligonucleotide
acccaggacacggagcttgtggagac

SEQ ID NO: 9794 - DNA, 25 bp, Artificial Sequence
  Description of Artificial Sequence: Synthetic oligonucleotide
cccaggacacggagcttgtggagac

SEQ ID NO: 9795 - DNA, 26 bp, Artificial Sequence
  Description of Artificial Sequence: Synthetic oligonucleotide
ccaggacacggagcttgtggagacca

SEQ ID NO: 9796 - DNA, 26 bp, Artificial Sequence
  Description of Artificial Sequence: Synthetic oligonucleotide
caggacacggagcttgtggagaccag

SEQ ID NO: 9797 - DNA, 26 bp, Artificial Sequence
  Description of Artificial Sequence: Synthetic oligonucleotide
aggacacggagcttgtggagaccagg

SEQ ID NO: 9798 - DNA, 25 bp, Artificial Sequence
  Description of Artificial Sequence: Synthetic oligonucleotide
ggacacggagcttgtggagaccagg

SEQ ID NO: 9799 - DNA, 25 bp, Artificial Sequence
  Description of Artificial Sequence: Synthetic oligonucleotide
gacacggagcttgtggagaccaggc

SEQ ID NO: 9800 - DNA, 26 bp, Artificial Sequence
  Description of Artificial Sequence: Synthetic oligonucleotide
acacggagcttgtggagaccaggcct

SEQ ID NO: 9801 - DNA, 25 bp, Artificial Sequence
  Description of Artificial Sequence: Synthetic oligonucleotide
cacggagcttgtggagaccaggcct

SEQ ID NO: 9802 - DNA, 25 bp, Artificial Sequence
  Description of Artificial Sequence: Synthetic oligonucleotide
acggagcttgtggagaccaggcctg

SEQ ID NO: 9803 - DNA, 24 bp, Artificial Sequence
  Description of Artificial Sequence: Synthetic oligonucleotide
cggagcttgtggagaccaggcctg

SEQ ID NO: 9804 - DNA, 25 bp, Artificial Sequence
  Description of Artificial Sequence: Synthetic oligonucleotide
ggagcttgtggagaccaggcctgca

SEQ ID NO: 9805 - DNA, 25 bp, Artificial Sequence
  Description of Artificial Sequence: Synthetic oligonucleotide
gagcttgtggagaccaggcctgcag

SEQ ID NO: 9806 - DNA, 25 bp, Artificial Sequence
  Description of Artificial Sequence: Synthetic oligonucleotide
agcttgtggagaccaggcctgcagg

SEQ ID NO: 9807 - DNA, 24 bp, Artificial Sequence
  Description of Artificial Sequence: Synthetic oligonucleotide
gcttgtggagaccaggcctgcagg

SEQ ID NO: 9808 - DNA, 24 bp, Artificial Sequence
  Description of Artificial Sequence: Synthetic oligonucleotide
cttgtggagaccaggcctgcaggg

SEQ ID NO: 9809 - DNA, 26 bp, Artificial Sequence
  Description of Artificial Sequence: Synthetic oligonucleotide
ttgtggagaccaggcctgcaggggat

SEQ ID NO: 9810 - DNA, 25 bp, Artificial Sequence
  Description of Artificial Sequence: Synthetic oligonucleotide
tgtggagaccaggcctgcaggggat

SEQ ID NO: 9811 - DNA, 27 bp, Artificial Sequence
  Description of Artificial Sequence: Synthetic oligonucleotide
gggatggaaccttccagaagtgggcgt

SEQ ID NO: 9812 - DNA, 27 bp, Artificial Sequence
  Description of Artificial Sequence: Synthetic oligonucleotide
ggatggaaccttccagaagtgggcgtc

SEQ ID NO: 9813 - DNA, 28 bp, Artificial Sequence
  Description of Artificial Sequence: Synthetic oligonucleotide
gatggaaccttccagaagtgggcgtctg

SEQ ID NO: 9814 - DNA, 29 bp, Artificial Sequence
  Description of Artificial Sequence: Synthetic oligonucleotide
atggaaccttccagaagtgggcgtctgtg

SEQ ID NO: 9815 - DNA, 28 bp, Artificial Sequence
  Description of Artificial Sequence: Synthetic oligonucleotide
tggaaccttccagaagtgggcgtctgtg

SEQ ID NO: 9816 - DNA, 27 bp, Artificial Sequence
  Description of Artificial Sequence: Synthetic oligonucleotide
ggaaccttccagaagtgggcgtctgtg

SEQ ID NO: 9817 - DNA, 27 bp, Artificial Sequence
  Description of Artificial Sequence: Synthetic oligonucleotide
gaaccttccagaagtgggcgtctgtgg

SEQ ID NO: 9818 - DNA, 28 bp, Artificial Sequence
  Description of Artificial Sequence: Synthetic oligonucleotide
aaccttccagaagtgggcgtctgtggtg

SEQ ID NO: 9819 - DNA, 27 bp, Artificial Sequence
  Description of Artificial Sequence: Synthetic oligonucleotide
cccatcgtgggcatcattgctggccta

SEQ ID NO: 9820 - DNA, 27 bp, Artificial Sequence
  Description of Artificial Sequence: Synthetic oligonucleotide
ccatcgtgggcatcattgctggcctag

SEQ ID NO: 9821 - DNA, 29 bp, Artificial Sequence
  Description of Artificial Sequence: Synthetic oligonucleotide
catcgtgggcatcattgctggcctagttc

SEQ ID NO: 9822 - DNA, 30 bp, Artificial Sequence
  Description of Artificial Sequence: Synthetic oligonucleotide
atcgtgggcatcattgctggcctagttctc

SEQ ID NO: 9823 - DNA, 29 bp, Artificial Sequence
  Description of Artificial Sequence: Synthetic oligonucleotide
tcgtgggcatcattgctggcctagttctc

SEQ ID NO: 9824 - DNA, 28 bp, Artificial Sequence
  Description of Artificial Sequence: Synthetic oligonucleotide
cgtgggcatcattgctggcctagttctc

SEQ ID NO: 9825 - DNA, 31 bp, Artificial Sequence
  Description of Artificial Sequence: Synthetic oligonucleotide
gtgggcatcattgctggcctagttctctttg

SEQ ID NO: 9826 - DNA, 31 bp, Artificial Sequence
  Description of Artificial Sequence: Synthetic oligonucleotide
tgggcatcattgctggcctagttctctttgg

SEQ ID NO: 9827 - DNA, 30 bp, Artificial Sequence
  Description of Artificial Sequence: Synthetic oligonucleotide
gggcatcattgctggcctagttctctttgg

SEQ ID NO: 9828 - DNA, 31 bp, Artificial Sequence
  Description of Artificial Sequence: Synthetic oligonucleotide
ggcatcattgctggcctagttctctttggag

SEQ ID NO: 9829 - DNA, 31 bp, Artificial Sequence
  Description of Artificial Sequence: Synthetic oligonucleotide
gcatcattgctggcctagttctctttggagc

SEQ ID NO: 9830 - DNA, 34 bp, Artificial Sequence
  Description of Artificial Sequence: Synthetic oligonucleotide
catcattgctggcctagttctctttggagctatg

SEQ ID NO: 9831 - DNA, 36 bp, Artificial Sequence
  Description of Artificial Sequence: Synthetic oligonucleotide
atcattgctggcctagttctctttggagctatgttc

SEQ ID NO: 9832 - DNA, 35 bp, Artificial Sequence
  Description of Artificial Sequence: Synthetic oligonucleotide
tcattgctggcctagttctctttggagctatgttc

SEQ ID NO: 9833 - DNA, 34 bp, Artificial Sequence
  Description of Artificial Sequence: Synthetic oligonucleotide
cattgctggcctagttctctttggagctatgttc

SEQ ID NO: 9834 - DNA, 34 bp, Artificial Sequence
  Description of Artificial Sequence: Synthetic oligonucleotide
attgctggcctagttctctttggagctatgttcg

SEQ ID NO: 9835 - DNA, 33 bp, Artificial Sequence
  Description of Artificial Sequence: Synthetic oligonucleotide
ttgctggcctagttctctttggagctatgttcg

SEQ ID NO: 9836 - DNA, 32 bp, Artificial Sequence
  Description of Artificial Sequence: Synthetic oligonucleotide
tgctggcctagttctctttggagctatgttcg

SEQ ID NO: 9837 - DNA, 31 bp, Artificial Sequence
  Description of Artificial Sequence: Synthetic oligonucleotide
gctggcctagttctctttggagctatgttcg

SEQ ID NO: 9838 - DNA, 31 bp, Artificial Sequence
  Description of Artificial Sequence: Synthetic oligonucleotide
ctggcctagttctctttggagctatgttcgc

SEQ ID NO: 9839 - DNA, 32 bp, Artificial Sequence
  Description of Artificial Sequence: Synthetic oligonucleotide
tggcctagttctctttggagctatgttcgctg

SEQ ID NO: 9840 - DNA, 31 bp, Artificial Sequence
  Description of Artificial Sequence: Synthetic oligonucleotide
ggcctagttctctttggagctatgttcgctg

SEQ ID NO: 9841 - DNA, 31 bp, Artificial Sequence
  Description of Artificial Sequence: Synthetic oligonucleotide
gcctagttctctttggagctatgttcgctgg

SEQ ID NO: 9842 - DNA, 32 bp, Artificial Sequence
  Description of Artificial Sequence: Synthetic oligonucleotide
cctagttctctttggagctatgttcgctggag

SEQ ID NO: 9843 - DNA, 32 bp, Artificial Sequence
  Description of Artificial Sequence: Synthetic oligonucleotide
ctagttctctttggagctatgttcgctggagc

SEQ ID NO: 9844 - DNA, 33 bp, Artificial Sequence
  Description of Artificial Sequence: Synthetic oligonucleotide
tagttctctttggagctatgttcgctggagctg

SEQ ID NO: 9845 - DNA, 32 bp, Artificial Sequence
  Description of Artificial Sequence: Synthetic oligonucleotide
agttctctttggagctatgttcgctggagctg

SEQ ID NO: 9846 - DNA, 31 bp, Artificial Sequence
  Description of Artificial Sequence: Synthetic oligonucleotide
gttctctttggagctatgttcgctggagctg

SEQ ID NO: 9847 - DNA, 32 bp, Artificial Sequence
  Description of Artificial Sequence: Synthetic oligonucleotide
ttctctttggagctatgttcgctggagctgtg

SEQ ID NO: 9848 - DNA, 31 bp, Artificial Sequence
  Description of Artificial Sequence: Synthetic oligonucleotide
tctctttggagctatgttcgctggagctgtg

SEQ ID NO: 9849 - DNA, 30 bp, Artificial Sequence
  Description of Artificial Sequence: Synthetic oligonucleotide
ctctttggagctatgttcgctggagctgtg

SEQ ID NO: 9850 - DNA, 30 bp, Artificial Sequence
  Description of Artificial Sequence: Synthetic oligonucleotide
tctttggagctatgttcgctggagctgtgg

SEQ ID NO: 9851 - DNA, 29 bp, Artificial Sequence
  Description of Artificial Sequence: Synthetic oligonucleotide
ctttggagctatgttcgctggagctgtgg

SEQ ID NO: 9852 - DNA, 30 bp, Artificial Sequence
  Description of Artificial Sequence: Synthetic oligonucleotide
tttggagctatgttcgctggagctgtggtc

SEQ ID NO: 9853 - DNA, 29 bp, Artificial Sequence
  Description of Artificial Sequence: Synthetic oligonucleotide
ttggagctatgttcgctggagctgtggtc

SEQ ID NO: 9854 - DNA, 28 bp, Artificial Sequence
  Description of Artificial Sequence: Synthetic oligonucleotide
tggagctatgttcgctggagctgtggtc

SEQ ID NO: 9855 - DNA, 27 bp, Artificial Sequence
  Description of Artificial Sequence: Synthetic oligonucleotide
ggagctatgttcgctggagctgtggtc

SEQ ID NO: 9856 - DNA, 27 bp, Artificial Sequence
  Description of Artificial Sequence: Synthetic oligonucleotide
gagctatgttcgctggagctgtggtcg

SEQ ID NO: 9857 - DNA, 27 bp, Artificial Sequence
  Description of Artificial Sequence: Synthetic oligonucleotide
agctatgttcgctggagctgtggtcgc

SEQ ID NO: 9858 - DNA, 27 bp, Artificial Sequence
  Description of Artificial Sequence: Synthetic oligonucleotide
gctatgttcgctggagctgtggtcgct

SEQ ID NO: 9859 - DNA, 27 bp, Artificial Sequence
  Description of Artificial Sequence: Synthetic oligonucleotide
ctatgttcgctggagctgtggtcgctg

SEQ ID NO: 9860 - DNA, 27 bp, Artificial Sequence
  Description of Artificial Sequence: Synthetic oligonucleotide
tatgttcgctggagctgtggtcgctgc

SEQ ID NO: 9861 - DNA, 27 bp, Artificial Sequence
  Description of Artificial Sequence: Synthetic oligonucleotide
atgttcgctggagctgtggtcgctgct

SEQ ID NO: 9862 - DNA, 26 bp, Artificial Sequence
  Description of Artificial Sequence: Synthetic oligonucleotide
tgttcgctggagctgtggtcgctgct

SEQ ID NO: 9863 - DNA, 25 bp, Artificial Sequence
  Description of Artificial Sequence: Synthetic oligonucleotide
gttcgctggagctgtggtcgctgct

SEQ ID NO: 9864 - DNA, 26 bp, Artificial Sequence
  Description of Artificial Sequence: Synthetic oligonucleotide
ttcgctggagctgtggtcgctgctgt

SEQ ID NO: 9865 - DNA, 25 bp, Artificial Sequence
  Description of Artificial Sequence: Synthetic oligonucleotide
tcgctggagctgtggtcgctgctgt

SEQ ID NO: 9866 - DNA, 24 bp, Artificial Sequence
  Description of Artificial Sequence: Synthetic oligonucleotide
cgctggagctgtggtcgctgctgt

SEQ ID NO: 9867 - DNA, 25 bp, Artificial Sequence
  Description of Artificial Sequence: Synthetic oligonucleotide
gctggagctgtggtcgctgctgtga

SEQ ID NO: 9868 - DNA, 25 bp, Artificial Sequence
  Description of Artificial Sequence: Synthetic oligonucleotide
ctggagctgtggtcgctgctgtgag

SEQ ID NO: 9869 - DNA, 26 bp, Artificial Sequence
  Description of Artificial Sequence: Synthetic oligonucleotide
tggagctgtggtcgctgctgtgaggt

SEQ ID NO: 9870 - DNA, 25 bp, Artificial Sequence
  Description of Artificial Sequence: Synthetic oligonucleotide
ggagctgtggtcgctgctgtgaggt

SEQ ID NO: 9871 - DNA, 25 bp, Artificial Sequence
  Description of Artificial Sequence: Synthetic oligonucleotide
gagctgtggtcgctgctgtgaggtg

SEQ ID NO: 9872 - DNA, 26 bp, Artificial Sequence
  Description of Artificial Sequence: Synthetic oligonucleotide
agctgtggtcgctgctgtgaggtgga

SEQ ID NO: 9873 - DNA, 25 bp, Artificial Sequence
  Description of Artificial Sequence: Synthetic oligonucleotide
gctgtggtcgctgctgtgaggtgga

SEQ ID NO: 9874 - DNA, 25 bp, Artificial Sequence
  Description of Artificial Sequence: Synthetic oligonucleotide
ctgtggtcgctgctgtgaggtggag

SEQ ID NO: 9875 - DNA, 26 bp, Artificial Sequence
  Description of Artificial Sequence: Synthetic oligonucleotide
tgtggtcgctgctgtgaggtggagga

SEQ ID NO: 9876 - DNA, 25 bp, Artificial Sequence
  Description of Artificial Sequence: Synthetic oligonucleotide
gtggtcgctgctgtgaggtggagga

SEQ ID NO: 9877 - DNA, 25 bp, Artificial Sequence
  Description of Artificial Sequence: Synthetic oligonucleotide
tggtcgctgctgtgaggtggaggag

SEQ ID NO: 9878 - DNA, 24 bp, Artificial Sequence
  Description of Artificial Sequence: Synthetic oligonucleotide
ggtcgctgctgtgaggtggaggag

SEQ ID NO: 9879 - DNA, 26 bp, Artificial Sequence
  Description of Artificial Sequence: Synthetic oligonucleotide
gtcgctgctgtgaggtggaggaggaa

SEQ ID NO: 9880 - DNA, 27 bp, Artificial Sequence
  Description of Artificial Sequence: Synthetic oligonucleotide
tcgctgctgtgaggtggaggaggaaga

SEQ ID NO: 9881 - DNA, 26 bp, Artificial Sequence
  Description of Artificial Sequence: Synthetic oligonucleotide
cgctgctgtgaggtggaggaggaaga

SEQ ID NO: 9882 - DNA, 26 bp, Artificial Sequence
  Description of Artificial Sequence: Synthetic oligonucleotide
gctgctgtgaggtggaggaggaagag

SEQ ID NO: 9883 - DNA, 27 bp, Artificial Sequence
  Description of Artificial Sequence: Synthetic oligonucleotide
ctgctgtgaggtggaggaggaagagct

SEQ ID NO: 9884 - DNA, 27 bp, Artificial Sequence
  Description of Artificial Sequence: Synthetic oligonucleotide
tgctgtgaggtggaggaggaagagctc

SEQ ID NO: 9885 - DNA, 27 bp, Artificial Sequence
  Description of Artificial Sequence: Synthetic oligonucleotide
gctgtgaggtggaggaggaagagctca

SEQ ID NO: 9886 - DNA, 27 bp, Artificial Sequence
  Description of Artificial Sequence: Synthetic oligonucleotide
ctgtgaggtggaggaggaagagctcag

SEQ ID NO: 9887 - DNA, 30 bp, Artificial Sequence
  Description of Artificial Sequence: Synthetic oligonucleotide
tgtgaggtggaggaggaagagctcagatag

SEQ ID NO: 9888 - DNA, 29 bp, Artificial Sequence
  Description of Artificial Sequence: Synthetic oligonucleotide
gtgaggtggaggaggaagagctcagatag

SEQ ID NO: 9889 - DNA, 33 bp, Artificial Sequence
  Description of Artificial Sequence: Synthetic oligonucleotide
tgaggtggaggaggaagagctcagatagaaaag

SEQ ID NO: 9890 - DNA, 32 bp, Artificial Sequence
  Description of Artificial Sequence: Synthetic oligonucleotide
gaggtggaggaggaagagctcagatagaaaag

SEQ ID NO: 9891 - DNA, 32 bp, Artificial Sequence
  Description of Artificial Sequence: Synthetic oligonucleotide
aggtggaggaggaagagctcagatagaaaagg

SEQ ID NO: 9892 - DNA, 31 bp, Artificial Sequence
  Description of Artificial Sequence: Synthetic oligonucleotide
ggtggaggaggaagagctcagatagaaaagg

SEQ ID NO: 9893 - DNA, 27 bp, Artificial Sequence
  Description of Artificial Sequence: Synthetic oligonucleotide
gcagtgacagtgcccagggctctgata

SEQ ID NO: 9894 - DNA, 28 bp, Artificial Sequence
  Description of Artificial Sequence: Synthetic oligonucleotide
cagtgacagtgcccagggctctgatatg

SEQ ID NO: 9895 - DNA, 29 bp, Artificial Sequence
  Description of Artificial Sequence: Synthetic oligonucleotide
agtgacagtgcccagggctctgatatgtc

SEQ ID NO: 9896 - DNA, 28 bp, Artificial Sequence
  Description of Artificial Sequence: Synthetic oligonucleotide
gtgacagtgcccagggctctgatatgtc

SEQ ID NO: 9897 - DNA, 29 bp, Artificial Sequence
  Description of Artificial Sequence: Synthetic oligonucleotide
tgacagtgcccagggctctgatatgtctc

SEQ ID NO: 9898 - DNA, 28 bp, Artificial Sequence
  Description of Artificial Sequence: Synthetic oligonucleotide
gacagtgcccagggctctgatatgtctc

SEQ ID NO: 9899 - DNA, 29 bp, Artificial Sequence
  Description of Artificial Sequence: Synthetic oligonucleotide
acagtgcccagggctctgatatgtctctc

SEQ ID NO: 9900 - DNA, 28 bp, Artificial Sequence
  Description of Artificial Sequence: Synthetic oligonucleotide
cagtgcccagggctctgatatgtctctc

SEQ ID NO: 9901 - DNA, 29 bp, Artificial Sequence
  Description of Artificial Sequence: Synthetic oligonucleotide
agtgcccagggctctgatatgtctctcac

SEQ ID NO: 9902 - DNA, 28 bp, Artificial Sequence
  Description of Artificial Sequence: Synthetic oligonucleotide
gtgcccagggctctgatatgtctctcac

SEQ ID NO: 9903 - DNA, 29 bp, Artificial Sequence
  Description of Artificial Sequence: Synthetic oligonucleotide
tgcccagggctctgatatgtctctcacag

SEQ ID NO: 9904 - DNA, 28 bp, Artificial Sequence
  Description of Artificial Sequence: Synthetic oligonucleotide
gcccagggctctgatatgtctctcacag

SEQ ID NO: 9905 - DNA, 28 bp, Artificial Sequence
  Description of Artificial Sequence: Synthetic oligonucleotide
cccagggctctgatatgtctctcacagc

SEQ ID NO: 9906 - DNA, 30 bp, Artificial Sequence
  Description of Artificial Sequence: Synthetic oligonucleotide
ccagggctctgatatgtctctcacagcttg

SEQ ID NO: 9907 - DNA, 34 bp, Artificial Sequence
  Description of Artificial Sequence: Synthetic oligonucleotide
cagggctctgatatgtctctcacagcttgtaaag

SEQ ID NO: 9908 - DNA, 35 bp, Artificial Sequence
  Description of Artificial Sequence: Synthetic oligonucleotide
agggctctgatatgtctctcacagcttgtaaagtg

SEQ ID NO: 9909 - DNA, 34 bp, Artificial Sequence
  Description of Artificial Sequence: Synthetic oligonucleotide
gggctctgatatgtctctcacagcttgtaaagtg

SEQ ID NO: 9910 - DNA, 35 bp, Artificial Sequence
  Description of Artificial Sequence: Synthetic oligonucleotide
ggctctgatatgtctctcacagcttgtaaagtgtg

SEQ ID NO: 9911 - DNA, 24 bp, Artificial Sequence
  Description of Artificial Sequence: Synthetic oligonucleotide
gcagcgggatggggaggaccagat

SEQ ID NO: 9912 - DNA, 24 bp, Artificial Sequence
  Description of Artificial Sequence: Synthetic oligonucleotide
cagcgggatggggaggaccagatc

SEQ ID NO: 9913 - DNA, 25 bp, Artificial Sequence
  Description of Artificial Sequence: Synthetic oligonucleotide
agcgggatggggaggaccagatcca

SEQ ID NO: 9914 - DNA, 24 bp, Artificial Sequence
  Description of Artificial Sequence: Synthetic oligonucleotide
gcgggatggggaggaccagatcca

SEQ ID NO: 9915 - DNA, 24 bp, Artificial Sequence
  Description of Artificial Sequence: Synthetic oligonucleotide
cgggatggggaggaccagatccag

SEQ ID NO: 9916 - DNA, 25 bp, Artificial Sequence
  Description of Artificial Sequence: Synthetic oligonucleotide
gggatggggaggaccagatccagga

SEQ ID NO: 9917 - DNA, 26 bp, Artificial Sequence
  Description of Artificial Sequence: Synthetic oligonucleotide
ggatggggaggaccagatccaggaca

SEQ ID NO: 9918 - DNA, 26 bp, Artificial Sequence
  Description of Artificial Sequence: Synthetic oligonucleotide
gatggggaggaccagatccaggacac

SEQ ID NO: 9919 - DNA, 26 bp, Artificial Sequence
  Description of Artificial Sequence: Synthetic oligonucleotide
atggggaggaccagatccaggacacg

SEQ ID NO: 9920 - DNA, 25 bp, Artificial Sequence
  Description of Artificial Sequence: Synthetic oligonucleotide
tggggaggaccagatccaggacacg

SEQ ID NO: 9921 - DNA, 24 bp, Artificial Sequence
  Description of Artificial Sequence: Synthetic oligonucleotide
ggggaggaccagatccaggacacg

SEQ ID NO: 9922 - DNA, 25 bp, Artificial Sequence
  Description of Artificial Sequence: Synthetic oligonucleotide
gggaggaccagatccaggacacgga

SEQ ID NO: 9923 - DNA, 25 bp, Artificial Sequence
  Description of Artificial Sequence: Synthetic oligonucleotide
ggaggaccagatccaggacacggag

SEQ ID NO: 9924 - DNA, 26 bp, Artificial Sequence
  Description of Artificial Sequence: Synthetic oligonucleotide
gaggaccagatccaggacacggagct

SEQ ID NO: 9925 - DNA, 26 bp, Artificial Sequence
  Description of Artificial Sequence: Synthetic oligonucleotide
aggaccagatccaggacacggagctc

SEQ ID NO: 9926 - DNA, 25 bp, Artificial Sequence
  Description of Artificial Sequence: Synthetic oligonucleotide
ggaccagatccaggacacggagctc

SEQ ID NO: 9927 - DNA, 26 bp, Artificial Sequence
  Description of Artificial Sequence: Synthetic oligonucleotide
gaccagatccaggacacggagctcgt

SEQ ID NO: 9928 - DNA, 26 bp, Artificial Sequence
  Description of Artificial Sequence: Synthetic oligonucleotide
accagatccaggacacggagctcgtg

SEQ ID NO: 9929 - DNA, 25 bp, Artificial Sequence
  Description of Artificial Sequence: Synthetic oligonucleotide
ccagatccaggacacggagctcgtg

SEQ ID NO: 9930 - DNA, 26 bp, Artificial Sequence
  Description of Artificial Sequence: Synthetic oligonucleotide
cagatccaggacacggagctcgtgga

SEQ ID NO: 9931 - DNA, 27 bp, Artificial Sequence
  Description of Artificial Sequence: Synthetic oligonucleotide
agatccaggacacggagctcgtggaga

SEQ ID NO: 9932 - DNA, 26 bp, Artificial Sequence
  Description of Artificial Sequence: Synthetic oligonucleotide
gatccaggacacggagctcgtggaga

SEQ ID NO: 9933 - DNA, 26 bp, Artificial Sequence
  Description of Artificial Sequence: Synthetic oligonucleotide
atccaggacacggagctcgtggagac

SEQ ID NO: 9934 - DNA, 25 bp, Artificial Sequence
  Description of Artificial Sequence: Synthetic oligonucleotide
tccaggacacggagctcgtggagac

SEQ ID NO: 9935 - DNA, 24 bp, Artificial Sequence
  Description of Artificial Sequence: Synthetic oligonucleotide
tggggtcggactggcgcttcctct

SEQ ID NO: 9936 - DNA, 23 bp, Artificial Sequence
  Description of Artificial Sequence: Synthetic oligonucleotide
ggggtcggactggcgcttcctct

SEQ ID NO: 9937 - DNA, 23 bp, Artificial Sequence
  Description of Artificial Sequence: Synthetic oligonucleotide
gggtcggactggcgcttcctctg

SEQ ID NO: 9938 - DNA, 23 bp, Artificial Sequence
  Description of Artificial Sequence: Synthetic oligonucleotide
ggtcggactggcgcttcctctgc

SEQ ID NO: 9939 - DNA, 23 bp, Artificial Sequence
  Description of Artificial Sequence: Synthetic oligonucleotide
gtcggactggcgcttcctctgcg

SEQ ID NO: 9940 - DNA, 23 bp, Artificial Sequence
  Description of Artificial Sequence: Synthetic oligonucleotide
tcggactggcgcttcctctgcgg

SEQ ID NO: 9941 - DNA, 22 bp, Artificial Sequence
  Description of Artificial Sequence: Synthetic oligonucleotide
cggactggcgcttcctctgcgg

SEQ ID NO: 9942 - DNA, 24 bp, Artificial Sequence
  Description of Artificial Sequence: Synthetic oligonucleotide
ggactggcgcttcctctgcgggta

SEQ ID NO: 9943 - DNA, 24 bp, Artificial Sequence
  Description of Artificial Sequence: Synthetic oligonucleotide
gactggcgcttcctctgcgggtac

SEQ ID NO: 9944 - DNA, 25 bp, Artificial Sequence
  Description of Artificial Sequence: Synthetic oligonucleotide
actggcgcttcctctgcgggtacca

SEQ ID NO: 9945 - DNA, 24 bp, Artificial Sequence
  Description of Artificial Sequence: Synthetic oligonucleotide
ctggcgcttcctctgcgggtacca

SEQ ID NO: 9946 - DNA, 24 bp, Artificial Sequence
  Description of Artificial Sequence: Synthetic oligonucleotide
tggcgcttcctctgcgggtaccac

SEQ ID NO: 9947 - DNA, 23 bp, Artificial Sequence
  Description of Artificial Sequence: Synthetic oligonucleotide
ggcgcttcctctgcgggtaccac

SEQ ID NO: 9948 - DNA, 24 bp, Artificial Sequence
  Description of Artificial Sequence: Synthetic oligonucleotide
gcgcttcctctgcgggtaccacca

SEQ ID NO: 9949 - DNA, 26 bp, Artificial Sequence
  Description of Artificial Sequence: Synthetic oligonucleotide
cgcttcctctgcgggtaccaccagta

SEQ ID NO: 9950 - DNA, 26 bp, Artificial Sequence
  Description of Artificial Sequence: Synthetic oligonucleotide
gcttcctctgcgggtaccaccagtac

SEQ ID NO: 9951 - DNA, 26 bp, Artificial Sequence
  Description of Artificial Sequence: Synthetic oligonucleotide
cttcctctgcgggtaccaccagtacg

SEQ ID NO: 9952 - DNA, 26 bp, Artificial Sequence
  Description of Artificial Sequence: Synthetic oligonucleotide
ttcctctgcgggtaccaccagtacgc

SEQ ID NO: 9953 - DNA, 25 bp, Artificial Sequence
  Description of Artificial Sequence: Synthetic oligonucleotide
tcctctgcgggtaccaccagtacgc

SEQ ID NO: 9954 - DNA, 24 bp, Artificial Sequence
  Description of Artificial Sequence: Synthetic oligonucleotide
cctctgcgggtaccaccagtacgc

SEQ ID NO: 9955 - DNA, 26 bp, Artificial Sequence
  Description of Artificial Sequence: Synthetic oligonucleotide
ctctgcgggtaccaccagtacgccta

SEQ ID NO: 9956 - DNA, 26 bp, Artificial Sequence
  Description of Artificial Sequence: Synthetic oligonucleotide
tctgcgggtaccaccagtacgcctac

SEQ ID NO: 9957 - DNA, 25 bp, Artificial Sequence
  Description of Artificial Sequence: Synthetic oligonucleotide
ctgcgggtaccaccagtacgcctac

SEQ ID NO: 9958 - DNA, 26 bp, Artificial Sequence
  Description of Artificial Sequence: Synthetic oligonucleotide
tgcgggtaccaccagtacgcctacga

SEQ ID NO: 9959 - DNA, 26 bp, Artificial Sequence
  Description of Artificial Sequence: Synthetic oligonucleotide
cggcccatgtggcggagcagttgaaa

SEQ ID NO: 9960 - DNA, 26 bp, Artificial Sequence
  Description of Artificial Sequence: Synthetic oligonucleotide
ggcccatgtggcggagcagttgaaag

SEQ ID NO: 9961 - DNA, 26 bp, Artificial Sequence
  Description of Artificial Sequence: Synthetic oligonucleotide
gcccatgtggcggagcagttgaaagc

SEQ ID NO: 9962 - DNA, 27 bp, Artificial Sequence
  Description of Artificial Sequence: Synthetic oligonucleotide
cccatgtggcggagcagttgaaagcct

SEQ ID NO: 9963 - DNA, 28 bp, Artificial Sequence
  Description of Artificial Sequence: Synthetic oligonucleotide
ccatgtggcggagcagttgaaagcctac

SEQ ID NO: 9964 - DNA, 28 bp, Artificial Sequence
  Description of Artificial Sequence: Synthetic oligonucleotide
catgtggcggagcagttgaaagcctacc

SEQ ID NO: 9965 - DNA, 29 bp, Artificial Sequence
  Description of Artificial Sequence: Synthetic oligonucleotide
atgtggcggagcagttgaaagcctacctg

SEQ ID NO: 9966 - DNA, 28 bp, Artificial Sequence
  Description of Artificial Sequence: Synthetic oligonucleotide
tgtggcggagcagttgaaagcctacctg

SEQ ID NO: 9967 - DNA, 27 bp, Artificial Sequence
  Description of Artificial Sequence: Synthetic oligonucleotide
gtggcggagcagttgaaagcctacctg

SEQ ID NO: 9968 - DNA, 27 bp, Artificial Sequence
  Description of Artificial Sequence: Synthetic oligonucleotide
tggcggagcagttgaaagcctacctgg

SEQ ID NO: 9969 - DNA, 27 bp, Artificial Sequence
  Description of Artificial Sequence: Synthetic oligonucleotide
ggcggagcagttgaaagcctacctgga

SEQ ID NO: 9970 - DNA, 27 bp, Artificial Sequence
  Description of Artificial Sequence: Synthetic oligonucleotide
gcggagcagttgaaagcctacctggag

SEQ ID NO: 9971 - DNA, 27 bp, Artificial Sequence
  Description of Artificial Sequence: Synthetic oligonucleotide
cggagcagttgaaagcctacctggagg

SEQ ID NO: 9972 - DNA, 27 bp, Artificial Sequence
  Description of Artificial Sequence: Synthetic oligonucleotide
ggagcagttgaaagcctacctggaggg

SEQ ID NO: 9973 - DNA, 27 bp, Artificial Sequence
  Description of Artificial Sequence: Synthetic oligonucleotide
gagcagttgaaagcctacctggagggc

SEQ ID NO: 9974 - DNA, 28 bp, Artificial Sequence
  Description of Artificial Sequence: Synthetic oligonucleotide
agcagttgaaagcctacctggagggcac

SEQ ID NO: 9975 - DNA, 27 bp, Artificial Sequence
  Description of Artificial Sequence: Synthetic oligonucleotide
gcagttgaaagcctacctggagggcac

SEQ ID NO: 9976 - DNA, 27 bp, Artificial Sequence
  Description of Artificial Sequence: Synthetic oligonucleotide
cagttgaaagcctacctggagggcacg

SEQ ID NO: 9977 - DNA, 28 bp, Artificial Sequence
  Description of Artificial Sequence: Synthetic oligonucleotide
agttgaaagcctacctggagggcacgtg

SEQ ID NO: 9978 - DNA, 27 bp, Artificial Sequence
  Description of Artificial Sequence: Synthetic oligonucleotide
gttgaaagcctacctggagggcacgtg

SEQ ID NO: 9979 - DNA, 27 bp, Artificial Sequence
  Description of Artificial Sequence: Synthetic oligonucleotide
ttgaaagcctacctggagggcacgtgc

SEQ ID NO: 9980 - DNA, 26 bp, Artificial Sequence
  Description of Artificial Sequence: Synthetic oligonucleotide
tgaaagcctacctggagggcacgtgc

SEQ ID NO: 9981 - DNA, 25 bp, Artificial Sequence
  Description of Artificial Sequence: Synthetic oligonucleotide
gaaagcctacctggagggcacgtgc

SEQ ID NO: 9982 - DNA, 26 bp, Artificial Sequence
  Description of Artificial Sequence: Synthetic oligonucleotide
aaagcctacctggagggcacgtgcgt

SEQ ID NO: 9983 - DNA, 25 bp, Artificial Sequence
  Description of Artificial Sequence: Synthetic oligonucleotide
aagcctacctggagggcacgtgcgt

SEQ ID NO: 9984 - DNA, 26 bp, Artificial Sequence
  Description of Artificial Sequence: Synthetic oligonucleotide
tccggagtattgggacggggagacag

SEQ ID NO: 9985 - DNA, 25 bp, Artificial Sequence
  Description of Artificial Sequence: Synthetic oligonucleotide
ccggagtattgggacggggagacag

SEQ ID NO: 9986 - DNA, 25 bp, Artificial Sequence
  Description of Artificial Sequence: Synthetic oligonucleotide
cggagtattgggacggggagacagg

SEQ ID NO: 9987 - DNA, 27 bp, Artificial Sequence
  Description of Artificial Sequence: Synthetic oligonucleotide
ggagtattgggacggggagacagggaa

SEQ ID NO: 9988 - DNA, 28 bp, Artificial Sequence
  Description of Artificial Sequence: Synthetic oligonucleotide
gagtattgggacggggagacagggaaag

SEQ ID NO: 9989 - DNA, 29 bp, Artificial Sequence
  Description of Artificial Sequence: Synthetic oligonucleotide
agtattgggacggggagacagggaaagtg

SEQ ID NO: 9990 - DNA, 28 bp, Artificial Sequence
  Description of Artificial Sequence: Synthetic oligonucleotide
gtattgggacggggagacagggaaagtg

SEQ ID NO: 9991 - DNA, 30 bp, Artificial Sequence
  Description of Artificial Sequence: Synthetic oligonucleotide
tattgggacggggagacagggaaagtgaag

SEQ ID NO: 9992 - DNA, 29 bp, Artificial Sequence
  Description of Artificial Sequence: Synthetic oligonucleotide
attgggacggggagacagggaaagtgaag

SEQ ID NO: 9993 - DNA, 28 bp, Artificial Sequence
  Description of Artificial Sequence: Synthetic oligonucleotide
ttgggacggggagacagggaaagtgaag

SEQ ID NO: 9994 - DNA, 27 bp, Artificial Sequence
  Description of Artificial Sequence: Synthetic oligonucleotide
tgggacggggagacagggaaagtgaag

SEQ ID NO: 9995 - DNA, 26 bp, Artificial Sequence
  Description of Artificial Sequence: Synthetic oligonucleotide
gggacggggagacagggaaagtgaag

SEQ ID NO: 9996 - DNA, 26 bp, Artificial Sequence
  Description of Artificial Sequence: Synthetic oligonucleotide
ggacggggagacagggaaagtgaagg

SEQ ID NO: 9997 - DNA, 26 bp, Artificial Sequence
  Description of Artificial Sequence: Synthetic oligonucleotide
gacggggagacagggaaagtgaaggc

SEQ ID NO: 9998 - DNA, 26 bp, Artificial Sequence
  Description of Artificial Sequence: Synthetic oligonucleotide
acggggagacagggaaagtgaaggcc

SEQ ID NO: 9999 - DNA, 25 bp, Artificial Sequence
  Description of Artificial Sequence: Synthetic oligonucleotide
cggggagacagggaaagtgaaggcc

SEQ ID NO: 10000 - DNA, 26 bp, Artificial Sequence
  Description of Artificial Sequence: Synthetic oligonucleotide
ggggagacagggaaagtgaaggccca

SEQ ID NO: 10001 - DNA, 27 bp, Artificial Sequence
  Description of Artificial Sequence: Synthetic oligonucleotide
gggagacagggaaagtgaaggcccact

SEQ ID NO: 10002 - DNA, 22 bp, Artificial Sequence
  Description of Artificial Sequence: Synthetic oligonucleotide
accgcggcggacatggcagctc

SEQ ID NO: 10003 - DNA, 21 bp, Artificial Sequence
  Description of Artificial Sequence: Synthetic oligonucleotide
ccgcggcggacatggcagctc

SEQ ID NO: 10004 - DNA, 21 bp, Artificial Sequence
  Description of Artificial Sequence: Synthetic oligonucleotide
cgcggcggacatggcagctcg

SEQ ID NO: 10005 - DNA, 22 bp, Artificial Sequence
  Description of Artificial Sequence: Synthetic oligonucleotide
gcggcggacatggcagctcgga

SEQ ID NO: 10006 - DNA, 22 bp, Artificial Sequence
  Description of Artificial Sequence: Synthetic oligonucleotide
cggcggacatggcagctcggac

SEQ ID NO: 10007 - DNA, 23 bp, Artificial Sequence
  Description of Artificial Sequence: Synthetic oligonucleotide
ggcggacatggcagctcggacca

SEQ ID NO: 10008 - DNA, 23 bp, Artificial Sequence
  Description of Artificial Sequence: Synthetic oligonucleotide
gcggacatggcagctcggaccac

SEQ ID NO: 10009 - DNA, 25 bp, Artificial Sequence
  Description of Artificial Sequence: Synthetic oligonucleotide
cggacatggcagctcggaccaccaa

SEQ ID NO: 10010 - DNA, 25 bp, Artificial Sequence
  Description of Artificial Sequence: Synthetic oligonucleotide
ggacatggcagctcggaccaccaag

SEQ ID NO: 10011 - DNA, 26 bp, Artificial Sequence
  Description of Artificial Sequence: Synthetic oligonucleotide
gacatggcagctcggaccaccaagca

SEQ ID NO: 10012 - DNA, 27 bp, Artificial Sequence
  Description of Artificial Sequence: Synthetic oligonucleotide
acatggcagctcggaccaccaagcaca

SEQ ID NO: 10013 - DNA, 27 bp, Artificial Sequence
  Description of Artificial Sequence: Synthetic oligonucleotide
catggcagctcggaccaccaagcacaa

SEQ ID NO: 10014 - DNA, 27 bp, Artificial Sequence
  Description of Artificial Sequence: Synthetic oligonucleotide
atggcagctcggaccaccaagcacaag

SEQ ID NO: 10015 - DNA, 27 bp, Artificial Sequence
  Description of Artificial Sequence: Synthetic oligonucleotide
tggcagctcggaccaccaagcacaagt

SEQ ID NO: 10016 - DNA, 26 bp, Artificial Sequence
  Description of Artificial Sequence: Synthetic oligonucleotide
ggcagctcggaccaccaagcacaagt

SEQ ID NO: 10017 - DNA, 26 bp, Artificial Sequence
  Description of Artificial Sequence: Synthetic oligonucleotide
gcagctcggaccaccaagcacaagtg

SEQ ID NO: 10018 - DNA, 26 bp, Artificial Sequence
  Description of Artificial Sequence: Synthetic oligonucleotide
cagctcggaccaccaagcacaagtgg

SEQ ID NO: 10019 - DNA, 27 bp, Artificial Sequence
  Description of Artificial Sequence: Synthetic oligonucleotide
agctcggaccaccaagcacaagtggga

SEQ ID NO: 10020 - DNA, 26 bp, Artificial Sequence
  Description of Artificial Sequence: Synthetic oligonucleotide
gctcggaccaccaagcacaagtggga

SEQ ID NO: 10021 - DNA, 26 bp, Artificial Sequence
  Description of Artificial Sequence: Synthetic oligonucleotide
ctcggaccaccaagcacaagtgggag

SEQ ID NO: 10022 - DNA, 26 bp, Artificial Sequence
  Description of Artificial Sequence: Synthetic oligonucleotide
tcggaccaccaagcacaagtgggagg

SEQ ID NO: 10023 - DNA, 25 bp, Artificial Sequence
  Description of Artificial Sequence: Synthetic oligonucleotide
cggaccaccaagcacaagtgggagg

SEQ ID NO: 10024 - DNA, 25 bp, Artificial Sequence
  Description of Artificial Sequence: Synthetic oligonucleotide
ggaccaccaagcacaagtgggaggc

SEQ ID NO: 10025 - DNA, 24 bp, Artificial Sequence
  Description of Artificial Sequence: Synthetic oligonucleotide
gcgggcgccgtggatagagcagaa

SEQ ID NO: 10026 - DNA, 24 bp, Artificial Sequence
  Description of Artificial Sequence: Synthetic oligonucleotide
cgggcgccgtggatagagcagaag

SEQ ID NO: 10027 - DNA, 24 bp, Artificial Sequence
  Description of Artificial Sequence: Synthetic oligonucleotide
gggcgccgtggatagagcagaagg

SEQ ID NO: 10028 - DNA, 25 bp, Artificial Sequence
  Description of Artificial Sequence: Synthetic oligonucleotide
ggcgccgtggatagagcagaagggt

SEQ ID NO: 10029 - DNA, 25 bp, Artificial Sequence
  Description of Artificial Sequence: Synthetic oligonucleotide
gcgccgtggatagagcagaagggtc

SEQ ID NO: 10030 - DNA, 25 bp, Artificial Sequence
  Description of Artificial Sequence: Synthetic oligonucleotide
cgccgtggatagagcagaagggtcc

SEQ ID NO: 10031 - DNA, 25 bp, Artificial Sequence
  Description of Artificial Sequence: Synthetic oligonucleotide
gccgtggatagagcagaagggtccg

SEQ ID NO: 10032 - DNA, 26 bp, Artificial Sequence
  Description of Artificial Sequence: Synthetic oligonucleotide
ccgtggatagagcagaagggtccgga

SEQ ID NO: 10033 - DNA, 27 bp, Artificial Sequence
  Description of Artificial Sequence: Synthetic oligonucleotide
cgtggatagagcagaagggtccggagt

SEQ ID NO: 10034 - DNA, 30 bp, Artificial Sequence
  Description of Artificial Sequence: Synthetic oligonucleotide
gtggatagagcagaagggtccggagtattg

SEQ ID NO: 10035 - DNA, 30 bp, Artificial Sequence
  Description of Artificial Sequence: Synthetic oligonucleotide
tggatagagcagaagggtccggagtattgg

SEQ ID NO: 10036 - DNA, 29 bp, Artificial Sequence
  Description of Artificial Sequence: Synthetic oligonucleotide
ggatagagcagaagggtccggagtattgg

SEQ ID NO: 10037 - DNA, 29 bp, Artificial Sequence
  Description of Artificial Sequence: Synthetic oligonucleotide
gatagagcagaagggtccggagtattggg

SEQ ID NO: 10038 - DNA, 30 bp, Artificial Sequence
  Description of Artificial Sequence: Synthetic oligonucleotide
atagagcagaagggtccggagtattgggac

SEQ ID NO: 10039 - DNA, 29 bp, Artificial Sequence
  Description of Artificial Sequence: Synthetic oligonucleotide
tagagcagaagggtccggagtattgggac

SEQ ID NO: 10040 - DNA, 28 bp, Artificial Sequence
  Description of Artificial Sequence: Synthetic oligonucleotide
agagcagaagggtccggagtattgggac

SEQ ID NO: 10041 - DNA, 27 bp, Artificial Sequence
  Description of Artificial Sequence: Synthetic oligonucleotide
gagcagaagggtccggagtattgggac

SEQ ID NO: 10042 - DNA, 27 bp, Artificial Sequence
  Description of Artificial Sequence: Synthetic oligonucleotide
agcagaagggtccggagtattgggacg

SEQ ID NO: 10043 - DNA, 26 bp, Artificial Sequence
  Description of Artificial Sequence: Synthetic oligonucleotide
gcagaagggtccggagtattgggacg

SEQ ID NO: 10044 - DNA, 26 bp, Artificial Sequence
  Description of Artificial Sequence: Synthetic oligonucleotide
cagaagggtccggagtattgggacgg

SEQ ID NO: 10045 - DNA, 26 bp, Artificial Sequence
  Description of Artificial Sequence: Synthetic oligonucleotide
agaagggtccggagtattgggacggg

SEQ ID NO: 10046 - DNA, 25 bp, Artificial Sequence
  Description of Artificial Sequence: Synthetic oligonucleotide
gaagggtccggagtattgggacggg

SEQ ID NO: 10047 - DNA, 26 bp, Artificial Sequence
  Description of Artificial Sequence: Synthetic oligonucleotide
aagggtccggagtattgggacgggga

SEQ ID NO: 10048 - DNA, 28 bp, Artificial Sequence
  Description of Artificial Sequence: Synthetic oligonucleotide
agtggctccgcagatacctggagaacag

SEQ ID NO: 10049 - DNA, 27 bp, Artificial Sequence
  Description of Artificial Sequence: Synthetic oligonucleotide
gtggctccgcagatacctggagaacag

SEQ ID NO: 10050 - DNA, 27 bp, Artificial Sequence
  Description of Artificial Sequence: Synthetic oligonucleotide
tggctccgcagatacctggagaacagg

SEQ ID NO: 10051 - DNA, 27 bp, Artificial Sequence
  Description of Artificial Sequence: Synthetic oligonucleotide
ggctccgcagatacctggagaacagga

SEQ ID NO: 10052 - DNA, 28 bp, Artificial Sequence
  Description of Artificial Sequence: Synthetic oligonucleotide
gctccgcagatacctggagaacaggaag

SEQ ID NO: 10053 - DNA, 28 bp, Artificial Sequence
  Description of Artificial Sequence: Synthetic oligonucleotide
ctccgcagatacctggagaacaggaagg

SEQ ID NO: 10054 - DNA, 29 bp, Artificial Sequence
  Description of Artificial Sequence: Synthetic oligonucleotide
tccgcagatacctggagaacaggaaggag

SEQ ID NO: 10055 - DNA, 28 bp, Artificial Sequence
  Description of Artificial Sequence: Synthetic oligonucleotide
ccgcagatacctggagaacaggaaggag

SEQ ID NO: 10056 - DNA, 29 bp, Artificial Sequence
  Description of Artificial Sequence: Synthetic oligonucleotide
cgcagatacctggagaacaggaaggagac

SEQ ID NO: 10057 - DNA, 29 bp, Artificial Sequence
  Description of Artificial Sequence: Synthetic oligonucleotide
gcagatacctggagaacaggaaggagacg

SEQ ID NO: 10058 - DNA, 29 bp, Artificial Sequence
  Description of Artificial Sequence: Synthetic oligonucleotide
cagatacctggagaacaggaaggagacgc

SEQ ID NO: 10059 - DNA, 30 bp, Artificial Sequence
  Description of Artificial Sequence: Synthetic oligonucleotide
agatacctggagaacaggaaggagacgctg

SEQ ID NO: 10060 - DNA, 29 bp, Artificial Sequence
  Description of Artificial Sequence: Synthetic oligonucleotide
gatacctggagaacaggaaggagacgctg

SEQ ID NO: 10061 - DNA, 29 bp, Artificial Sequence
  Description of Artificial Sequence: Synthetic oligonucleotide
atacctggagaacaggaaggagacgctgc

SEQ ID NO: 10062 - DNA, 28 bp, Artificial Sequence
  Description of Artificial Sequence: Synthetic oligonucleotide
tacctggagaacaggaaggagacgctgc

SEQ ID NO: 10063 - DNA, 27 bp, Artificial Sequence
  Description of Artificial Sequence: Synthetic oligonucleotide
acctggagaacaggaaggagacgctgc

SEQ ID NO: 10064 - DNA, 27 bp, Artificial Sequence
  Description of Artificial Sequence: Synthetic oligonucleotide
cctggagaacaggaaggagacgctgca

SEQ ID NO: 10065 - DNA, 27 bp, Artificial Sequence
  Description of Artificial Sequence: Synthetic oligonucleotide
ctggagaacaggaaggagacgctgcag

SEQ ID NO: 10066 - DNA, 27 bp, Artificial Sequence
  Description of Artificial Sequence: Synthetic oligonucleotide
tggagaacaggaaggagacgctgcagc

SEQ ID NO: 10067 - DNA, 26 bp, Artificial Sequence
  Description of Artificial Sequence: Synthetic oligonucleotide
ggagaacaggaaggagacgctgcagc

SEQ ID NO: 10068 - DNA, 26 bp, Artificial Sequence
  Description of Artificial Sequence: Synthetic oligonucleotide
gagaacaggaaggagacgctgcagcg

SEQ ID NO: 10069 - DNA, 27 bp, Artificial Sequence
  Description of Artificial Sequence: Synthetic oligonucleotide
agaacaggaaggagacgctgcagcgca

SEQ ID NO: 10070 - DNA, 26 bp, Artificial Sequence
  Description of Artificial Sequence: Synthetic oligonucleotide
gaacaggaaggagacgctgcagcgca

SEQ ID NO: 10071 - DNA, 26 bp, Artificial Sequence
  Description of Artificial Sequence: Synthetic oligonucleotide
aacaggaaggagacgctgcagcgcac

SEQ ID NO: 10072 - DNA, 25 bp, Artificial Sequence
  Description of Artificial Sequence: Synthetic oligonucleotide
acaggaaggagacgctgcagcgcac

SEQ ID NO: 10073 - DNA, 24 bp, Artificial Sequence
  Description of Artificial Sequence: Synthetic oligonucleotide
caggaaggagacgctgcagcgcac

SEQ ID NO: 10074 - DNA, 24 bp, Artificial Sequence
  Description of Artificial Sequence: Synthetic oligonucleotide
aggaaggagacgctgcagcgcacg

SEQ ID NO: 10075 - DNA, 27 bp, Artificial Sequence
  Description of Artificial Sequence: Synthetic oligonucleotide
agtggctccgcagatacctggagaacc

SEQ ID NO: 10076 - DNA, 26 bp, Artificial Sequence
  Description of Artificial Sequence: Synthetic oligonucleotide
gtggctccgcagatacctggagaacc

SEQ ID NO: 10077 - DNA, 26 bp, Artificial Sequence
  Description of Artificial Sequence: Synthetic oligonucleotide
tggctccgcagatacctggagaaccg

SEQ ID NO: 10078 - DNA, 25 bp, Artificial Sequence
  Description of Artificial Sequence: Synthetic oligonucleotide
ggctccgcagatacctggagaaccg

SEQ ID NO: 10079 - DNA, 27 bp, Artificial Sequence
  Description of Artificial Sequence: Synthetic oligonucleotide
gctccgcagatacctggagaaccggaa

SEQ ID NO: 10080 - DNA, 27 bp, Artificial Sequence
  Description of Artificial Sequence: Synthetic oligonucleotide
ctccgcagatacctggagaaccggaag

SEQ ID NO: 10081 - DNA, 27 bp, Artificial Sequence
  Description of Artificial Sequence: Synthetic oligonucleotide
tccgcagatacctggagaaccggaagg

SEQ ID NO: 10082 - DNA, 27 bp, Artificial Sequence
  Description of Artificial Sequence: Synthetic oligonucleotide
ccgcagatacctggagaaccggaagga

SEQ ID NO: 10083 - DNA, 27 bp, Artificial Sequence
  Description of Artificial Sequence: Synthetic oligonucleotide
cgcagatacctggagaaccggaaggag

SEQ ID NO: 10084 - DNA, 28 bp, Artificial Sequence
  Description of Artificial Sequence: Synthetic oligonucleotide
gcagatacctggagaaccggaaggagac

SEQ ID NO: 10085 - DNA, 28 bp, Artificial Sequence
  Description of Artificial Sequence: Synthetic oligonucleotide
cagatacctggagaaccggaaggagacg

SEQ ID NO: 10086 - DNA, 28 bp, Artificial Sequence
  Description of Artificial Sequence: Synthetic oligonucleotide
agatacctggagaaccggaaggagacgc

SEQ ID NO: 10087 - DNA, 27 bp, Artificial Sequence
  Description of Artificial Sequence: Synthetic oligonucleotide
gatacctggagaaccggaaggagacgc

SEQ ID NO: 10088 - DNA, 28 bp, Artificial Sequence
  Description of Artificial Sequence: Synthetic oligonucleotide
atacctggagaaccggaaggagacgctg

SEQ ID NO: 10089 - DNA, 27 bp, Artificial Sequence
  Description of Artificial Sequence: Synthetic oligonucleotide
tacctggagaaccggaaggagacgctg

SEQ ID NO: 10090 - DNA, 26 bp, Artificial Sequence
  Description of Artificial Sequence: Synthetic oligonucleotide
acctggagaaccggaaggagacgctg

SEQ ID NO: 10091 - DNA, 25 bp, Artificial Sequence
  Description of Artificial Sequence: Synthetic oligonucleotide
cctggagaaccggaaggagacgctg

SEQ ID NO: 10092 - DNA, 26 bp, Artificial Sequence
  Description of Artificial Sequence: Synthetic oligonucleotide
ctggagaaccggaaggagacgctgca

SEQ ID NO: 10093 - DNA, 26 bp, Artificial Sequence
  Description of Artificial Sequence: Synthetic oligonucleotide
tggagaaccggaaggagacgctgcag

SEQ ID NO: 10094 - DNA, 25 bp, Artificial Sequence
  Description of Artificial Sequence: Synthetic oligonucleotide
ggagaaccggaaggagacgctgcag

SEQ ID NO: 10095 - DNA, 25 bp, Artificial Sequence
  Description of Artificial Sequence: Synthetic oligonucleotide
gagaaccggaaggagacgctgcagc

SEQ ID NO: 10096 - DNA, 25 bp, Artificial Sequence
  Description of Artificial Sequence: Synthetic oligonucleotide
agaaccggaaggagacgctgcagcg

SEQ ID NO: 10097 - DNA, 24 bp, Artificial Sequence
  Description of Artificial Sequence: Synthetic oligonucleotide
gaaccggaaggagacgctgcagcg

SEQ ID NO: 10098 - DNA, 25 bp, Artificial Sequence
  Description of Artificial Sequence: Synthetic oligonucleotide
aaccggaaggagacgctgcagcgca

SEQ ID NO: 10099 - DNA, 24 bp, Artificial Sequence
  Description of Artificial Sequence: Synthetic oligonucleotide
accggaaggagacgctgcagcgca

SEQ ID NO: 10100 - DNA, 23 bp, Artificial Sequence
  Description of Artificial Sequence: Synthetic oligonucleotide
ccggaaggagacgctgcagcgca

SEQ ID NO: 10101 - DNA, 23 bp, Artificial Sequence
  Description of Artificial Sequence: Synthetic oligonucleotide
cggaaggagacgctgcagcgcac

SEQ ID NO: 10102 - DNA, 24 bp, Artificial Sequence
  Description of Artificial Sequence: Synthetic oligonucleotide
caccctgaggtgctgggccctgaa

SEQ ID NO: 10103 - DNA, 26 bp, Artificial Sequence
  Description of Artificial Sequence: Synthetic oligonucleotide
accctgaggtgctgggccctgaactt

SEQ ID NO: 10104 - DNA, 25 bp, Artificial Sequence
  Description of Artificial Sequence: Synthetic oligonucleotide
ccctgaggtgctgggccctgaactt

SEQ ID NO: 10105 - DNA, 27 bp, Artificial Sequence
  Description of Artificial Sequence: Synthetic oligonucleotide
cctgaggtgctgggccctgaacttcta

SEQ ID NO: 10106 - DNA, 27 bp, Artificial Sequence
  Description of Artificial Sequence: Synthetic oligonucleotide
ctgaggtgctgggccctgaacttctac

SEQ ID NO: 10107 - DNA, 27 bp, Artificial Sequence
  Description of Artificial Sequence: Synthetic oligonucleotide
tgaggtgctgggccctgaacttctacc

SEQ ID NO: 10108 - DNA, 26 bp, Artificial Sequence
  Description of Artificial Sequence: Synthetic oligonucleotide
gaggtgctgggccctgaacttctacc

SEQ ID NO: 10109 - DNA, 27 bp, Artificial Sequence
  Description of Artificial Sequence: Synthetic oligonucleotide
aggtgctgggccctgaacttctaccct

SEQ ID NO: 10110 - DNA, 26 bp, Artificial Sequence
  Description of Artificial Sequence: Synthetic oligonucleotide
ggtgctgggccctgaacttctaccct

SEQ ID NO: 10111 - DNA, 26 bp, Artificial Sequence
  Description of Artificial Sequence: Synthetic oligonucleotide
gtgctgggccctgaacttctaccctg

SEQ ID NO: 10112 - DNA, 26 bp, Artificial Sequence
  Description of Artificial Sequence: Synthetic oligonucleotide
tgctgggccctgaacttctaccctgc

SEQ ID NO: 10113 - DNA, 25 bp, Artificial Sequence
  Description of Artificial Sequence: Synthetic oligonucleotide
gctgggccctgaacttctaccctgc

SEQ ID NO: 10114 - DNA, 25 bp, Artificial Sequence
  Description of Artificial Sequence: Synthetic oligonucleotide
ctgggccctgaacttctaccctgcg

SEQ ID NO: 10115 - DNA, 26 bp, Artificial Sequence
  Description of Artificial Sequence: Synthetic oligonucleotide
tgggccctgaacttctaccctgcgga

SEQ ID NO: 10116 - DNA, 25 bp, Artificial Sequence
  Description of Artificial Sequence: Synthetic oligonucleotide
gggccctgaacttctaccctgcgga

SEQ ID NO: 10117 - DNA, 27 bp, Artificial Sequence
  Description of Artificial Sequence: Synthetic oligonucleotide
ggccctgaacttctaccctgcggagat

SEQ ID NO: 10118 - DNA, 27 bp, Artificial Sequence
  Description of Artificial Sequence: Synthetic oligonucleotide
gccctgaacttctaccctgcggagatc

SEQ ID NO: 10119 - DNA, 28 bp, Artificial Sequence
  Description of Artificial Sequence: Synthetic oligonucleotide
ccctgaacttctaccctgcggagatcac

SEQ ID NO: 10120 - DNA, 29 bp, Artificial Sequence
  Description of Artificial Sequence: Synthetic oligonucleotide
cctgaacttctaccctgcggagatcacac

SEQ ID NO: 10121 - DNA, 30 bp, Artificial Sequence
  Description of Artificial Sequence: Synthetic oligonucleotide
ctgaacttctaccctgcggagatcacactg

SEQ ID NO: 10122 - DNA, 31 bp, Artificial Sequence
  Description of Artificial Sequence: Synthetic oligonucleotide
tgaacttctaccctgcggagatcacactgac

SEQ ID NO: 10123 - DNA, 30 bp, Artificial Sequence
  Description of Artificial Sequence: Synthetic oligonucleotide
gaacttctaccctgcggagatcacactgac

SEQ ID NO: 10124 - DNA, 30 bp, Artificial Sequence
  Description of Artificial Sequence: Synthetic oligonucleotide
aacttctaccctgcggagatcacactgacc

SEQ ID NO: 10125 - DNA, 29 bp, Artificial Sequence
  Description of Artificial Sequence: Synthetic oligonucleotide
acttctaccctgcggagatcacactgacc

SEQ ID NO: 10126 - DNA, 32 bp, Artificial Sequence
  Description of Artificial Sequence: Synthetic oligonucleotide
gctctcactccatgaggtatttctccacatcc

SEQ ID NO: 10127 - DNA, 32 bp, Artificial Sequence
  Description of Artificial Sequence: Synthetic oligonucleotide
ctctcactccatgaggtatttctccacatccg

SEQ ID NO: 10128 - DNA, 33 bp, Artificial Sequence
  Description of Artificial Sequence: Synthetic oligonucleotide
tctcactccatgaggtatttctccacatccgtg

SEQ ID NO: 10129 - DNA, 32 bp, Artificial Sequence
  Description of Artificial Sequence: Synthetic oligonucleotide
ctcactccatgaggtatttctccacatccgtg

SEQ ID NO: 10130 - DNA, 33 bp, Artificial Sequence
  Description of Artificial Sequence: Synthetic oligonucleotide
tcactccatgaggtatttctccacatccgtgtc

SEQ ID NO: 10131 - DNA, 24 bp, Artificial Sequence
  Description of Artificial Sequence: Synthetic oligonucleotide
ctacctggagggcacgtgcgtggt

SEQ ID NO: 10132 - DNA, 25 bp, Artificial Sequence
  Description of Artificial Sequence: Synthetic oligonucleotide
tacctggagggcacgtgcgtggtgt

SEQ ID NO: 10133 - DNA, 24 bp, Artificial Sequence
  Description of Artificial Sequence: Synthetic oligonucleotide
acctggagggcacgtgcgtggtgt

SEQ ID NO: 10134 - DNA, 23 bp, Artificial Sequence
  Description of Artificial Sequence: Synthetic oligonucleotide
cctggagggcacgtgcgtggtgt

SEQ ID NO: 10135 - DNA, 23 bp, Artificial Sequence
  Description of Artificial Sequence: Synthetic oligonucleotide
ctggagggcacgtgcgtggtgtg

SEQ ID NO: 10136 - DNA, 23 bp, Artificial Sequence
  Description of Artificial Sequence: Synthetic oligonucleotide
tggagggcacgtgcgtggtgtgg

SEQ ID NO: 10137 - DNA, 22 bp, Artificial Sequence
  Description of Artificial Sequence: Synthetic oligonucleotide
ggagggcacgtgcgtggtgtgg

SEQ ID NO: 10138 - DNA, 23 bp, Artificial Sequence
  Description of Artificial Sequence: Synthetic oligonucleotide
gagggcacgtgcgtggtgtggct

SEQ ID NO: 10139 - DNA, 23 bp, Artificial Sequence
  Description of Artificial Sequence: Synthetic oligonucleotide
agggcacgtgcgtggtgtggctc

SEQ ID NO: 10140 - DNA, 22 bp, Artificial Sequence
  Description of Artificial Sequence: Synthetic oligonucleotide
gggcacgtgcgtggtgtggctc

SEQ ID NO: 10141 - DNA, 22 bp, Artificial Sequence
  Description of Artificial Sequence: Synthetic oligonucleotide
ggcacgtgcgtggtgtggctcc

SEQ ID NO: 10142 - DNA, 22 bp, Artificial Sequence
  Description of Artificial Sequence: Synthetic oligonucleotide
gcacgtgcgtggtgtggctccg

SEQ ID NO: 10143 - DNA, 23 bp, Artificial Sequence
  Description of Artificial Sequence: Synthetic oligonucleotide
cacgtgcgtggtgtggctccgca

SEQ ID NO: 10144 - DNA, 26 bp, Artificial Sequence
  Description of Artificial Sequence: Synthetic oligonucleotide
acgtgcgtggtgtggctccgcagata

SEQ ID NO: 10145 - DNA, 25 bp, Artificial Sequence
  Description of Artificial Sequence: Synthetic oligonucleotide
cgtgcgtggtgtggctccgcagata

SEQ ID NO: 10146 - DNA, 25 bp, Artificial Sequence
  Description of Artificial Sequence: Synthetic oligonucleotide
gtgcgtggtgtggctccgcagatac

SEQ ID NO: 10147 - DNA, 26 bp, Artificial Sequence
  Description of Artificial Sequence: Synthetic oligonucleotide
tgcgtggtgtggctccgcagatacct

SEQ ID NO: 10148 - DNA, 25 bp, Artificial Sequence
  Description of Artificial Sequence: Synthetic oligonucleotide
gcgtggtgtggctccgcagatacct

SEQ ID NO: 10149 - DNA, 25 bp, Artificial Sequence
  Description of Artificial Sequence: Synthetic oligonucleotide
cgtggtgtggctccgcagatacctg

SEQ ID NO: 10150 - DNA, 26 bp, Artificial Sequence
  Description of Artificial Sequence: Synthetic oligonucleotide
gtggtgtggctccgcagatacctgga

SEQ ID NO: 10151 - DNA, 27 bp, Artificial Sequence
  Description of Artificial Sequence: Synthetic oligonucleotide
tggtgtggctccgcagatacctggaga

SEQ ID NO: 10152 - DNA, 27 bp, Artificial Sequence
  Description of Artificial Sequence: Synthetic oligonucleotide
ggtgtggctccgcagatacctggagaa

SEQ ID NO: 10153 - DNA, 27 bp, Artificial Sequence
  Description of Artificial Sequence: Synthetic oligonucleotide
gtgtggctccgcagatacctggagaac

SEQ ID NO: 10154 - DNA, 27 bp, Artificial Sequence
  Description of Artificial Sequence: Synthetic oligonucleotide
tgtggctccgcagatacctggagaacg

SEQ ID NO: 10155 - DNA, 29 bp, Artificial Sequence
  Description of Artificial Sequence: Synthetic oligonucleotide
acggaatgtgaaggcccagtcacagactg

SEQ ID NO: 10156 - DNA, 28 bp, Artificial Sequence
  Description of Artificial Sequence: Synthetic oligonucleotide
cggaatgtgaaggcccagtcacagactg

SEQ ID NO: 10157 - DNA, 29 bp, Artificial Sequence
  Description of Artificial Sequence: Synthetic oligonucleotide
ggaatgtgaaggcccagtcacagactgac

SEQ ID NO: 10158 - DNA, 29 bp, Artificial Sequence
  Description of Artificial Sequence: Synthetic oligonucleotide
gaatgtgaaggcccagtcacagactgacc

SEQ ID NO: 10159 - DNA, 29 bp, Artificial Sequence
  Description of Artificial Sequence: Synthetic oligonucleotide
aatgtgaaggcccagtcacagactgaccg

SEQ ID NO: 10160 - DNA, 28 bp, Artificial Sequence
  Description of Artificial Sequence: Synthetic oligonucleotide
atgtgaaggcccagtcacagactgaccg

SEQ ID NO: 10161 - DNA, 27 bp, Artificial Sequence
  Description of Artificial Sequence: Synthetic oligonucleotide
tgtgaaggcccagtcacagactgaccg

SEQ ID NO: 10162 - DNA, 28 bp, Artificial Sequence
  Description of Artificial Sequence: Synthetic oligonucleotide
ggacatggcagctcagatcaccaagcac

SEQ ID NO: 10163 - DNA, 30 bp, Artificial Sequence
  Description of Artificial Sequence: Synthetic oligonucleotide
gacatggcagctcagatcaccaagcacaag

SEQ ID NO: 10164 - DNA, 31 bp, Artificial Sequence
  Description of Artificial Sequence: Synthetic oligonucleotide
acatggcagctcagatcaccaagcacaagtg

SEQ ID NO: 10165 - DNA, 30 bp, Artificial Sequence
  Description of Artificial Sequence: Synthetic oligonucleotide
catggcagctcagatcaccaagcacaagtg

SEQ ID NO: 10166 - DNA, 30 bp, Artificial Sequence
  Description of Artificial Sequence: Synthetic oligonucleotide
atggcagctcagatcaccaagcacaagtgg

SEQ ID NO: 10167 - DNA, 29 bp, Artificial Sequence
  Description of Artificial Sequence: Synthetic oligonucleotide
tggcagctcagatcaccaagcacaagtgg

SEQ ID NO: 10168 - DNA, 28 bp, Artificial Sequence
  Description of Artificial Sequence: Synthetic oligonucleotide
ggcagctcagatcaccaagcacaagtgg

SEQ ID NO: 10169 - DNA, 28 bp, Artificial Sequence
  Description of Artificial Sequence: Synthetic oligonucleotide
gcagctcagatcaccaagcacaagtggg

SEQ ID NO: 10170 - DNA, 29 bp, Artificial Sequence
  Description of Artificial Sequence: Synthetic oligonucleotide
cagctcagatcaccaagcacaagtgggag

SEQ ID NO: 10171 - DNA, 29 bp, Artificial Sequence
  Description of Artificial Sequence: Synthetic oligonucleotide
agctcagatcaccaagcacaagtgggagg

SEQ ID NO: 10172 - DNA, 27 bp, Artificial Sequence
  Description of Artificial Sequence: Synthetic oligonucleotide
ttgagagcctacctggagggcacgtga

SEQ ID NO: 10173 - DNA, 26 bp, Artificial Sequence
  Description of Artificial Sequence: Synthetic oligonucleotide
tgagagcctacctggagggcacgtga

SEQ ID NO: 10174 - DNA, 25 bp, Artificial Sequence
  Description of Artificial Sequence: Synthetic oligonucleotide
gagagcctacctggagggcacgtga

SEQ ID NO: 10175 - DNA, 26 bp, Artificial Sequence
  Description of Artificial Sequence: Synthetic oligonucleotide
agagcctacctggagggcacgtgagt

SEQ ID NO: 10176 - DNA, 25 bp, Artificial Sequence
  Description of Artificial Sequence: Synthetic oligonucleotide
gagcctacctggagggcacgtgagt

SEQ ID NO: 10177 - DNA, 25 bp, Artificial Sequence
  Description of Artificial Sequence: Synthetic oligonucleotide
agcctacctggagggcacgtgagtg

SEQ ID NO: 10178 - DNA, 24 bp, Artificial Sequence
  Description of Artificial Sequence: Synthetic oligonucleotide
gcctacctggagggcacgtgagtg

SEQ ID NO: 10179 - DNA, 25 bp, Artificial Sequence
  Description of Artificial Sequence: Synthetic oligonucleotide
cctacctggagggcacgtgagtgga

SEQ ID NO: 10180 - DNA, 26 bp, Artificial Sequence
  Description of Artificial Sequence: Synthetic oligonucleotide
ctacctggagggcacgtgagtggagt

SEQ ID NO: 10181 - DNA, 26 bp, Artificial Sequence
  Description of Artificial Sequence: Synthetic oligonucleotide
tacctggagggcacgtgagtggagtg

SEQ ID NO: 10182 - DNA, 25 bp, Artificial Sequence
  Description of Artificial Sequence: Synthetic oligonucleotide
acctggagggcacgtgagtggagtg

SEQ ID NO: 10183 - DNA, 24 bp, Artificial Sequence
  Description of Artificial Sequence: Synthetic oligonucleotide
cctggagggcacgtgagtggagtg

SEQ ID NO: 10184 - DNA, 24 bp, Artificial Sequence
  Description of Artificial Sequence: Synthetic oligonucleotide
ctggagggcacgtgagtggagtgg

SEQ ID NO: 10185 - DNA, 25 bp, Artificial Sequence
  Description of Artificial Sequence: Synthetic oligonucleotide
tggagggcacgtgagtggagtggct

SEQ ID NO: 10186 - DNA, 24 bp, Artificial Sequence
  Description of Artificial Sequence: Synthetic oligonucleotide
ggagggcacgtgagtggagtggct

SEQ ID NO: 10187 - DNA, 24 bp, Artificial Sequence
  Description of Artificial Sequence: Synthetic oligonucleotide
gagggcacgtgagtggagtggctc

SEQ ID NO: 10188 - DNA, 24 bp, Artificial Sequence
  Description of Artificial Sequence: Synthetic oligonucleotide
agggcacgtgagtggagtggctcc

SEQ ID NO: 10189 - DNA, 23 bp, Artificial Sequence
  Description of Artificial Sequence: Synthetic oligonucleotide
gggcacgtgagtggagtggctcc

SEQ ID NO: 10190 - DNA, 23 bp, Artificial Sequence
  Description of Artificial Sequence: Synthetic oligonucleotide
ggcacgtgagtggagtggctccg

SEQ ID NO: 10191 - DNA, 24 bp, Artificial Sequence
  Description of Artificial Sequence: Synthetic oligonucleotide
gcacgtgagtggagtggctccgca

SEQ ID NO: 10192 - DNA, 27 bp, Artificial Sequence
  Description of Artificial Sequence: Synthetic oligonucleotide
cacgtgagtggagtggctccgcagata

SEQ ID NO: 10193 - DNA, 27 bp, Artificial Sequence
  Description of Artificial Sequence: Synthetic oligonucleotide
acgtgagtggagtggctccgcagatac

SEQ ID NO: 10194 - DNA, 26 bp, Artificial Sequence
  Description of Artificial Sequence: Synthetic oligonucleotide
cgtgagtggagtggctccgcagatac

SEQ ID NO: 10195 - DNA, 27 bp, Artificial Sequence
  Description of Artificial Sequence: Synthetic oligonucleotide
gtgagtggagtggctccgcagatacct

SEQ ID NO: 10196 - DNA, 27 bp, Artificial Sequence
  Description of Artificial Sequence: Synthetic oligonucleotide
tgagtggagtggctccgcagatacctg

SEQ ID NO: 10197 - DNA, 26 bp, Artificial Sequence
  Description of Artificial Sequence: Synthetic oligonucleotide
gagtggagtggctccgcagatacctg

SEQ ID NO: 10198 - DNA, 27 bp, Artificial Sequence
  Description of Artificial Sequence: Synthetic oligonucleotide
agtggagtggctccgcagatacctgga

SEQ ID NO: 10199 - DNA, 26 bp, Artificial Sequence
  Description of Artificial Sequence: Synthetic oligonucleotide
gcggctgtggtggtgccttctggata

SEQ ID NO: 10200 - DNA, 26 bp, Artificial Sequence
  Description of Artificial Sequence: Synthetic oligonucleotide
cggctgtggtggtgccttctggatag

SEQ ID NO: 10201 - DNA, 27 bp, Artificial Sequence
  Description of Artificial Sequence: Synthetic oligonucleotide
ggctgtggtggtgccttctggatagga

SEQ ID NO: 10202 - DNA, 27 bp, Artificial Sequence
  Description of Artificial Sequence: Synthetic oligonucleotide
gctgtggtggtgccttctggataggag

SEQ ID NO: 10203 - DNA, 27 bp, Artificial Sequence
  Description of Artificial Sequence: Synthetic oligonucleotide
ctgtggtggtgccttctggataggagc

SEQ ID NO: 10204 - DNA, 28 bp, Artificial Sequence
  Description of Artificial Sequence: Synthetic oligonucleotide
tgtggtggtgccttctggataggagcag

SEQ ID NO: 10205 - DNA, 27 bp, Artificial Sequence
  Description of Artificial Sequence: Synthetic oligonucleotide
gtggtggtgccttctggataggagcag

SEQ ID NO: 10206 - DNA, 28 bp, Artificial Sequence
  Description of Artificial Sequence: Synthetic oligonucleotide
tggtggtgccttctggataggagcagag

SEQ ID NO: 10207 - DNA, 27 bp, Artificial Sequence
  Description of Artificial Sequence: Synthetic oligonucleotide
ggtggtgccttctggataggagcagag

SEQ ID NO: 10208 - DNA, 30 bp, Artificial Sequence
  Description of Artificial Sequence: Synthetic oligonucleotide
gtggtgccttctggataggagcagagatac

SEQ ID NO: 10209 - DNA, 31 bp, Artificial Sequence
  Description of Artificial Sequence: Synthetic oligonucleotide
tggtgccttctggataggagcagagatacac

SEQ ID NO: 10210 - DNA, 30 bp, Artificial Sequence
  Description of Artificial Sequence: Synthetic oligonucleotide
ggtgccttctggataggagcagagatacac

SEQ ID NO: 10211 - DNA, 30 bp, Artificial Sequence
  Description of Artificial Sequence: Synthetic oligonucleotide
gtgccttctggataggagcagagatacacc

SEQ ID NO: 10212 - DNA, 31 bp, Artificial Sequence
  Description of Artificial Sequence: Synthetic oligonucleotide
tgccttctggataggagcagagatacacctg

SEQ ID NO: 10213 - DNA, 30 bp, Artificial Sequence
  Description of Artificial Sequence: Synthetic oligonucleotide
gccttctggataggagcagagatacacctg

SEQ ID NO: 10214 - DNA, 30 bp, Artificial Sequence
  Description of Artificial Sequence: Synthetic oligonucleotide
ccttctggataggagcagagatacacctgc

SEQ ID NO: 10215 - DNA, 30 bp, Artificial Sequence
  Description of Artificial Sequence: Synthetic oligonucleotide
cttctggataggagcagagatacacctgcc

SEQ ID NO: 10216 - DNA, 32 bp, Artificial Sequence
  Description of Artificial Sequence: Synthetic oligonucleotide
ttctggataggagcagagatacacctgccatg

SEQ ID NO: 10217 - DNA, 31 bp, Artificial Sequence
  Description of Artificial Sequence: Synthetic oligonucleotide
tctggataggagcagagatacacctgccatg

SEQ ID NO: 10218 - DNA, 30 bp, Artificial Sequence
  Description of Artificial Sequence: Synthetic oligonucleotide
ctggataggagcagagatacacctgccatg

SEQ ID NO: 10219 - DNA, 31 bp, Artificial Sequence
  Description of Artificial Sequence: Synthetic oligonucleotide
tggataggagcagagatacacctgccatgtg

SEQ ID NO: 10220 - DNA, 30 bp, Artificial Sequence
  Description of Artificial Sequence: Synthetic oligonucleotide
ggataggagcagagatacacctgccatgtg

SEQ ID NO: 10221 - DNA, 30 bp, Artificial Sequence
  Description of Artificial Sequence: Synthetic oligonucleotide
gataggagcagagatacacctgccatgtgc

SEQ ID NO: 10222 - DNA, 31 bp, Artificial Sequence
  Description of Artificial Sequence: Synthetic oligonucleotide
ataggagcagagatacacctgccatgtgcag

SEQ ID NO: 10223 - DNA, 30 bp, Artificial Sequence
  Description of Artificial Sequence: Synthetic oligonucleotide
taggagcagagatacacctgccatgtgcag

SEQ ID NO: 10224 - DNA, 26 bp, Artificial Sequence
  Description of Artificial Sequence: Synthetic oligonucleotide
cagagcgaggccggttctcacacctt

SEQ ID NO: 10225 - DNA, 26 bp, Artificial Sequence
  Description of Artificial Sequence: Synthetic oligonucleotide
agagcgaggccggttctcacaccttc

SEQ ID NO: 10226 - DNA, 25 bp, Artificial Sequence
  Description of Artificial Sequence: Synthetic oligonucleotide
gagcgaggccggttctcacaccttc

SEQ ID NO: 10227 - DNA, 26 bp, Artificial Sequence
  Description of Artificial Sequence: Synthetic oligonucleotide
agcgaggccggttctcacaccttcca

SEQ ID NO: 10228 - DNA, 25 bp, Artificial Sequence
  Description of Artificial Sequence: Synthetic oligonucleotide
gcgaggccggttctcacaccttcca

SEQ ID NO: 10229 - DNA, 26 bp, Artificial Sequence
  Description of Artificial Sequence: Synthetic oligonucleotide
cgaggccggttctcacaccttccaga

SEQ ID NO: 10230 - DNA, 26 bp, Artificial Sequence
  Description of Artificial Sequence: Synthetic oligonucleotide
gaggccggttctcacaccttccagag

SEQ ID NO: 10231 - DNA, 27 bp, Artificial Sequence
  Description of Artificial Sequence: Synthetic oligonucleotide
aggccggttctcacaccttccagagga

SEQ ID NO: 10232 - DNA, 27 bp, Artificial Sequence
  Description of Artificial Sequence: Synthetic oligonucleotide
ggccggttctcacaccttccagaggat

SEQ ID NO: 10233 - DNA, 27 bp, Artificial Sequence
  Description of Artificial Sequence: Synthetic oligonucleotide
gccggttctcacaccttccagaggatg

SEQ ID NO: 10234 - DNA, 30 bp, Artificial Sequence
  Description of Artificial Sequence: Synthetic oligonucleotide
ccggttctcacaccttccagaggatgtatg

SEQ ID NO: 10235 - DNA, 30 bp, Artificial Sequence
  Description of Artificial Sequence: Synthetic oligonucleotide
cggttctcacaccttccagaggatgtatgg

SEQ ID NO: 10236 - DNA, 30 bp, Artificial Sequence
  Description of Artificial Sequence: Synthetic oligonucleotide
ggttctcacaccttccagaggatgtatggc

SEQ ID NO: 10237 - DNA, 31 bp, Artificial Sequence
  Description of Artificial Sequence: Synthetic oligonucleotide
gttctcacaccttccagaggatgtatggctg

SEQ ID NO: 10238 - DNA, 31 bp, Artificial Sequence
  Description of Artificial Sequence: Synthetic oligonucleotide
ttctcacaccttccagaggatgtatggctgc

SEQ ID NO: 10239 - DNA, 30 bp, Artificial Sequence
  Description of Artificial Sequence: Synthetic oligonucleotide
tctcacaccttccagaggatgtatggctgc

SEQ ID NO: 10240 - DNA, 29 bp, Artificial Sequence
  Description of Artificial Sequence: Synthetic oligonucleotide
ctcacaccttccagaggatgtatggctgc

SEQ ID NO: 10241 - DNA, 29 bp, Artificial Sequence
  Description of Artificial Sequence: Synthetic oligonucleotide
tcacaccttccagaggatgtatggctgcg

SEQ ID NO: 10242 - DNA, 28 bp, Artificial Sequence
  Description of Artificial Sequence: Synthetic oligonucleotide
cacaccttccagaggatgtatggctgcg

SEQ ID NO: 10243 - DNA, 29 bp, Artificial Sequence
  Description of Artificial Sequence: Synthetic oligonucleotide
acaccttccagaggatgtatggctgcgac

SEQ ID NO: 10244 - DNA, 28 bp, Artificial Sequence
  Description of Artificial Sequence: Synthetic oligonucleotide
caccttccagaggatgtatggctgcgac

SEQ ID NO: 10245 - DNA, 28 bp, Artificial Sequence
  Description of Artificial Sequence: Synthetic oligonucleotide
accttccagaggatgtatggctgcgacg

SEQ ID NO: 10246 - DNA, 27 bp, Artificial Sequence
  Description of Artificial Sequence: Synthetic oligonucleotide
ccttccagaggatgtatggctgcgacg

SEQ ID NO: 10247 - DNA, 28 bp, Artificial Sequence
  Description of Artificial Sequence: Synthetic oligonucleotide
cttccagaggatgtatggctgcgacgtg

SEQ ID NO: 10248 - DNA, 28 bp, Artificial Sequence
  Description of Artificial Sequence: Synthetic oligonucleotide
ttccagaggatgtatggctgcgacgtgg

SEQ ID NO: 10249 - DNA, 28 bp, Artificial Sequence
  Description of Artificial Sequence: Synthetic oligonucleotide
tcagaccaccaagcacaagtgggaggtg

SEQ ID NO: 10250 - DNA, 27 bp, Artificial Sequence
  Description of Artificial Sequence: Synthetic oligonucleotide
cagaccaccaagcacaagtgggaggtg

SEQ ID NO: 10251 - DNA, 27 bp, Artificial Sequence
  Description of Artificial Sequence: Synthetic oligonucleotide
agaccaccaagcacaagtgggaggtgg

SEQ ID NO: 10252 - DNA, 26 bp, Artificial Sequence
  Description of Artificial Sequence: Synthetic oligonucleotide
gaccaccaagcacaagtgggaggtgg

SEQ ID NO: 10253 - DNA, 26 bp, Artificial Sequence
  Description of Artificial Sequence: Synthetic oligonucleotide
accaccaagcacaagtgggaggtggc

SEQ ID NO: 10254 - DNA, 25 bp, Artificial Sequence
  Description of Artificial Sequence: Synthetic oligonucleotide
ccaccaagcacaagtgggaggtggc

SEQ ID NO: 10255 - DNA, 25 bp, Artificial Sequence
  Description of Artificial Sequence: Synthetic oligonucleotide
caccaagcacaagtgggaggtggcc

SEQ ID NO: 10256 - DNA, 27 bp, Artificial Sequence
  Description of Artificial Sequence: Synthetic oligonucleotide
accaagcacaagtgggaggtggcccat

SEQ ID NO: 10257 - DNA, 26 bp, Artificial Sequence
  Description of Artificial Sequence: Synthetic oligonucleotide
ccaagcacaagtgggaggtggcccat

SEQ ID NO: 10258 - DNA, 27 bp, Artificial Sequence
  Description of Artificial Sequence: Synthetic oligonucleotide
caagcacaagtgggaggtggcccatgt

SEQ ID NO: 10259 - DNA, 27 bp, Artificial Sequence
  Description of Artificial Sequence: Synthetic oligonucleotide
aagcacaagtgggaggtggcccatgtg

SEQ ID NO: 10260 - DNA, 26 bp, Artificial Sequence
  Description of Artificial Sequence: Synthetic oligonucleotide
agcacaagtgggaggtggcccatgtg

SEQ ID NO: 10261 - DNA, 25 bp, Artificial Sequence
  Description of Artificial Sequence: Synthetic oligonucleotide
gcacaagtgggaggtggcccatgtg

SEQ ID NO: 10262 - DNA, 25 bp, Artificial Sequence
  Description of Artificial Sequence: Synthetic oligonucleotide
cacaagtgggaggtggcccatgtgg

SEQ ID NO: 10263 - DNA, 25 bp, Artificial Sequence
  Description of Artificial Sequence: Synthetic oligonucleotide
acaagtgggaggtggcccatgtggc

SEQ ID NO: 10264 - DNA, 24 bp, Artificial Sequence
  Description of Artificial Sequence: Synthetic oligonucleotide
caagtgggaggtggcccatgtggc

SEQ ID NO: 10265 - DNA, 24 bp, Artificial Sequence
  Description of Artificial Sequence: Synthetic oligonucleotide
aagtgggaggtggcccatgtggcg

SEQ ID NO: 10266 - DNA, 23 bp, Artificial Sequence
  Description of Artificial Sequence: Synthetic oligonucleotide
agtgggaggtggcccatgtggcg

SEQ ID NO: 10267 - DNA, 22 bp, Artificial Sequence
  Description of Artificial Sequence: Synthetic oligonucleotide
gtgggaggtggcccatgtggcg

SEQ ID NO: 10268 - DNA, 23 bp, Artificial Sequence
  Description of Artificial Sequence: Synthetic oligonucleotide
tgggaggtggcccatgtggcgga

SEQ ID NO: 10269 - DNA, 22 bp, Artificial Sequence
  Description of Artificial Sequence: Synthetic oligonucleotide
gggaggtggcccatgtggcgga

SEQ ID NO: 10270 - DNA, 22 bp, Artificial Sequence
  Description of Artificial Sequence: Synthetic oligonucleotide
ggaggtggcccatgtggcggag

SEQ ID NO: 10271 - DNA, 23 bp, Artificial Sequence
  Description of Artificial Sequence: Synthetic oligonucleotide
gaggtggcccatgtggcggagca

SEQ ID NO: 10272 - DNA, 25 bp, Artificial Sequence
  Description of Artificial Sequence: Synthetic oligonucleotide
aggtggcccatgtggcggagcagtt

SEQ ID NO: 10273 - DNA, 24 bp, Artificial Sequence
  Description of Artificial Sequence: Synthetic oligonucleotide
ggtggcccatgtggcggagcagtt

SEQ ID NO: 10274 - DNA, 25 bp, Artificial Sequence
  Description of Artificial Sequence: Synthetic oligonucleotide
gtggcccatgtggcggagcagttga

SEQ ID NO: 10275 - DNA, 26 bp, Artificial Sequence
  Description of Artificial Sequence: Synthetic oligonucleotide
tggcccatgtggcggagcagttgaga

SEQ ID NO: 10276 - DNA, 25 bp, Artificial Sequence
  Description of Artificial Sequence: Synthetic oligonucleotide
cttcctccgcgggtaccaccagtag

SEQ ID NO: 10277 - DNA, 25 bp, Artificial Sequence
  Description of Artificial Sequence: Synthetic oligonucleotide
ttcctccgcgggtaccaccagtagg

SEQ ID NO: 10278 - DNA, 24 bp, Artificial Sequence
  Description of Artificial Sequence: Synthetic oligonucleotide
tcctccgcgggtaccaccagtagg

SEQ ID NO: 10279 - DNA, 23 bp, Artificial Sequence
  Description of Artificial Sequence: Synthetic oligonucleotide
cctccgcgggtaccaccagtagg

SEQ ID NO: 10280 - DNA, 23 bp, Artificial Sequence
  Description of Artificial Sequence: Synthetic oligonucleotide
ctccgcgggtaccaccagtaggc

SEQ ID NO: 10281 - DNA, 25 bp, Artificial Sequence
  Description of Artificial Sequence: Synthetic oligonucleotide
tccgcgggtaccaccagtaggccta

SEQ ID NO: 10282 - DNA, 24 bp, Artificial Sequence
  Description of Artificial Sequence: Synthetic oligonucleotide
ccgcgggtaccaccagtaggccta

SEQ ID NO: 10283 - DNA, 24 bp, Artificial Sequence
  Description of Artificial Sequence: Synthetic oligonucleotide
cgcgggtaccaccagtaggcctac

SEQ ID NO: 10284 - DNA, 25 bp, Artificial Sequence
  Description of Artificial Sequence: Synthetic oligonucleotide
gcgggtaccaccagtaggcctacga

SEQ ID NO: 10285 - DNA, 25 bp, Artificial Sequence
  Description of Artificial Sequence: Synthetic oligonucleotide
cgggtaccaccagtaggcctacgac

SEQ ID NO: 10286 - DNA, 25 bp, Artificial Sequence
  Description of Artificial Sequence: Synthetic oligonucleotide
gggtaccaccagtaggcctacgacg

SEQ ID NO: 10287 - DNA, 25 bp, Artificial Sequence
  Description of Artificial Sequence: Synthetic oligonucleotide
ggtaccaccagtaggcctacgacgg

SEQ ID NO: 10288 - DNA, 27 bp, Artificial Sequence
  Description of Artificial Sequence: Synthetic oligonucleotide
gtaccaccagtaggcctacgacggcaa

SEQ ID NO: 10289 - DNA, 27 bp, Artificial Sequence
  Description of Artificial Sequence: Synthetic oligonucleotide
taccaccagtaggcctacgacggcaag

SEQ ID NO: 10290 - DNA, 26 bp, Artificial Sequence
  Description of Artificial Sequence: Synthetic oligonucleotide
accaccagtaggcctacgacggcaag

SEQ ID NO: 10291 - DNA, 25 bp, Artificial Sequence
  Description of Artificial Sequence: Synthetic oligonucleotide
ccaccagtaggcctacgacggcaag

SEQ ID NO: 10292 - DNA, 27 bp, Artificial Sequence
  Description of Artificial Sequence: Synthetic oligonucleotide
caccagtaggcctacgacggcaaggat

SEQ ID NO: 10293 - DNA, 29 bp, Artificial Sequence
  Description of Artificial Sequence: Synthetic oligonucleotide
accagtaggcctacgacggcaaggattac

SEQ ID NO: 10294 - DNA, 28 bp, Artificial Sequence
  Description of Artificial Sequence: Synthetic oligonucleotide
ccagtaggcctacgacggcaaggattac

SEQ ID NO: 10295 - DNA, 30 bp, Artificial Sequence
  Description of Artificial Sequence: Synthetic oligonucleotide
cagtaggcctacgacggcaaggattacatc

SEQ ID NO: 10296 - DNA, 30 bp, Artificial Sequence
  Description of Artificial Sequence: Synthetic oligonucleotide
agtaggcctacgacggcaaggattacatcg

SEQ ID NO: 10297 - DNA, 29 bp, Artificial Sequence
  Description of Artificial Sequence: Synthetic oligonucleotide
gtaggcctacgacggcaaggattacatcg

SEQ ID NO: 10298 - DNA, 29 bp, Artificial Sequence
  Description of Artificial Sequence: Synthetic oligonucleotide
taggcctacgacggcaaggattacatcgc

SEQ ID NO: 10299 - DNA, 28 bp, Artificial Sequence
  Description of Artificial Sequence: Synthetic oligonucleotide
aggcctacgacggcaaggattacatcgc

SEQ ID NO: 10300 - DNA, 27 bp, Artificial Sequence
  Description of Artificial Sequence: Synthetic oligonucleotide
ggcctacgacggcaaggattacatcgc

SEQ ID NO: 10301 - DNA, 30 bp, Artificial Sequence
  Description of Artificial Sequence: Synthetic oligonucleotide
acgcccccaaaacgcatatgactcaccaag

SEQ ID NO: 10302 - DNA, 29 bp, Artificial Sequence
  Description of Artificial Sequence: Synthetic oligonucleotide
cgcccccaaaacgcatatgactcaccaag

SEQ ID NO: 10303 - DNA, 29 bp, Artificial Sequence
  Description of Artificial Sequence: Synthetic oligonucleotide
gcccccaaaacgcatatgactcaccaagc

SEQ ID NO: 10304 - DNA, 30 bp, Artificial Sequence
  Description of Artificial Sequence: Synthetic oligonucleotide
cccccaaaacgcatatgactcaccaagctg

SEQ ID NO: 10305 - DNA, 31 bp, Artificial Sequence
  Description of Artificial Sequence: Synthetic oligonucleotide
ccccaaaacgcatatgactcaccaagctgtc

SEQ ID NO: 10306 - DNA, 32 bp, Artificial Sequence
  Description of Artificial Sequence: Synthetic oligonucleotide
cccaaaacgcatatgactcaccaagctgtctc

SEQ ID NO: 10307 - DNA, 33 bp, Artificial Sequence
  Description of Artificial Sequence: Synthetic oligonucleotide
ccaaaacgcatatgactcaccaagctgtctctg

SEQ ID NO: 10308 - DNA, 34 bp, Artificial Sequence
  Description of Artificial Sequence: Synthetic oligonucleotide
caaaacgcatatgactcaccaagctgtctctgac

SEQ ID NO: 10309 - DNA, 34 bp, Artificial Sequence
  Description of Artificial Sequence: Synthetic oligonucleotide
aaaacgcatatgactcaccaagctgtctctgacc

SEQ ID NO: 10310 - DNA, 33 bp, Artificial Sequence
  Description of Artificial Sequence: Synthetic oligonucleotide
aaacgcatatgactcaccaagctgtctctgacc

SEQ ID NO: 10311 - DNA, 32 bp, Artificial Sequence
  Description of Artificial Sequence: Synthetic oligonucleotide
aacgcatatgactcaccaagctgtctctgacc

SEQ ID NO: 10312 - DNA, 31 bp, Artificial Sequence
  Description of Artificial Sequence: Synthetic oligonucleotide
acgcatatgactcaccaagctgtctctgacc

SEQ ID NO: 10313 - DNA, 30 bp, Artificial Sequence
  Description of Artificial Sequence: Synthetic oligonucleotide
cgcatatgactcaccaagctgtctctgacc

SEQ ID NO: 10314 - DNA, 32 bp, Artificial Sequence
  Description of Artificial Sequence: Synthetic oligonucleotide
gcatatgactcaccaagctgtctctgaccatg

SEQ ID NO: 10315 - DNA, 34 bp, Artificial Sequence
  Description of Artificial Sequence: Synthetic oligonucleotide
catatgactcaccaagctgtctctgaccatgaag

SEQ ID NO: 10316 - DNA, 34 bp, Artificial Sequence
  Description of Artificial Sequence: Synthetic oligonucleotide
atatgactcaccaagctgtctctgaccatgaagc

SEQ ID NO: 10317 - DNA, 33 bp, Artificial Sequence
  Description of Artificial Sequence: Synthetic oligonucleotide
tatgactcaccaagctgtctctgaccatgaagc

SEQ ID NO: 10318 - DNA, 32 bp, Artificial Sequence
  Description of Artificial Sequence: Synthetic oligonucleotide
atgactcaccaagctgtctctgaccatgaagc

SEQ ID NO: 10319 - DNA, 31 bp, Artificial Sequence
  Description of Artificial Sequence: Synthetic oligonucleotide
tgactcaccaagctgtctctgaccatgaagc

SEQ ID NO: 10320 - DNA, 30 bp, Artificial Sequence
  Description of Artificial Sequence: Synthetic oligonucleotide
gactcaccaagctgtctctgaccatgaagc

SEQ ID NO: 10321 - DNA, 30 bp, Artificial Sequence
  Description of Artificial Sequence: Synthetic oligonucleotide
actcaccaagctgtctctgaccatgaagcc

SEQ ID NO: 10322 - DNA, 29 bp, Artificial Sequence
  Description of Artificial Sequence: Synthetic oligonucleotide
ctcaccaagctgtctctgaccatgaagcc

SEQ ID NO: 10323 - DNA, 30 bp, Artificial Sequence
  Description of Artificial Sequence: Synthetic oligonucleotide
tcaccaagctgtctctgaccatgaagccac

SEQ ID NO: 10324 - DNA, 29 bp, Artificial Sequence
  Description of Artificial Sequence: Synthetic oligonucleotide
caccaagctgtctctgaccatgaagccac

SEQ ID NO: 10325 - DNA, 29 bp, Artificial Sequence
  Description of Artificial Sequence: Synthetic oligonucleotide
accaagctgtctctgaccatgaagccacc

SEQ ID NO: 10326 - DNA, 28 bp, Artificial Sequence
  Description of Artificial Sequence: Synthetic oligonucleotide
ccaagctgtctctgaccatgaagccacc

SEQ ID NO: 10327 - DNA, 28 bp, Artificial Sequence
  Description of Artificial Sequence: Synthetic oligonucleotide
caagctgtctctgaccatgaagccaccc

SEQ ID NO: 10328 - DNA, 29 bp, Artificial Sequence
  Description of Artificial Sequence: Synthetic oligonucleotide
aagctgtctctgaccatgaagccaccctg

SEQ ID NO: 10329 - DNA, 28 bp, Artificial Sequence
  Description of Artificial Sequence: Synthetic oligonucleotide
agctgtctctgaccatgaagccaccctg

SEQ ID NO: 10330 - DNA, 31 bp, Artificial Sequence
  Description of Artificial Sequence: Synthetic oligonucleotide
agtacgcctacgacggcaaggattacatctc

SEQ ID NO: 10331 - DNA, 30 bp, Artificial Sequence
  Description of Artificial Sequence: Synthetic oligonucleotide
gtacgcctacgacggcaaggattacatctc

SEQ ID NO: 10332 - DNA, 30 bp, Artificial Sequence
  Description of Artificial Sequence: Synthetic oligonucleotide
tacgcctacgacggcaaggattacatctcc

SEQ ID NO: 10333 - DNA, 29 bp, Artificial Sequence
  Description of Artificial Sequence: Synthetic oligonucleotide
acgcctacgacggcaaggattacatctcc

SEQ ID NO: 10334 - DNA, 28 bp, Artificial Sequence
  Description of Artificial Sequence: Synthetic oligonucleotide
cgcctacgacggcaaggattacatctcc

SEQ ID NO: 10335 - DNA, 28 bp, Artificial Sequence
  Description of Artificial Sequence: Synthetic oligonucleotide
gcctacgacggcaaggattacatctccc

SEQ ID NO: 10336 - DNA, 29 bp, Artificial Sequence
  Description of Artificial Sequence: Synthetic oligonucleotide
cctacgacggcaaggattacatctccctg

SEQ ID NO: 10337 - DNA, 32 bp, Artificial Sequence
  Description of Artificial Sequence: Synthetic oligonucleotide
ctacgacggcaaggattacatctccctgaaag

SEQ ID NO: 10338 - DNA, 33 bp, Artificial Sequence
  Description of Artificial Sequence: Synthetic oligonucleotide
tacgacggcaaggattacatctccctgaaagag

SEQ ID NO: 10339 - DNA, 32 bp, Artificial Sequence
  Description of Artificial Sequence: Synthetic oligonucleotide
acgacggcaaggattacatctccctgaaagag

SEQ ID NO: 10340 - DNA, 31 bp, Artificial Sequence
  Description of Artificial Sequence: Synthetic oligonucleotide
cgacggcaaggattacatctccctgaaagag

SEQ ID NO: 10341 - DNA, 31 bp, Artificial Sequence
  Description of Artificial Sequence: Synthetic oligonucleotide
gacggcaaggattacatctccctgaaagagg

SEQ ID NO: 10342 - DNA, 32 bp, Artificial Sequence
  Description of Artificial Sequence: Synthetic oligonucleotide
acggcaaggattacatctccctgaaagaggac

SEQ ID NO: 10343 - DNA, 31 bp, Artificial Sequence
  Description of Artificial Sequence: Synthetic oligonucleotide
cggcaaggattacatctccctgaaagaggac

SEQ ID NO: 10344 - DNA, 31 bp, Artificial Sequence
  Description of Artificial Sequence: Synthetic oligonucleotide
ggcaaggattacatctccctgaaagaggacc

SEQ ID NO: 10345 - DNA, 32 bp, Artificial Sequence
  Description of Artificial Sequence: Synthetic oligonucleotide
gcaaggattacatctccctgaaagaggacctg

SEQ ID NO: 10346 - DNA, 32 bp, Artificial Sequence
  Description of Artificial Sequence: Synthetic oligonucleotide
caaggattacatctccctgaaagaggacctgc

SEQ ID NO: 10347 - DNA, 32 bp, Artificial Sequence
  Description of Artificial Sequence: Synthetic oligonucleotide
aaggattacatctccctgaaagaggacctgcg

SEQ ID NO: 10348 - DNA, 31 bp, Artificial Sequence
  Description of Artificial Sequence: Synthetic oligonucleotide
aggattacatctccctgaaagaggacctgcg

SEQ ID NO: 10349 - DNA, 30 bp, Artificial Sequence
  Description of Artificial Sequence: Synthetic oligonucleotide
ggattacatctccctgaaagaggacctgcg

SEQ ID NO: 10350 - DNA, 30 bp, Artificial Sequence
  Description of Artificial Sequence: Synthetic oligonucleotide
gattacatctccctgaaagaggacctgcgc

SEQ ID NO: 10351 - DNA, 31 bp, Artificial Sequence
  Description of Artificial Sequence: Synthetic oligonucleotide
attacatctccctgaaagaggacctgcgctc

SEQ ID NO: 10352 - DNA, 30 bp, Artificial Sequence
  Description of Artificial Sequence: Synthetic oligonucleotide
ttacatctccctgaaagaggacctgcgctc

SEQ ID NO: 10353 - DNA, 29 bp, Artificial Sequence
  Description of Artificial Sequence: Synthetic oligonucleotide
tacatctccctgaaagaggacctgcgctc

SEQ ID NO: 10354 - DNA, 28 bp, Artificial Sequence
  Description of Artificial Sequence: Synthetic oligonucleotide
acatctccctgaaagaggacctgcgctc

SEQ ID NO: 10355 - DNA, 27 bp, Artificial Sequence
  Description of Artificial Sequence: Synthetic oligonucleotide
catctccctgaaagaggacctgcgctc

SEQ ID NO: 10356 - DNA, 29 bp, Artificial Sequence
  Description of Artificial Sequence: Synthetic oligonucleotide
atctccctgaaagaggacctgcgctcttg

SEQ ID NO: 10357 - DNA, 28 bp, Artificial Sequence
  Description of Artificial Sequence: Synthetic oligonucleotide
tctccctgaaagaggacctgcgctcttg

SEQ ID NO: 10358 - DNA, 27 bp, Artificial Sequence
  Description of Artificial Sequence: Synthetic oligonucleotide
ctccctgaaagaggacctgcgctcttg

SEQ ID NO: 10359 - DNA, 27 bp, Artificial Sequence
  Description of Artificial Sequence: Synthetic oligonucleotide
tccctgaaagaggacctgcgctcttgg

SEQ ID NO: 10360 - DNA, 27 bp, Artificial Sequence
  Description of Artificial Sequence: Synthetic oligonucleotide
gtccggagtattgggacgaggagacac

SEQ ID NO: 10361 - DNA, 27 bp, Artificial Sequence
  Description of Artificial Sequence: Synthetic oligonucleotide
tccggagtattgggacgaggagacacg

SEQ ID NO: 10362 - DNA, 26 bp, Artificial Sequence
  Description of Artificial Sequence: Synthetic oligonucleotide
ccggagtattgggacgaggagacacg

SEQ ID NO: 10363 - DNA, 27 bp, Artificial Sequence
  Description of Artificial Sequence: Synthetic oligonucleotide
cggagtattgggacgaggagacacgga

SEQ ID NO: 10364 - DNA, 29 bp, Artificial Sequence
  Description of Artificial Sequence: Synthetic oligonucleotide
ggagtattgggacgaggagacacggaaag

SEQ ID NO: 10365 - DNA, 30 bp, Artificial Sequence
  Description of Artificial Sequence: Synthetic oligonucleotide
gagtattgggacgaggagacacggaaagtg

SEQ ID NO: 10366 - DNA, 32 bp, Artificial Sequence
  Description of Artificial Sequence: Synthetic oligonucleotide
agtattgggacgaggagacacggaaagtgaag

SEQ ID NO: 10367 - DNA, 31 bp, Artificial Sequence
  Description of Artificial Sequence: Synthetic oligonucleotide
gtattgggacgaggagacacggaaagtgaag

SEQ ID NO: 10368 - DNA, 31 bp, Artificial Sequence
  Description of Artificial Sequence: Synthetic oligonucleotide
tattgggacgaggagacacggaaagtgaagg

SEQ ID NO: 10369 - DNA, 30 bp, Artificial Sequence
  Description of Artificial Sequence: Synthetic oligonucleotide
attgggacgaggagacacggaaagtgaagg

SEQ ID NO: 10370 - DNA, 29 bp, Artificial Sequence
  Description of Artificial Sequence: Synthetic oligonucleotide
ttgggacgaggagacacggaaagtgaagg

SEQ ID NO: 10371 - DNA, 28 bp, Artificial Sequence
  Description of Artificial Sequence: Synthetic oligonucleotide
tgggacgaggagacacggaaagtgaagg

SEQ ID NO: 10372 - DNA, 27 bp, Artificial Sequence
  Description of Artificial Sequence: Synthetic oligonucleotide
gggacgaggagacacggaaagtgaagg

SEQ ID NO: 10373 - DNA, 27 bp, Artificial Sequence
  Description of Artificial Sequence: Synthetic oligonucleotide
ggacgaggagacacggaaagtgaaggc

SEQ ID NO: 10374 - DNA, 27 bp, Artificial Sequence
  Description of Artificial Sequence: Synthetic oligonucleotide
gacgaggagacacggaaagtgaaggcc

SEQ ID NO: 10375 - DNA, 27 bp, Artificial Sequence
  Description of Artificial Sequence: Synthetic oligonucleotide
acgaggagacacggaaagtgaaggccc

SEQ ID NO: 10376 - DNA, 27 bp, Artificial Sequence
  Description of Artificial Sequence: Synthetic oligonucleotide
cgaggagacacggaaagtgaaggccca

SEQ ID NO: 10377 - DNA, 27 bp, Artificial Sequence
  Description of Artificial Sequence: Synthetic oligonucleotide
gaggagacacggaaagtgaaggcccac

SEQ ID NO: 10378 - DNA, 26 bp, Artificial Sequence
  Description of Artificial Sequence: Synthetic oligonucleotide
cctgcgcggctactacaaccagagca

SEQ ID NO: 10379 - DNA, 26 bp, Artificial Sequence
  Description of Artificial Sequence: Synthetic oligonucleotide
ctgcgcggctactacaaccagagcag

SEQ ID NO: 10380 - DNA, 26 bp, Artificial Sequence
  Description of Artificial Sequence: Synthetic oligonucleotide
tgcgcggctactacaaccagagcagg

SEQ ID NO: 10381 - DNA, 25 bp, Artificial Sequence
  Description of Artificial Sequence: Synthetic oligonucleotide
gcgcggctactacaaccagagcagg

SEQ ID NO: 10382 - DNA, 25 bp, Artificial Sequence
  Description of Artificial Sequence: Synthetic oligonucleotide
cgcggctactacaaccagagcaggc

SEQ ID NO: 10383 - DNA, 25 bp, Artificial Sequence
  Description of Artificial Sequence: Synthetic oligonucleotide
gcggctactacaaccagagcaggcc

SEQ ID NO: 10384 - DNA, 25 bp, Artificial Sequence
  Description of Artificial Sequence: Synthetic oligonucleotide
cggctactacaaccagagcaggccg

SEQ ID NO: 10385 - DNA, 27 bp, Artificial Sequence
  Description of Artificial Sequence: Synthetic oligonucleotide
ggctactacaaccagagcaggccggtt

SEQ ID NO: 10386 - DNA, 27 bp, Artificial Sequence
  Description of Artificial Sequence: Synthetic oligonucleotide
gctactacaaccagagcaggccggttc

SEQ ID NO: 10387 - DNA, 28 bp, Artificial Sequence
  Description of Artificial Sequence: Synthetic oligonucleotide
ctactacaaccagagcaggccggttctc

SEQ ID NO: 10388 - DNA, 29 bp, Artificial Sequence
  Description of Artificial Sequence: Synthetic oligonucleotide
tactacaaccagagcaggccggttctcac

SEQ ID NO: 10389 - DNA, 28 bp, Artificial Sequence
  Description of Artificial Sequence: Synthetic oligonucleotide
actacaaccagagcaggccggttctcac

SEQ ID NO: 10390 - DNA, 27 bp, Artificial Sequence
  Description of Artificial Sequence: Synthetic oligonucleotide
ctacaaccagagcaggccggttctcac

SEQ ID NO: 10391 - DNA, 28 bp, Artificial Sequence
  Description of Artificial Sequence: Synthetic oligonucleotide
tacaaccagagcaggccggttctcacac

SEQ ID NO: 10392 - DNA, 27 bp, Artificial Sequence
  Description of Artificial Sequence: Synthetic oligonucleotide
acaaccagagcaggccggttctcacac

SEQ ID NO: 10393 - DNA, 26 bp, Artificial Sequence
  Description of Artificial Sequence: Synthetic oligonucleotide
caaccagagcaggccggttctcacac

SEQ ID NO: 10394 - DNA, 26 bp, Artificial Sequence
  Description of Artificial Sequence: Synthetic oligonucleotide
aaccagagcaggccggttctcacacc

SEQ ID NO: 10395 - DNA, 25 bp, Artificial Sequence
  Description of Artificial Sequence: Synthetic oligonucleotide
accagagcaggccggttctcacacc

SEQ ID NO: 10396 - DNA, 24 bp, Artificial Sequence
  Description of Artificial Sequence: Synthetic oligonucleotide
ccagagcaggccggttctcacacc

SEQ ID NO: 10397 - DNA, 25 bp, Artificial Sequence
  Description of Artificial Sequence: Synthetic oligonucleotide
cagagcaggccggttctcacaccgt

SEQ ID NO: 10398 - DNA, 25 bp, Artificial Sequence
  Description of Artificial Sequence: Synthetic oligonucleotide
agagcaggccggttctcacaccgtc

SEQ ID NO: 10399 - DNA, 24 bp, Artificial Sequence
  Description of Artificial Sequence: Synthetic oligonucleotide
gagcaggccggttctcacaccgtc

SEQ ID NO: 10400 - DNA, 25 bp, Artificial Sequence
  Description of Artificial Sequence: Synthetic oligonucleotide
agcaggccggttctcacaccgtcca

SEQ ID NO: 10401 - DNA, 24 bp, Artificial Sequence
  Description of Artificial Sequence: Synthetic oligonucleotide
gcaggccggttctcacaccgtcca

SEQ ID NO: 10402 - DNA, 26 bp, Artificial Sequence
  Description of Artificial Sequence: Synthetic oligonucleotide
cggctactacaaccagagcgaggcct

SEQ ID NO: 10403 - DNA, 27 bp, Artificial Sequence
  Description of Artificial Sequence: Synthetic oligonucleotide
ggctactacaaccagagcgaggcctgt

SEQ ID NO: 10404 - DNA, 28 bp, Artificial Sequence
  Description of Artificial Sequence: Synthetic oligonucleotide
gctactacaaccagagcgaggcctgttc

SEQ ID NO: 10405 - DNA, 29 bp, Artificial Sequence
  Description of Artificial Sequence: Synthetic oligonucleotide
ctactacaaccagagcgaggcctgttctc

SEQ ID NO: 10406 - DNA, 30 bp, Artificial Sequence
  Description of Artificial Sequence: Synthetic oligonucleotide
tactacaaccagagcgaggcctgttctcac

SEQ ID NO: 10407 - DNA, 29 bp, Artificial Sequence
  Description of Artificial Sequence: Synthetic oligonucleotide
actacaaccagagcgaggcctgttctcac

SEQ ID NO: 10408 - DNA, 28 bp, Artificial Sequence
  Description of Artificial Sequence: Synthetic oligonucleotide
ctacaaccagagcgaggcctgttctcac

SEQ ID NO: 10409 - DNA, 29 bp, Artificial Sequence
  Description of Artificial Sequence: Synthetic oligonucleotide
tacaaccagagcgaggcctgttctcacac

SEQ ID NO: 10410 - DNA, 28 bp, Artificial Sequence
  Description of Artificial Sequence: Synthetic oligonucleotide
acaaccagagcgaggcctgttctcacac

SEQ ID NO: 10411 - DNA, 27 bp, Artificial Sequence
  Description of Artificial Sequence: Synthetic oligonucleotide
caaccagagcgaggcctgttctcacac

SEQ ID NO: 10412 - DNA, 27 bp, Artificial Sequence
  Description of Artificial Sequence: Synthetic oligonucleotide
aaccagagcgaggcctgttctcacacc

SEQ ID NO: 10413 - DNA, 26 bp, Artificial Sequence
  Description of Artificial Sequence: Synthetic oligonucleotide
accagagcgaggcctgttctcacacc

SEQ ID NO: 10414 - DNA, 25 bp, Artificial Sequence
  Description of Artificial Sequence: Synthetic oligonucleotide
ccagagcgaggcctgttctcacacc

SEQ ID NO: 10415 - DNA, 26 bp, Artificial Sequence
  Description of Artificial Sequence: Synthetic oligonucleotide
cagagcgaggcctgttctcacaccgt

SEQ ID NO: 10416 - DNA, 26 bp, Artificial Sequence
  Description of Artificial Sequence: Synthetic oligonucleotide
agagcgaggcctgttctcacaccgtc

SEQ ID NO: 10417 - DNA, 25 bp, Artificial Sequence
  Description of Artificial Sequence: Synthetic oligonucleotide
gagcgaggcctgttctcacaccgtc

SEQ ID NO: 10418 - DNA, 26 bp, Artificial Sequence
  Description of Artificial Sequence: Synthetic oligonucleotide
agcgaggcctgttctcacaccgtcca

SEQ ID NO: 10419 - DNA, 25 bp, Artificial Sequence
  Description of Artificial Sequence: Synthetic oligonucleotide
gcgaggcctgttctcacaccgtcca

SEQ ID NO: 10420 - DNA, 26 bp, Artificial Sequence
  Description of Artificial Sequence: Synthetic oligonucleotide
cgaggcctgttctcacaccgtccaga

SEQ ID NO: 10421 - DNA, 26 bp, Artificial Sequence
  Description of Artificial Sequence: Synthetic oligonucleotide
gaggcctgttctcacaccgtccagag

SEQ ID NO: 10422 - DNA, 27 bp, Artificial Sequence
  Description of Artificial Sequence: Synthetic oligonucleotide
aggcctgttctcacaccgtccagagga

SEQ ID NO: 10423 - DNA, 27 bp, Artificial Sequence
  Description of Artificial Sequence: Synthetic oligonucleotide
ggcctgttctcacaccgtccagaggat

SEQ ID NO: 10424 - DNA, 27 bp, Artificial Sequence
  Description of Artificial Sequence: Synthetic oligonucleotide
gcctgttctcacaccgtccagaggatg

SEQ ID NO: 10425 - DNA, 30 bp, Artificial Sequence
  Description of Artificial Sequence: Synthetic oligonucleotide
cctgttctcacaccgtccagaggatgtatg

SEQ ID NO: 10426 - DNA, 30 bp, Artificial Sequence
  Description of Artificial Sequence: Synthetic oligonucleotide
ctgttctcacaccgtccagaggatgtatgg

SEQ ID NO: 10427 - DNA, 30 bp, Artificial Sequence
  Description of Artificial Sequence: Synthetic oligonucleotide
tgttctcacaccgtccagaggatgtatggc

SEQ ID NO: 10428 - DNA, 25 bp, Artificial Sequence
  Description of Artificial Sequence: Synthetic oligonucleotide
acccaggacacggagctcgtggaca

SEQ ID NO: 10429 - DNA, 24 bp, Artificial Sequence
  Description of Artificial Sequence: Synthetic oligonucleotide
cccaggacacggagctcgtggaca

SEQ ID NO: 10430 - DNA, 24 bp, Artificial Sequence
  Description of Artificial Sequence: Synthetic oligonucleotide
ccaggacacggagctcgtggacac

SEQ ID NO: 10431 - DNA, 25 bp, Artificial Sequence
  Description of Artificial Sequence: Synthetic oligonucleotide
caggacacggagctcgtggacacca

SEQ ID NO: 10432 - DNA, 25 bp, Artificial Sequence
  Description of Artificial Sequence: Synthetic oligonucleotide
aggacacggagctcgtggacaccag

SEQ ID NO: 10433 - DNA, 24 bp, Artificial Sequence
  Description of Artificial Sequence: Synthetic oligonucleotide
ggacacggagctcgtggacaccag

SEQ ID NO: 10434 - DNA, 24 bp, Artificial Sequence
  Description of Artificial Sequence: Synthetic oligonucleotide
gacacggagctcgtggacaccagg

SEQ ID NO: 10435 - DNA, 24 bp, Artificial Sequence
  Description of Artificial Sequence: Synthetic oligonucleotide
acacggagctcgtggacaccaggc

SEQ ID NO: 10436 - DNA, 23 bp, Artificial Sequence
  Description of Artificial Sequence: Synthetic oligonucleotide
cacggagctcgtggacaccaggc

SEQ ID NO: 10437 - DNA, 24 bp, Artificial Sequence
  Description of Artificial Sequence: Synthetic oligonucleotide
acggagctcgtggacaccaggcct

SEQ ID NO: 10438 - DNA, 23 bp, Artificial Sequence
  Description of Artificial Sequence: Synthetic oligonucleotide
cggagctcgtggacaccaggcct

SEQ ID NO: 10439 - DNA, 23 bp, Artificial Sequence
  Description of Artificial Sequence: Synthetic oligonucleotide
ggagctcgtggacaccaggcctg

SEQ ID NO: 10440 - DNA, 24 bp, Artificial Sequence
  Description of Artificial Sequence: Synthetic oligonucleotide
gagctcgtggacaccaggcctgca

SEQ ID NO: 10441 - DNA, 24 bp, Artificial Sequence
  Description of Artificial Sequence: Synthetic oligonucleotide
agctcgtggacaccaggcctgcag

SEQ ID NO: 10442 - DNA, 23 bp, Artificial Sequence
  Description of Artificial Sequence: Synthetic oligonucleotide
gctcgtggacaccaggcctgcag

SEQ ID NO: 10443 - DNA, 23 bp, Artificial Sequence
  Description of Artificial Sequence: Synthetic oligonucleotide
ctcgtggacaccaggcctgcagg

SEQ ID NO: 10444 - DNA, 23 bp, Artificial Sequence
  Description of Artificial Sequence: Synthetic oligonucleotide
tcgtggacaccaggcctgcaggg

SEQ ID NO: 10445 - DNA, 22 bp, Artificial Sequence
  Description of Artificial Sequence: Synthetic oligonucleotide
cgtggacaccaggcctgcaggg

SEQ ID NO: 10446 - DNA, 24 bp, Artificial Sequence
  Description of Artificial Sequence: Synthetic oligonucleotide
gtggacaccaggcctgcaggggat

SEQ ID NO: 10447 - DNA, 24 bp, Artificial Sequence
  Description of Artificial Sequence: Synthetic oligonucleotide
tggacaccaggcctgcaggggatg

SEQ ID NO: 10448 - DNA, 23 bp, Artificial Sequence
  Description of Artificial Sequence: Synthetic oligonucleotide
ggacaccaggcctgcaggggatg

SEQ ID NO: 10449 - DNA, 25 bp, Artificial Sequence
  Description of Artificial Sequence: Synthetic oligonucleotide
gacaccaggcctgcaggggatggaa

SEQ ID NO: 10450 - DNA, 25 bp, Artificial Sequence
  Description of Artificial Sequence: Synthetic oligonucleotide
acaccaggcctgcaggggatggaac

SEQ ID NO: 10451 - DNA, 24 bp, Artificial Sequence
  Description of Artificial Sequence: Synthetic oligonucleotide
caccaggcctgcaggggatggaac

SEQ ID NO: 10452 - DNA, 27 bp, Artificial Sequence
  Description of Artificial Sequence: Synthetic oligonucleotide
agacccaggacacggagctcgtggata

SEQ ID NO: 10453 - DNA, 26 bp, Artificial Sequence
  Description of Artificial Sequence: Synthetic oligonucleotide
gacccaggacacggagctcgtggata

SEQ ID NO: 10454 - DNA, 26 bp, Artificial Sequence
  Description of Artificial Sequence: Synthetic oligonucleotide
acccaggacacggagctcgtggatac

SEQ ID NO: 10455 - DNA, 25 bp, Artificial Sequence
  Description of Artificial Sequence: Synthetic oligonucleotide
cccaggacacggagctcgtggatac

SEQ ID NO: 10456 - DNA, 26 bp, Artificial Sequence
  Description of Artificial Sequence: Synthetic oligonucleotide
ccaggacacggagctcgtggatacca

SEQ ID NO: 10457 - DNA, 26 bp, Artificial Sequence
  Description of Artificial Sequence: Synthetic oligonucleotide
caggacacggagctcgtggataccag

SEQ ID NO: 10458 - DNA, 26 bp, Artificial Sequence
  Description of Artificial Sequence: Synthetic oligonucleotide
aggacacggagctcgtggataccagg

SEQ ID NO: 10459 - DNA, 25 bp, Artificial Sequence
  Description of Artificial Sequence: Synthetic oligonucleotide
ggacacggagctcgtggataccagg

SEQ ID NO: 10460 - DNA, 25 bp, Artificial Sequence
  Description of Artificial Sequence: Synthetic oligonucleotide
gacacggagctcgtggataccaggc

SEQ ID NO: 10461 - DNA, 26 bp, Artificial Sequence
  Description of Artificial Sequence: Synthetic oligonucleotide
acacggagctcgtggataccaggcct

SEQ ID NO: 10462 - DNA, 25 bp, Artificial Sequence
  Description of Artificial Sequence: Synthetic oligonucleotide
cacggagctcgtggataccaggcct

SEQ ID NO: 10463 - DNA, 25 bp, Artificial Sequence
  Description of Artificial Sequence: Synthetic oligonucleotide
acggagctcgtggataccaggcctg

SEQ ID NO: 10464 - DNA, 24 bp, Artificial Sequence
  Description of Artificial Sequence: Synthetic oligonucleotide
cggagctcgtggataccaggcctg

SEQ ID NO: 10465 - DNA, 25 bp, Artificial Sequence
  Description of Artificial Sequence: Synthetic oligonucleotide
ggagctcgtggataccaggcctgca

SEQ ID NO: 10466 - DNA, 25 bp, Artificial Sequence
  Description of Artificial Sequence: Synthetic oligonucleotide
gagctcgtggataccaggcctgcag

SEQ ID NO: 10467 - DNA, 25 bp, Artificial Sequence
  Description of Artificial Sequence: Synthetic oligonucleotide
agctcgtggataccaggcctgcagg

SEQ ID NO: 10468 - DNA, 24 bp, Artificial Sequence
  Description of Artificial Sequence: Synthetic oligonucleotide
gctcgtggataccaggcctgcagg

SEQ ID NO: 10469 - DNA, 24 bp, Artificial Sequence
  Description of Artificial Sequence: Synthetic oligonucleotide
ctcgtggataccaggcctgcaggg

SEQ ID NO: 10470 - DNA, 26 bp, Artificial Sequence
  Description of Artificial Sequence: Synthetic oligonucleotide
tcgtggataccaggcctgcaggggat

SEQ ID NO: 10471 - DNA, 25 bp, Artificial Sequence
  Description of Artificial Sequence: Synthetic oligonucleotide
cgtggataccaggcctgcaggggat

SEQ ID NO: 10472 - DNA, 25 bp, Artificial Sequence
  Description of Artificial Sequence: Synthetic oligonucleotide
gtggataccaggcctgcaggggatg

SEQ ID NO: 10473 - DNA, 27 bp, Artificial Sequence
  Description of Artificial Sequence: Synthetic oligonucleotide
tggataccaggcctgcaggggatggaa

SEQ ID NO: 10474 - DNA, 26 bp, Artificial Sequence
  Description of Artificial Sequence: Synthetic oligonucleotide
ggataccaggcctgcaggggatggaa

SEQ ID NO: 10475 - DNA, 26 bp, Artificial Sequence
  Description of Artificial Sequence: Synthetic oligonucleotide
gataccaggcctgcaggggatggaac

SEQ ID NO: 10476 - DNA, 27 bp, Artificial Sequence
  Description of Artificial Sequence: Synthetic oligonucleotide
ataccaggcctgcaggggatggaacct

SEQ ID NO: 10477 - DNA, 27 bp, Artificial Sequence
  Description of Artificial Sequence: Synthetic oligonucleotide
taccaggcctgcaggggatggaacctt

SEQ ID NO: 10478 - DNA, 29 bp, Artificial Sequence
  Description of Artificial Sequence: Synthetic oligonucleotide
cagataatgtatggctgcgacgtggggtc

SEQ ID NO: 10479 - DNA, 29 bp, Artificial Sequence
  Description of Artificial Sequence: Synthetic oligonucleotide
agataatgtatggctgcgacgtggggtcg

SEQ ID NO: 10480 - DNA, 28 bp, Artificial Sequence
  Description of Artificial Sequence: Synthetic oligonucleotide
gataatgtatggctgcgacgtggggtcg

SEQ ID NO: 10481 - DNA, 28 bp, Artificial Sequence
  Description of Artificial Sequence: Synthetic oligonucleotide
ataatgtatggctgcgacgtggggtcgg

SEQ ID NO: 10482 - DNA, 27 bp, Artificial Sequence
  Description of Artificial Sequence: Synthetic oligonucleotide
taatgtatggctgcgacgtggggtcgg

SEQ ID NO: 10483 - DNA, 27 bp, Artificial Sequence
  Description of Artificial Sequence: Synthetic oligonucleotide
aatgtatggctgcgacgtggggtcgga

SEQ ID NO: 10484 - DNA, 23 bp, Artificial Sequence
  Description of Artificial Sequence: Synthetic oligonucleotide
cgcaagtgggaggcggcccatga

SEQ ID NO: 10485 - DNA, 23 bp, Artificial Sequence
  Description of Artificial Sequence: Synthetic oligonucleotide
gcaagtgggaggcggcccatgag

SEQ ID NO: 10486 - DNA, 26 bp, Artificial Sequence
  Description of Artificial Sequence: Synthetic oligonucleotide
gacagtgcccagggctctgatgtgtc

SEQ ID NO: 10487 - DNA, 26 bp, Artificial Sequence
  Description of Artificial Sequence: Synthetic oligonucleotide
acagtgcccagggctctgatgtgtcc

SEQ ID NO: 10488 - DNA, 25 bp, Artificial Sequence
  Description of Artificial Sequence: Synthetic oligonucleotide
cagtgcccagggctctgatgtgtcc

SEQ ID NO: 10489 - DNA, 26 bp, Artificial Sequence
  Description of Artificial Sequence: Synthetic oligonucleotide
agtgcccagggctctgatgtgtccct

SEQ ID NO: 10490 - DNA, 25 bp, Artificial Sequence
  Description of Artificial Sequence: Synthetic oligonucleotide
gtgcccagggctctgatgtgtccct

SEQ ID NO: 10491 - DNA, 26 bp, Artificial Sequence
  Description of Artificial Sequence: Synthetic oligonucleotide
tgcccagggctctgatgtgtccctca

SEQ ID NO: 10492 - DNA, 25 bp, Artificial Sequence
  Description of Artificial Sequence: Synthetic oligonucleotide
gcccagggctctgatgtgtccctca

SEQ ID NO: 10493 - DNA, 26 bp, Artificial Sequence
  Description of Artificial Sequence: Synthetic oligonucleotide
cccagggctctgatgtgtccctcaca

SEQ ID NO: 10494 - DNA, 26 bp, Artificial Sequence
  Description of Artificial Sequence: Synthetic oligonucleotide
ccagggctctgatgtgtccctcacag

SEQ ID NO: 10495 - DNA, 27 bp, Artificial Sequence
  Description of Artificial Sequence: Synthetic oligonucleotide
cagggctctgatgtgtccctcacagct

SEQ ID NO: 10496 - DNA, 28 bp, Artificial Sequence
  Description of Artificial Sequence: Synthetic oligonucleotide
agggctctgatgtgtccctcacagcttg

SEQ ID NO: 10497 - DNA, 27 bp, Artificial Sequence
  Description of Artificial Sequence: Synthetic oligonucleotide
gggctctgatgtgtccctcacagcttg

SEQ ID NO: 10498 - DNA, 31 bp, Artificial Sequence
  Description of Artificial Sequence: Synthetic oligonucleotide
ggctctgatgtgtccctcacagcttgtaaag

SEQ ID NO: 10499 - DNA, 32 bp, Artificial Sequence
  Description of Artificial Sequence: Synthetic oligonucleotide
gctctgatgtgtccctcacagcttgtaaagtg

SEQ ID NO: 10500 - DNA, 33 bp, Artificial Sequence
  Description of Artificial Sequence: Synthetic oligonucleotide
ctctgatgtgtccctcacagcttgtaaagtgtg

SEQ ID NO: 10501 - DNA, 27 bp, Artificial Sequence
  Description of Artificial Sequence: Synthetic oligonucleotide
ccaagcccctcaccctgagatgggata

SEQ ID NO: 10502 - DNA, 28 bp, Artificial Sequence
  Description of Artificial Sequence: Synthetic oligonucleotide
caagcccctcaccctgagatgggataag

SEQ ID NO: 10503 - DNA, 28 bp, Artificial Sequence
  Description of Artificial Sequence: Synthetic oligonucleotide
aagcccctcaccctgagatgggataagg

SEQ ID NO: 10504 - DNA, 27 bp, Artificial Sequence
  Description of Artificial Sequence: Synthetic oligonucleotide
agcccctcaccctgagatgggataagg

SEQ ID NO: 10505 - DNA, 27 bp, Artificial Sequence
  Description of Artificial Sequence: Synthetic oligonucleotide
gcccctcaccctgagatgggataagga

SEQ ID NO: 10506 - DNA, 27 bp, Artificial Sequence
  Description of Artificial Sequence: Synthetic oligonucleotide
cccctcaccctgagatgggataaggag

SEQ ID NO: 10507 - DNA, 27 bp, Artificial Sequence
  Description of Artificial Sequence: Synthetic oligonucleotide
ccctcaccctgagatgggataaggagg

SEQ ID NO: 10508 - DNA, 27 bp, Artificial Sequence
  Description of Artificial Sequence: Synthetic oligonucleotide
cctcaccctgagatgggataaggaggg

SEQ ID NO: 10509 - DNA, 28 bp, Artificial Sequence
  Description of Artificial Sequence: Synthetic oligonucleotide
ctcaccctgagatgggataaggagggag

SEQ ID NO: 10510 - DNA, 30 bp, Artificial Sequence
  Description of Artificial Sequence: Synthetic oligonucleotide
tcaccctgagatgggataaggagggagatg

SEQ ID NO: 10511 - DNA, 29 bp, Artificial Sequence
  Description of Artificial Sequence: Synthetic oligonucleotide
caccctgagatgggataaggagggagatg

SEQ ID NO: 10512 - DNA, 29 bp, Artificial Sequence
  Description of Artificial Sequence: Synthetic oligonucleotide
accctgagatgggataaggagggagatgg

SEQ ID NO: 10513 - DNA, 28 bp, Artificial Sequence
  Description of Artificial Sequence: Synthetic oligonucleotide
ccctgagatgggataaggagggagatgg

SEQ ID NO: 10514 - DNA, 28 bp, Artificial Sequence
  Description of Artificial Sequence: Synthetic oligonucleotide
cctgagatgggataaggagggagatggg

SEQ ID NO: 10515 - DNA, 28 bp, Artificial Sequence
  Description of Artificial Sequence: Synthetic oligonucleotide
ctgagatgggataaggagggagatgggg

SEQ ID NO: 10516 - DNA, 28 bp, Artificial Sequence
  Description of Artificial Sequence: Synthetic oligonucleotide
tgagatgggataaggagggagatggggg

SEQ ID NO: 10517 - DNA, 27 bp, Artificial Sequence
  Description of Artificial Sequence: Synthetic oligonucleotide
gagatgggataaggagggagatggggg

SEQ ID NO: 10518 - DNA, 28 bp, Artificial Sequence
  Description of Artificial Sequence: Synthetic oligonucleotide
agatgggataaggagggagatgggggtg

SEQ ID NO: 10519 - DNA, 27 bp, Artificial Sequence
  Description of Artificial Sequence: Synthetic oligonucleotide
gatgggataaggagggagatgggggtg

SEQ ID NO: 10520 - DNA, 28 bp, Artificial Sequence
  Description of Artificial Sequence: Synthetic oligonucleotide
atgggataaggagggagatgggggtgtc

SEQ ID NO: 10521 - DNA, 27 bp, Artificial Sequence
  Description of Artificial Sequence: Synthetic oligonucleotide
tgggataaggagggagatgggggtgtc

SEQ ID NO: 10522 - DNA, 27 bp, Artificial Sequence
  Description of Artificial Sequence: Synthetic oligonucleotide
gggataaggagggagatgggggtgtca

SEQ ID NO: 10523 - DNA, 28 bp, Artificial Sequence
  Description of Artificial Sequence: Synthetic oligonucleotide
ggataaggagggagatgggggtgtcatg

SEQ ID NO: 10524 - DNA, 29 bp, Artificial Sequence
  Description of Artificial Sequence: Synthetic oligonucleotide
gataaggagggagatgggggtgtcatgtc

SEQ ID NO: 10525 - DNA, 30 bp, Artificial Sequence
  Description of Artificial Sequence: Synthetic oligonucleotide
ataaggagggagatgggggtgtcatgtctc

SEQ ID NO: 10526 - DNA, 29 bp, Artificial Sequence
  Description of Artificial Sequence: Synthetic oligonucleotide
taaggagggagatgggggtgtcatgtctc

SEQ ID NO: 10527 - DNA, 28 bp, Artificial Sequence
  Description of Artificial Sequence: Synthetic oligonucleotide
aaggagggagatgggggtgtcatgtctc

SEQ ID NO: 10528 - DNA, 27 bp, Artificial Sequence
  Description of Artificial Sequence: Synthetic oligonucleotide
aggagggagatgggggtgtcatgtctc

SEQ ID NO: 10529 - DNA, 27 bp, Artificial Sequence
  Description of Artificial Sequence: Synthetic oligonucleotide
ggagggagatgggggtgtcatgtctct

SEQ ID NO: 10530 - DNA, 29 bp, Artificial Sequence
  Description of Artificial Sequence: Synthetic oligonucleotide
gagggagatgggggtgtcatgtctcttag

SEQ ID NO: 10531 - DNA, 29 bp, Artificial Sequence
  Description of Artificial Sequence: Synthetic oligonucleotide
agggagatgggggtgtcatgtctcttagg

SEQ ID NO: 10532 - DNA, 28 bp, Artificial Sequence
  Description of Artificial Sequence: Synthetic oligonucleotide
gggagatgggggtgtcatgtctcttagg

SEQ ID NO: 10533 - DNA, 28 bp, Artificial Sequence
  Description of Artificial Sequence: Synthetic oligonucleotide
ggagatgggggtgtcatgtctcttaggg

SEQ ID NO: 10534 - DNA, 31 bp, Artificial Sequence
  Description of Artificial Sequence: Synthetic oligonucleotide
gagatgggggtgtcatgtctcttagggaaag

SEQ ID NO: 10535 - DNA, 31 bp, Artificial Sequence
  Description of Artificial Sequence: Synthetic oligonucleotide
agatgggggtgtcatgtctcttagggaaagc

SEQ ID NO: 10536 - DNA, 30 bp, Artificial Sequence
  Description of Artificial Sequence: Synthetic oligonucleotide
gatgggggtgtcatgtctcttagggaaagc

SEQ ID NO: 10537 - DNA, 31 bp, Artificial Sequence
  Description of Artificial Sequence: Synthetic oligonucleotide
atgggggtgtcatgtctcttagggaaagcag

SEQ ID NO: 10538 - DNA, 30 bp, Artificial Sequence
  Description of Artificial Sequence: Synthetic oligonucleotide
tgggggtgtcatgtctcttagggaaagcag

SEQ ID NO: 10539 - DNA, 29 bp, Artificial Sequence
  Description of Artificial Sequence: Synthetic oligonucleotide
gggggtgtcatgtctcttagggaaagcag

SEQ ID NO: 10540 - DNA, 29 bp, Artificial Sequence
  Description of Artificial Sequence: Synthetic oligonucleotide
ggggtgtcatgtctcttagggaaagcagg

SEQ ID NO: 10541 - DNA, 30 bp, Artificial Sequence
  Description of Artificial Sequence: Synthetic oligonucleotide
gggtgtcatgtctcttagggaaagcaggag

SEQ ID NO: 10542 - DNA, 30 bp, Artificial Sequence
  Description of Artificial Sequence: Synthetic oligonucleotide
ggtgtcatgtctcttagggaaagcaggagc

SEQ ID NO: 10543 - DNA, 30 bp, Artificial Sequence
  Description of Artificial Sequence: Synthetic oligonucleotide
gtgtcatgtctcttagggaaagcaggagcc

SEQ ID NO: 10544 - DNA, 31 bp, Artificial Sequence
  Description of Artificial Sequence: Synthetic oligonucleotide
tgtcatgtctcttagggaaagcaggagcctc

SEQ ID NO: 10545 - DNA, 30 bp, Artificial Sequence
  Description of Artificial Sequence: Synthetic oligonucleotide
gtcatgtctcttagggaaagcaggagcctc

SEQ ID NO: 10546 - DNA, 31 bp, Artificial Sequence
  Description of Artificial Sequence: Synthetic oligonucleotide
tcatgtctcttagggaaagcaggagcctctc

SEQ ID NO: 10547 - DNA, 30 bp, Artificial Sequence
  Description of Artificial Sequence: Synthetic oligonucleotide
catgtctcttagggaaagcaggagcctctc

SEQ ID NO: 10548 - DNA, 31 bp, Artificial Sequence
  Description of Artificial Sequence: Synthetic oligonucleotide
atgtctcttagggaaagcaggagcctctctg

SEQ ID NO: 10549 - DNA, 30 bp, Artificial Sequence
  Description of Artificial Sequence: Synthetic oligonucleotide
tgtctcttagggaaagcaggagcctctctg

SEQ ID NO: 10550 - DNA, 29 bp, Artificial Sequence
  Description of Artificial Sequence: Synthetic oligonucleotide
gtctcttagggaaagcaggagcctctctg

SEQ ID NO: 10551 - DNA, 29 bp, Artificial Sequence
  Description of Artificial Sequence: Synthetic oligonucleotide
tctcttagggaaagcaggagcctctctgg

SEQ ID NO: 10552 - DNA, 28 bp, Artificial Sequence
  Description of Artificial Sequence: Synthetic oligonucleotide
ctcttagggaaagcaggagcctctctgg

SEQ ID NO: 10553 - DNA, 29 bp, Artificial Sequence
  Description of Artificial Sequence: Synthetic oligonucleotide
tcttagggaaagcaggagcctctctggag

SEQ ID NO: 10554 - DNA, 28 bp, Artificial Sequence
  Description of Artificial Sequence: Synthetic oligonucleotide
cttagggaaagcaggagcctctctggag

SEQ ID NO: 10555 - DNA, 29 bp, Artificial Sequence
  Description of Artificial Sequence: Synthetic oligonucleotide
ttagggaaagcaggagcctctctggagac

SEQ ID NO: 10556 - DNA, 28 bp, Artificial Sequence
  Description of Artificial Sequence: Synthetic oligonucleotide
tagggaaagcaggagcctctctggagac

SEQ ID NO: 10557 - DNA, 27 bp, Artificial Sequence
  Description of Artificial Sequence: Synthetic oligonucleotide
agggaaagcaggagcctctctggagac

SEQ ID NO: 10558 - DNA, 26 bp, Artificial Sequence
  Description of Artificial Sequence: Synthetic oligonucleotide
gggaaagcaggagcctctctggagac

SEQ ID NO: 10559 - DNA, 27 bp, Artificial Sequence
  Description of Artificial Sequence: Synthetic oligonucleotide
ggaaagcaggagcctctctggagacct

SEQ ID NO: 10560 - DNA, 30 bp, Artificial Sequence
  Description of Artificial Sequence: Synthetic oligonucleotide
gaaagcaggagcctctctggagacctttag

SEQ ID NO: 10561 - DNA, 31 bp, Artificial Sequence
  Description of Artificial Sequence: Synthetic oligonucleotide
aaagcaggagcctctctggagacctttagag

SEQ ID NO: 10562 - DNA, 30 bp, Artificial Sequence
  Description of Artificial Sequence: Synthetic oligonucleotide
aagcaggagcctctctggagacctttagag

SEQ ID NO: 10563 - DNA, 29 bp, Artificial Sequence
  Description of Artificial Sequence: Synthetic oligonucleotide
agcaggagcctctctggagacctttagag

SEQ ID NO: 10564 - DNA, 28 bp, Artificial Sequence
  Description of Artificial Sequence: Synthetic oligonucleotide
gcaggagcctctctggagacctttagag

SEQ ID NO: 10565 - DNA, 28 bp, Artificial Sequence
  Description of Artificial Sequence: Synthetic oligonucleotide
caggagcctctctggagacctttagagc

SEQ ID NO: 10566 - DNA, 29 bp, Artificial Sequence
  Description of Artificial Sequence: Synthetic oligonucleotide
aggagcctctctggagacctttagagctg

SEQ ID NO: 10567 - DNA, 28 bp, Artificial Sequence
  Description of Artificial Sequence: Synthetic oligonucleotide
ggagcctctctggagacctttagagctg

SEQ ID NO: 10568 - DNA, 29 bp, Artificial Sequence
  Description of Artificial Sequence: Synthetic oligonucleotide
gagcctctctggagacctttagagctgtc

SEQ ID NO: 10569 - DNA, 31 bp, Artificial Sequence
  Description of Artificial Sequence: Synthetic oligonucleotide
agcctctctggagacctttagagctgtcttc

SEQ ID NO: 10570 - DNA, 30 bp, Artificial Sequence
  Description of Artificial Sequence: Synthetic oligonucleotide
gcctctctggagacctttagagctgtcttc

SEQ ID NO: 10571 - DNA, 30 bp, Artificial Sequence
  Description of Artificial Sequence: Synthetic oligonucleotide
cctctctggagacctttagagctgtcttcc

SEQ ID NO: 10572 - DNA, 30 bp, Artificial Sequence
  Description of Artificial Sequence: Synthetic oligonucleotide
ctctctggagacctttagagctgtcttccc

SEQ ID NO: 10573 - DNA, 31 bp, Artificial Sequence
  Description of Artificial Sequence: Synthetic oligonucleotide
tctctggagacctttagagctgtcttcccag

SEQ ID NO: 10574 - DNA, 30 bp, Artificial Sequence
  Description of Artificial Sequence: Synthetic oligonucleotide
ctctggagacctttagagctgtcttcccag

SEQ ID NO: 10575 - DNA, 30 bp, Artificial Sequence
  Description of Artificial Sequence: Synthetic oligonucleotide
tctggagacctttagagctgtcttcccagc

SEQ ID NO: 10576 - DNA, 29 bp, Artificial Sequence
  Description of Artificial Sequence: Synthetic oligonucleotide
ctggagacctttagagctgtcttcccagc

SEQ ID NO: 10577 - DNA, 29 bp, Artificial Sequence
  Description of Artificial Sequence: Synthetic oligonucleotide
tggagacctttagagctgtcttcccagcc

SEQ ID NO: 10578 - DNA, 28 bp, Artificial Sequence
  Description of Artificial Sequence: Synthetic oligonucleotide
ggagacctttagagctgtcttcccagcc

SEQ ID NO: 10579 - DNA, 28 bp, Artificial Sequence
  Description of Artificial Sequence: Synthetic oligonucleotide
gagacctttagagctgtcttcccagccc

SEQ ID NO: 10580 - DNA, 29 bp, Artificial Sequence
  Description of Artificial Sequence: Synthetic oligonucleotide
agacctttagagctgtcttcccagcccac

SEQ ID NO: 10581 - DNA, 28 bp, Artificial Sequence
  Description of Artificial Sequence: Synthetic oligonucleotide
gacctttagagctgtcttcccagcccac

SEQ ID NO: 10582 - DNA, 28 bp, Artificial Sequence
  Description of Artificial Sequence: Synthetic oligonucleotide
acctttagagctgtcttcccagcccacc

SEQ ID NO: 10583 - DNA, 27 bp, Artificial Sequence
  Description of Artificial Sequence: Synthetic oligonucleotide
cctttagagctgtcttcccagcccacc

SEQ ID NO: 10584 - DNA, 29 bp, Artificial Sequence
  Description of Artificial Sequence: Synthetic oligonucleotide
ctttagagctgtcttcccagcccaccatc

SEQ ID NO: 10585 - DNA, 29 bp, Artificial Sequence
  Description of Artificial Sequence: Synthetic oligonucleotide
tttagagctgtcttcccagcccaccatcc

SEQ ID NO: 10586 - DNA, 28 bp, Artificial Sequence
  Description of Artificial Sequence: Synthetic oligonucleotide
ttagagctgtcttcccagcccaccatcc

SEQ ID NO: 10587 - DNA, 27 bp, Artificial Sequence
  Description of Artificial Sequence: Synthetic oligonucleotide
tagagctgtcttcccagcccaccatcc

SEQ ID NO: 10588 - DNA, 26 bp, Artificial Sequence
  Description of Artificial Sequence: Synthetic oligonucleotide
agagctgtcttcccagcccaccatcc

SEQ ID NO: 10589 - DNA, 26 bp, Artificial Sequence
  Description of Artificial Sequence: Synthetic oligonucleotide
cggagcagctgagagcctacctggat

SEQ ID NO: 10590 - DNA, 26 bp, Artificial Sequence
  Description of Artificial Sequence: Synthetic oligonucleotide
ggagcagctgagagcctacctggatg

SEQ ID NO: 10591 - DNA, 26 bp, Artificial Sequence
  Description of Artificial Sequence: Synthetic oligonucleotide
gagcagctgagagcctacctggatgg

SEQ ID NO: 10592 - DNA, 27 bp, Artificial Sequence
  Description of Artificial Sequence: Synthetic oligonucleotide
agcagctgagagcctacctggatggca

SEQ ID NO: 10593 - DNA, 26 bp, Artificial Sequence
  Description of Artificial Sequence: Synthetic oligonucleotide
gcagctgagagcctacctggatggca

SEQ ID NO: 10594 - DNA, 26 bp, Artificial Sequence
  Description of Artificial Sequence: Synthetic oligonucleotide
cagctgagagcctacctggatggcac

SEQ ID NO: 10595 - DNA, 27 bp, Artificial Sequence
  Description of Artificial Sequence: Synthetic oligonucleotide
agctgagagcctacctggatggcacgt

SEQ ID NO: 10596 - DNA, 26 bp, Artificial Sequence
  Description of Artificial Sequence: Synthetic oligonucleotide
gctgagagcctacctggatggcacgt

SEQ ID NO: 10597 - DNA, 26 bp, Artificial Sequence
  Description of Artificial Sequence: Synthetic oligonucleotide
ctgagagcctacctggatggcacgtg

SEQ ID NO: 10598 - DNA, 27 bp, Artificial Sequence
  Description of Artificial Sequence: Synthetic oligonucleotide
aggggccggagtattgggaccaggaaa

SEQ ID NO: 10599 - DNA, 26 bp, Artificial Sequence
  Description of Artificial Sequence: Synthetic oligonucleotide
ggggccggagtattgggaccaggaaa

SEQ ID NO: 10600 - DNA, 27 bp, Artificial Sequence
  Description of Artificial Sequence: Synthetic oligonucleotide
gggccggagtattgggaccaggaaaca

SEQ ID NO: 10601 - DNA, 27 bp, Artificial Sequence
  Description of Artificial Sequence: Synthetic oligonucleotide
ggccggagtattgggaccaggaaacac

SEQ ID NO: 10602 - DNA, 27 bp, Artificial Sequence
  Description of Artificial Sequence: Synthetic oligonucleotide
gccggagtattgggaccaggaaacacg

SEQ ID NO: 10603 - DNA, 27 bp, Artificial Sequence
  Description of Artificial Sequence: Synthetic oligonucleotide
ccggagtattgggaccaggaaacacgg

SEQ ID NO: 10604 - DNA, 30 bp, Artificial Sequence
  Description of Artificial Sequence: Synthetic oligonucleotide
cggagtattgggaccaggaaacacggaatg

SEQ ID NO: 10605 - DNA, 31 bp, Artificial Sequence
  Description of Artificial Sequence: Synthetic oligonucleotide
ggagtattgggaccaggaaacacggaatgtg

SEQ ID NO: 10606 - DNA, 33 bp, Artificial Sequence
  Description of Artificial Sequence: Synthetic oligonucleotide
gagtattgggaccaggaaacacggaatgtgaag

SEQ ID NO: 10607 - DNA, 33 bp, Artificial Sequence
  Description of Artificial Sequence: Synthetic oligonucleotide
agtattgggaccaggaaacacggaatgtgaagg

SEQ ID NO: 10608 - DNA, 32 bp, Artificial Sequence
  Description of Artificial Sequence: Synthetic oligonucleotide
gtattgggaccaggaaacacggaatgtgaagg

SEQ ID NO: 10609 - DNA, 32 bp, Artificial Sequence
  Description of Artificial Sequence: Synthetic oligonucleotide
tattgggaccaggaaacacggaatgtgaaggc

SEQ ID NO: 10610 - DNA, 31 bp, Artificial Sequence
  Description of Artificial Sequence: Synthetic oligonucleotide
attgggaccaggaaacacggaatgtgaaggc

SEQ ID NO: 10611 - DNA, 30 bp, Artificial Sequence
  Description of Artificial Sequence: Synthetic oligonucleotide
ttgggaccaggaaacacggaatgtgaaggc

SEQ ID NO: 10612 - DNA, 29 bp, Artificial Sequence
  Description of Artificial Sequence: Synthetic oligonucleotide
tgggaccaggaaacacggaatgtgaaggc

SEQ ID NO: 10613 - DNA, 28 bp, Artificial Sequence
  Description of Artificial Sequence: Synthetic oligonucleotide
gggaccaggaaacacggaatgtgaaggc

SEQ ID NO: 10614 - DNA, 28 bp, Artificial Sequence
  Description of Artificial Sequence: Synthetic oligonucleotide
ggaccaggaaacacggaatgtgaaggcc

SEQ ID NO: 10615 - DNA, 28 bp, Artificial Sequence
  Description of Artificial Sequence: Synthetic oligonucleotide
gaccaggaaacacggaatgtgaaggccc

SEQ ID NO: 10616 - DNA, 29 bp, Artificial Sequence
  Description of Artificial Sequence: Synthetic oligonucleotide
accaggaaacacggaatgtgaaggcccag

SEQ ID NO: 10617 - DNA, 28 bp, Artificial Sequence
  Description of Artificial Sequence: Synthetic oligonucleotide
ccaggaaacacggaatgtgaaggcccag

SEQ ID NO: 10618 - DNA, 29 bp, Artificial Sequence
  Description of Artificial Sequence: Synthetic oligonucleotide
caggaaacacggaatgtgaaggcccagtc

SEQ ID NO: 10619 - DNA, 30 bp, Artificial Sequence
  Description of Artificial Sequence: Synthetic oligonucleotide
aggaaacacggaatgtgaaggcccagtcac

SEQ ID NO: 10620 - DNA, 29 bp, Artificial Sequence
  Description of Artificial Sequence: Synthetic oligonucleotide
ggaaacacggaatgtgaaggcccagtcac

SEQ ID NO: 10621 - DNA, 30 bp, Artificial Sequence
  Description of Artificial Sequence: Synthetic oligonucleotide
gaaacacggaatgtgaaggcccagtcacag

SEQ ID NO: 10622 - DNA, 31 bp, Artificial Sequence
  Description of Artificial Sequence: Synthetic oligonucleotide
aaacacggaatgtgaaggcccagtcacagac

SEQ ID NO: 10623 - DNA, 30 bp, Artificial Sequence
  Description of Artificial Sequence: Synthetic oligonucleotide
aacacggaatgtgaaggcccagtcacagac

SEQ ID NO: 10624 - DNA, 27 bp, Artificial Sequence
  Description of Artificial Sequence: Synthetic oligonucleotide
ggaccctgcgcggctactacaaccaaa

SEQ ID NO: 10625 - DNA, 27 bp, Artificial Sequence
  Description of Artificial Sequence: Synthetic oligonucleotide
gaccctgcgcggctactacaaccaaag

SEQ ID NO: 10626 - DNA, 27 bp, Artificial Sequence
  Description of Artificial Sequence: Synthetic oligonucleotide
accctgcgcggctactacaaccaaagc

SEQ ID NO: 10627 - DNA, 26 bp, Artificial Sequence
  Description of Artificial Sequence: Synthetic oligonucleotide
ccctgcgcggctactacaaccaaagc

SEQ ID NO: 10628 - DNA, 27 bp, Artificial Sequence
  Description of Artificial Sequence: Synthetic oligonucleotide
cctgcgcggctactacaaccaaagcga

SEQ ID NO: 10629 - DNA, 27 bp, Artificial Sequence
  Description of Artificial Sequence: Synthetic oligonucleotide
ctgcgcggctactacaaccaaagcgag

SEQ ID NO: 10630 - DNA, 27 bp, Artificial Sequence
  Description of Artificial Sequence: Synthetic oligonucleotide
tgcgcggctactacaaccaaagcgagg

SEQ ID NO: 10631 - DNA, 26 bp, Artificial Sequence
  Description of Artificial Sequence: Synthetic oligonucleotide
gcgcggctactacaaccaaagcgagg

SEQ ID NO: 10632 - DNA, 26 bp, Artificial Sequence
  Description of Artificial Sequence: Synthetic oligonucleotide
cgcggctactacaaccaaagcgaggc

SEQ ID NO: 10633 - DNA, 26 bp, Artificial Sequence
  Description of Artificial Sequence: Synthetic oligonucleotide
gcggctactacaaccaaagcgaggcc

SEQ ID NO: 10634 - DNA, 26 bp, Artificial Sequence
  Description of Artificial Sequence: Synthetic oligonucleotide
cggctactacaaccaaagcgaggccg

SEQ ID NO: 10635 - DNA, 27 bp, Artificial Sequence
  Description of Artificial Sequence: Synthetic oligonucleotide
ggctactacaaccaaagcgaggccggt

SEQ ID NO: 10636 - DNA, 28 bp, Artificial Sequence
  Description of Artificial Sequence: Synthetic oligonucleotide
gctactacaaccaaagcgaggccggttc

SEQ ID NO: 10637 - DNA, 29 bp, Artificial Sequence
  Description of Artificial Sequence: Synthetic oligonucleotide
ctactacaaccaaagcgaggccggttctc

SEQ ID NO: 10638 - DNA, 30 bp, Artificial Sequence
  Description of Artificial Sequence: Synthetic oligonucleotide
tactacaaccaaagcgaggccggttctcac

SEQ ID NO: 10639 - DNA, 29 bp, Artificial Sequence
  Description of Artificial Sequence: Synthetic oligonucleotide
actacaaccaaagcgaggccggttctcac

SEQ ID NO: 10640 - DNA, 28 bp, Artificial Sequence
  Description of Artificial Sequence: Synthetic oligonucleotide
ctacaaccaaagcgaggccggttctcac

SEQ ID NO: 10641 - DNA, 29 bp, Artificial Sequence
  Description of Artificial Sequence: Synthetic oligonucleotide
tacaaccaaagcgaggccggttctcacac

SEQ ID NO: 10642 - DNA, 28 bp, Artificial Sequence
  Description of Artificial Sequence: Synthetic oligonucleotide
acaaccaaagcgaggccggttctcacac

SEQ ID NO: 10643 - DNA, 27 bp, Artificial Sequence
  Description of Artificial Sequence: Synthetic oligonucleotide
caaccaaagcgaggccggttctcacac

SEQ ID NO: 10644 - DNA, 27 bp, Artificial Sequence
  Description of Artificial Sequence: Synthetic oligonucleotide
aaccaaagcgaggccggttctcacacc

SEQ ID NO: 10645 - DNA, 27 bp, Artificial Sequence
  Description of Artificial Sequence: Synthetic oligonucleotide
accaaagcgaggccggttctcacacca

SEQ ID NO: 10646 - DNA, 27 bp, Artificial Sequence
  Description of Artificial Sequence: Synthetic oligonucleotide
ccaaagcgaggccggttctcacaccat

SEQ ID NO: 10647 - DNA, 27 bp, Artificial Sequence
  Description of Artificial Sequence: Synthetic oligonucleotide
caaagcgaggccggttctcacaccatc

SEQ ID NO: 10648 - DNA, 27 bp, Artificial Sequence
  Description of Artificial Sequence: Synthetic oligonucleotide
aaagcgaggccggttctcacaccatcc

SEQ ID NO: 10649 - DNA, 27 bp, Artificial Sequence
  Description of Artificial Sequence: Synthetic oligonucleotide
aagcgaggccggttctcacaccatcca

SEQ ID NO: 10650 - DNA, 27 bp, Artificial Sequence
  Description of Artificial Sequence: Synthetic oligonucleotide
cagagcgaggccggttctcacaccatt

SEQ ID NO: 10651 - DNA, 27 bp, Artificial Sequence
  Description of Artificial Sequence: Synthetic oligonucleotide
agagcgaggccggttctcacaccattc

SEQ ID NO: 10652 - DNA, 27 bp, Artificial Sequence
  Description of Artificial Sequence: Synthetic oligonucleotide
gagcgaggccggttctcacaccattca

SEQ ID NO: 10653 - DNA, 27 bp, Artificial Sequence
  Description of Artificial Sequence: Synthetic oligonucleotide
agcgaggccggttctcacaccattcag

SEQ ID NO: 10654 - DNA, 27 bp, Artificial Sequence
  Description of Artificial Sequence: Synthetic oligonucleotide
gcgaggccggttctcacaccattcaga

SEQ ID NO: 10655 - DNA, 31 bp, Artificial Sequence
  Description of Artificial Sequence: Synthetic oligonucleotide
cgaggccggttctcacaccattcagataatg

SEQ ID NO: 10656 - DNA, 34 bp, Artificial Sequence
  Description of Artificial Sequence: Synthetic oligonucleotide
gaggccggttctcacaccattcagataatgtatg

SEQ ID NO: 10657 - DNA, 34 bp, Artificial Sequence
  Description of Artificial Sequence: Synthetic oligonucleotide
aggccggttctcacaccattcagataatgtatgg

SEQ ID NO: 10658 - DNA, 33 bp, Artificial Sequence
  Description of Artificial Sequence: Synthetic oligonucleotide
ggccggttctcacaccattcagataatgtatgg

SEQ ID NO: 10659 - DNA, 33 bp, Artificial Sequence
  Description of Artificial Sequence: Synthetic oligonucleotide
gccggttctcacaccattcagataatgtatggc

SEQ ID NO: 10660 - DNA, 34 bp, Artificial Sequence
  Description of Artificial Sequence: Synthetic oligonucleotide
ccggttctcacaccattcagataatgtatggctg

SEQ ID NO: 10661 - DNA, 34 bp, Artificial Sequence
  Description of Artificial Sequence: Synthetic oligonucleotide
cggttctcacaccattcagataatgtatggctgc

SEQ ID NO: 10662 - DNA, 34 bp, Artificial Sequence
  Description of Artificial Sequence: Synthetic oligonucleotide
ggttctcacaccattcagataatgtatggctgcg

SEQ ID NO: 10663 - DNA, 35 bp, Artificial Sequence
  Description of Artificial Sequence: Synthetic oligonucleotide
gttctcacaccattcagataatgtatggctgcgac

SEQ ID NO: 10664 - DNA, 35 bp, Artificial Sequence
  Description of Artificial Sequence: Synthetic oligonucleotide
ttctcacaccattcagataatgtatggctgcgacg

SEQ ID NO: 10665 - DNA, 34 bp, Artificial Sequence
  Description of Artificial Sequence: Synthetic oligonucleotide
tctcacaccattcagataatgtatggctgcgacg

SEQ ID NO: 10666 - DNA, 33 bp, Artificial Sequence
  Description of Artificial Sequence: Synthetic oligonucleotide
ctcacaccattcagataatgtatggctgcgacg

SEQ ID NO: 10667 - DNA, 34 bp, Artificial Sequence
  Description of Artificial Sequence: Synthetic oligonucleotide
tcacaccattcagataatgtatggctgcgacgtg

SEQ ID NO: 10668 - DNA, 33 bp, Artificial Sequence
  Description of Artificial Sequence: Synthetic oligonucleotide
cacaccattcagataatgtatggctgcgacgtg

SEQ ID NO: 10669 - DNA, 33 bp, Artificial Sequence
  Description of Artificial Sequence: Synthetic oligonucleotide
acaccattcagataatgtatggctgcgacgtgg

SEQ ID NO: 10670 - DNA, 32 bp, Artificial Sequence
  Description of Artificial Sequence: Synthetic oligonucleotide
caccattcagataatgtatggctgcgacgtgg

SEQ ID NO: 10671 - DNA, 32 bp, Artificial Sequence
  Description of Artificial Sequence: Synthetic oligonucleotide
accattcagataatgtatggctgcgacgtggg

SEQ ID NO: 10672 - DNA, 31 bp, Artificial Sequence
  Description of Artificial Sequence: Synthetic oligonucleotide
ccattcagataatgtatggctgcgacgtggg

SEQ ID NO: 10673 - DNA, 31 bp, Artificial Sequence
  Description of Artificial Sequence: Synthetic oligonucleotide
cattcagataatgtatggctgcgacgtgggg

SEQ ID NO: 10674 - DNA, 32 bp, Artificial Sequence
  Description of Artificial Sequence: Synthetic oligonucleotide
attcagataatgtatggctgcgacgtggggtc

SEQ ID NO: 10675 - DNA, 31 bp, Artificial Sequence
  Description of Artificial Sequence: Synthetic oligonucleotide
ttcagataatgtatggctgcgacgtggggtc

SEQ ID NO: 10676 - DNA, 30 bp, Artificial Sequence
  Description of Artificial Sequence: Synthetic oligonucleotide
tcagataatgtatggctgcgacgtggggtc

SEQ ID NO: 10677 - DNA, 25 bp, Artificial Sequence
  Description of Artificial Sequence: Synthetic oligonucleotide
aaggagacgctgcagcgcacggatc

SEQ ID NO: 10678 - DNA, 24 bp, Artificial Sequence
  Description of Artificial Sequence: Synthetic oligonucleotide
aggagacgctgcagcgcacggatc

SEQ ID NO: 10679 - DNA, 23 bp, Artificial Sequence
  Description of Artificial Sequence: Synthetic oligonucleotide
ggagacgctgcagcgcacggatc

SEQ ID NO: 10680 - DNA, 23 bp, Artificial Sequence
  Description of Artificial Sequence: Synthetic oligonucleotide
gagacgctgcagcgcacggatcc

SEQ ID NO: 10681 - DNA, 23 bp, Artificial Sequence
  Description of Artificial Sequence: Synthetic oligonucleotide
agacgctgcagcgcacggatccc

SEQ ID NO: 10682 - DNA, 22 bp, Artificial Sequence
  Description of Artificial Sequence: Synthetic oligonucleotide
gacgctgcagcgcacggatccc

SEQ ID NO: 10683 - DNA, 22 bp, Artificial Sequence
  Description of Artificial Sequence: Synthetic oligonucleotide
acgctgcagcgcacggatcccc

SEQ ID NO: 10684 - DNA, 21 bp, Artificial Sequence
  Description of Artificial Sequence: Synthetic oligonucleotide
cgctgcagcgcacggatcccc

SEQ ID NO: 10685 - DNA, 21 bp, Artificial Sequence
  Description of Artificial Sequence: Synthetic oligonucleotide
gctgcagcgcacggatccccc

SEQ ID NO: 10686 - DNA, 23 bp, Artificial Sequence
  Description of Artificial Sequence: Synthetic oligonucleotide
ctgcagcgcacggatccccccaa

SEQ ID NO: 10687 - DNA, 24 bp, Artificial Sequence
  Description of Artificial Sequence: Synthetic oligonucleotide
tgcagcgcacggatccccccaaga

SEQ ID NO: 10688 - DNA, 23 bp, Artificial Sequence
  Description of Artificial Sequence: Synthetic oligonucleotide
gcagcgcacggatccccccaaga

SEQ ID NO: 10689 - DNA, 24 bp, Artificial Sequence
  Description of Artificial Sequence: Synthetic oligonucleotide
cagcgcacggatccccccaagaca

SEQ ID NO: 10690 - DNA, 27 bp, Artificial Sequence
  Description of Artificial Sequence: Synthetic oligonucleotide
agcgcacggatccccccaagacacata

SEQ ID NO: 10691 - DNA, 27 bp, Artificial Sequence
  Description of Artificial Sequence: Synthetic oligonucleotide
gcgcacggatccccccaagacacatat

SEQ ID NO: 10692 - DNA, 27 bp, Artificial Sequence
  Description of Artificial Sequence: Synthetic oligonucleotide
cgcacggatccccccaagacacatatg

SEQ ID NO: 10693 - DNA, 28 bp, Artificial Sequence
  Description of Artificial Sequence: Synthetic oligonucleotide
gcacggatccccccaagacacatatgac

SEQ ID NO: 10694 - DNA, 28 bp, Artificial Sequence
  Description of Artificial Sequence: Synthetic oligonucleotide
cacggatccccccaagacacatatgacc

SEQ ID NO: 10695 - DNA, 28 bp, Artificial Sequence
  Description of Artificial Sequence: Synthetic oligonucleotide
acggatccccccaagacacatatgaccc

SEQ ID NO: 10696 - DNA, 27 bp, Artificial Sequence
  Description of Artificial Sequence: Synthetic oligonucleotide
cggatccccccaagacacatatgaccc

SEQ ID NO: 10697 - DNA, 28 bp, Artificial Sequence
  Description of Artificial Sequence: Synthetic oligonucleotide
ggatccccccaagacacatatgacccac

SEQ ID NO: 10698 - DNA, 28 bp, Artificial Sequence
  Description of Artificial Sequence: Synthetic oligonucleotide
gatccccccaagacacatatgacccacc

SEQ ID NO: 10699 - DNA, 29 bp, Artificial Sequence
  Description of Artificial Sequence: Synthetic oligonucleotide
atccccccaagacacatatgacccaccac

SEQ ID NO: 10700 - DNA, 28 bp, Artificial Sequence
  Description of Artificial Sequence: Synthetic oligonucleotide
tccccccaagacacatatgacccaccac

SEQ ID NO: 10701 - DNA, 28 bp, Artificial Sequence
  Description of Artificial Sequence: Synthetic oligonucleotide
aaggcccagtcacagactgaccgagtag

SEQ ID NO: 10702 - DNA, 27 bp, Artificial Sequence
  Description of Artificial Sequence: Synthetic oligonucleotide
aggcccagtcacagactgaccgagtag

SEQ ID NO: 10703 - DNA, 27 bp, Artificial Sequence
  Description of Artificial Sequence: Synthetic oligonucleotide
ggcccagtcacagactgaccgagtaga

SEQ ID NO: 10704 - DNA, 27 bp, Artificial Sequence
  Description of Artificial Sequence: Synthetic oligonucleotide
gcccagtcacagactgaccgagtagac

SEQ ID NO: 10705 - DNA, 27 bp, Artificial Sequence
  Description of Artificial Sequence: Synthetic oligonucleotide
cccagtcacagactgaccgagtagacc

SEQ ID NO: 10706 - DNA, 28 bp, Artificial Sequence
  Description of Artificial Sequence: Synthetic oligonucleotide
ccagtcacagactgaccgagtagacctg

SEQ ID NO: 10707 - DNA, 28 bp, Artificial Sequence
  Description of Artificial Sequence: Synthetic oligonucleotide
cagtcacagactgaccgagtagacctgg

SEQ ID NO: 10708 - DNA, 28 bp, Artificial Sequence
  Description of Artificial Sequence: Synthetic oligonucleotide
agtcacagactgaccgagtagacctggg

SEQ ID NO: 10709 - DNA, 27 bp, Artificial Sequence
  Description of Artificial Sequence: Synthetic oligonucleotide
gtcacagactgaccgagtagacctggg

SEQ ID NO: 10710 - DNA, 27 bp, Artificial Sequence
  Description of Artificial Sequence: Synthetic oligonucleotide
tcacagactgaccgagtagacctgggg

SEQ ID NO: 10711 - DNA, 27 bp, Artificial Sequence
  Description of Artificial Sequence: Synthetic oligonucleotide
cacagactgaccgagtagacctgggga

SEQ ID NO: 10712 - DNA, 27 bp, Artificial Sequence
  Description of Artificial Sequence: Synthetic oligonucleotide
acagactgaccgagtagacctggggac

SEQ ID NO: 10713 - DNA, 26 bp, Artificial Sequence
  Description of Artificial Sequence: Synthetic oligonucleotide
cagactgaccgagtagacctggggac

SEQ ID NO: 10714 - DNA, 26 bp, Artificial Sequence
  Description of Artificial Sequence: Synthetic oligonucleotide
agactgaccgagtagacctggggacc

SEQ ID NO: 10715 - DNA, 25 bp, Artificial Sequence
  Description of Artificial Sequence: Synthetic oligonucleotide
gactgaccgagtagacctggggacc

SEQ ID NO: 10716 - DNA, 26 bp, Artificial Sequence
  Description of Artificial Sequence: Synthetic oligonucleotide
actgaccgagtagacctggggaccct

SEQ ID NO: 10717 - DNA, 25 bp, Artificial Sequence
  Description of Artificial Sequence: Synthetic oligonucleotide
ctgaccgagtagacctggggaccct

SEQ ID NO: 10718 - DNA, 25 bp, Artificial Sequence
  Description of Artificial Sequence: Synthetic oligonucleotide
tgaccgagtagacctggggaccctg

SEQ ID NO: 10719 - DNA, 24 bp, Artificial Sequence
  Description of Artificial Sequence: Synthetic oligonucleotide
gaccgagtagacctggggaccctg

SEQ ID NO: 10720 - DNA, 24 bp, Artificial Sequence
  Description of Artificial Sequence: Synthetic oligonucleotide
accgagtagacctggggaccctgc

SEQ ID NO: 10721 - DNA, 23 bp, Artificial Sequence
  Description of Artificial Sequence: Synthetic oligonucleotide
ccgagtagacctggggaccctgc

SEQ ID NO: 10722 - DNA, 23 bp, Artificial Sequence
  Description of Artificial Sequence: Synthetic oligonucleotide
cgagtagacctggggaccctgcg

SEQ ID NO: 10723 - DNA, 23 bp, Artificial Sequence
  Description of Artificial Sequence: Synthetic oligonucleotide
gagtagacctggggaccctgcgc

SEQ ID NO: 10724 - DNA, 23 bp, Artificial Sequence
  Description of Artificial Sequence: Synthetic oligonucleotide
agtagacctggggaccctgcgcg

SEQ ID NO: 10725 - DNA, 22 bp, Artificial Sequence
  Description of Artificial Sequence: Synthetic oligonucleotide
gtagacctggggaccctgcgcg

SEQ ID NO: 10726 - DNA, 22 bp, Artificial Sequence
  Description of Artificial Sequence: Synthetic oligonucleotide
tagacctggggaccctgcgcgg

SEQ ID NO: 10727 - DNA, 21 bp, Artificial Sequence
  Description of Artificial Sequence: Synthetic oligonucleotide
agacctggggaccctgcgcgg

SEQ ID NO: 10728 - DNA, 22 bp, Artificial Sequence
  Description of Artificial Sequence: Synthetic oligonucleotide
gcggagagccccgcttcatcgc

SEQ ID NO: 10729 - DNA, 22 bp, Artificial Sequence
  Description of Artificial Sequence: Synthetic oligonucleotide
cggagagccccgcttcatcgcc

SEQ ID NO: 10730 - DNA, 23 bp, Artificial Sequence
  Description of Artificial Sequence: Synthetic oligonucleotide
ggagagccccgcttcatcgccgt

SEQ ID NO: 10731 - DNA, 23 bp, Artificial Sequence
  Description of Artificial Sequence: Synthetic oligonucleotide
gagagccccgcttcatcgccgtg

SEQ ID NO: 10732 - DNA, 23 bp, Artificial Sequence
  Description of Artificial Sequence: Synthetic oligonucleotide
agagccccgcttcatcgccgtgg

SEQ ID NO: 10733 - DNA, 33 bp, Artificial Sequence
  Description of Artificial Sequence: Synthetic oligonucleotide
gagtattgggaccaggagacacggaatgtaaag

SEQ ID NO: 10734 - DNA, 33 bp, Artificial Sequence
  Description of Artificial Sequence: Synthetic oligonucleotide
agtattgggaccaggagacacggaatgtaaagg

SEQ ID NO: 10735 - DNA, 32 bp, Artificial Sequence
  Description of Artificial Sequence: Synthetic oligonucleotide
gtattgggaccaggagacacggaatgtaaagg

SEQ ID NO: 10736 - DNA, 32 bp, Artificial Sequence
  Description of Artificial Sequence: Synthetic oligonucleotide
tattgggaccaggagacacggaatgtaaaggc

SEQ ID NO: 10737 - DNA, 31 bp, Artificial Sequence
  Description of Artificial Sequence: Synthetic oligonucleotide
attgggaccaggagacacggaatgtaaaggc

SEQ ID NO: 10738 - DNA, 30 bp, Artificial Sequence
  Description of Artificial Sequence: Synthetic oligonucleotide
ttgggaccaggagacacggaatgtaaaggc

SEQ ID NO: 10739 - DNA, 29 bp, Artificial Sequence
  Description of Artificial Sequence: Synthetic oligonucleotide
tgggaccaggagacacggaatgtaaaggc

SEQ ID NO: 10740 - DNA, 28 bp, Artificial Sequence
  Description of Artificial Sequence: Synthetic oligonucleotide
gggaccaggagacacggaatgtaaaggc

SEQ ID NO: 10741 - DNA, 28 bp, Artificial Sequence
  Description of Artificial Sequence: Synthetic oligonucleotide
ggaccaggagacacggaatgtaaaggcc

SEQ ID NO: 10742 - DNA, 28 bp, Artificial Sequence
  Description of Artificial Sequence: Synthetic oligonucleotide
gaccaggagacacggaatgtaaaggccc

SEQ ID NO: 10743 - DNA, 29 bp, Artificial Sequence
  Description of Artificial Sequence: Synthetic oligonucleotide
accaggagacacggaatgtaaaggcccag

SEQ ID NO: 10744 - DNA, 28 bp, Artificial Sequence
  Description of Artificial Sequence: Synthetic oligonucleotide
ccaggagacacggaatgtaaaggcccag

SEQ ID NO: 10745 - DNA, 29 bp, Artificial Sequence
  Description of Artificial Sequence: Synthetic oligonucleotide
caggagacacggaatgtaaaggcccagtc

SEQ ID NO: 10746 - DNA, 30 bp, Artificial Sequence
  Description of Artificial Sequence: Synthetic oligonucleotide
aggagacacggaatgtaaaggcccagtcac

SEQ ID NO: 10747 - DNA, 29 bp, Artificial Sequence
  Description of Artificial Sequence: Synthetic oligonucleotide
ggagacacggaatgtaaaggcccagtcac

SEQ ID NO: 10748 - DNA, 30 bp, Artificial Sequence
  Description of Artificial Sequence: Synthetic oligonucleotide
gagacacggaatgtaaaggcccagtcacag

SEQ ID NO: 10749 - DNA, 31 bp, Artificial Sequence
  Description of Artificial Sequence: Synthetic oligonucleotide
agacacggaatgtaaaggcccagtcacagac

SEQ ID NO: 10750 - DNA, 30 bp, Artificial Sequence
  Description of Artificial Sequence: Synthetic oligonucleotide
gacacggaatgtaaaggcccagtcacagac

SEQ ID NO: 10751 - DNA, 31 bp, Artificial Sequence
  Description of Artificial Sequence: Synthetic oligonucleotide
acacggaatgtaaaggcccagtcacagactg

SEQ ID NO: 10752 - DNA, 30 bp, Artificial Sequence
  Description of Artificial Sequence: Synthetic oligonucleotide
cacggaatgtaaaggcccagtcacagactg

SEQ ID NO: 10753 - DNA, 31 bp, Artificial Sequence
  Description of Artificial Sequence: Synthetic oligonucleotide
acggaatgtaaaggcccagtcacagactgac

SEQ ID NO: 10754 - DNA, 30 bp, Artificial Sequence
  Description of Artificial Sequence: Synthetic oligonucleotide
cggaatgtaaaggcccagtcacagactgac

SEQ ID NO: 10755 - DNA, 30 bp, Artificial Sequence
  Description of Artificial Sequence: Synthetic oligonucleotide
ggaatgtaaaggcccagtcacagactgacc

SEQ ID NO: 10756 - DNA, 30 bp, Artificial Sequence
  Description of Artificial Sequence: Synthetic oligonucleotide
gaatgtaaaggcccagtcacagactgaccg

SEQ ID NO: 10757 - DNA, 31 bp, Artificial Sequence
  Description of Artificial Sequence: Synthetic oligonucleotide
aatgtaaaggcccagtcacagactgaccgag

SEQ ID NO: 10758 - DNA, 30 bp, Artificial Sequence
  Description of Artificial Sequence: Synthetic oligonucleotide
atgtaaaggcccagtcacagactgaccgag

SEQ ID NO: 10759 - DNA, 29 bp, Artificial Sequence
  Description of Artificial Sequence: Synthetic oligonucleotide
tgtaaaggcccagtcacagactgaccgag

SEQ ID NO: 10760 - DNA, 28 bp, Artificial Sequence
  Description of Artificial Sequence: Synthetic oligonucleotide
gtaaaggcccagtcacagactgaccgag

SEQ ID NO: 10761 - DNA, 29 bp, Artificial Sequence
  Description of Artificial Sequence: Synthetic oligonucleotide
taaaggcccagtcacagactgaccgagtg

SEQ ID NO: 10762 - DNA, 28 bp, Artificial Sequence
  Description of Artificial Sequence: Synthetic oligonucleotide
aaaggcccagtcacagactgaccgagtg

SEQ ID NO: 10763 - DNA, 23 bp, Artificial Sequence
  Description of Artificial Sequence: Synthetic oligonucleotide
accgagtggacctggggaccctc

SEQ ID NO: 10764 - DNA, 22 bp, Artificial Sequence
  Description of Artificial Sequence: Synthetic oligonucleotide
ccgagtggacctggggaccctc

SEQ ID NO: 10765 - DNA, 22 bp, Artificial Sequence
  Description of Artificial Sequence: Synthetic oligonucleotide
cgagtggacctggggaccctcc

SEQ ID NO: 10766 - DNA, 22 bp, Artificial Sequence
  Description of Artificial Sequence: Synthetic oligonucleotide
gagtggacctggggaccctccg

SEQ ID NO: 10767 - DNA, 22 bp, Artificial Sequence
  Description of Artificial Sequence: Synthetic oligonucleotide
agtggacctggggaccctccgc

SEQ ID NO: 10768 - DNA, 21 bp, Artificial Sequence
  Description of Artificial Sequence: Synthetic oligonucleotide
gtggacctggggaccctccgc

SEQ ID NO: 10769 - DNA, 21 bp, Artificial Sequence
  Description of Artificial Sequence: Synthetic oligonucleotide
tggacctggggaccctccgcg

SEQ ID NO: 10770 - DNA, 20 bp, Artificial Sequence
  Description of Artificial Sequence: Synthetic oligonucleotide
ggacctggggaccctccgcg

SEQ ID NO: 10771 - DNA, 20 bp, Artificial Sequence
  Description of Artificial Sequence: Synthetic oligonucleotide
gacctggggaccctccgcgg

SEQ ID NO: 10772 - DNA, 22 bp, Artificial Sequence
  Description of Artificial Sequence: Synthetic oligonucleotide
acctggggaccctccgcggcta

SEQ ID NO: 10773 - DNA, 21 bp, Artificial Sequence
  Description of Artificial Sequence: Synthetic oligonucleotide
cctggggaccctccgcggcta

SEQ ID NO: 10774 - DNA, 23 bp, Artificial Sequence
  Description of Artificial Sequence: Synthetic oligonucleotide
ctggggaccctccgcggctacta

SEQ ID NO: 10775 - DNA, 25 bp, Artificial Sequence
  Description of Artificial Sequence: Synthetic oligonucleotide
tggggaccctccgcggctactacaa

SEQ ID NO: 10776 - DNA, 24 bp, Artificial Sequence
  Description of Artificial Sequence: Synthetic oligonucleotide
ggggaccctccgcggctactacaa

SEQ ID NO: 10777 - DNA, 24 bp, Artificial Sequence
  Description of Artificial Sequence: Synthetic oligonucleotide
gggaccctccgcggctactacaac

SEQ ID NO: 10778 - DNA, 25 bp, Artificial Sequence
  Description of Artificial Sequence: Synthetic oligonucleotide
ggaccctccgcggctactacaacca

SEQ ID NO: 10779 - DNA, 26 bp, Artificial Sequence
  Description of Artificial Sequence: Synthetic oligonucleotide
gaccctccgcggctactacaaccaga

SEQ ID NO: 10780 - DNA, 26 bp, Artificial Sequence
  Description of Artificial Sequence: Synthetic oligonucleotide
accctccgcggctactacaaccagag

SEQ ID NO: 10781 - DNA, 25 bp, Artificial Sequence
  Description of Artificial Sequence: Synthetic oligonucleotide
ccctccgcggctactacaaccagag

SEQ ID NO: 10782 - DNA, 25 bp, Artificial Sequence
  Description of Artificial Sequence: Synthetic oligonucleotide
cctccgcggctactacaaccagagc

SEQ ID NO: 10783 - DNA, 26 bp, Artificial Sequence
  Description of Artificial Sequence: Synthetic oligonucleotide
ctccgcggctactacaaccagagcga

SEQ ID NO: 10784 - DNA, 26 bp, Artificial Sequence
  Description of Artificial Sequence: Synthetic oligonucleotide
tccgcggctactacaaccagagcgag

SEQ ID NO: 10785 - DNA, 25 bp, Artificial Sequence
  Description of Artificial Sequence: Synthetic oligonucleotide
ccgcggctactacaaccagagcgag

SEQ ID NO: 10786 - DNA, 28 bp, Artificial Sequence
  Description of Artificial Sequence: Synthetic oligonucleotide
gagtggctccgcagatacctggagaatg

SEQ ID NO: 10787 - DNA, 28 bp, Artificial Sequence
  Description of Artificial Sequence: Synthetic oligonucleotide
agtggctccgcagatacctggagaatgg

SEQ ID NO: 10788 - DNA, 27 bp, Artificial Sequence
  Description of Artificial Sequence: Synthetic oligonucleotide
gtggctccgcagatacctggagaatgg

SEQ ID NO: 10789 - DNA, 27 bp, Artificial Sequence
  Description of Artificial Sequence: Synthetic oligonucleotide
tggctccgcagatacctggagaatggg

SEQ ID NO: 10790 - DNA, 27 bp, Artificial Sequence
  Description of Artificial Sequence: Synthetic oligonucleotide
ggctccgcagatacctggagaatggga

SEQ ID NO: 10791 - DNA, 28 bp, Artificial Sequence
  Description of Artificial Sequence: Synthetic oligonucleotide
gctccgcagatacctggagaatgggaag

SEQ ID NO: 10792 - DNA, 28 bp, Artificial Sequence
  Description of Artificial Sequence: Synthetic oligonucleotide
ctccgcagatacctggagaatgggaagg

SEQ ID NO: 10793 - DNA, 29 bp, Artificial Sequence
  Description of Artificial Sequence: Synthetic oligonucleotide
tccgcagatacctggagaatgggaaggag

SEQ ID NO: 10794 - DNA, 28 bp, Artificial Sequence
  Description of Artificial Sequence: Synthetic oligonucleotide
ccgcagatacctggagaatgggaaggag

SEQ ID NO: 10795 - DNA, 29 bp, Artificial Sequence
  Description of Artificial Sequence: Synthetic oligonucleotide
cgcagatacctggagaatgggaaggagac

SEQ ID NO: 10796 - DNA, 29 bp, Artificial Sequence
  Description of Artificial Sequence: Synthetic oligonucleotide
gcagatacctggagaatgggaaggagacg

SEQ ID NO: 10797 - DNA, 29 bp, Artificial Sequence
  Description of Artificial Sequence: Synthetic oligonucleotide
cagatacctggagaatgggaaggagacgc

SEQ ID NO: 10798 - DNA, 30 bp, Artificial Sequence
  Description of Artificial Sequence: Synthetic oligonucleotide
agatacctggagaatgggaaggagacgctg

SEQ ID NO: 10799 - DNA, 29 bp, Artificial Sequence
  Description of Artificial Sequence: Synthetic oligonucleotide
gatacctggagaatgggaaggagacgctg

SEQ ID NO: 10800 - DNA, 29 bp, Artificial Sequence
  Description of Artificial Sequence: Synthetic oligonucleotide
atacctggagaatgggaaggagacgctgc

SEQ ID NO: 10801 - DNA, 28 bp, Artificial Sequence
  Description of Artificial Sequence: Synthetic oligonucleotide
tacctggagaatgggaaggagacgctgc

SEQ ID NO: 10802 - DNA, 27 bp, Artificial Sequence
  Description of Artificial Sequence: Synthetic oligonucleotide
acctggagaatgggaaggagacgctgc

SEQ ID NO: 10803 - DNA, 27 bp, Artificial Sequence
  Description of Artificial Sequence: Synthetic oligonucleotide
cctggagaatgggaaggagacgctgca

SEQ ID NO: 10804 - DNA, 27 bp, Artificial Sequence
  Description of Artificial Sequence: Synthetic oligonucleotide
ctggagaatgggaaggagacgctgcag

SEQ ID NO: 10805 - DNA, 27 bp, Artificial Sequence
  Description of Artificial Sequence: Synthetic oligonucleotide
tggagaatgggaaggagacgctgcagc

SEQ ID NO: 10806 - DNA, 26 bp, Artificial Sequence
  Description of Artificial Sequence: Synthetic oligonucleotide
ggagaatgggaaggagacgctgcagc

SEQ ID NO: 10807 - DNA, 26 bp, Artificial Sequence
  Description of Artificial Sequence: Synthetic oligonucleotide
gagaatgggaaggagacgctgcagcg

SEQ ID NO: 10808 - DNA, 27 bp, Artificial Sequence
  Description of Artificial Sequence: Synthetic oligonucleotide
agaatgggaaggagacgctgcagcgca

SEQ ID NO: 10809 - DNA, 26 bp, Artificial Sequence
  Description of Artificial Sequence: Synthetic oligonucleotide
gaatgggaaggagacgctgcagcgca

SEQ ID NO: 10810 - DNA, 26 bp, Artificial Sequence
  Description of Artificial Sequence: Synthetic oligonucleotide
aatgggaaggagacgctgcagcgcac

SEQ ID NO: 10811 - DNA, 25 bp, Artificial Sequence
  Description of Artificial Sequence: Synthetic oligonucleotide
atgggaaggagacgctgcagcgcac

SEQ ID NO: 10812 - DNA, 24 bp, Artificial Sequence
  Description of Artificial Sequence: Synthetic oligonucleotide
tgggaaggagacgctgcagcgcac

SEQ ID NO: 10813 - DNA, 24 bp, Artificial Sequence
  Description of Artificial Sequence: Synthetic oligonucleotide
aagtgggaggcggcccatgaggca

SEQ ID NO: 10814 - DNA, 23 bp, Artificial Sequence
  Description of Artificial Sequence: Synthetic oligonucleotide
agtgggaggcggcccatgaggca

SEQ ID NO: 10815 - DNA, 22 bp, Artificial Sequence
  Description of Artificial Sequence: Synthetic oligonucleotide
gtgggaggcggcccatgaggca

SEQ ID NO: 10816 - DNA, 23 bp, Artificial Sequence
  Description of Artificial Sequence: Synthetic oligonucleotide
tgggaggcggcccatgaggcaga

SEQ ID NO: 10817 - DNA, 22 bp, Artificial Sequence
  Description of Artificial Sequence: Synthetic oligonucleotide
gggaggcggcccatgaggcaga

SEQ ID NO: 10818 - DNA, 22 bp, Artificial Sequence
  Description of Artificial Sequence: Synthetic oligonucleotide
ggaggcggcccatgaggcagag

SEQ ID NO: 10819 - DNA, 23 bp, Artificial Sequence
  Description of Artificial Sequence: Synthetic oligonucleotide
gaggcggcccatgaggcagagca

SEQ ID NO: 10820 - DNA, 25 bp, Artificial Sequence
  Description of Artificial Sequence: Synthetic oligonucleotide
aggcggcccatgaggcagagcagtt

SEQ ID NO: 10821 - DNA, 24 bp, Artificial Sequence
  Description of Artificial Sequence: Synthetic oligonucleotide
ggcggcccatgaggcagagcagtt

SEQ ID NO: 10822 - DNA, 25 bp, Artificial Sequence
  Description of Artificial Sequence: Synthetic oligonucleotide
gcggcccatgaggcagagcagttga

SEQ ID NO: 10823 - DNA, 26 bp, Artificial Sequence
  Description of Artificial Sequence: Synthetic oligonucleotide
cggcccatgaggcagagcagttgaga

SEQ ID NO: 10824 - DNA, 26 bp, Artificial Sequence
  Description of Artificial Sequence: Synthetic oligonucleotide
ggcccatgaggcagagcagttgagag

SEQ ID NO: 10825 - DNA, 26 bp, Artificial Sequence
  Description of Artificial Sequence: Synthetic oligonucleotide
gcccatgaggcagagcagttgagagc

SEQ ID NO: 10826 - DNA, 27 bp, Artificial Sequence
  Description of Artificial Sequence: Synthetic oligonucleotide
cccatgaggcagagcagttgagagcct

SEQ ID NO: 10827 - DNA, 28 bp, Artificial Sequence
  Description of Artificial Sequence: Synthetic oligonucleotide
ccatgaggcagagcagttgagagcctac

SEQ ID NO: 10828 - DNA, 28 bp, Artificial Sequence
  Description of Artificial Sequence: Synthetic oligonucleotide
catgaggcagagcagttgagagcctacc

SEQ ID NO: 10829 - DNA, 29 bp, Artificial Sequence
  Description of Artificial Sequence: Synthetic oligonucleotide
atgaggcagagcagttgagagcctacctg

SEQ ID NO: 10830 - DNA, 28 bp, Artificial Sequence
  Description of Artificial Sequence: Synthetic oligonucleotide
tgaggcagagcagttgagagcctacctg

SEQ ID NO: 10831 - DNA, 27 bp, Artificial Sequence
  Description of Artificial Sequence: Synthetic oligonucleotide
gaggcagagcagttgagagcctacctg

SEQ ID NO: 10832 - DNA, 27 bp, Artificial Sequence
  Description of Artificial Sequence: Synthetic oligonucleotide
aggcagagcagttgagagcctacctgg

SEQ ID NO: 10833 - DNA, 27 bp, Artificial Sequence
  Description of Artificial Sequence: Synthetic oligonucleotide
ggcagagcagttgagagcctacctgga

SEQ ID NO: 10834 - DNA, 28 bp, Artificial Sequence
  Description of Artificial Sequence: Synthetic oligonucleotide
gcagagcagttgagagcctacctggatg

SEQ ID NO: 10835 - DNA, 28 bp, Artificial Sequence
  Description of Artificial Sequence: Synthetic oligonucleotide
cagagcagttgagagcctacctggatgg

SEQ ID NO: 10836 - DNA, 28 bp, Artificial Sequence
  Description of Artificial Sequence: Synthetic oligonucleotide
agagcagttgagagcctacctggatggc

SEQ ID NO: 10837 - DNA, 27 bp, Artificial Sequence
  Description of Artificial Sequence: Synthetic oligonucleotide
ccggagtattgggaccaggagacacga

SEQ ID NO: 10838 - DNA, 30 bp, Artificial Sequence
  Description of Artificial Sequence: Synthetic oligonucleotide
cggagtattgggaccaggagacacgaaatg

SEQ ID NO: 10839 - DNA, 31 bp, Artificial Sequence
  Description of Artificial Sequence: Synthetic oligonucleotide
ggagtattgggaccaggagacacgaaatgtg

SEQ ID NO: 10840 - DNA, 33 bp, Artificial Sequence
  Description of Artificial Sequence: Synthetic oligonucleotide
gagtattgggaccaggagacacgaaatgtgaag

SEQ ID NO: 10841 - DNA, 33 bp, Artificial Sequence
  Description of Artificial Sequence: Synthetic oligonucleotide
agtattgggaccaggagacacgaaatgtgaagg

SEQ ID NO: 10842 - DNA, 32 bp, Artificial Sequence
  Description of Artificial Sequence: Synthetic oligonucleotide
gtattgggaccaggagacacgaaatgtgaagg

SEQ ID NO: 10843 - DNA, 32 bp, Artificial Sequence
  Description of Artificial Sequence: Synthetic oligonucleotide
tattgggaccaggagacacgaaatgtgaaggc

SEQ ID NO: 10844 - DNA, 31 bp, Artificial Sequence
  Description of Artificial Sequence: Synthetic oligonucleotide
attgggaccaggagacacgaaatgtgaaggc

SEQ ID NO: 10845 - DNA, 30 bp, Artificial Sequence
  Description of Artificial Sequence: Synthetic oligonucleotide
ttgggaccaggagacacgaaatgtgaaggc

SEQ ID NO: 10846 - DNA, 29 bp, Artificial Sequence
  Description of Artificial Sequence: Synthetic oligonucleotide
tgggaccaggagacacgaaatgtgaaggc

SEQ ID NO: 10847 - DNA, 28 bp, Artificial Sequence
  Description of Artificial Sequence: Synthetic oligonucleotide
gggaccaggagacacgaaatgtgaaggc

SEQ ID NO: 10848 - DNA, 28 bp, Artificial Sequence
  Description of Artificial Sequence: Synthetic oligonucleotide
ggaccaggagacacgaaatgtgaaggcc

SEQ ID NO: 10849 - DNA, 28 bp, Artificial Sequence
  Description of Artificial Sequence: Synthetic oligonucleotide
gaccaggagacacgaaatgtgaaggccc

SEQ ID NO: 10850 - DNA, 29 bp, Artificial Sequence
  Description of Artificial Sequence: Synthetic oligonucleotide
accaggagacacgaaatgtgaaggcccag

SEQ ID NO: 10851 - DNA, 28 bp, Artificial Sequence
  Description of Artificial Sequence: Synthetic oligonucleotide
ccaggagacacgaaatgtgaaggcccag

SEQ ID NO: 10852 - DNA, 29 bp, Artificial Sequence
  Description of Artificial Sequence: Synthetic oligonucleotide
caggagacacgaaatgtgaaggcccagtc

SEQ ID NO: 10853 - DNA, 30 bp, Artificial Sequence
  Description of Artificial Sequence: Synthetic oligonucleotide
aggagacacgaaatgtgaaggcccagtcac

SEQ ID NO: 10854 - DNA, 29 bp, Artificial Sequence
  Description of Artificial Sequence: Synthetic oligonucleotide
ggagacacgaaatgtgaaggcccagtcac

SEQ ID NO: 10855 - DNA, 30 bp, Artificial Sequence
  Description of Artificial Sequence: Synthetic oligonucleotide
gagacacgaaatgtgaaggcccagtcacag

SEQ ID NO: 10856 - DNA, 31 bp, Artificial Sequence
  Description of Artificial Sequence: Synthetic oligonucleotide
agacacgaaatgtgaaggcccagtcacagac

SEQ ID NO: 10857 - DNA, 30 bp, Artificial Sequence
  Description of Artificial Sequence: Synthetic oligonucleotide
gacacgaaatgtgaaggcccagtcacagac

SEQ ID NO: 10858 - DNA, 31 bp, Artificial Sequence
  Description of Artificial Sequence: Synthetic oligonucleotide
acacgaaatgtgaaggcccagtcacagactg

SEQ ID NO: 10859 - DNA, 30 bp, Artificial Sequence
  Description of Artificial Sequence: Synthetic oligonucleotide
cacgaaatgtgaaggcccagtcacagactg

SEQ ID NO: 10860 - DNA, 31 bp, Artificial Sequence
  Description of Artificial Sequence: Synthetic oligonucleotide
acgaaatgtgaaggcccagtcacagactgac

SEQ ID NO: 10861 - DNA, 30 bp, Artificial Sequence
  Description of Artificial Sequence: Synthetic oligonucleotide
cgaaatgtgaaggcccagtcacagactgac

SEQ ID NO: 10862 - DNA, 30 bp, Artificial Sequence
  Description of Artificial Sequence: Synthetic oligonucleotide
gaaatgtgaaggcccagtcacagactgacc

SEQ ID NO: 10863 - DNA, 30 bp, Artificial Sequence
  Description of Artificial Sequence: Synthetic oligonucleotide
aaatgtgaaggcccagtcacagactgaccg

SEQ ID NO: 10864 - DNA, 23 bp, Artificial Sequence
  Description of Artificial Sequence: Synthetic oligonucleotide
gccctgaacgaggacctgcgctc

SEQ ID NO: 10865 - DNA, 24 bp, Artificial Sequence
  Description of Artificial Sequence: Synthetic oligonucleotide
ccctgaacgaggacctgcgctcct

SEQ ID NO: 10866 - DNA, 24 bp, Artificial Sequence
  Description of Artificial Sequence: Synthetic oligonucleotide
cctgaacgaggacctgcgctcctg

SEQ ID NO: 10867 - DNA, 25 bp, Artificial Sequence
  Description of Artificial Sequence: Synthetic oligonucleotide
ctgaacgaggacctgcgctcctgga

SEQ ID NO: 10868 - DNA, 25 bp, Artificial Sequence
  Description of Artificial Sequence: Synthetic oligonucleotide
tgaacgaggacctgcgctcctggac

SEQ ID NO: 10869 - DNA, 24 bp, Artificial Sequence
  Description of Artificial Sequence: Synthetic oligonucleotide
gaacgaggacctgcgctcctggac

SEQ ID NO: 10870 - DNA, 24 bp, Artificial Sequence
  Description of Artificial Sequence: Synthetic oligonucleotide
aacgaggacctgcgctcctggacc

SEQ ID NO: 10871 - DNA, 23 bp, Artificial Sequence
  Description of Artificial Sequence: Synthetic oligonucleotide
acgaggacctgcgctcctggacc

SEQ ID NO: 10872 - DNA, 22 bp, Artificial Sequence
  Description of Artificial Sequence: Synthetic oligonucleotide
cgaggacctgcgctcctggacc

SEQ ID NO: 10873 - DNA, 21 bp, Artificial Sequence
  Description of Artificial Sequence: Synthetic oligonucleotide
ctggaccgcggcggacatggc

SEQ ID NO: 10874 - DNA, 30 bp, Artificial Sequence
  Description of Artificial Sequence: Synthetic oligonucleotide
agataatgtatggctgcgacgtggggtctg

SEQ ID NO: 10875 - DNA, 29 bp, Artificial Sequence
  Description of Artificial Sequence: Synthetic oligonucleotide
gataatgtatggctgcgacgtggggtctg

SEQ ID NO: 10876 - DNA, 30 bp, Artificial Sequence
  Description of Artificial Sequence: Synthetic oligonucleotide
ataatgtatggctgcgacgtggggtctgac

SEQ ID NO: 10877 - DNA, 29 bp, Artificial Sequence
  Description of Artificial Sequence: Synthetic oligonucleotide
taatgtatggctgcgacgtggggtctgac

SEQ ID NO: 10878 - DNA, 28 bp, Artificial Sequence
  Description of Artificial Sequence: Synthetic oligonucleotide
aatgtatggctgcgacgtggggtctgac

SEQ ID NO: 10879 - DNA, 27 bp, Artificial Sequence
  Description of Artificial Sequence: Synthetic oligonucleotide
atgtatggctgcgacgtggggtctgac

SEQ ID NO: 10880 - DNA, 26 bp, Artificial Sequence
  Description of Artificial Sequence: Synthetic oligonucleotide
tgtatggctgcgacgtggggtctgac

SEQ ID NO: 10881 - DNA, 25 bp, Artificial Sequence
  Description of Artificial Sequence: Synthetic oligonucleotide
gtatggctgcgacgtggggtctgac

SEQ ID NO: 10882 - DNA, 25 bp, Artificial Sequence
  Description of Artificial Sequence: Synthetic oligonucleotide
tatggctgcgacgtggggtctgacg

SEQ ID NO: 10883 - DNA, 24 bp, Artificial Sequence
  Description of Artificial Sequence: Synthetic oligonucleotide
atggctgcgacgtggggtctgacg

SEQ ID NO: 10884 - DNA, 23 bp, Artificial Sequence
  Description of Artificial Sequence: Synthetic oligonucleotide
tggctgcgacgtggggtctgacg

SEQ ID NO: 10885 - DNA, 22 bp, Artificial Sequence
  Description of Artificial Sequence: Synthetic oligonucleotide
ggctgcgacgtggggtctgacg

SEQ ID NO: 10886 - DNA, 22 bp, Artificial Sequence
  Description of Artificial Sequence: Synthetic oligonucleotide
gctgcgacgtggggtctgacgg

SEQ ID NO: 10887 - DNA, 22 bp, Artificial Sequence
  Description of Artificial Sequence: Synthetic oligonucleotide
ctgcgacgtggggtctgacggg

SEQ ID NO: 10888 - DNA, 22 bp, Artificial Sequence
  Description of Artificial Sequence: Synthetic oligonucleotide
tgcgacgtggggtctgacgggc

SEQ ID NO: 10889 - DNA, 21 bp, Artificial Sequence
  Description of Artificial Sequence: Synthetic oligonucleotide
gcgacgtggggtctgacgggc

SEQ ID NO: 10890 - DNA, 21 bp, Artificial Sequence
  Description of Artificial Sequence: Synthetic oligonucleotide
cgacgtggggtctgacgggcg

SEQ ID NO: 10891 - DNA, 23 bp, Artificial Sequence
  Description of Artificial Sequence: Synthetic oligonucleotide
gacgtggggtctgacgggcgctt

SEQ ID NO: 10892 - DNA, 23 bp, Artificial Sequence
  Description of Artificial Sequence: Synthetic oligonucleotide
acgtggggtctgacgggcgcttc

SEQ ID NO: 10893 - DNA, 22 bp, Artificial Sequence
  Description of Artificial Sequence: Synthetic oligonucleotide
cgtggggtctgacgggcgcttc

SEQ ID NO: 10894 - DNA, 23 bp, Artificial Sequence
  Description of Artificial Sequence: Synthetic oligonucleotide
gtggggtctgacgggcgcttcct

SEQ ID NO: 10895 - DNA, 23 bp, Artificial Sequence
  Description of Artificial Sequence: Synthetic oligonucleotide
tggggtctgacgggcgcttcctc

SEQ ID NO: 10896 - DNA, 22 bp, Artificial Sequence
  Description of Artificial Sequence: Synthetic oligonucleotide
ggggtctgacgggcgcttcctc

SEQ ID NO: 10897 - DNA, 22 bp, Artificial Sequence
  Description of Artificial Sequence: Synthetic oligonucleotide
gggtctgacgggcgcttcctcc

SEQ ID NO: 10898 - DNA, 22 bp, Artificial Sequence
  Description of Artificial Sequence: Synthetic oligonucleotide
ggtctgacgggcgcttcctccg

SEQ ID NO: 10899 - DNA, 22 bp, Artificial Sequence
  Description of Artificial Sequence: Synthetic oligonucleotide
gtctgacgggcgcttcctccgc

SEQ ID NO: 10900 - DNA, 22 bp, Artificial Sequence
  Description of Artificial Sequence: Synthetic oligonucleotide
tctgacgggcgcttcctccgcg

SEQ ID NO: 10901 - DNA, 21 bp, Artificial Sequence
  Description of Artificial Sequence: Synthetic oligonucleotide
ctgacgggcgcttcctccgcg

SEQ ID NO: 10902 - DNA, 21 bp, Artificial Sequence
  Description of Artificial Sequence: Synthetic oligonucleotide
tgacgggcgcttcctccgcgg

SEQ ID NO: 10903 - DNA, 23 bp, Artificial Sequence
  Description of Artificial Sequence: Synthetic oligonucleotide
cgcgggtaccggcaggacgctta

SEQ ID NO: 10904 - DNA, 23 bp, Artificial Sequence
  Description of Artificial Sequence: Synthetic oligonucleotide
gcgggtaccggcaggacgcttac

SEQ ID NO: 10905 - DNA, 24 bp, Artificial Sequence
  Description of Artificial Sequence: Synthetic oligonucleotide
cgggtaccggcaggacgcttacga

SEQ ID NO: 10906 - DNA, 24 bp, Artificial Sequence
  Description of Artificial Sequence: Synthetic oligonucleotide
gggtaccggcaggacgcttacgac

SEQ ID NO: 10907 - DNA, 24 bp, Artificial Sequence
  Description of Artificial Sequence: Synthetic oligonucleotide
ggtaccggcaggacgcttacgacg

SEQ ID NO: 10908 - DNA, 24 bp, Artificial Sequence
  Description of Artificial Sequence: Synthetic oligonucleotide
gtaccggcaggacgcttacgacgg

SEQ ID NO: 10909 - DNA, 26 bp, Artificial Sequence
  Description of Artificial Sequence: Synthetic oligonucleotide
taccggcaggacgcttacgacggcaa

SEQ ID NO: 10910 - DNA, 25 bp, Artificial Sequence
  Description of Artificial Sequence: Synthetic oligonucleotide
accggcaggacgcttacgacggcaa

SEQ ID NO: 10911 - DNA, 24 bp, Artificial Sequence
  Description of Artificial Sequence: Synthetic oligonucleotide
ccggcaggacgcttacgacggcaa

SEQ ID NO: 10912 - DNA, 24 bp, Artificial Sequence
  Description of Artificial Sequence: Synthetic oligonucleotide
cggcaggacgcttacgacggcaag

SEQ ID NO: 10913 - DNA, 27 bp, Artificial Sequence
  Description of Artificial Sequence: Synthetic oligonucleotide
ggcaggacgcttacgacggcaaggatt

SEQ ID NO: 10914 - DNA, 26 bp, Artificial Sequence
  Description of Artificial Sequence: Synthetic oligonucleotide
cggagcagcagagagcctacctggat

SEQ ID NO: 10915 - DNA, 26 bp, Artificial Sequence
  Description of Artificial Sequence: Synthetic oligonucleotide
ggagcagcagagagcctacctggatg

SEQ ID NO: 10916 - DNA, 26 bp, Artificial Sequence
  Description of Artificial Sequence: Synthetic oligonucleotide
gagcagcagagagcctacctggatgg

SEQ ID NO: 10917 - DNA, 27 bp, Artificial Sequence
  Description of Artificial Sequence: Synthetic oligonucleotide
agcagcagagagcctacctggatggca

SEQ ID NO: 10918 - DNA, 26 bp, Artificial Sequence
  Description of Artificial Sequence: Synthetic oligonucleotide
gcagcagagagcctacctggatggca

SEQ ID NO: 10919 - DNA, 26 bp, Artificial Sequence
  Description of Artificial Sequence: Synthetic oligonucleotide
cagcagagagcctacctggatggcac

SEQ ID NO: 10920 - DNA, 27 bp, Artificial Sequence
  Description of Artificial Sequence: Synthetic oligonucleotide
agcagagagcctacctggatggcacgt

SEQ ID NO: 10921 - DNA, 26 bp, Artificial Sequence
  Description of Artificial Sequence: Synthetic oligonucleotide
gcagagagcctacctggatggcacgt

SEQ ID NO: 10922 - DNA, 26 bp, Artificial Sequence
  Description of Artificial Sequence: Synthetic oligonucleotide
cagagagcctacctggatggcacgtg

SEQ ID NO: 10923 - DNA, 26 bp, Artificial Sequence
  Description of Artificial Sequence: Synthetic oligonucleotide
agagagcctacctggatggcacgtgc

SEQ ID NO: 10924 - DNA, 32 bp, Artificial Sequence
  Description of Artificial Sequence: Synthetic oligonucleotide
cggttctcacaccatccagataatgtatggcg

SEQ ID NO: 10925 - DNA, 33 bp, Artificial Sequence
  Description of Artificial Sequence: Synthetic oligonucleotide
ggttctcacaccatccagataatgtatggcgtg

SEQ ID NO: 10926 - DNA, 33 bp, Artificial Sequence
  Description of Artificial Sequence: Synthetic oligonucleotide
gttctcacaccatccagataatgtatggcgtgg

SEQ ID NO: 10927 - DNA, 33 bp, Artificial Sequence
  Description of Artificial Sequence: Synthetic oligonucleotide
ttctcacaccatccagataatgtatggcgtggg

SEQ ID NO: 10928 - DNA, 32 bp, Artificial Sequence
  Description of Artificial Sequence: Synthetic oligonucleotide
tctcacaccatccagataatgtatggcgtggg

SEQ ID NO: 10929 - DNA, 31 bp, Artificial Sequence
  Description of Artificial Sequence: Synthetic oligonucleotide
ctcacaccatccagataatgtatggcgtggg

SEQ ID NO: 10930 - DNA, 31 bp, Artificial Sequence
  Description of Artificial Sequence: Synthetic oligonucleotide
tcacaccatccagataatgtatggcgtgggg

SEQ ID NO: 10931 - DNA, 30 bp, Artificial Sequence
  Description of Artificial Sequence: Synthetic oligonucleotide
cacaccatccagataatgtatggcgtgggg

SEQ ID NO: 10932 - DNA, 31 bp, Artificial Sequence
  Description of Artificial Sequence: Synthetic oligonucleotide
acaccatccagataatgtatggcgtggggtc

SEQ ID NO: 10933 - DNA, 30 bp, Artificial Sequence
  Description of Artificial Sequence: Synthetic oligonucleotide
caccatccagataatgtatggcgtggggtc

SEQ ID NO: 10934 - DNA, 30 bp, Artificial Sequence
  Description of Artificial Sequence: Synthetic oligonucleotide
accatccagataatgtatggcgtggggtcg

SEQ ID NO: 10935 - DNA, 29 bp, Artificial Sequence
  Description of Artificial Sequence: Synthetic oligonucleotide
ccatccagataatgtatggcgtggggtcg

SEQ ID NO: 10936 - DNA, 29 bp, Artificial Sequence
  Description of Artificial Sequence: Synthetic oligonucleotide
catccagataatgtatggcgtggggtcgg

SEQ ID NO: 10937 - DNA, 30 bp, Artificial Sequence
  Description of Artificial Sequence: Synthetic oligonucleotide
atccagataatgtatggcgtggggtcggac

SEQ ID NO: 10938 - DNA, 29 bp, Artificial Sequence
  Description of Artificial Sequence: Synthetic oligonucleotide
tccagataatgtatggcgtggggtcggac

SEQ ID NO: 10939 - DNA, 28 bp, Artificial Sequence
  Description of Artificial Sequence: Synthetic oligonucleotide
ccagataatgtatggcgtggggtcggac

SEQ ID NO: 10940 - DNA, 28 bp, Artificial Sequence
  Description of Artificial Sequence: Synthetic oligonucleotide
cagataatgtatggcgtggggtcggacg

SEQ ID NO: 10941 - DNA, 28 bp, Artificial Sequence
  Description of Artificial Sequence: Synthetic oligonucleotide
agataatgtatggcgtggggtcggacgg

SEQ ID NO: 10942 - DNA, 27 bp, Artificial Sequence
  Description of Artificial Sequence: Synthetic oligonucleotide
gataatgtatggcgtggggtcggacgg

SEQ ID NO: 10943 - DNA, 27 bp, Artificial Sequence
  Description of Artificial Sequence: Synthetic oligonucleotide
ataatgtatggcgtggggtcggacggg

SEQ ID NO: 10944 - DNA, 26 bp, Artificial Sequence
  Description of Artificial Sequence: Synthetic oligonucleotide
taatgtatggcgtggggtcggacggg

SEQ ID NO: 10945 - DNA, 25 bp, Artificial Sequence
  Description of Artificial Sequence: Synthetic oligonucleotide
aatgtatggcgtggggtcggacggg

SEQ ID NO: 10946 - DNA, 24 bp, Artificial Sequence
  Description of Artificial Sequence: Synthetic oligonucleotide
atgtatggcgtggggtcggacggg

SEQ ID NO: 10947 - DNA, 23 bp, Artificial Sequence
  Description of Artificial Sequence: Synthetic oligonucleotide
tgtatggcgtggggtcggacggg

SEQ ID NO: 10948 - DNA, 22 bp, Artificial Sequence
  Description of Artificial Sequence: Synthetic oligonucleotide
gtatggcgtggggtcggacggg

SEQ ID NO: 10949 - DNA, 22 bp, Artificial Sequence
  Description of Artificial Sequence: Synthetic oligonucleotide
tatggcgtggggtcggacgggc

SEQ ID NO: 10950 - DNA, 21 bp, Artificial Sequence
  Description of Artificial Sequence: Synthetic oligonucleotide
atggcgtggggtcggacgggc

SEQ ID NO: 10951 - DNA, 20 bp, Artificial Sequence
  Description of Artificial Sequence: Synthetic oligonucleotide
tggcgtggggtcggacgggc

SEQ ID NO: 10952 - DNA, 20 bp, Artificial Sequence
  Description of Artificial Sequence: Synthetic oligonucleotide
ggcgtggggtcggacgggct

SEQ ID NO: 10953 - DNA, 20 bp, Artificial Sequence
  Description of Artificial Sequence: Synthetic oligonucleotide
gcgtggggtcggacgggcgt

SEQ ID NO: 10954 - DNA, 28 bp, Artificial Sequence
  Description of Artificial Sequence: Synthetic oligonucleotide
gcatcattgctggcctggttctccttgc

SEQ ID NO: 10955 - DNA, 29 bp, Artificial Sequence
  Description of Artificial Sequence: Synthetic oligonucleotide
catcattgctggcctggttctccttgcag

SEQ ID NO: 10956 - DNA, 29 bp, Artificial Sequence
  Description of Artificial Sequence: Synthetic oligonucleotide
atcattgctggcctggttctccttgcagc

SEQ ID NO: 10957 - DNA, 28 bp, Artificial Sequence
  Description of Artificial Sequence: Synthetic oligonucleotide
tcattgctggcctggttctccttgcagc

SEQ ID NO: 10958 - DNA, 27 bp, Artificial Sequence
  Description of Artificial Sequence: Synthetic oligonucleotide
cattgctggcctggttctccttgcagc

SEQ ID NO: 10959 - DNA, 28 bp, Artificial Sequence
  Description of Artificial Sequence: Synthetic oligonucleotide
attgctggcctggttctccttgcagctg

SEQ ID NO: 10960 - DNA, 27 bp, Artificial Sequence
  Description of Artificial Sequence: Synthetic oligonucleotide
ttgctggcctggttctccttgcagctg

SEQ ID NO: 10961 - DNA, 27 bp, Artificial Sequence
  Description of Artificial Sequence: Synthetic oligonucleotide
tgctggcctggttctccttgcagctgt

SEQ ID NO: 10962 - DNA, 26 bp, Artificial Sequence
  Description of Artificial Sequence: Synthetic oligonucleotide
gctggcctggttctccttgcagctgt

SEQ ID NO: 10963 - DNA, 27 bp, Artificial Sequence
  Description of Artificial Sequence: Synthetic oligonucleotide
ctggcctggttctccttgcagctgtga

SEQ ID NO: 10964 - DNA, 28 bp, Artificial Sequence
  Description of Artificial Sequence: Synthetic oligonucleotide
tggcctggttctccttgcagctgtgatc

SEQ ID NO: 10965 - DNA, 27 bp, Artificial Sequence
  Description of Artificial Sequence: Synthetic oligonucleotide
ggcctggttctccttgcagctgtgatc

SEQ ID NO: 10966 - DNA, 28 bp, Artificial Sequence
  Description of Artificial Sequence: Synthetic oligonucleotide
gcctggttctccttgcagctgtgatcac

SEQ ID NO: 10967 - DNA, 29 bp, Artificial Sequence
  Description of Artificial Sequence: Synthetic oligonucleotide
cctggttctccttgcagctgtgatcactg

SEQ ID NO: 10968 - DNA, 29 bp, Artificial Sequence
  Description of Artificial Sequence: Synthetic oligonucleotide
ctggttctccttgcagctgtgatcactgg

SEQ ID NO: 10969 - DNA, 30 bp, Artificial Sequence
  Description of Artificial Sequence: Synthetic oligonucleotide
tggttctccttgcagctgtgatcactggag

SEQ ID NO: 10970 - DNA, 29 bp, Artificial Sequence
  Description of Artificial Sequence: Synthetic oligonucleotide
ggttctccttgcagctgtgatcactggag

SEQ ID NO: 10971 - DNA, 29 bp, Artificial Sequence
  Description of Artificial Sequence: Synthetic oligonucleotide
gttctccttgcagctgtgatcactggagc

SEQ ID NO: 10972 - DNA, 30 bp, Artificial Sequence
  Description of Artificial Sequence: Synthetic oligonucleotide
ttctccttgcagctgtgatcactggagctg

SEQ ID NO: 10973 - DNA, 29 bp, Artificial Sequence
  Description of Artificial Sequence: Synthetic oligonucleotide
tctccttgcagctgtgatcactggagctg

SEQ ID NO: 10974 - DNA, 28 bp, Artificial Sequence
  Description of Artificial Sequence: Synthetic oligonucleotide
ctccttgcagctgtgatcactggagctg

SEQ ID NO: 10975 - DNA, 29 bp, Artificial Sequence
  Description of Artificial Sequence: Synthetic oligonucleotide
tccttgcagctgtgatcactggagctgtg

SEQ ID NO: 10976 - DNA, 28 bp, Artificial Sequence
  Description of Artificial Sequence: Synthetic oligonucleotide
ccttgcagctgtgatcactggagctgtg

SEQ ID NO: 10977 - DNA, 28 bp, Artificial Sequence
  Description of Artificial Sequence: Synthetic oligonucleotide
cttgcagctgtgatcactggagctgtgg

SEQ ID NO: 10978 - DNA, 29 bp, Artificial Sequence
  Description of Artificial Sequence: Synthetic oligonucleotide
ttgcagctgtgatcactggagctgtggtc

SEQ ID NO: 10979 - DNA, 28 bp, Artificial Sequence
  Description of Artificial Sequence: Synthetic oligonucleotide
tgcagctgtgatcactggagctgtggtc

SEQ ID NO: 10980 - DNA, 27 bp, Artificial Sequence
  Description of Artificial Sequence: Synthetic oligonucleotide
gcagctgtgatcactggagctgtggtc

SEQ ID NO: 10981 - DNA, 27 bp, Artificial Sequence
  Description of Artificial Sequence: Synthetic oligonucleotide
cagctgtgatcactggagctgtggtcg

SEQ ID NO: 10982 - DNA, 27 bp, Artificial Sequence
  Description of Artificial Sequence: Synthetic oligonucleotide
ggagcagttgagagcctacctggatgc

SEQ ID NO: 10983 - DNA, 27 bp, Artificial Sequence
  Description of Artificial Sequence: Synthetic oligonucleotide
gagcagttgagagcctacctggatgcc

SEQ ID NO: 10984 - DNA, 28 bp, Artificial Sequence
  Description of Artificial Sequence: Synthetic oligonucleotide
agcagttgagagcctacctggatgccac

SEQ ID NO: 10985 - DNA, 27 bp, Artificial Sequence
  Description of Artificial Sequence: Synthetic oligonucleotide
gcagttgagagcctacctggatgccac

SEQ ID NO: 10986 - DNA, 27 bp, Artificial Sequence
  Description of Artificial Sequence: Synthetic oligonucleotide
cagttgagagcctacctggatgccacg

SEQ ID NO: 10987 - DNA, 28 bp, Artificial Sequence
  Description of Artificial Sequence: Synthetic oligonucleotide
agttgagagcctacctggatgccacgtg

SEQ ID NO: 10988 - DNA, 27 bp, Artificial Sequence
  Description of Artificial Sequence: Synthetic oligonucleotide
gttgagagcctacctggatgccacgtg

SEQ ID NO: 10989 - DNA, 27 bp, Artificial Sequence
  Description of Artificial Sequence: Synthetic oligonucleotide
ttgagagcctacctggatgccacgtgc

SEQ ID NO: 10990 - DNA, 26 bp, Artificial Sequence
  Description of Artificial Sequence: Synthetic oligonucleotide
tgagagcctacctggatgccacgtgc

SEQ ID NO: 10991 - DNA, 25 bp, Artificial Sequence
  Description of Artificial Sequence: Synthetic oligonucleotide
gagagcctacctggatgccacgtgc

SEQ ID NO: 10992 - DNA, 26 bp, Artificial Sequence
  Description of Artificial Sequence: Synthetic oligonucleotide
agagcctacctggatgccacgtgcgt

SEQ ID NO: 10993 - DNA, 25 bp, Artificial Sequence
  Description of Artificial Sequence: Synthetic oligonucleotide
gagcctacctggatgccacgtgcgt

SEQ ID NO: 10994 - DNA, 25 bp, Artificial Sequence
  Description of Artificial Sequence: Synthetic oligonucleotide
agcctacctggatgccacgtgcgtg

SEQ ID NO: 10995 - DNA, 24 bp, Artificial Sequence
  Description of Artificial Sequence: Synthetic oligonucleotide
gcctacctggatgccacgtgcgtg

SEQ ID NO: 10996 - DNA, 25 bp, Artificial Sequence
  Description of Artificial Sequence: Synthetic oligonucleotide
cctacctggatgccacgtgcgtgga

SEQ ID NO: 10997 - DNA, 26 bp, Artificial Sequence
  Description of Artificial Sequence: Synthetic oligonucleotide
ctacctggatgccacgtgcgtggagt

SEQ ID NO: 10998 - DNA, 26 bp, Artificial Sequence
  Description of Artificial Sequence: Synthetic oligonucleotide
tacctggatgccacgtgcgtggagtg

SEQ ID NO: 10999 - DNA, 25 bp, Artificial Sequence
  Description of Artificial Sequence: Synthetic oligonucleotide
acctggatgccacgtgcgtggagtg

SEQ ID NO: 11000 - DNA, 24 bp, Artificial Sequence
  Description of Artificial Sequence: Synthetic oligonucleotide
cctggatgccacgtgcgtggagtg

SEQ ID NO: 11001 - DNA, 24 bp, Artificial Sequence
  Description of Artificial Sequence: Synthetic oligonucleotide
ctggatgccacgtgcgtggagtgg

SEQ ID NO: 11002 - DNA, 25 bp, Artificial Sequence
  Description of Artificial Sequence: Synthetic oligonucleotide
tggatgccacgtgcgtggagtggct

SEQ ID NO: 11003 - DNA, 24 bp, Artificial Sequence
  Description of Artificial Sequence: Synthetic oligonucleotide
ggatgccacgtgcgtggagtggct

SEQ ID NO: 11004 - DNA, 24 bp, Artificial Sequence
  Description of Artificial Sequence: Synthetic oligonucleotide
gatgccacgtgcgtggagtggctc

SEQ ID NO: 11005 - DNA, 24 bp, Artificial Sequence
  Description of Artificial Sequence: Synthetic oligonucleotide
atgccacgtgcgtggagtggctcc

SEQ ID NO: 11006 - DNA, 23 bp, Artificial Sequence
  Description of Artificial Sequence: Synthetic oligonucleotide
tgccacgtgcgtggagtggctcc

SEQ ID NO: 11007 - DNA, 22 bp, Artificial Sequence
  Description of Artificial Sequence: Synthetic oligonucleotide
gccacgtgcgtggagtggctcc

SEQ ID NO: 11008 - DNA, 22 bp, Artificial Sequence
  Description of Artificial Sequence: Synthetic oligonucleotide
ccacgtgcgtggagtggctccg

SEQ ID NO: 11009 - DNA, 23 bp, Artificial Sequence
  Description of Artificial Sequence: Synthetic oligonucleotide
gcgggtaccggcaggacgcctaa

SEQ ID NO: 11010 - DNA, 24 bp, Artificial Sequence
  Description of Artificial Sequence: Synthetic oligonucleotide
cgggtaccggcaggacgcctaaga

SEQ ID NO: 11011 - DNA, 24 bp, Artificial Sequence
  Description of Artificial Sequence: Synthetic oligonucleotide
gggtaccggcaggacgcctaagac

SEQ ID NO: 11012 - DNA, 24 bp, Artificial Sequence
  Description of Artificial Sequence: Synthetic oligonucleotide
ggtaccggcaggacgcctaagacg

SEQ ID NO: 11013 - DNA, 24 bp, Artificial Sequence
  Description of Artificial Sequence: Synthetic oligonucleotide
gtaccggcaggacgcctaagacgg

SEQ ID NO: 11014 - DNA, 26 bp, Artificial Sequence
  Description of Artificial Sequence: Synthetic oligonucleotide
taccggcaggacgcctaagacggcaa

SEQ ID NO: 11015 - DNA, 25 bp, Artificial Sequence
  Description of Artificial Sequence: Synthetic oligonucleotide
accggcaggacgcctaagacggcaa

SEQ ID NO: 11016 - DNA, 24 bp, Artificial Sequence
  Description of Artificial Sequence: Synthetic oligonucleotide
ccggcaggacgcctaagacggcaa

SEQ ID NO: 11017 - DNA, 24 bp, Artificial Sequence
  Description of Artificial Sequence: Synthetic oligonucleotide
cggcaggacgcctaagacggcaag

SEQ ID NO: 11018 - DNA, 27 bp, Artificial Sequence
  Description of Artificial Sequence: Synthetic oligonucleotide
ggcaggacgcctaagacggcaaggatt

SEQ ID NO: 11019 - DNA, 28 bp, Artificial Sequence
  Description of Artificial Sequence: Synthetic oligonucleotide
gcaggacgcctaagacggcaaggattac

SEQ ID NO: 11020 - DNA, 30 bp, Artificial Sequence
  Description of Artificial Sequence: Synthetic oligonucleotide
caggacgcctaagacggcaaggattacatc

SEQ ID NO: 11021 - DNA, 30 bp, Artificial Sequence
  Description of Artificial Sequence: Synthetic oligonucleotide
aggacgcctaagacggcaaggattacatcg

SEQ ID NO: 11022 - DNA, 29 bp, Artificial Sequence
  Description of Artificial Sequence: Synthetic oligonucleotide
ggacgcctaagacggcaaggattacatcg

SEQ ID NO: 11023 - DNA, 29 bp, Artificial Sequence
  Description of Artificial Sequence: Synthetic oligonucleotide
gacgcctaagacggcaaggattacatcgc

SEQ ID NO: 11024 - DNA, 29 bp, Artificial Sequence
  Description of Artificial Sequence: Synthetic oligonucleotide
acgcctaagacggcaaggattacatcgcc

SEQ ID NO: 11025 - DNA, 28 bp, Artificial Sequence
  Description of Artificial Sequence: Synthetic oligonucleotide
cgcctaagacggcaaggattacatcgcc

SEQ ID NO: 11026 - DNA, 28 bp, Artificial Sequence
  Description of Artificial Sequence: Synthetic oligonucleotide
gcctaagacggcaaggattacatcgccc

SEQ ID NO: 11027 - DNA, 29 bp, Artificial Sequence
  Description of Artificial Sequence: Synthetic oligonucleotide
cctaagacggcaaggattacatcgccctg

SEQ ID NO: 11028 - DNA, 31 bp, Artificial Sequence
  Description of Artificial Sequence: Synthetic oligonucleotide
ctaagacggcaaggattacatcgccctgaac

SEQ ID NO: 11029 - DNA, 31 bp, Artificial Sequence
  Description of Artificial Sequence: Synthetic oligonucleotide
taagacggcaaggattacatcgccctgaacg

SEQ ID NO: 11030 - DNA, 30 bp, Artificial Sequence
  Description of Artificial Sequence: Synthetic oligonucleotide
aagacggcaaggattacatcgccctgaacg

SEQ ID NO: 11031 - DNA, 29 bp, Artificial Sequence
  Description of Artificial Sequence: Synthetic oligonucleotide
agacggcaaggattacatcgccctgaacg

SEQ ID NO: 11032 - DNA, 29 bp, Artificial Sequence
  Description of Artificial Sequence: Synthetic oligonucleotide
cgggctcccactccatgaggtatttctac

SEQ ID NO: 11033 - DNA, 30 bp, Artificial Sequence
  Description of Artificial Sequence: Synthetic oligonucleotide
gggctcccactccatgaggtatttctacac

SEQ ID NO: 11034 - DNA, 30 bp, Artificial Sequence
  Description of Artificial Sequence: Synthetic oligonucleotide
ggctcccactccatgaggtatttctacacc

SEQ ID NO: 11035 - DNA, 29 bp, Artificial Sequence
  Description of Artificial Sequence: Synthetic oligonucleotide
acggcaaggattacatcgccctgaacgtg

SEQ ID NO: 11036 - DNA, 28 bp, Artificial Sequence
  Description of Artificial Sequence: Synthetic oligonucleotide
cggcaaggattacatcgccctgaacgtg

SEQ ID NO: 11037 - DNA, 28 bp, Artificial Sequence
  Description of Artificial Sequence: Synthetic oligonucleotide
ggcaaggattacatcgccctgaacgtgg

SEQ ID NO: 11038 - DNA, 29 bp, Artificial Sequence
  Description of Artificial Sequence: Synthetic oligonucleotide
gcaaggattacatcgccctgaacgtggac

SEQ ID NO: 11039 - DNA, 29 bp, Artificial Sequence
  Description of Artificial Sequence: Synthetic oligonucleotide
caaggattacatcgccctgaacgtggacc

SEQ ID NO: 11040 - DNA, 30 bp, Artificial Sequence
  Description of Artificial Sequence: Synthetic oligonucleotide
aaggattacatcgccctgaacgtggacctg

SEQ ID NO: 11041 - DNA, 29 bp, Artificial Sequence
  Description of Artificial Sequence: Synthetic oligonucleotide
aggattacatcgccctgaacgtggacctg

SEQ ID NO: 11042 - DNA, 28 bp, Artificial Sequence
  Description of Artificial Sequence: Synthetic oligonucleotide
ggattacatcgccctgaacgtggacctg

SEQ ID NO: 11043 - DNA, 28 bp, Artificial Sequence
  Description of Artificial Sequence: Synthetic oligonucleotide
gattacatcgccctgaacgtggacctgc

SEQ ID NO: 11044 - DNA, 28 bp, Artificial Sequence
  Description of Artificial Sequence: Synthetic oligonucleotide
attacatcgccctgaacgtggacctgcg

SEQ ID NO: 11045 - DNA, 27 bp, Artificial Sequence
  Description of Artificial Sequence: Synthetic oligonucleotide
ttacatcgccctgaacgtggacctgcg

SEQ ID NO: 11046 - DNA, 26 bp, Artificial Sequence
  Description of Artificial Sequence: Synthetic oligonucleotide
tacatcgccctgaacgtggacctgcg

SEQ ID NO: 11047 - DNA, 25 bp, Artificial Sequence
  Description of Artificial Sequence: Synthetic oligonucleotide
acatcgccctgaacgtggacctgcg

SEQ ID NO: 11048 - DNA, 24 bp, Artificial Sequence
  Description of Artificial Sequence: Synthetic oligonucleotide
catcgccctgaacgtggacctgcg

SEQ ID NO: 11049 - DNA, 25 bp, Artificial Sequence
  Description of Artificial Sequence: Synthetic oligonucleotide
atcgccctgaacgtggacctgcgct

SEQ ID NO: 11050 - DNA, 24 bp, Artificial Sequence
  Description of Artificial Sequence: Synthetic oligonucleotide
tcgccctgaacgtggacctgcgct

SEQ ID NO: 11051 - DNA, 23 bp, Artificial Sequence
  Description of Artificial Sequence: Synthetic oligonucleotide
cgccctgaacgtggacctgcgct

SEQ ID NO: 11052 - DNA, 25 bp, Artificial Sequence
  Description of Artificial Sequence: Synthetic oligonucleotide
gccctgaacgtggacctgcgctctt

SEQ ID NO: 11053 - DNA, 25 bp, Artificial Sequence
  Description of Artificial Sequence: Synthetic oligonucleotide
ccctgaacgtggacctgcgctcttg

SEQ ID NO: 11054 - DNA, 26 bp, Artificial Sequence
  Description of Artificial Sequence: Synthetic oligonucleotide
cctgaacgtggacctgcgctcttgga

SEQ ID NO: 11055 - DNA, 26 bp, Artificial Sequence
  Description of Artificial Sequence: Synthetic oligonucleotide
ctgaacgtggacctgcgctcttggac

SEQ ID NO: 11056 - DNA, 26 bp, Artificial Sequence
  Description of Artificial Sequence: Synthetic oligonucleotide
tgaacgtggacctgcgctcttggacc

SEQ ID NO: 11057 - DNA, 25 bp, Artificial Sequence
  Description of Artificial Sequence: Synthetic oligonucleotide
gaacgtggacctgcgctcttggacc

SEQ ID NO: 11058 - DNA, 25 bp, Artificial Sequence
  Description of Artificial Sequence: Synthetic oligonucleotide
aacgtggacctgcgctcttggaccg

SEQ ID NO: 11059 - DNA, 24 bp, Artificial Sequence
  Description of Artificial Sequence: Synthetic oligonucleotide
acgtggacctgcgctcttggaccg

SEQ ID NO: 11060 - DNA, 23 bp, Artificial Sequence
  Description of Artificial Sequence: Synthetic oligonucleotide
cgtggacctgcgctcttggaccg

SEQ ID NO: 11061 - DNA, 23 bp, Artificial Sequence
  Description of Artificial Sequence: Synthetic oligonucleotide
gtggacctgcgctcttggaccgc

SEQ ID NO: 11062 - DNA, 23 bp, Artificial Sequence
  Description of Artificial Sequence: Synthetic oligonucleotide
tggacctgcgctcttggaccgcg

SEQ ID NO: 11063 - DNA, 26 bp, Artificial Sequence
  Description of Artificial Sequence: Synthetic oligonucleotide
gaccctgcgcggctactacaaccaca

SEQ ID NO: 11064 - DNA, 26 bp, Artificial Sequence
  Description of Artificial Sequence: Synthetic oligonucleotide
accctgcgcggctactacaaccacag

SEQ ID NO: 11065 - DNA, 25 bp, Artificial Sequence
  Description of Artificial Sequence: Synthetic oligonucleotide
ccctgcgcggctactacaaccacag

SEQ ID NO: 11066 - DNA, 25 bp, Artificial Sequence
  Description of Artificial Sequence: Synthetic oligonucleotide
cctgcgcggctactacaaccacagc

SEQ ID NO: 11067 - DNA, 26 bp, Artificial Sequence
  Description of Artificial Sequence: Synthetic oligonucleotide
ctgcgcggctactacaaccacagcga

SEQ ID NO: 11068 - DNA, 26 bp, Artificial Sequence
  Description of Artificial Sequence: Synthetic oligonucleotide
tgcgcggctactacaaccacagcgag

SEQ ID NO: 11069 - DNA, 25 bp, Artificial Sequence
  Description of Artificial Sequence: Synthetic oligonucleotide
gcgcggctactacaaccacagcgag

SEQ ID NO: 11070 - DNA, 25 bp, Artificial Sequence
  Description of Artificial Sequence: Synthetic oligonucleotide
cgcggctactacaaccacagcgagg

SEQ ID NO: 11071 - DNA, 25 bp, Artificial Sequence
  Description of Artificial Sequence: Synthetic oligonucleotide
gcggctactacaaccacagcgaggc

SEQ ID NO: 11072 - DNA, 25 bp, Artificial Sequence
  Description of Artificial Sequence: Synthetic oligonucleotide
cggctactacaaccacagcgaggcc

SEQ ID NO: 11073 - DNA, 25 bp, Artificial Sequence
  Description of Artificial Sequence: Synthetic oligonucleotide
ggctactacaaccacagcgaggccg

SEQ ID NO: 11074 - DNA, 27 bp, Artificial Sequence
  Description of Artificial Sequence: Synthetic oligonucleotide
gctactacaaccacagcgaggccggtt

SEQ ID NO: 11075 - DNA, 27 bp, Artificial Sequence
  Description of Artificial Sequence: Synthetic oligonucleotide
ctactacaaccacagcgaggccggttc

SEQ ID NO: 11076 - DNA, 28 bp, Artificial Sequence
  Description of Artificial Sequence: Synthetic oligonucleotide
tactacaaccacagcgaggccggttctc

SEQ ID NO: 11077 - DNA, 27 bp, Artificial Sequence
  Description of Artificial Sequence: Synthetic oligonucleotide
actacaaccacagcgaggccggttctc

SEQ ID NO: 11078 - DNA, 27 bp, Artificial Sequence
  Description of Artificial Sequence: Synthetic oligonucleotide
ctacaaccacagcgaggccggttctca

SEQ ID NO: 11079 - DNA, 27 bp, Artificial Sequence
  Description of Artificial Sequence: Synthetic oligonucleotide
tacaaccacagcgaggccggttctcac

SEQ ID NO: 11080 - DNA, 27 bp, Artificial Sequence
  Description of Artificial Sequence: Synthetic oligonucleotide
acaaccacagcgaggccggttctcaca

SEQ ID NO: 11081 - DNA, 26 bp, Artificial Sequence
  Description of Artificial Sequence: Synthetic oligonucleotide
caaccacagcgaggccggttctcaca

SEQ ID NO: 11082 - DNA, 26 bp, Artificial Sequence
  Description of Artificial Sequence: Synthetic oligonucleotide
aaccacagcgaggccggttctcacac

SEQ ID NO: 11083 - DNA, 25 bp, Artificial Sequence
  Description of Artificial Sequence: Synthetic oligonucleotide
accacagcgaggccggttctcacac

SEQ ID NO: 11084 - DNA, 24 bp, Artificial Sequence
  Description of Artificial Sequence: Synthetic oligonucleotide
ccacagcgaggccggttctcacac

SEQ ID NO: 11085 - DNA, 26 bp, Artificial Sequence
  Description of Artificial Sequence: Synthetic oligonucleotide
cacagcgaggccggttctcacaccat

SEQ ID NO: 11086 - DNA, 26 bp, Artificial Sequence
  Description of Artificial Sequence: Synthetic oligonucleotide
acagcgaggccggttctcacaccatc

SEQ ID NO: 11087 - DNA, 25 bp, Artificial Sequence
  Description of Artificial Sequence: Synthetic oligonucleotide
cagcgaggccggttctcacaccatc

SEQ ID NO: 11088 - DNA, 33 bp, Artificial Sequence
  Description of Artificial Sequence: Synthetic oligonucleotide
aggccggttctcacaccatccagataatgtttg

SEQ ID NO: 11089 - DNA, 32 bp, Artificial Sequence
  Description of Artificial Sequence: Synthetic oligonucleotide
ggccggttctcacaccatccagataatgtttg

SEQ ID NO: 11090 - DNA, 32 bp, Artificial Sequence
  Description of Artificial Sequence: Synthetic oligonucleotide
gccggttctcacaccatccagataatgtttgg

SEQ ID NO: 11091 - DNA, 32 bp, Artificial Sequence
  Description of Artificial Sequence: Synthetic oligonucleotide
ccggttctcacaccatccagataatgtttggc

SEQ ID NO: 11092 - DNA, 33 bp, Artificial Sequence
  Description of Artificial Sequence: Synthetic oligonucleotide
cggttctcacaccatccagataatgtttggctg

SEQ ID NO: 11093 - DNA, 33 bp, Artificial Sequence
  Description of Artificial Sequence: Synthetic oligonucleotide
ggttctcacaccatccagataatgtttggctgc

SEQ ID NO: 11094 - DNA, 33 bp, Artificial Sequence
  Description of Artificial Sequence: Synthetic oligonucleotide
gttctcacaccatccagataatgtttggctgcg

SEQ ID NO: 11095 - DNA, 34 bp, Artificial Sequence
  Description of Artificial Sequence: Synthetic oligonucleotide
ttctcacaccatccagataatgtttggctgcgac

SEQ ID NO: 11096 - DNA, 33 bp, Artificial Sequence
  Description of Artificial Sequence: Synthetic oligonucleotide
tctcacaccatccagataatgtttggctgcgac

SEQ ID NO: 11097 - DNA, 32 bp, Artificial Sequence
  Description of Artificial Sequence: Synthetic oligonucleotide
ctcacaccatccagataatgtttggctgcgac

SEQ ID NO: 11098 - DNA, 32 bp, Artificial Sequence
  Description of Artificial Sequence: Synthetic oligonucleotide
tcacaccatccagataatgtttggctgcgacg

SEQ ID NO: 11099 - DNA, 31 bp, Artificial Sequence
  Description of Artificial Sequence: Synthetic oligonucleotide
cacaccatccagataatgtttggctgcgacg

SEQ ID NO: 11100 - DNA, 32 bp, Artificial Sequence
  Description of Artificial Sequence: Synthetic oligonucleotide
acaccatccagataatgtttggctgcgacgtg

SEQ ID NO: 11101 - DNA, 31 bp, Artificial Sequence
  Description of Artificial Sequence: Synthetic oligonucleotide
caccatccagataatgtttggctgcgacgtg

SEQ ID NO: 11102 - DNA, 31 bp, Artificial Sequence
  Description of Artificial Sequence: Synthetic oligonucleotide
accatccagataatgtttggctgcgacgtgg

SEQ ID NO: 11103 - DNA, 30 bp, Artificial Sequence
  Description of Artificial Sequence: Synthetic oligonucleotide
ccatccagataatgtttggctgcgacgtgg

SEQ ID NO: 11104 - DNA, 30 bp, Artificial Sequence
  Description of Artificial Sequence: Synthetic oligonucleotide
catccagataatgtttggctgcgacgtggg

SEQ ID NO: 11105 - DNA, 30 bp, Artificial Sequence
  Description of Artificial Sequence: Synthetic oligonucleotide
atccagataatgtttggctgcgacgtgggg

SEQ ID NO: 11106 - DNA, 29 bp, Artificial Sequence
  Description of Artificial Sequence: Synthetic oligonucleotide
tccagataatgtttggctgcgacgtgggg

SEQ ID NO: 11107 - DNA, 28 bp, Artificial Sequence
  Description of Artificial Sequence: Synthetic oligonucleotide
ccagataatgtttggctgcgacgtgggg

SEQ ID NO: 11108 - DNA, 29 bp, Artificial Sequence
  Description of Artificial Sequence: Synthetic oligonucleotide
cagataatgtttggctgcgacgtggggtc

SEQ ID NO: 11109 - DNA, 29 bp, Artificial Sequence
  Description of Artificial Sequence: Synthetic oligonucleotide
agataatgtttggctgcgacgtggggtcg

SEQ ID NO: 11110 - DNA, 28 bp, Artificial Sequence
  Description of Artificial Sequence: Synthetic oligonucleotide
gataatgtttggctgcgacgtggggtcg

SEQ ID NO: 11111 - DNA, 28 bp, Artificial Sequence
  Description of Artificial Sequence: Synthetic oligonucleotide
ataatgtttggctgcgacgtggggtcgg

SEQ ID NO: 11112 - DNA, 27 bp, Artificial Sequence
  Description of Artificial Sequence: Synthetic oligonucleotide
taatgtttggctgcgacgtggggtcgg

SEQ ID NO: 11113 - DNA, 27 bp, Artificial Sequence
  Description of Artificial Sequence: Synthetic oligonucleotide
aatgtttggctgcgacgtggggtcgga

SEQ ID NO: 11114 - DNA, 23 bp, Artificial Sequence
  Description of Artificial Sequence: Synthetic oligonucleotide
gcggcggacatggcggctcagtt

SEQ ID NO: 11115 - DNA, 24 bp, Artificial Sequence
  Description of Artificial Sequence: Synthetic oligonucleotide
cggcggacatggcggctcagttca

SEQ ID NO: 11116 - DNA, 24 bp, Artificial Sequence
  Description of Artificial Sequence: Synthetic oligonucleotide
ggcggacatggcggctcagttcac

SEQ ID NO: 11117 - DNA, 26 bp, Artificial Sequence
  Description of Artificial Sequence: Synthetic oligonucleotide
gcggacatggcggctcagttcaccaa

SEQ ID NO: 11118 - DNA, 26 bp, Artificial Sequence
  Description of Artificial Sequence: Synthetic oligonucleotide
cggacatggcggctcagttcaccaag

SEQ ID NO: 11119 - DNA, 26 bp, Artificial Sequence
  Description of Artificial Sequence: Synthetic oligonucleotide
ggacatggcggctcagttcaccaagc

SEQ ID NO: 11120 - DNA, 26 bp, Artificial Sequence
  Description of Artificial Sequence: Synthetic oligonucleotide
gacatggcggctcagttcaccaagcg

SEQ ID NO: 11121 - DNA, 27 bp, Artificial Sequence
  Description of Artificial Sequence: Synthetic oligonucleotide
acatggcggctcagttcaccaagcgca

SEQ ID NO: 11122 - DNA, 27 bp, Artificial Sequence
  Description of Artificial Sequence: Synthetic oligonucleotide
catggcggctcagttcaccaagcgcaa

SEQ ID NO: 11123 - DNA, 27 bp, Artificial Sequence
  Description of Artificial Sequence: Synthetic oligonucleotide
atggcggctcagttcaccaagcgcaag

SEQ ID NO: 11124 - DNA, 27 bp, Artificial Sequence
  Description of Artificial Sequence: Synthetic oligonucleotide
tggcggctcagttcaccaagcgcaagt

SEQ ID NO: 11125 - DNA, 26 bp, Artificial Sequence
  Description of Artificial Sequence: Synthetic oligonucleotide
ggcggctcagttcaccaagcgcaagt

SEQ ID NO: 11126 - DNA, 26 bp, Artificial Sequence
  Description of Artificial Sequence: Synthetic oligonucleotide
gcggctcagttcaccaagcgcaagtg

SEQ ID NO: 11127 - DNA, 26 bp, Artificial Sequence
  Description of Artificial Sequence: Synthetic oligonucleotide
cggctcagttcaccaagcgcaagtgg

SEQ ID NO: 11128 - DNA, 27 bp, Artificial Sequence
  Description of Artificial Sequence: Synthetic oligonucleotide
ggctcagttcaccaagcgcaagtggga

SEQ ID NO: 11129 - DNA, 27 bp, Artificial Sequence
  Description of Artificial Sequence: Synthetic oligonucleotide
gctcagttcaccaagcgcaagtgggag

SEQ ID NO: 11130 - DNA, 27 bp, Artificial Sequence
  Description of Artificial Sequence: Synthetic oligonucleotide
ctcagttcaccaagcgcaagtgggagg

SEQ ID NO: 11131 - DNA, 27 bp, Artificial Sequence
  Description of Artificial Sequence: Synthetic oligonucleotide
tcagttcaccaagcgcaagtgggaggc

SEQ ID NO: 11132 - DNA, 26 bp, Artificial Sequence
  Description of Artificial Sequence: Synthetic oligonucleotide
cagttcaccaagcgcaagtgggaggc

SEQ ID NO: 11133 - DNA, 26 bp, Artificial Sequence
  Description of Artificial Sequence: Synthetic oligonucleotide
agttcaccaagcgcaagtgggaggcg

SEQ ID NO: 11134 - DNA, 25 bp, Artificial Sequence
  Description of Artificial Sequence: Synthetic oligonucleotide
gttcaccaagcgcaagtgggaggcg

SEQ ID NO: 11135 - DNA, 25 bp, Artificial Sequence
  Description of Artificial Sequence: Synthetic oligonucleotide
ttcaccaagcgcaagtgggaggcgg

SEQ ID NO: 11136 - DNA, 27 bp, Artificial Sequence
  Description of Artificial Sequence: Synthetic oligonucleotide
gtctgcccaagcccctcaccctgaaat

SEQ ID NO: 11137 - DNA, 27 bp, Artificial Sequence
  Description of Artificial Sequence: Synthetic oligonucleotide
tctgcccaagcccctcaccctgaaatg

SEQ ID NO: 11138 - DNA, 26 bp, Artificial Sequence
  Description of Artificial Sequence: Synthetic oligonucleotide
ctgcccaagcccctcaccctgaaatg

SEQ ID NO: 11139 - DNA, 26 bp, Artificial Sequence
  Description of Artificial Sequence: Synthetic oligonucleotide
tgcccaagcccctcaccctgaaatgg

SEQ ID NO: 11140 - DNA, 25 bp, Artificial Sequence
  Description of Artificial Sequence: Synthetic oligonucleotide
gcccaagcccctcaccctgaaatgg

SEQ ID NO: 11141 - DNA, 25 bp, Artificial Sequence
  Description of Artificial Sequence: Synthetic oligonucleotide
cccaagcccctcaccctgaaatggg

SEQ ID NO: 11142 - DNA, 27 bp, Artificial Sequence
  Description of Artificial Sequence: Synthetic oligonucleotide
cggaacacacggaatgtgaaggcccag

SEQ ID NO: 11143 - DNA, 28 bp, Artificial Sequence
  Description of Artificial Sequence: Synthetic oligonucleotide
ggaacacacggaatgtgaaggcccagtc

SEQ ID NO: 11144 - DNA, 29 bp, Artificial Sequence
  Description of Artificial Sequence: Synthetic oligonucleotide
gaacacacggaatgtgaaggcccagtcac

SEQ ID NO: 11145 - DNA, 30 bp, Artificial Sequence
  Description of Artificial Sequence: Synthetic oligonucleotide
aacacacggaatgtgaaggcccagtcacag

SEQ ID NO: 11146 - DNA, 29 bp, Artificial Sequence
  Description of Artificial Sequence: Synthetic oligonucleotide
acacacggaatgtgaaggcccagtcacag

SEQ ID NO: 11147 - DNA, 28 bp, Artificial Sequence
  Description of Artificial Sequence: Synthetic oligonucleotide
cacacggaatgtgaaggcccagtcacag

SEQ ID NO: 11148 - DNA, 25 bp, Artificial Sequence
  Description of Artificial Sequence: Synthetic oligonucleotide
gtggacgacacgcagttcgtgcggt

SEQ ID NO: 11149 - DNA, 25 bp, Artificial Sequence
  Description of Artificial Sequence: Synthetic oligonucleotide
tggacgacacgcagttcgtgcggtg

SEQ ID NO: 11150 - DNA, 24 bp, Artificial Sequence
  Description of Artificial Sequence: Synthetic oligonucleotide
ggacgacacgcagttcgtgcggtg

SEQ ID NO: 11151 - DNA, 24 bp, Artificial Sequence
  Description of Artificial Sequence: Synthetic oligonucleotide
gacgacacgcagttcgtgcggtgc

SEQ ID NO: 11152 - DNA, 25 bp, Artificial Sequence
  Description of Artificial Sequence: Synthetic oligonucleotide
acgacacgcagttcgtgcggtgcga

SEQ ID NO: 11153 - DNA, 24 bp, Artificial Sequence
  Description of Artificial Sequence: Synthetic oligonucleotide
cgacacgcagttcgtgcggtgcga

SEQ ID NO: 11154 - DNA, 25 bp, Artificial Sequence
  Description of Artificial Sequence: Synthetic oligonucleotide
gacacgcagttcgtgcggtgcgaca

SEQ ID NO: 11155 - DNA, 25 bp, Artificial Sequence
  Description of Artificial Sequence: Synthetic oligonucleotide
acacgcagttcgtgcggtgcgacag

SEQ ID NO: 11156 - DNA, 24 bp, Artificial Sequence
  Description of Artificial Sequence: Synthetic oligonucleotide
cacgcagttcgtgcggtgcgacag

SEQ ID NO: 11157 - DNA, 24 bp, Artificial Sequence
  Description of Artificial Sequence: Synthetic oligonucleotide
acgcagttcgtgcggtgcgacagc

SEQ ID NO: 11158 - DNA, 23 bp, Artificial Sequence
  Description of Artificial Sequence: Synthetic oligonucleotide
cgcagttcgtgcggtgcgacagc

SEQ ID NO: 11159 - DNA, 24 bp, Artificial Sequence
  Description of Artificial Sequence: Synthetic oligonucleotide
gcagttcgtgcggtgcgacagcga

SEQ ID NO: 11160 - DNA, 24 bp, Artificial Sequence
  Description of Artificial Sequence: Synthetic oligonucleotide
cagttcgtgcggtgcgacagcgac

SEQ ID NO: 11161 - DNA, 24 bp, Artificial Sequence
  Description of Artificial Sequence: Synthetic oligonucleotide
agttcgtgcggtgcgacagcgacg

SEQ ID NO: 11162 - DNA, 23 bp, Artificial Sequence
  Description of Artificial Sequence: Synthetic oligonucleotide
gttcgtgcggtgcgacagcgacg

SEQ ID NO: 11163 - DNA, 23 bp, Artificial Sequence
  Description of Artificial Sequence: Synthetic oligonucleotide
ttcgtgcggtgcgacagcgacgc

SEQ ID NO: 11164 - DNA, 22 bp, Artificial Sequence
  Description of Artificial Sequence: Synthetic oligonucleotide
tcgtgcggtgcgacagcgacgc

SEQ ID NO: 11165 - DNA, 21 bp, Artificial Sequence
  Description of Artificial Sequence: Synthetic oligonucleotide
cgtgcggtgcgacagcgacgc

SEQ ID NO: 11166 - DNA, 21 bp, Artificial Sequence
  Description of Artificial Sequence: Synthetic oligonucleotide
gtgcggtgcgacagcgacgcc

SEQ ID NO: 11167 - DNA, 21 bp, Artificial Sequence
  Description of Artificial Sequence: Synthetic oligonucleotide
tgcggtgcgacagcgacgccg

SEQ ID NO: 11168 - DNA, 20 bp, Artificial Sequence
  Description of Artificial Sequence: Synthetic oligonucleotide
gcggtgcgacagcgacgccg

SEQ ID NO: 11169 - DNA, 20 bp, Artificial Sequence
  Description of Artificial Sequence: Synthetic oligonucleotide
cggtgcgacagcgacgccgc

SEQ ID NO: 11170 - DNA, 21 bp, Artificial Sequence
  Description of Artificial Sequence: Synthetic oligonucleotide
ggtgcgacagcgacgccgcga

SEQ ID NO: 11171 - DNA, 21 bp, Artificial Sequence
  Description of Artificial Sequence: Synthetic oligonucleotide
gtgcgacagcgacgccgcgag

SEQ ID NO: 11172 - DNA, 21 bp, Artificial Sequence
  Description of Artificial Sequence: Synthetic oligonucleotide
tgcgacagcgacgccgcgagc

SEQ ID NO: 11173 - DNA, 20 bp, Artificial Sequence
  Description of Artificial Sequence: Synthetic oligonucleotide
gcgacagcgacgccgcgagc

SEQ ID NO: 11174 - DNA, 25 bp, Artificial Sequence
  Description of Artificial Sequence: Synthetic oligonucleotide
ccatgtgcagcatgagggtctgccc

SEQ ID NO: 11175 - DNA, 26 bp, Artificial Sequence
  Description of Artificial Sequence: Synthetic oligonucleotide
catgtgcagcatgagggtctgcccga

SEQ ID NO: 11176 - DNA, 26 bp, Artificial Sequence
  Description of Artificial Sequence: Synthetic oligonucleotide
atgtgcagcatgagggtctgcccgag

SEQ ID NO: 11177 - DNA, 25 bp, Artificial Sequence
  Description of Artificial Sequence: Synthetic oligonucleotide
tgtgcagcatgagggtctgcccgag

SEQ ID NO: 11178 - DNA, 24 bp, Artificial Sequence
  Description of Artificial Sequence: Synthetic oligonucleotide
gtgcagcatgagggtctgcccgag

SEQ ID NO: 11179 - DNA, 24 bp, Artificial Sequence
  Description of Artificial Sequence: Synthetic oligonucleotide
tgcagcatgagggtctgcccgagc

SEQ ID NO: 11180 - DNA, 23 bp, Artificial Sequence
  Description of Artificial Sequence: Synthetic oligonucleotide
gcagcatgagggtctgcccgagc

SEQ ID NO: 11181 - DNA, 23 bp, Artificial Sequence
  Description of Artificial Sequence: Synthetic oligonucleotide
cagcatgagggtctgcccgagcc

SEQ ID NO: 11182 - DNA, 23 bp, Artificial Sequence
  Description of Artificial Sequence: Synthetic oligonucleotide
agcatgagggtctgcccgagccc

SEQ ID NO: 11183 - DNA, 22 bp, Artificial Sequence
  Description of Artificial Sequence: Synthetic oligonucleotide
gcatgagggtctgcccgagccc

SEQ ID NO: 11184 - DNA, 23 bp, Artificial Sequence
  Description of Artificial Sequence: Synthetic oligonucleotide
catgagggtctgcccgagcccct

SEQ ID NO: 11185 - DNA, 24 bp, Artificial Sequence
  Description of Artificial Sequence: Synthetic oligonucleotide
atgagggtctgcccgagcccctca

SEQ ID NO: 11186 - DNA, 23 bp, Artificial Sequence
  Description of Artificial Sequence: Synthetic oligonucleotide
tgagggtctgcccgagcccctca

SEQ ID NO: 11187 - DNA, 22 bp, Artificial Sequence
  Description of Artificial Sequence: Synthetic oligonucleotide
gagggtctgcccgagcccctca

SEQ ID NO: 11188 - DNA, 22 bp, Artificial Sequence
  Description of Artificial Sequence: Synthetic oligonucleotide
agggtctgcccgagcccctcac

SEQ ID NO: 11189 - DNA, 21 bp, Artificial Sequence
  Description of Artificial Sequence: Synthetic oligonucleotide
gggtctgcccgagcccctcac

SEQ ID NO: 11190 - DNA, 21 bp, Artificial Sequence
  Description of Artificial Sequence: Synthetic oligonucleotide
ggtctgcccgagcccctcacc

SEQ ID NO: 11191 - DNA, 22 bp, Artificial Sequence
  Description of Artificial Sequence: Synthetic oligonucleotide
gtctgcccgagcccctcaccct

SEQ ID NO: 11192 - DNA, 23 bp, Artificial Sequence
  Description of Artificial Sequence: Synthetic oligonucleotide
tctgcccgagcccctcaccctga

SEQ ID NO: 11193 - DNA, 22 bp, Artificial Sequence
  Description of Artificial Sequence: Synthetic oligonucleotide
ctgcccgagcccctcaccctga

SEQ ID NO: 11194 - DNA, 24 bp, Artificial Sequence
  Description of Artificial Sequence: Synthetic oligonucleotide
tgcccgagcccctcaccctgagat

SEQ ID NO: 11195 - DNA, 23 bp, Artificial Sequence
  Description of Artificial Sequence: Synthetic oligonucleotide
gcccgagcccctcaccctgagat

SEQ ID NO: 11196 - DNA, 23 bp, Artificial Sequence
  Description of Artificial Sequence: Synthetic oligonucleotide
cccgagcccctcaccctgagatg

SEQ ID NO: 11197 - DNA, 23 bp, Artificial Sequence
  Description of Artificial Sequence: Synthetic oligonucleotide
ccgagcccctcaccctgagatgg

SEQ ID NO: 11198 - DNA, 24 bp, Artificial Sequence
  Description of Artificial Sequence: Synthetic oligonucleotide
cgagcccctcaccctgagatggga

SEQ ID NO: 11199 - DNA, 24 bp, Artificial Sequence
  Description of Artificial Sequence: Synthetic oligonucleotide
gagcccctcaccctgagatgggag

SEQ ID NO: 11200 - DNA, 28 bp, Artificial Sequence
  Description of Artificial Sequence: Synthetic oligonucleotide
gacggcaaggattacatcgccctgaacc

SEQ ID NO: 11201 - DNA, 29 bp, Artificial Sequence
  Description of Artificial Sequence: Synthetic oligonucleotide
acggcaaggattacatcgccctgaaccag

SEQ ID NO: 11202 - DNA, 28 bp, Artificial Sequence
  Description of Artificial Sequence: Synthetic oligonucleotide
cggcaaggattacatcgccctgaaccag

SEQ ID NO: 11203 - DNA, 28 bp, Artificial Sequence
  Description of Artificial Sequence: Synthetic oligonucleotide
ggcaaggattacatcgccctgaaccagg

SEQ ID NO: 11204 - DNA, 29 bp, Artificial Sequence
  Description of Artificial Sequence: Synthetic oligonucleotide
gcaaggattacatcgccctgaaccaggac

SEQ ID NO: 11205 - DNA, 29 bp, Artificial Sequence
  Description of Artificial Sequence: Synthetic oligonucleotide
caaggattacatcgccctgaaccaggacc

SEQ ID NO: 11206 - DNA, 30 bp, Artificial Sequence
  Description of Artificial Sequence: Synthetic oligonucleotide
aaggattacatcgccctgaaccaggacctg

SEQ ID NO: 11207 - DNA, 29 bp, Artificial Sequence
  Description of Artificial Sequence: Synthetic oligonucleotide
aggattacatcgccctgaaccaggacctg

SEQ ID NO: 11208 - DNA, 28 bp, Artificial Sequence
  Description of Artificial Sequence: Synthetic oligonucleotide
ggattacatcgccctgaaccaggacctg

SEQ ID NO: 11209 - DNA, 28 bp, Artificial Sequence
  Description of Artificial Sequence: Synthetic oligonucleotide
gattacatcgccctgaaccaggacctgc

SEQ ID NO: 11210 - DNA, 28 bp, Artificial Sequence
  Description of Artificial Sequence: Synthetic oligonucleotide
attacatcgccctgaaccaggacctgcg

SEQ ID NO: 11211 - DNA, 27 bp, Artificial Sequence
  Description of Artificial Sequence: Synthetic oligonucleotide
ttacatcgccctgaaccaggacctgcg

SEQ ID NO: 11212 - DNA, 26 bp, Artificial Sequence
  Description of Artificial Sequence: Synthetic oligonucleotide
tacatcgccctgaaccaggacctgcg

SEQ ID NO: 11213 - DNA, 25 bp, Artificial Sequence
  Description of Artificial Sequence: Synthetic oligonucleotide
acatcgccctgaaccaggacctgcg

SEQ ID NO: 11214 - DNA, 24 bp, Artificial Sequence
  Description of Artificial Sequence: Synthetic oligonucleotide
catcgccctgaaccaggacctgcg

SEQ ID NO: 11215 - DNA, 25 bp, Artificial Sequence
  Description of Artificial Sequence: Synthetic oligonucleotide
atcgccctgaaccaggacctgcgct

SEQ ID NO: 11216 - DNA, 24 bp, Artificial Sequence
  Description of Artificial Sequence: Synthetic oligonucleotide
tcgccctgaaccaggacctgcgct

SEQ ID NO: 11217 - DNA, 23 bp, Artificial Sequence
  Description of Artificial Sequence: Synthetic oligonucleotide
cgccctgaaccaggacctgcgct

SEQ ID NO: 11218 - DNA, 25 bp, Artificial Sequence
  Description of Artificial Sequence: Synthetic oligonucleotide
gccctgaaccaggacctgcgctctt

SEQ ID NO: 11219 - DNA, 25 bp, Artificial Sequence
  Description of Artificial Sequence: Synthetic oligonucleotide
ccctgaaccaggacctgcgctcttg

SEQ ID NO: 11220 - DNA, 26 bp, Artificial Sequence
  Description of Artificial Sequence: Synthetic oligonucleotide
cctgaaccaggacctgcgctcttgga

SEQ ID NO: 11221 - DNA, 26 bp, Artificial Sequence
  Description of Artificial Sequence: Synthetic oligonucleotide
ctgaaccaggacctgcgctcttggac

SEQ ID NO: 11222 - DNA, 26 bp, Artificial Sequence
  Description of Artificial Sequence: Synthetic oligonucleotide
tgaaccaggacctgcgctcttggacc

SEQ ID NO: 11223 - DNA, 25 bp, Artificial Sequence
  Description of Artificial Sequence: Synthetic oligonucleotide
gaaccaggacctgcgctcttggacc

SEQ ID NO: 11224 - DNA, 25 bp, Artificial Sequence
  Description of Artificial Sequence: Synthetic oligonucleotide
aaccaggacctgcgctcttggaccg

SEQ ID NO: 11225 - DNA, 24 bp, Artificial Sequence
  Description of Artificial Sequence: Synthetic oligonucleotide
accaggacctgcgctcttggaccg

SEQ ID NO: 11226 - DNA, 23 bp, Artificial Sequence
  Description of Artificial Sequence: Synthetic oligonucleotide
ccaggacctgcgctcttggaccg

SEQ ID NO: 11227 - DNA, 23 bp, Artificial Sequence
  Description of Artificial Sequence: Synthetic oligonucleotide
caggacctgcgctcttggaccgc

SEQ ID NO: 11228 - DNA, 29 bp, Artificial Sequence
  Description of Artificial Sequence: Synthetic oligonucleotide
gaggccggttctcacaccatccagataac

SEQ ID NO: 11229 - DNA, 29 bp, Artificial Sequence
  Description of Artificial Sequence: Synthetic oligonucleotide
aggccggttctcacaccatccagataacg

SEQ ID NO: 11230 - DNA, 28 bp, Artificial Sequence
  Description of Artificial Sequence: Synthetic oligonucleotide
ggccggttctcacaccatccagataacg

SEQ ID NO: 11231 - DNA, 31 bp, Artificial Sequence
  Description of Artificial Sequence: Synthetic oligonucleotide
gccggttctcacaccatccagataacgtatg

SEQ ID NO: 11232 - DNA, 31 bp, Artificial Sequence
  Description of Artificial Sequence: Synthetic oligonucleotide
ccggttctcacaccatccagataacgtatgg

SEQ ID NO: 11233 - DNA, 31 bp, Artificial Sequence
  Description of Artificial Sequence: Synthetic oligonucleotide
cggttctcacaccatccagataacgtatggc

SEQ ID NO: 11234 - DNA, 32 bp, Artificial Sequence
  Description of Artificial Sequence: Synthetic oligonucleotide
ggttctcacaccatccagataacgtatggctg

SEQ ID NO: 11235 - DNA, 32 bp, Artificial Sequence
  Description of Artificial Sequence: Synthetic oligonucleotide
gttctcacaccatccagataacgtatggctgc

SEQ ID NO: 11236 - DNA, 32 bp, Artificial Sequence
  Description of Artificial Sequence: Synthetic oligonucleotide
ttctcacaccatccagataacgtatggctgcg

SEQ ID NO: 11237 - DNA, 31 bp, Artificial Sequence
  Description of Artificial Sequence: Synthetic oligonucleotide
tctcacaccatccagataacgtatggctgcg

SEQ ID NO: 11238 - DNA, 30 bp, Artificial Sequence
  Description of Artificial Sequence: Synthetic oligonucleotide
ctcacaccatccagataacgtatggctgcg

SEQ ID NO: 11239 - DNA, 31 bp, Artificial Sequence
  Description of Artificial Sequence: Synthetic oligonucleotide
tcacaccatccagataacgtatggctgcgac

SEQ ID NO: 11240 - DNA, 30 bp, Artificial Sequence
  Description of Artificial Sequence: Synthetic oligonucleotide
cacaccatccagataacgtatggctgcgac

SEQ ID NO: 11241 - DNA, 30 bp, Artificial Sequence
  Description of Artificial Sequence: Synthetic oligonucleotide
acaccatccagataacgtatggctgcgacg

SEQ ID NO: 11242 - DNA, 29 bp, Artificial Sequence
  Description of Artificial Sequence: Synthetic oligonucleotide
caccatccagataacgtatggctgcgacg

SEQ ID NO: 11243 - DNA, 30 bp, Artificial Sequence
  Description of Artificial Sequence: Synthetic oligonucleotide
accatccagataacgtatggctgcgacgtg

SEQ ID NO: 11244 - DNA, 29 bp, Artificial Sequence
  Description of Artificial Sequence: Synthetic oligonucleotide
ccatccagataacgtatggctgcgacgtg

SEQ ID NO: 11245 - DNA, 29 bp, Artificial Sequence
  Description of Artificial Sequence: Synthetic oligonucleotide
catccagataacgtatggctgcgacgtgg

SEQ ID NO: 11246 - DNA, 29 bp, Artificial Sequence
  Description of Artificial Sequence: Synthetic oligonucleotide
atccagataacgtatggctgcgacgtggg

SEQ ID NO: 11247 - DNA, 28 bp, Artificial Sequence
  Description of Artificial Sequence: Synthetic oligonucleotide
tccagataacgtatggctgcgacgtggg

SEQ ID NO: 11248 - DNA, 27 bp, Artificial Sequence
  Description of Artificial Sequence: Synthetic oligonucleotide
ccagataacgtatggctgcgacgtggg

SEQ ID NO: 11249 - DNA, 27 bp, Artificial Sequence
  Description of Artificial Sequence: Synthetic oligonucleotide
cagataacgtatggctgcgacgtgggg

SEQ ID NO: 11250 - DNA, 28 bp, Artificial Sequence
  Description of Artificial Sequence: Synthetic oligonucleotide
agataacgtatggctgcgacgtggggtc

SEQ ID NO: 11251 - DNA, 27 bp, Artificial Sequence
  Description of Artificial Sequence: Synthetic oligonucleotide
gataacgtatggctgcgacgtggggtc

SEQ ID NO: 11252 - DNA, 27 bp, Artificial Sequence
  Description of Artificial Sequence: Synthetic oligonucleotide
ataacgtatggctgcgacgtggggtcg

SEQ ID NO: 11253 - DNA, 26 bp, Artificial Sequence
  Description of Artificial Sequence: Synthetic oligonucleotide
taacgtatggctgcgacgtggggtcg

SEQ ID NO: 11254 - DNA, 25 bp, Artificial Sequence
  Description of Artificial Sequence: Synthetic oligonucleotide
aacgtatggctgcgacgtggggtcg

SEQ ID NO: 11255 - DNA, 24 bp, Artificial Sequence
  Description of Artificial Sequence: Synthetic oligonucleotide
acgtatggctgcgacgtggggtcg

SEQ ID NO: 11256 - DNA, 23 bp, Artificial Sequence
  Description of Artificial Sequence: Synthetic oligonucleotide
cgtatggctgcgacgtggggtcg

SEQ ID NO: 11257 - DNA, 28 bp, Artificial Sequence
  Description of Artificial Sequence: Synthetic oligonucleotide
ggaccaggagacacggaatgtgaaggtc

SEQ ID NO: 11258 - DNA, 28 bp, Artificial Sequence
  Description of Artificial Sequence: Synthetic oligonucleotide
gaccaggagacacggaatgtgaaggtcc

SEQ ID NO: 11259 - DNA, 29 bp, Artificial Sequence
  Description of Artificial Sequence: Synthetic oligonucleotide
accaggagacacggaatgtgaaggtccag

SEQ ID NO: 11260 - DNA, 28 bp, Artificial Sequence
  Description of Artificial Sequence: Synthetic oligonucleotide
ccaggagacacggaatgtgaaggtccag

SEQ ID NO: 11261 - DNA, 29 bp, Artificial Sequence
  Description of Artificial Sequence: Synthetic oligonucleotide
caggagacacggaatgtgaaggtccagtc

SEQ ID NO: 11262 - DNA, 30 bp, Artificial Sequence
  Description of Artificial Sequence: Synthetic oligonucleotide
aggagacacggaatgtgaaggtccagtcac

SEQ ID NO: 11263 - DNA, 29 bp, Artificial Sequence
  Description of Artificial Sequence: Synthetic oligonucleotide
ggagacacggaatgtgaaggtccagtcac

SEQ ID NO: 11264 - DNA, 30 bp, Artificial Sequence
  Description of Artificial Sequence: Synthetic oligonucleotide
gagacacggaatgtgaaggtccagtcacag

SEQ ID NO: 11265 - DNA, 31 bp, Artificial Sequence
  Description of Artificial Sequence: Synthetic oligonucleotide
agacacggaatgtgaaggtccagtcacagac

SEQ ID NO: 11266 - DNA, 30 bp, Artificial Sequence
  Description of Artificial Sequence: Synthetic oligonucleotide
gacacggaatgtgaaggtccagtcacagac

SEQ ID NO: 11267 - DNA, 31 bp, Artificial Sequence
  Description of Artificial Sequence: Synthetic oligonucleotide
acacggaatgtgaaggtccagtcacagactg

SEQ ID NO: 11268 - DNA, 30 bp, Artificial Sequence
  Description of Artificial Sequence: Synthetic oligonucleotide
cacggaatgtgaaggtccagtcacagactg

SEQ ID NO: 11269 - DNA, 31 bp, Artificial Sequence
  Description of Artificial Sequence: Synthetic oligonucleotide
acggaatgtgaaggtccagtcacagactgac

SEQ ID NO: 11270 - DNA, 30 bp, Artificial Sequence
  Description of Artificial Sequence: Synthetic oligonucleotide
cggaatgtgaaggtccagtcacagactgac

SEQ ID NO: 11271 - DNA, 30 bp, Artificial Sequence
  Description of Artificial Sequence: Synthetic oligonucleotide
ggaatgtgaaggtccagtcacagactgacc

SEQ ID NO: 11272 - DNA, 30 bp, Artificial Sequence
  Description of Artificial Sequence: Synthetic oligonucleotide
gaatgtgaaggtccagtcacagactgaccg

SEQ ID NO: 11273 - DNA, 31 bp, Artificial Sequence
  Description of Artificial Sequence: Synthetic oligonucleotide
aatgtgaaggtccagtcacagactgaccgag

SEQ ID NO: 11274 - DNA, 30 bp, Artificial Sequence
  Description of Artificial Sequence: Synthetic oligonucleotide
atgtgaaggtccagtcacagactgaccgag

SEQ ID NO: 11275 - DNA, 29 bp, Artificial Sequence
  Description of Artificial Sequence: Synthetic oligonucleotide
tgtgaaggtccagtcacagactgaccgag

SEQ ID NO: 11276 - DNA, 28 bp, Artificial Sequence
  Description of Artificial Sequence: Synthetic oligonucleotide
gtgaaggtccagtcacagactgaccgag

SEQ ID NO: 11277 - DNA, 29 bp, Artificial Sequence
  Description of Artificial Sequence: Synthetic oligonucleotide
tgaaggtccagtcacagactgaccgagtg

SEQ ID NO: 11278 - DNA, 28 bp, Artificial Sequence
  Description of Artificial Sequence: Synthetic oligonucleotide
gaaggtccagtcacagactgaccgagtg

SEQ ID NO: 11279 - DNA, 28 bp, Artificial Sequence
  Description of Artificial Sequence: Synthetic oligonucleotide
aaggtccagtcacagactgaccgagtgg

SEQ ID NO: 11280 - DNA, 27 bp, Artificial Sequence
  Description of Artificial Sequence: Synthetic oligonucleotide
aggtccagtcacagactgaccgagtgg

SEQ ID NO: 11281 - DNA, 27 bp, Artificial Sequence
  Description of Artificial Sequence: Synthetic oligonucleotide
ggtccagtcacagactgaccgagtgga

SEQ ID NO: 11282 - DNA, 27 bp, Artificial Sequence
  Description of Artificial Sequence: Synthetic oligonucleotide
gtccagtcacagactgaccgagtggac

SEQ ID NO: 11283 - DNA, 27 bp, Artificial Sequence
  Description of Artificial Sequence: Synthetic oligonucleotide
tccagtcacagactgaccgagtggacc

SEQ ID NO: 11284 - DNA, 27 bp, Artificial Sequence
  Description of Artificial Sequence: Synthetic oligonucleotide
gaggagacagggaaagtgaaggcccag

SEQ ID NO: 11285 - DNA, 28 bp, Artificial Sequence
  Description of Artificial Sequence: Synthetic oligonucleotide
aggagacagggaaagtgaaggcccagtc

SEQ ID NO: 11286 - DNA, 27 bp, Artificial Sequence
  Description of Artificial Sequence: Synthetic oligonucleotide
ggagacagggaaagtgaaggcccagtc

SEQ ID NO: 11287 - DNA, 28 bp, Artificial Sequence
  Description of Artificial Sequence: Synthetic oligonucleotide
gagacagggaaagtgaaggcccagtcac

SEQ ID NO: 11288 - DNA, 29 bp, Artificial Sequence
  Description of Artificial Sequence: Synthetic oligonucleotide
agacagggaaagtgaaggcccagtcacag

SEQ ID NO: 11289 - DNA, 28 bp, Artificial Sequence
  Description of Artificial Sequence: Synthetic oligonucleotide
gacagggaaagtgaaggcccagtcacag

SEQ ID NO: 11290 - DNA, 29 bp, Artificial Sequence
  Description of Artificial Sequence: Synthetic oligonucleotide
acagggaaagtgaaggcccagtcacagac

SEQ ID NO: 11291 - DNA, 28 bp, Artificial Sequence
  Description of Artificial Sequence: Synthetic oligonucleotide
cagggaaagtgaaggcccagtcacagac

SEQ ID NO: 11292 - DNA, 29 bp, Artificial Sequence
  Description of Artificial Sequence: Synthetic oligonucleotide
agggaaagtgaaggcccagtcacagactg

SEQ ID NO: 11293 - DNA, 28 bp, Artificial Sequence
  Description of Artificial Sequence: Synthetic oligonucleotide
gggaaagtgaaggcccagtcacagactg

SEQ ID NO: 11294 - DNA, 24 bp, Artificial Sequence
  Description of Artificial Sequence: Synthetic oligonucleotide
cttcctccgcgggtaccggcagta

SEQ ID NO: 11295 - DNA, 24 bp, Artificial Sequence
  Description of Artificial Sequence: Synthetic oligonucleotide
ttcctccgcgggtaccggcagtac

SEQ ID NO: 11296 - DNA, 23 bp, Artificial Sequence
  Description of Artificial Sequence: Synthetic oligonucleotide
tcctccgcgggtaccggcagtac

SEQ ID NO: 11297 - DNA, 22 bp, Artificial Sequence
  Description of Artificial Sequence: Synthetic oligonucleotide
cctccgcgggtaccggcagtac

SEQ ID NO: 11298 - DNA, 22 bp, Artificial Sequence
  Description of Artificial Sequence: Synthetic oligonucleotide
ctccgcgggtaccggcagtacg

SEQ ID NO: 11299 - DNA, 22 bp, Artificial Sequence
  Description of Artificial Sequence: Synthetic oligonucleotide
tccgcgggtaccggcagtacgc

SEQ ID NO: 11300 - DNA, 21 bp, Artificial Sequence
  Description of Artificial Sequence: Synthetic oligonucleotide
ccgcgggtaccggcagtacgc

SEQ ID NO: 11301 - DNA, 23 bp, Artificial Sequence
  Description of Artificial Sequence: Synthetic oligonucleotide
cgcgggtaccggcagtacgccta

SEQ ID NO: 11302 - DNA, 23 bp, Artificial Sequence
  Description of Artificial Sequence: Synthetic oligonucleotide
gcgggtaccggcagtacgcctac

SEQ ID NO: 11303 - DNA, 24 bp, Artificial Sequence
  Description of Artificial Sequence: Synthetic oligonucleotide
cgggtaccggcagtacgcctacga

SEQ ID NO: 11304 - DNA, 24 bp, Artificial Sequence
  Description of Artificial Sequence: Synthetic oligonucleotide
gggtaccggcagtacgcctacgac

SEQ ID NO: 11305 - DNA, 24 bp, Artificial Sequence
  Description of Artificial Sequence: Synthetic oligonucleotide
ggtaccggcagtacgcctacgacg

SEQ ID NO: 11306 - DNA, 24 bp, Artificial Sequence
  Description of Artificial Sequence: Synthetic oligonucleotide
gtaccggcagtacgcctacgacgg

SEQ ID NO: 11307 - DNA, 26 bp, Artificial Sequence
  Description of Artificial Sequence: Synthetic oligonucleotide
taccggcagtacgcctacgacggcaa

SEQ ID NO: 11308 - DNA, 25 bp, Artificial Sequence
  Description of Artificial Sequence: Synthetic oligonucleotide
accggcagtacgcctacgacggcaa

SEQ ID NO: 11309 - DNA, 24 bp, Artificial Sequence
  Description of Artificial Sequence: Synthetic oligonucleotide
ccggcagtacgcctacgacggcaa

SEQ ID NO: 11310 - DNA, 24 bp, Artificial Sequence
  Description of Artificial Sequence: Synthetic oligonucleotide
cggcagtacgcctacgacggcaag

SEQ ID NO: 11311 - DNA, 27 bp, Artificial Sequence
  Description of Artificial Sequence: Synthetic oligonucleotide
ggcagtacgcctacgacggcaaggatt

SEQ ID NO: 11312 - DNA, 23 bp, Artificial Sequence
  Description of Artificial Sequence: Synthetic oligonucleotide
gagccagaggatggagccgcggt

SEQ ID NO: 11313 - DNA, 23 bp, Artificial Sequence
  Description of Artificial Sequence: Synthetic oligonucleotide
agccagaggatggagccgcggtc

SEQ ID NO: 11314 - DNA, 22 bp, Artificial Sequence
  Description of Artificial Sequence: Synthetic oligonucleotide
gccagaggatggagccgcggtc

SEQ ID NO: 11315 - DNA, 22 bp, Artificial Sequence
  Description of Artificial Sequence: Synthetic oligonucleotide
ccagaggatggagccgcggtcg

SEQ ID NO: 11316 - DNA, 22 bp, Artificial Sequence
  Description of Artificial Sequence: Synthetic oligonucleotide
cagaggatggagccgcggtcgc

SEQ ID NO: 11317 - DNA, 22 bp, Artificial Sequence
  Description of Artificial Sequence: Synthetic oligonucleotide
agaggatggagccgcggtcgcc

SEQ ID NO: 11318 - DNA, 21 bp, Artificial Sequence
  Description of Artificial Sequence: Synthetic oligonucleotide
gaggatggagccgcggtcgcc

SEQ ID NO: 11319 - DNA, 22 bp, Artificial Sequence
  Description of Artificial Sequence: Synthetic oligonucleotide
aggatggagccgcggtcgccgt

SEQ ID NO: 11320 - DNA, 21 bp, Artificial Sequence
  Description of Artificial Sequence: Synthetic oligonucleotide
ggatggagccgcggtcgccgt

SEQ ID NO: 11321 - DNA, 21 bp, Artificial Sequence
  Description of Artificial Sequence: Synthetic oligonucleotide
gatggagccgcggtcgccgtg

SEQ ID NO: 11322 - DNA, 24 bp, Artificial Sequence
  Description of Artificial Sequence: Synthetic oligonucleotide
atggagccgcggtcgccgtggata

SEQ ID NO: 11323 - DNA, 23 bp, Artificial Sequence
  Description of Artificial Sequence: Synthetic oligonucleotide
tggagccgcggtcgccgtggata

SEQ ID NO: 11324 - DNA, 22 bp, Artificial Sequence
  Description of Artificial Sequence: Synthetic oligonucleotide
ggagccgcggtcgccgtggata

SEQ ID NO: 11325 - DNA, 23 bp, Artificial Sequence
  Description of Artificial Sequence: Synthetic oligonucleotide
gagccgcggtcgccgtggataga

SEQ ID NO: 11326 - DNA, 23 bp, Artificial Sequence
  Description of Artificial Sequence: Synthetic oligonucleotide
agccgcggtcgccgtggatagag

SEQ ID NO: 11327 - DNA, 22 bp, Artificial Sequence
  Description of Artificial Sequence: Synthetic oligonucleotide
gccgcggtcgccgtggatagag

SEQ ID NO: 11328 - DNA, 23 bp, Artificial Sequence
  Description of Artificial Sequence: Synthetic oligonucleotide
ccgcggtcgccgtggatagagca

SEQ ID NO: 11329 - DNA, 23 bp, Artificial Sequence
  Description of Artificial Sequence: Synthetic oligonucleotide
cgcggtcgccgtggatagagcag

SEQ ID NO: 11330 - DNA, 24 bp, Artificial Sequence
  Description of Artificial Sequence: Synthetic oligonucleotide
gcggtcgccgtggatagagcagga

SEQ ID NO: 11331 - DNA, 24 bp, Artificial Sequence
  Description of Artificial Sequence: Synthetic oligonucleotide
cggtcgccgtggatagagcaggag

SEQ ID NO: 11332 - DNA, 24 bp, Artificial Sequence
  Description of Artificial Sequence: Synthetic oligonucleotide
ggtcgccgtggatagagcaggagg

SEQ ID NO: 11333 - DNA, 24 bp, Artificial Sequence
  Description of Artificial Sequence: Synthetic oligonucleotide
gtcgccgtggatagagcaggaggg

SEQ ID NO: 11334 - DNA, 24 bp, Artificial Sequence
  Description of Artificial Sequence: Synthetic oligonucleotide
tcgccgtggatagagcaggagggg

SEQ ID NO: 11335 - DNA, 26 bp, Artificial Sequence
  Description of Artificial Sequence: Synthetic oligonucleotide
ccaggagacacggaatgtgaaggccc

SEQ ID NO: 11336 - DNA, 26 bp, Artificial Sequence
  Description of Artificial Sequence: Synthetic oligonucleotide
caggagacacggaatgtgaaggcccc

SEQ ID NO: 11337 - DNA, 27 bp, Artificial Sequence
  Description of Artificial Sequence: Synthetic oligonucleotide
aggagacacggaatgtgaaggccccgt

SEQ ID NO: 11338 - DNA, 26 bp, Artificial Sequence
  Description of Artificial Sequence: Synthetic oligonucleotide
ggagacacggaatgtgaaggccccgt

SEQ ID NO: 11339 - DNA, 27 bp, Artificial Sequence
  Description of Artificial Sequence: Synthetic oligonucleotide
gagacacggaatgtgaaggccccgtca

SEQ ID NO: 11340 - DNA, 27 bp, Artificial Sequence
  Description of Artificial Sequence: Synthetic oligonucleotide
agacacggaatgtgaaggccccgtcac

SEQ ID NO: 11341 - DNA, 27 bp, Artificial Sequence
  Description of Artificial Sequence: Synthetic oligonucleotide
gacacggaatgtgaaggccccgtcaca

SEQ ID NO: 11342 - DNA, 27 bp, Artificial Sequence
  Description of Artificial Sequence: Synthetic oligonucleotide
acacggaatgtgaaggccccgtcacag

SEQ ID NO: 11343 - DNA, 27 bp, Artificial Sequence
  Description of Artificial Sequence: Synthetic oligonucleotide
cacggaatgtgaaggccccgtcacaga

SEQ ID NO: 11344 - DNA, 27 bp, Artificial Sequence
  Description of Artificial Sequence: Synthetic oligonucleotide
acggaatgtgaaggccccgtcacagac

SEQ ID NO: 11345 - DNA, 27 bp, Artificial Sequence
  Description of Artificial Sequence: Synthetic oligonucleotide
cggaatgtgaaggccccgtcacagact

SEQ ID NO: 11346 - DNA, 27 bp, Artificial Sequence
  Description of Artificial Sequence: Synthetic oligonucleotide
ggaatgtgaaggccccgtcacagactg

SEQ ID NO: 11347 - DNA, 28 bp, Artificial Sequence
  Description of Artificial Sequence: Synthetic oligonucleotide
gaatgtgaaggccccgtcacagactgac

SEQ ID NO: 11348 - DNA, 28 bp, Artificial Sequence
  Description of Artificial Sequence: Synthetic oligonucleotide
aatgtgaaggccccgtcacagactgacc

SEQ ID NO: 11349 - DNA, 27 bp, Artificial Sequence
  Description of Artificial Sequence: Synthetic oligonucleotide
atgtgaaggccccgtcacagactgacc

SEQ ID NO: 11350 - DNA, 26 bp, Artificial Sequence
  Description of Artificial Sequence: Synthetic oligonucleotide
tgtgaaggccccgtcacagactgacc

SEQ ID NO: 11351 - DNA, 25 bp, Artificial Sequence
  Description of Artificial Sequence: Synthetic oligonucleotide
gtgaaggccccgtcacagactgacc

SEQ ID NO: 11352 - DNA, 26 bp, Artificial Sequence
  Description of Artificial Sequence: Synthetic oligonucleotide
tgaaggccccgtcacagactgaccga

SEQ ID NO: 11353 - DNA, 25 bp, Artificial Sequence
  Description of Artificial Sequence: Synthetic oligonucleotide
gaaggccccgtcacagactgaccga

SEQ ID NO: 11354 - DNA, 26 bp, Artificial Sequence
  Description of Artificial Sequence: Synthetic oligonucleotide
aaggccccgtcacagactgaccgagt

SEQ ID NO: 11355 - DNA, 25 bp, Artificial Sequence
  Description of Artificial Sequence: Synthetic oligonucleotide
aggccccgtcacagactgaccgagt

SEQ ID NO: 11356 - DNA, 24 bp, Artificial Sequence
  Description of Artificial Sequence: Synthetic oligonucleotide
ggccccgtcacagactgaccgagt

SEQ ID NO: 11357 - DNA, 24 bp, Artificial Sequence
  Description of Artificial Sequence: Synthetic oligonucleotide
gccccgtcacagactgaccgagtg

SEQ ID NO: 11358 - DNA, 25 bp, Artificial Sequence
  Description of Artificial Sequence: Synthetic oligonucleotide
ccccgtcacagactgaccgagtgga

SEQ ID NO: 11359 - DNA, 25 bp, Artificial Sequence
  Description of Artificial Sequence: Synthetic oligonucleotide
cccgtcacagactgaccgagtggac

SEQ ID NO: 11360 - DNA, 26 bp, Artificial Sequence
  Description of Artificial Sequence: Synthetic oligonucleotide
ccgtcacagactgaccgagtggacct

SEQ ID NO: 11361 - DNA, 26 bp, Artificial Sequence
  Description of Artificial Sequence: Synthetic oligonucleotide
cgtcacagactgaccgagtggacctg

SEQ ID NO: 11362 - DNA, 23 bp, Artificial Sequence
  Description of Artificial Sequence: Synthetic oligonucleotide
ctcttggaccgcggcggacatgc

SEQ ID NO: 11363 - DNA, 23 bp, Artificial Sequence
  Description of Artificial Sequence: Synthetic oligonucleotide
tcttggaccgcggcggacatgcc

SEQ ID NO: 11364 - DNA, 22 bp, Artificial Sequence
  Description of Artificial Sequence: Synthetic oligonucleotide
cttggaccgcggcggacatgcc

SEQ ID NO: 11365 - DNA, 22 bp, Artificial Sequence
  Description of Artificial Sequence: Synthetic oligonucleotide
ttggaccgcggcggacatgccg

SEQ ID NO: 11366 - DNA, 21 bp, Artificial Sequence
  Description of Artificial Sequence: Synthetic oligonucleotide
tggaccgcggcggacatgccg

SEQ ID NO: 11367 - DNA, 20 bp, Artificial Sequence
  Description of Artificial Sequence: Synthetic oligonucleotide
ggaccgcggcggacatgccg

SEQ ID NO: 11368 - DNA, 20 bp, Artificial Sequence
  Description of Artificial Sequence: Synthetic oligonucleotide
gaccgcggcggacatgccgg

SEQ ID NO: 11369 - DNA, 21 bp, Artificial Sequence
  Description of Artificial Sequence: Synthetic oligonucleotide
accgcggcggacatgccggct

SEQ ID NO: 11370 - DNA, 20 bp, Artificial Sequence
  Description of Artificial Sequence: Synthetic oligonucleotide
ccgcggcggacatgccggct

SEQ ID NO: 11371 - DNA, 21 bp, Artificial Sequence
  Description of Artificial Sequence: Synthetic oligonucleotide
cgcggcggacatgccggctca

SEQ ID NO: 11372 - DNA, 23 bp, Artificial Sequence
  Description of Artificial Sequence: Synthetic oligonucleotide
gcggcggacatgccggctcagat

SEQ ID NO: 11373 - DNA, 24 bp, Artificial Sequence
  Description of Artificial Sequence: Synthetic oligonucleotide
cggcggacatgccggctcagatca

SEQ ID NO: 11374 - DNA, 24 bp, Artificial Sequence
  Description of Artificial Sequence: Synthetic oligonucleotide
ggcggacatgccggctcagatcac

SEQ ID NO: 11375 - DNA, 26 bp, Artificial Sequence
  Description of Artificial Sequence: Synthetic oligonucleotide
gcggacatgccggctcagatcaccaa

SEQ ID NO: 11376 - DNA, 26 bp, Artificial Sequence
  Description of Artificial Sequence: Synthetic oligonucleotide
cggacatgccggctcagatcaccaag

SEQ ID NO: 11377 - DNA, 26 bp, Artificial Sequence
  Description of Artificial Sequence: Synthetic oligonucleotide
ggacatgccggctcagatcaccaagc

SEQ ID NO: 11378 - DNA, 26 bp, Artificial Sequence
  Description of Artificial Sequence: Synthetic oligonucleotide
gacatgccggctcagatcaccaagcg

SEQ ID NO: 11379 - DNA, 27 bp, Artificial Sequence
  Description of Artificial Sequence: Synthetic oligonucleotide
acatgccggctcagatcaccaagcgca

SEQ ID NO: 11380 - DNA, 27 bp, Artificial Sequence
  Description of Artificial Sequence: Synthetic oligonucleotide
catgccggctcagatcaccaagcgcaa

SEQ ID NO: 11381 - DNA, 27 bp, Artificial Sequence
  Description of Artificial Sequence: Synthetic oligonucleotide
atgccggctcagatcaccaagcgcaag

SEQ ID NO: 11382 - DNA, 27 bp, Artificial Sequence
  Description of Artificial Sequence: Synthetic oligonucleotide
tgccggctcagatcaccaagcgcaagt

SEQ ID NO: 11383 - DNA, 26 bp, Artificial Sequence
  Description of Artificial Sequence: Synthetic oligonucleotide
gccggctcagatcaccaagcgcaagt

SEQ ID NO: 11384 - DNA, 26 bp, Artificial Sequence
  Description of Artificial Sequence: Synthetic oligonucleotide
ccggctcagatcaccaagcgcaagtg

SEQ ID NO: 11385 - DNA, 26 bp, Artificial Sequence
  Description of Artificial Sequence: Synthetic oligonucleotide
ggccggagtattgggaccaggagact

SEQ ID NO: 11386 - DNA, 27 bp, Artificial Sequence
  Description of Artificial Sequence: Synthetic oligonucleotide
gccggagtattgggaccaggagactga

SEQ ID NO: 11387 - DNA, 27 bp, Artificial Sequence
  Description of Artificial Sequence: Synthetic oligonucleotide
ccggagtattgggaccaggagactgac

SEQ ID NO: 11388 - DNA, 27 bp, Artificial Sequence
  Description of Artificial Sequence: Synthetic oligonucleotide
cggagtattgggaccaggagactgacc

SEQ ID NO: 11389 - DNA, 27 bp, Artificial Sequence
  Description of Artificial Sequence: Synthetic oligonucleotide
ggagtattgggaccaggagactgaccg

SEQ ID NO: 11390 - DNA, 28 bp, Artificial Sequence
  Description of Artificial Sequence: Synthetic oligonucleotide
gagtattgggaccaggagactgaccgag

SEQ ID NO: 11391 - DNA, 29 bp, Artificial Sequence
  Description of Artificial Sequence: Synthetic oligonucleotide
agtattgggaccaggagactgaccgagtg

SEQ ID NO: 11392 - DNA, 28 bp, Artificial Sequence
  Description of Artificial Sequence: Synthetic oligonucleotide
gtattgggaccaggagactgaccgagtg

SEQ ID NO: 11393 - DNA, 28 bp, Artificial Sequence
  Description of Artificial Sequence: Synthetic oligonucleotide
tattgggaccaggagactgaccgagtgg

SEQ ID NO: 11394 - DNA, 27 bp, Artificial Sequence
  Description of Artificial Sequence: Synthetic oligonucleotide
attgggaccaggagactgaccgagtgg

SEQ ID NO: 11395 - DNA, 27 bp, Artificial Sequence
  Description of Artificial Sequence: Synthetic oligonucleotide
ttgggaccaggagactgaccgagtgga

SEQ ID NO: 11396 - DNA, 26 bp, Artificial Sequence
  Description of Artificial Sequence: Synthetic oligonucleotide
tgggaccaggagactgaccgagtgga

SEQ ID NO: 11397 - DNA, 25 bp, Artificial Sequence
  Description of Artificial Sequence: Synthetic oligonucleotide
gggaccaggagactgaccgagtgga

SEQ ID NO: 11398 - DNA, 25 bp, Artificial Sequence
  Description of Artificial Sequence: Synthetic oligonucleotide
ggaccaggagactgaccgagtggac

SEQ ID NO: 11399 - DNA, 26 bp, Artificial Sequence
  Description of Artificial Sequence: Synthetic oligonucleotide
gaccaggagactgaccgagtggacct

SEQ ID NO: 11400 - DNA, 26 bp, Artificial Sequence
  Description of Artificial Sequence: Synthetic oligonucleotide
accaggagactgaccgagtggacctg

SEQ ID NO: 11401 - DNA, 25 bp, Artificial Sequence
  Description of Artificial Sequence: Synthetic oligonucleotide
ccaggagactgaccgagtggacctg

SEQ ID NO: 11402 - DNA, 25 bp, Artificial Sequence
  Description of Artificial Sequence: Synthetic oligonucleotide
caggagactgaccgagtggacctgg

SEQ ID NO: 11403 - DNA, 25 bp, Artificial Sequence
  Description of Artificial Sequence: Synthetic oligonucleotide
aggagactgaccgagtggacctggg

SEQ ID NO: 11404 - DNA, 24 bp, Artificial Sequence
  Description of Artificial Sequence: Synthetic oligonucleotide
ggagactgaccgagtggacctggg

SEQ ID NO: 11405 - DNA, 25 bp, Artificial Sequence
  Description of Artificial Sequence: Synthetic oligonucleotide
gagactgaccgagtggacctgggga

SEQ ID NO: 11406 - DNA, 27 bp, Artificial Sequence
  Description of Artificial Sequence: Synthetic oligonucleotide
cctgcaggggatggaaccttccagaac

SEQ ID NO: 11407 - DNA, 28 bp, Artificial Sequence
  Description of Artificial Sequence: Synthetic oligonucleotide
ctgcaggggatggaaccttccagaactg

SEQ ID NO: 11408 - DNA, 28 bp, Artificial Sequence
  Description of Artificial Sequence: Synthetic oligonucleotide
tgcaggggatggaaccttccagaactgg

SEQ ID NO: 11409 - DNA, 27 bp, Artificial Sequence
  Description of Artificial Sequence: Synthetic oligonucleotide
gcaggggatggaaccttccagaactgg

SEQ ID NO: 11410 - DNA, 27 bp, Artificial Sequence
  Description of Artificial Sequence: Synthetic oligonucleotide
caggggatggaaccttccagaactggg

SEQ ID NO: 11411 - DNA, 27 bp, Artificial Sequence
  Description of Artificial Sequence: Synthetic oligonucleotide
aggggatggaaccttccagaactgggc

SEQ ID NO: 11412 - DNA, 26 bp, Artificial Sequence
  Description of Artificial Sequence: Synthetic oligonucleotide
ggggatggaaccttccagaactgggc

SEQ ID NO: 11413 - DNA, 26 bp, Artificial Sequence
  Description of Artificial Sequence: Synthetic oligonucleotide
gggatggaaccttccagaactgggcg

SEQ ID NO: 11414 - DNA, 26 bp, Artificial Sequence
  Description of Artificial Sequence: Synthetic oligonucleotide
ggatggaaccttccagaactgggcgg

SEQ ID NO: 11415 - DNA, 27 bp, Artificial Sequence
  Description of Artificial Sequence: Synthetic oligonucleotide
gatggaaccttccagaactgggcggct

SEQ ID NO: 11416 - DNA, 27 bp, Artificial Sequence
  Description of Artificial Sequence: Synthetic oligonucleotide
atggaaccttccagaactgggcggctg

SEQ ID NO: 11417 - DNA, 27 bp, Artificial Sequence
  Description of Artificial Sequence: Synthetic oligonucleotide
tggaaccttccagaactgggcggctgt

SEQ ID NO: 11418 - DNA, 26 bp, Artificial Sequence
  Description of Artificial Sequence: Synthetic oligonucleotide
ggaaccttccagaactgggcggctgt

SEQ ID NO: 11419 - DNA, 26 bp, Artificial Sequence
  Description of Artificial Sequence: Synthetic oligonucleotide
gaaccttccagaactgggcggctgtg

SEQ ID NO: 11420 - DNA, 27 bp, Artificial Sequence
  Description of Artificial Sequence: Synthetic oligonucleotide
aaccttccagaactgggcggctgtggt

SEQ ID NO: 11421 - DNA, 26 bp, Artificial Sequence
  Description of Artificial Sequence: Synthetic oligonucleotide
accttccagaactgggcggctgtggt

SEQ ID NO: 11422 - DNA, 25 bp, Artificial Sequence
  Description of Artificial Sequence: Synthetic oligonucleotide
ccttccagaactgggcggctgtggt

SEQ ID NO: 11423 - DNA, 25 bp, Artificial Sequence
  Description of Artificial Sequence: Synthetic oligonucleotide
cttccagaactgggcggctgtggtg

SEQ ID NO: 11424 - DNA, 26 bp, Artificial Sequence
  Description of Artificial Sequence: Synthetic oligonucleotide
ttccagaactgggcggctgtggtggt

SEQ ID NO: 11425 - DNA, 25 bp, Artificial Sequence
  Description of Artificial Sequence: Synthetic oligonucleotide
tccagaactgggcggctgtggtggt

SEQ ID NO: 11426 - DNA, 24 bp, Artificial Sequence
  Description of Artificial Sequence: Synthetic oligonucleotide
ccagaactgggcggctgtggtggt

SEQ ID NO: 11427 - DNA, 24 bp, Artificial Sequence
  Description of Artificial Sequence: Synthetic oligonucleotide
cagaactgggcggctgtggtggtg

SEQ ID NO: 11428 - DNA, 24 bp, Artificial Sequence
  Description of Artificial Sequence: Synthetic oligonucleotide
agaactgggcggctgtggtggtgc

SEQ ID NO: 11429 - DNA, 23 bp, Artificial Sequence
  Description of Artificial Sequence: Synthetic oligonucleotide
gaactgggcggctgtggtggtgc

SEQ ID NO: 11430 - DNA, 25 bp, Artificial Sequence
  Description of Artificial Sequence: Synthetic oligonucleotide
aactgggcggctgtggtggtgcctt

SEQ ID NO: 11431 - DNA, 24 bp, Artificial Sequence
  Description of Artificial Sequence: Synthetic oligonucleotide
actgggcggctgtggtggtgcctt

SEQ ID NO: 11432 - DNA, 23 bp, Artificial Sequence
  Description of Artificial Sequence: Synthetic oligonucleotide
ctgggcggctgtggtggtgcctt

SEQ ID NO: 11433 - DNA, 26 bp, Artificial Sequence
  Description of Artificial Sequence: Synthetic oligonucleotide
gacatggcggctcagatcaccaagcc

SEQ ID NO: 11434 - DNA, 27 bp, Artificial Sequence
  Description of Artificial Sequence: Synthetic oligonucleotide
acatggcggctcagatcaccaagccca

SEQ ID NO: 11435 - DNA, 27 bp, Artificial Sequence
  Description of Artificial Sequence: Synthetic oligonucleotide
catggcggctcagatcaccaagcccaa

SEQ ID NO: 11436 - DNA, 27 bp, Artificial Sequence
  Description of Artificial Sequence: Synthetic oligonucleotide
atggcggctcagatcaccaagcccaag

SEQ ID NO: 11437 - DNA, 27 bp, Artificial Sequence
  Description of Artificial Sequence: Synthetic oligonucleotide
tggcggctcagatcaccaagcccaagt

SEQ ID NO: 11438 - DNA, 26 bp, Artificial Sequence
  Description of Artificial Sequence: Synthetic oligonucleotide
ggcggctcagatcaccaagcccaagt

SEQ ID NO: 11439 - DNA, 26 bp, Artificial Sequence
  Description of Artificial Sequence: Synthetic oligonucleotide
gcggctcagatcaccaagcccaagtg

SEQ ID NO: 11440 - DNA, 26 bp, Artificial Sequence
  Description of Artificial Sequence: Synthetic oligonucleotide
cggctcagatcaccaagcccaagtgg

SEQ ID NO: 11441 - DNA, 27 bp, Artificial Sequence
  Description of Artificial Sequence: Synthetic oligonucleotide
ggctcagatcaccaagcccaagtggga

SEQ ID NO: 11442 - DNA, 27 bp, Artificial Sequence
  Description of Artificial Sequence: Synthetic oligonucleotide
gctcagatcaccaagcccaagtgggag

SEQ ID NO: 11443 - DNA, 27 bp, Artificial Sequence
  Description of Artificial Sequence: Synthetic oligonucleotide
ctcagatcaccaagcccaagtgggagg

SEQ ID NO: 11444 - DNA, 27 bp, Artificial Sequence
  Description of Artificial Sequence: Synthetic oligonucleotide
tcagatcaccaagcccaagtgggaggc

SEQ ID NO: 11445 - DNA, 26 bp, Artificial Sequence
  Description of Artificial Sequence: Synthetic oligonucleotide
cagatcaccaagcccaagtgggaggc

SEQ ID NO: 11446 - DNA, 26 bp, Artificial Sequence
  Description of Artificial Sequence: Synthetic oligonucleotide
agatcaccaagcccaagtgggaggcg

SEQ ID NO: 11447 - DNA, 25 bp, Artificial Sequence
  Description of Artificial Sequence: Synthetic oligonucleotide
gatcaccaagcccaagtgggaggcg

SEQ ID NO: 11448 - DNA, 25 bp, Artificial Sequence
  Description of Artificial Sequence: Synthetic oligonucleotide
atcaccaagcccaagtgggaggcgg

SEQ ID NO: 11449 - DNA, 24 bp, Artificial Sequence
  Description of Artificial Sequence: Synthetic oligonucleotide
tcaccaagcccaagtgggaggcgg

SEQ ID NO: 11450 - DNA, 23 bp, Artificial Sequence
  Description of Artificial Sequence: Synthetic oligonucleotide
caccaagcccaagtgggaggcgg

SEQ ID NO: 11451 - DNA, 23 bp, Artificial Sequence
  Description of Artificial Sequence: Synthetic oligonucleotide
accaagcccaagtgggaggcggc

SEQ ID NO: 11452 - DNA, 22 bp, Artificial Sequence
  Description of Artificial Sequence: Synthetic oligonucleotide
ccaagcccaagtgggaggcggc

SEQ ID NO: 11453 - DNA, 22 bp, Artificial Sequence
  Description of Artificial Sequence: Synthetic oligonucleotide
caagcccaagtgggaggcggcc

SEQ ID NO: 11454 - DNA, 24 bp, Artificial Sequence
  Description of Artificial Sequence: Synthetic oligonucleotide
aagcccaagtgggaggcggcccat

SEQ ID NO: 11455 - DNA, 23 bp, Artificial Sequence
  Description of Artificial Sequence: Synthetic oligonucleotide
agcccaagtgggaggcggcccat

SEQ ID NO: 11456 - DNA, 22 bp, Artificial Sequence
  Description of Artificial Sequence: Synthetic oligonucleotide
gcccaagtgggaggcggcccat

SEQ ID NO: 11457 - DNA, 23 bp, Artificial Sequence
  Description of Artificial Sequence: Synthetic oligonucleotide
cccaagtgggaggcggcccatga

SEQ ID NO: 11458 - DNA, 23 bp, Artificial Sequence
  Description of Artificial Sequence: Synthetic oligonucleotide
ccaagtgggaggcggcccatgag

SEQ ID NO: 11459 - DNA, 35 bp, Artificial Sequence
  Description of Artificial Sequence: Synthetic oligonucleotide
gttctcacaccatccagataatgtatggctgctac

SEQ ID NO: 11460 - DNA, 35 bp, Artificial Sequence
  Description of Artificial Sequence: Synthetic oligonucleotide
ttctcacaccatccagataatgtatggctgctacg

SEQ ID NO: 11461 - DNA, 34 bp, Artificial Sequence
  Description of Artificial Sequence: Synthetic oligonucleotide
tctcacaccatccagataatgtatggctgctacg

SEQ ID NO: 11462 - DNA, 33 bp, Artificial Sequence
  Description of Artificial Sequence: Synthetic oligonucleotide
ctcacaccatccagataatgtatggctgctacg

SEQ ID NO: 11463 - DNA, 34 bp, Artificial Sequence
  Description of Artificial Sequence: Synthetic oligonucleotide
tcacaccatccagataatgtatggctgctacgtg

SEQ ID NO: 11464 - DNA, 33 bp, Artificial Sequence
  Description of Artificial Sequence: Synthetic oligonucleotide
cacaccatccagataatgtatggctgctacgtg

SEQ ID NO: 11465 - DNA, 33 bp, Artificial Sequence
  Description of Artificial Sequence: Synthetic oligonucleotide
acaccatccagataatgtatggctgctacgtgg

SEQ ID NO: 11466 - DNA, 32 bp, Artificial Sequence
  Description of Artificial Sequence: Synthetic oligonucleotide
caccatccagataatgtatggctgctacgtgg

SEQ ID NO: 11467 - DNA, 32 bp, Artificial Sequence
  Description of Artificial Sequence: Synthetic oligonucleotide
accatccagataatgtatggctgctacgtggg

SEQ ID NO: 11468 - DNA, 31 bp, Artificial Sequence
  Description of Artificial Sequence: Synthetic oligonucleotide
ccatccagataatgtatggctgctacgtggg

SEQ ID NO: 11469 - DNA, 31 bp, Artificial Sequence
  Description of Artificial Sequence: Synthetic oligonucleotide
catccagataatgtatggctgctacgtgggg

SEQ ID NO: 11470 - DNA, 32 bp, Artificial Sequence
  Description of Artificial Sequence: Synthetic oligonucleotide
atccagataatgtatggctgctacgtggggtc

SEQ ID NO: 11471 - DNA, 31 bp, Artificial Sequence
  Description of Artificial Sequence: Synthetic oligonucleotide
tccagataatgtatggctgctacgtggggtc

SEQ ID NO: 11472 - DNA, 30 bp, Artificial Sequence
  Description of Artificial Sequence: Synthetic oligonucleotide
ccagataatgtatggctgctacgtggggtc

SEQ ID NO: 11473 - DNA, 30 bp, Artificial Sequence
  Description of Artificial Sequence: Synthetic oligonucleotide
cagataatgtatggctgctacgtggggtcg

SEQ ID NO: 11474 - DNA, 30 bp, Artificial Sequence
  Description of Artificial Sequence: Synthetic oligonucleotide
agataatgtatggctgctacgtggggtcgg

SEQ ID NO: 11475 - DNA, 29 bp, Artificial Sequence
  Description of Artificial Sequence: Synthetic oligonucleotide
gataatgtatggctgctacgtggggtcgg

SEQ ID NO: 11476 - DNA, 30 bp, Artificial Sequence
  Description of Artificial Sequence: Synthetic oligonucleotide
ataatgtatggctgctacgtggggtcggac

SEQ ID NO: 11477 - DNA, 29 bp, Artificial Sequence
  Description of Artificial Sequence: Synthetic oligonucleotide
taatgtatggctgctacgtggggtcggac

SEQ ID NO: 11478 - DNA, 28 bp, Artificial Sequence
  Description of Artificial Sequence: Synthetic oligonucleotide
aatgtatggctgctacgtggggtcggac

SEQ ID NO: 11479 - DNA, 27 bp, Artificial Sequence
  Description of Artificial Sequence: Synthetic oligonucleotide
atgtatggctgctacgtggggtcggac

SEQ ID NO: 11480 - DNA, 26 bp, Artificial Sequence
  Description of Artificial Sequence: Synthetic oligonucleotide
tgtatggctgctacgtggggtcggac

SEQ ID NO: 11481 - DNA, 25 bp, Artificial Sequence
  Description of Artificial Sequence: Synthetic oligonucleotide
gtatggctgctacgtggggtcggac

SEQ ID NO: 11482 - DNA, 25 bp, Artificial Sequence
  Description of Artificial Sequence: Synthetic oligonucleotide
tatggctgctacgtggggtcggacg

SEQ ID NO: 11483 - DNA, 24 bp, Artificial Sequence
  Description of Artificial Sequence: Synthetic oligonucleotide
atggctgctacgtggggtcggacg

SEQ ID NO: 11484 - DNA, 23 bp, Artificial Sequence
  Description of Artificial Sequence: Synthetic oligonucleotide
tggctgctacgtggggtcggacg

SEQ ID NO: 11485 - DNA, 22 bp, Artificial Sequence
  Description of Artificial Sequence: Synthetic oligonucleotide
ggctgctacgtggggtcggacg

SEQ ID NO: 11486 - DNA, 22 bp, Artificial Sequence
  Description of Artificial Sequence: Synthetic oligonucleotide
gctgctacgtggggtcggacgg

SEQ ID NO: 11487 - DNA, 22 bp, Artificial Sequence
  Description of Artificial Sequence: Synthetic oligonucleotide
ctgctacgtggggtcggacggg

SEQ ID NO: 11488 - DNA, 22 bp, Artificial Sequence
  Description of Artificial Sequence: Synthetic oligonucleotide
tgctacgtggggtcggacgggc

SEQ ID NO: 11489 - DNA, 21 bp, Artificial Sequence
  Description of Artificial Sequence: Synthetic oligonucleotide
gctacgtggggtcggacgggc

SEQ ID NO: 11490 - DNA, 21 bp, Artificial Sequence
  Description of Artificial Sequence: Synthetic oligonucleotide
ctacgtggggtcggacgggcg

SEQ ID NO: 11491 - DNA, 23 bp, Artificial Sequence
  Description of Artificial Sequence: Synthetic oligonucleotide
tacgtggggtcggacgggcgctt

SEQ ID NO: 11492 - DNA, 27 bp, Artificial Sequence
  Description of Artificial Sequence: Synthetic oligonucleotide
cagttgagagcctacctggatggcacc

SEQ ID NO: 11493 - DNA, 28 bp, Artificial Sequence
  Description of Artificial Sequence: Synthetic oligonucleotide
agttgagagcctacctggatggcacctg

SEQ ID NO: 11494 - DNA, 27 bp, Artificial Sequence
  Description of Artificial Sequence: Synthetic oligonucleotide
gttgagagcctacctggatggcacctg

SEQ ID NO: 11495 - DNA, 27 bp, Artificial Sequence
  Description of Artificial Sequence: Synthetic oligonucleotide
ttgagagcctacctggatggcacctgc

SEQ ID NO: 11496 - DNA, 27 bp, Artificial Sequence
  Description of Artificial Sequence: Synthetic oligonucleotide
tgagagcctacctggatggcacctgca

SEQ ID NO: 11497 - DNA, 27 bp, Artificial Sequence
  Description of Artificial Sequence: Synthetic oligonucleotide
gagagcctacctggatggcacctgcat

SEQ ID NO: 11498 - DNA, 27 bp, Artificial Sequence
  Description of Artificial Sequence: Synthetic oligonucleotide
agagcctacctggatggcacctgcatg

SEQ ID NO: 11499 - DNA, 26 bp, Artificial Sequence
  Description of Artificial Sequence: Synthetic oligonucleotide
gagcctacctggatggcacctgcatg

SEQ ID NO: 11500 - DNA, 27 bp, Artificial Sequence
  Description of Artificial Sequence: Synthetic oligonucleotide
agcctacctggatggcacctgcatgga

SEQ ID NO: 11501 - DNA, 26 bp, Artificial Sequence
  Description of Artificial Sequence: Synthetic oligonucleotide
gcctacctggatggcacctgcatgga

SEQ ID NO: 11502 - DNA, 27 bp, Artificial Sequence
  Description of Artificial Sequence: Synthetic oligonucleotide
cctacctggatggcacctgcatggagt

SEQ ID NO: 11503 - DNA, 27 bp, Artificial Sequence
  Description of Artificial Sequence: Synthetic oligonucleotide
ctacctggatggcacctgcatggagtg

SEQ ID NO: 11504 - DNA, 27 bp, Artificial Sequence
  Description of Artificial Sequence: Synthetic oligonucleotide
tacctggatggcacctgcatggagtgg

SEQ ID NO: 11505 - DNA, 26 bp, Artificial Sequence
  Description of Artificial Sequence: Synthetic oligonucleotide
acctggatggcacctgcatggagtgg

SEQ ID NO: 11506 - DNA, 25 bp, Artificial Sequence
  Description of Artificial Sequence: Synthetic oligonucleotide
cctggatggcacctgcatggagtgg

SEQ ID NO: 11507 - DNA, 26 bp, Artificial Sequence
  Description of Artificial Sequence: Synthetic oligonucleotide
ctggatggcacctgcatggagtggct

SEQ ID NO: 11508 - DNA, 26 bp, Artificial Sequence
  Description of Artificial Sequence: Synthetic oligonucleotide
tggatggcacctgcatggagtggctc

SEQ ID NO: 11509 - DNA, 25 bp, Artificial Sequence
  Description of Artificial Sequence: Synthetic oligonucleotide
ggatggcacctgcatggagtggctc

SEQ ID NO: 11510 - DNA, 25 bp, Artificial Sequence
  Description of Artificial Sequence: Synthetic oligonucleotide
gatggcacctgcatggagtggctcc

SEQ ID NO: 11511 - DNA, 25 bp, Artificial Sequence
  Description of Artificial Sequence: Synthetic oligonucleotide
atggcacctgcatggagtggctccg

SEQ ID NO: 11512 - DNA, 24 bp, Artificial Sequence
  Description of Artificial Sequence: Synthetic oligonucleotide
tggcacctgcatggagtggctccg

SEQ ID NO: 11513 - DNA, 23 bp, Artificial Sequence
  Description of Artificial Sequence: Synthetic oligonucleotide
ggcacctgcatggagtggctccg

SEQ ID NO: 11514 - DNA, 24 bp, Artificial Sequence
  Description of Artificial Sequence: Synthetic oligonucleotide
gcacctgcatggagtggctccgca

SEQ ID NO: 11515 - DNA, 27 bp, Artificial Sequence
  Description of Artificial Sequence: Synthetic oligonucleotide
cacctgcatggagtggctccgcagata

SEQ ID NO: 11516 - DNA, 27 bp, Artificial Sequence
  Description of Artificial Sequence: Synthetic oligonucleotide
acctgcatggagtggctccgcagatac

SEQ ID NO: 11517 - DNA, 26 bp, Artificial Sequence
  Description of Artificial Sequence: Synthetic oligonucleotide
cctgcatggagtggctccgcagatac

SEQ ID NO: 11518 - DNA, 27 bp, Artificial Sequence
  Description of Artificial Sequence: Synthetic oligonucleotide
ctgcatggagtggctccgcagatacct

SEQ ID NO: 11519 - DNA, 23 bp, Artificial Sequence
  Description of Artificial Sequence: Synthetic oligonucleotide
tcttggaccgcggcggacttggc

SEQ ID NO: 11520 - DNA, 22 bp, Artificial Sequence
  Description of Artificial Sequence: Synthetic oligonucleotide
cttggaccgcggcggacttggc

SEQ ID NO: 11521 - DNA, 22 bp, Artificial Sequence
  Description of Artificial Sequence: Synthetic oligonucleotide
ttggaccgcggcggacttggcg

SEQ ID NO: 11522 - DNA, 21 bp, Artificial Sequence
  Description of Artificial Sequence: Synthetic oligonucleotide
tggaccgcggcggacttggcg

SEQ ID NO: 11523 - DNA, 20 bp, Artificial Sequence
  Description of Artificial Sequence: Synthetic oligonucleotide
ggaccgcggcggacttggcg

SEQ ID NO: 11524 - DNA, 20 bp, Artificial Sequence
  Description of Artificial Sequence: Synthetic oligonucleotide
gaccgcggcggacttggcgg

SEQ ID NO: 11525 - DNA, 21 bp, Artificial Sequence
  Description of Artificial Sequence: Synthetic oligonucleotide
accgcggcggacttggcggct

SEQ ID NO: 11526 - DNA, 20 bp, Artificial Sequence
  Description of Artificial Sequence: Synthetic oligonucleotide
ccgcggcggacttggcggct

SEQ ID NO: 11527 - DNA, 21 bp, Artificial Sequence
  Description of Artificial Sequence: Synthetic oligonucleotide
cgcggcggacttggcggctca

SEQ ID NO: 11528 - DNA, 23 bp, Artificial Sequence
  Description of Artificial Sequence: Synthetic oligonucleotide
gcggcggacttggcggctcagat

SEQ ID NO: 11529 - DNA, 24 bp, Artificial Sequence
  Description of Artificial Sequence: Synthetic oligonucleotide
cggcggacttggcggctcagatca

SEQ ID NO: 11530 - DNA, 24 bp, Artificial Sequence
  Description of Artificial Sequence: Synthetic oligonucleotide
ggcggacttggcggctcagatcac

SEQ ID NO: 11531 - DNA, 26 bp, Artificial Sequence
  Description of Artificial Sequence: Synthetic oligonucleotide
gcggacttggcggctcagatcaccaa

SEQ ID NO: 11532 - DNA, 26 bp, Artificial Sequence
  Description of Artificial Sequence: Synthetic oligonucleotide
cggacttggcggctcagatcaccaag

SEQ ID NO: 11533 - DNA, 26 bp, Artificial Sequence
  Description of Artificial Sequence: Synthetic oligonucleotide
ggacttggcggctcagatcaccaagc

SEQ ID NO: 11534 - DNA, 26 bp, Artificial Sequence
  Description of Artificial Sequence: Synthetic oligonucleotide
gacttggcggctcagatcaccaagcg

SEQ ID NO: 11535 - DNA, 27 bp, Artificial Sequence
  Description of Artificial Sequence: Synthetic oligonucleotide
acttggcggctcagatcaccaagcgca

SEQ ID NO: 11536 - DNA, 27 bp, Artificial Sequence
  Description of Artificial Sequence: Synthetic oligonucleotide
cttggcggctcagatcaccaagcgcaa

SEQ ID NO: 11537 - DNA, 27 bp, Artificial Sequence
  Description of Artificial Sequence: Synthetic oligonucleotide
ttggcggctcagatcaccaagcgcaag

SEQ ID NO: 11538 - DNA, 30 bp, Artificial Sequence
  Description of Artificial Sequence: Synthetic oligonucleotide
gtgccttctggagaggagcagagatacaac

SEQ ID NO: 11539 - DNA, 31 bp, Artificial Sequence
  Description of Artificial Sequence: Synthetic oligonucleotide
tgccttctggagaggagcagagatacaactg

SEQ ID NO: 11540 - DNA, 30 bp, Artificial Sequence
  Description of Artificial Sequence: Synthetic oligonucleotide
gccttctggagaggagcagagatacaactg

SEQ ID NO: 11541 - DNA, 30 bp, Artificial Sequence
  Description of Artificial Sequence: Synthetic oligonucleotide
ccttctggagaggagcagagatacaactgc

SEQ ID NO: 11542 - DNA, 30 bp, Artificial Sequence
  Description of Artificial Sequence: Synthetic oligonucleotide
cttctggagaggagcagagatacaactgcc

SEQ ID NO: 11543 - DNA, 32 bp, Artificial Sequence
  Description of Artificial Sequence: Synthetic oligonucleotide
ttctggagaggagcagagatacaactgccatg

SEQ ID NO: 11544 - DNA, 31 bp, Artificial Sequence
  Description of Artificial Sequence: Synthetic oligonucleotide
tctggagaggagcagagatacaactgccatg

SEQ ID NO: 11545 - DNA, 30 bp, Artificial Sequence
  Description of Artificial Sequence: Synthetic oligonucleotide
ctggagaggagcagagatacaactgccatg

SEQ ID NO: 11546 - DNA, 31 bp, Artificial Sequence
  Description of Artificial Sequence: Synthetic oligonucleotide
tggagaggagcagagatacaactgccatgtg

SEQ ID NO: 11547 - DNA, 30 bp, Artificial Sequence
  Description of Artificial Sequence: Synthetic oligonucleotide
ggagaggagcagagatacaactgccatgtg

SEQ ID NO: 11548 - DNA, 30 bp, Artificial Sequence
  Description of Artificial Sequence: Synthetic oligonucleotide
gagaggagcagagatacaactgccatgtgc

SEQ ID NO: 11549 - DNA, 31 bp, Artificial Sequence
  Description of Artificial Sequence: Synthetic oligonucleotide
agaggagcagagatacaactgccatgtgcag

SEQ ID NO: 11550 - DNA, 30 bp, Artificial Sequence
  Description of Artificial Sequence: Synthetic oligonucleotide
gaggagcagagatacaactgccatgtgcag

SEQ ID NO: 11551 - DNA, 30 bp, Artificial Sequence
  Description of Artificial Sequence: Synthetic oligonucleotide
aggagcagagatacaactgccatgtgcagc

SEQ ID NO: 11552 - DNA, 29 bp, Artificial Sequence
  Description of Artificial Sequence: Synthetic oligonucleotide
ggagcagagatacaactgccatgtgcagc

SEQ ID NO: 11553 - DNA, 31 bp, Artificial Sequence
  Description of Artificial Sequence: Synthetic oligonucleotide
gagcagagatacaactgccatgtgcagcatg

SEQ ID NO: 11554 - DNA, 32 bp, Artificial Sequence
  Description of Artificial Sequence: Synthetic oligonucleotide
agcagagatacaactgccatgtgcagcatgag

SEQ ID NO: 11555 - DNA, 31 bp, Artificial Sequence
  Description of Artificial Sequence: Synthetic oligonucleotide
gcagagatacaactgccatgtgcagcatgag

SEQ ID NO: 11556 - DNA, 31 bp, Artificial Sequence
  Description of Artificial Sequence: Synthetic oligonucleotide
cagagatacaactgccatgtgcagcatgagg

SEQ ID NO: 11557 - DNA, 31 bp, Artificial Sequence
  Description of Artificial Sequence: Synthetic oligonucleotide
agagatacaactgccatgtgcagcatgaggg

SEQ ID NO: 11558 - DNA, 30 bp, Artificial Sequence
  Description of Artificial Sequence: Synthetic oligonucleotide
gagatacaactgccatgtgcagcatgaggg

SEQ ID NO: 11559 - DNA, 31 bp, Artificial Sequence
  Description of Artificial Sequence: Synthetic oligonucleotide
agatacaactgccatgtgcagcatgagggtc

SEQ ID NO: 11560 - DNA, 30 bp, Artificial Sequence
  Description of Artificial Sequence: Synthetic oligonucleotide
gatacaactgccatgtgcagcatgagggtc

SEQ ID NO: 11561 - DNA, 31 bp, Artificial Sequence
  Description of Artificial Sequence: Synthetic oligonucleotide
atacaactgccatgtgcagcatgagggtctg

SEQ ID NO: 11562 - DNA, 30 bp, Artificial Sequence
  Description of Artificial Sequence: Synthetic oligonucleotide
tacaactgccatgtgcagcatgagggtctg

SEQ ID NO: 11563 - DNA, 29 bp, Artificial Sequence
  Description of Artificial Sequence: Synthetic oligonucleotide
acaactgccatgtgcagcatgagggtctg

SEQ ID NO: 11564 - DNA, 28 bp, Artificial Sequence
  Description of Artificial Sequence: Synthetic oligonucleotide
caactgccatgtgcagcatgagggtctg

SEQ ID NO: 11565 - DNA, 28 bp, Artificial Sequence
  Description of Artificial Sequence: Synthetic oligonucleotide
aactgccatgtgcagcatgagggtctgc

SEQ ID NO: 11566 - DNA, 27 bp, Artificial Sequence
  Description of Artificial Sequence: Synthetic oligonucleotide
actgccatgtgcagcatgagggtctgc

SEQ ID NO: 11567 - DNA, 28 bp, Artificial Sequence
  Description of Artificial Sequence: Synthetic oligonucleotide
ggcaaggattacatcgccctgaacgagc

SEQ ID NO: 11568 - DNA, 29 bp, Artificial Sequence
  Description of Artificial Sequence: Synthetic oligonucleotide
gcaaggattacatcgccctgaacgagcac

SEQ ID NO: 11569 - DNA, 29 bp, Artificial Sequence
  Description of Artificial Sequence: Synthetic oligonucleotide
caaggattacatcgccctgaacgagcacc

SEQ ID NO: 11570 - DNA, 30 bp, Artificial Sequence
  Description of Artificial Sequence: Synthetic oligonucleotide
aaggattacatcgccctgaacgagcacctg

SEQ ID NO: 11571 - DNA, 29 bp, Artificial Sequence
  Description of Artificial Sequence: Synthetic oligonucleotide
aggattacatcgccctgaacgagcacctg

SEQ ID NO: 11572 - DNA, 28 bp, Artificial Sequence
  Description of Artificial Sequence: Synthetic oligonucleotide
ggattacatcgccctgaacgagcacctg

SEQ ID NO: 11573 - DNA, 28 bp, Artificial Sequence
  Description of Artificial Sequence: Synthetic oligonucleotide
gattacatcgccctgaacgagcacctgc

SEQ ID NO: 11574 - DNA, 28 bp, Artificial Sequence
  Description of Artificial Sequence: Synthetic oligonucleotide
attacatcgccctgaacgagcacctgcg

SEQ ID NO: 11575 - DNA, 27 bp, Artificial Sequence
  Description of Artificial Sequence: Synthetic oligonucleotide
ttacatcgccctgaacgagcacctgcg

SEQ ID NO: 11576 - DNA, 26 bp, Artificial Sequence
  Description of Artificial Sequence: Synthetic oligonucleotide
tacatcgccctgaacgagcacctgcg

SEQ ID NO: 11577 - DNA, 25 bp, Artificial Sequence
  Description of Artificial Sequence: Synthetic oligonucleotide
acatcgccctgaacgagcacctgcg

SEQ ID NO: 11578 - DNA, 24 bp, Artificial Sequence
  Description of Artificial Sequence: Synthetic oligonucleotide
catcgccctgaacgagcacctgcg

SEQ ID NO: 11579 - DNA, 25 bp, Artificial Sequence
  Description of Artificial Sequence: Synthetic oligonucleotide
atcgccctgaacgagcacctgcgct

SEQ ID NO: 11580 - DNA, 24 bp, Artificial Sequence
  Description of Artificial Sequence: Synthetic oligonucleotide
tcgccctgaacgagcacctgcgct

SEQ ID NO: 11581 - DNA, 23 bp, Artificial Sequence
  Description of Artificial Sequence: Synthetic oligonucleotide
cgccctgaacgagcacctgcgct

SEQ ID NO: 11582 - DNA, 25 bp, Artificial Sequence
  Description of Artificial Sequence: Synthetic oligonucleotide
gccctgaacgagcacctgcgctctt

SEQ ID NO: 11583 - DNA, 25 bp, Artificial Sequence
  Description of Artificial Sequence: Synthetic oligonucleotide
ccctgaacgagcacctgcgctcttg

SEQ ID NO: 11584 - DNA, 26 bp, Artificial Sequence
  Description of Artificial Sequence: Synthetic oligonucleotide
cctgaacgagcacctgcgctcttgga

SEQ ID NO: 11585 - DNA, 26 bp, Artificial Sequence
  Description of Artificial Sequence: Synthetic oligonucleotide
ctgaacgagcacctgcgctcttggac

SEQ ID NO: 11586 - DNA, 26 bp, Artificial Sequence
  Description of Artificial Sequence: Synthetic oligonucleotide
tgaacgagcacctgcgctcttggacc

SEQ ID NO: 11587 - DNA, 25 bp, Artificial Sequence
  Description of Artificial Sequence: Synthetic oligonucleotide
gaacgagcacctgcgctcttggacc

SEQ ID NO: 11588 - DNA, 25 bp, Artificial Sequence
  Description of Artificial Sequence: Synthetic oligonucleotide
aacgagcacctgcgctcttggaccg

SEQ ID NO: 11589 - DNA, 24 bp, Artificial Sequence
  Description of Artificial Sequence: Synthetic oligonucleotide
acgagcacctgcgctcttggaccg

SEQ ID NO: 11590 - DNA, 23 bp, Artificial Sequence
  Description of Artificial Sequence: Synthetic oligonucleotide
cgagcacctgcgctcttggaccg

SEQ ID NO: 11591 - DNA, 23 bp, Artificial Sequence
  Description of Artificial Sequence: Synthetic oligonucleotide
gagcacctgcgctcttggaccgc

SEQ ID NO: 11592 - DNA, 23 bp, Artificial Sequence
  Description of Artificial Sequence: Synthetic oligonucleotide
agcacctgcgctcttggaccgcg

SEQ ID NO: 11593 - DNA, 22 bp, Artificial Sequence
  Description of Artificial Sequence: Synthetic oligonucleotide
gcacctgcgctcttggaccgcg

SEQ ID NO: 11594 - DNA, 22 bp, Artificial Sequence
  Description of Artificial Sequence: Synthetic oligonucleotide
cacctgcgctcttggaccgcgg

SEQ ID NO: 11595 - DNA, 24 bp, Artificial Sequence
  Description of Artificial Sequence: Synthetic oligonucleotide
accgagtggacctggggaccctga

SEQ ID NO: 11596 - DNA, 23 bp, Artificial Sequence
  Description of Artificial Sequence: Synthetic oligonucleotide
ccgagtggacctggggaccctga

SEQ ID NO: 11597 - DNA, 23 bp, Artificial Sequence
  Description of Artificial Sequence: Synthetic oligonucleotide
cgagtggacctggggaccctgag

SEQ ID NO: 11598 - DNA, 23 bp, Artificial Sequence
  Description of Artificial Sequence: Synthetic oligonucleotide
gagtggacctggggaccctgagc

SEQ ID NO: 11599 - DNA, 23 bp, Artificial Sequence
  Description of Artificial Sequence: Synthetic oligonucleotide
agtggacctggggaccctgagcg

SEQ ID NO: 11600 - DNA, 22 bp, Artificial Sequence
  Description of Artificial Sequence: Synthetic oligonucleotide
gtggacctggggaccctgagcg

SEQ ID NO: 11601 - DNA, 22 bp, Artificial Sequence
  Description of Artificial Sequence: Synthetic oligonucleotide
tggacctggggaccctgagcgg

SEQ ID NO: 11602 - DNA, 21 bp, Artificial Sequence
  Description of Artificial Sequence: Synthetic oligonucleotide
ggacctggggaccctgagcgg

SEQ ID NO: 11603 - DNA, 23 bp, Artificial Sequence
  Description of Artificial Sequence: Synthetic oligonucleotide
gacctggggaccctgagcggcta

SEQ ID NO: 11604 - DNA, 25 bp, Artificial Sequence
  Description of Artificial Sequence: Synthetic oligonucleotide
acctggggaccctgagcggctacta

SEQ ID NO: 11605 - DNA, 24 bp, Artificial Sequence
  Description of Artificial Sequence: Synthetic oligonucleotide
cctggggaccctgagcggctacta

SEQ ID NO: 11606 - DNA, 26 bp, Artificial Sequence
  Description of Artificial Sequence: Synthetic oligonucleotide
ctggggaccctgagcggctactacaa

SEQ ID NO: 11607 - DNA, 26 bp, Artificial Sequence
  Description of Artificial Sequence: Synthetic oligonucleotide
tggggaccctgagcggctactacaac

SEQ ID NO: 11608 - DNA, 25 bp, Artificial Sequence
  Description of Artificial Sequence: Synthetic oligonucleotide
ggggaccctgagcggctactacaac

SEQ ID NO: 11609 - DNA, 26 bp, Artificial Sequence
  Description of Artificial Sequence: Synthetic oligonucleotide
gggaccctgagcggctactacaacca

SEQ ID NO: 11610 - DNA, 27 bp, Artificial Sequence
  Description of Artificial Sequence: Synthetic oligonucleotide
ggaccctgagcggctactacaaccaga

SEQ ID NO: 11611 - DNA, 27 bp, Artificial Sequence
  Description of Artificial Sequence: Synthetic oligonucleotide
gaccctgagcggctactacaaccagag

SEQ ID NO: 11612 - DNA, 27 bp, Artificial Sequence
  Description of Artificial Sequence: Synthetic oligonucleotide
accctgagcggctactacaaccagagc

SEQ ID NO: 11613 - DNA, 26 bp, Artificial Sequence
  Description of Artificial Sequence: Synthetic oligonucleotide
ccctgagcggctactacaaccagagc

SEQ ID NO: 11614 - DNA, 27 bp, Artificial Sequence
  Description of Artificial Sequence: Synthetic oligonucleotide
cctgagcggctactacaaccagagcga

SEQ ID NO: 11615 - DNA, 27 bp, Artificial Sequence
  Description of Artificial Sequence: Synthetic oligonucleotide
ctgagcggctactacaaccagagcgag

SEQ ID NO: 11616 - DNA, 27 bp, Artificial Sequence
  Description of Artificial Sequence: Synthetic oligonucleotide
tgagcggctactacaaccagagcgagg

SEQ ID NO: 11617 - DNA, 26 bp, Artificial Sequence
  Description of Artificial Sequence: Synthetic oligonucleotide
gagcggctactacaaccagagcgagg

SEQ ID NO: 11618 - DNA, 26 bp, Artificial Sequence
  Description of Artificial Sequence: Synthetic oligonucleotide
agcggctactacaaccagagcgaggc

SEQ ID NO: 11619 - DNA, 22 bp, Artificial Sequence
  Description of Artificial Sequence: Synthetic oligonucleotide
ccccgcttcatcgccgtgggct

SEQ ID NO: 11620 - DNA, 22 bp, Artificial Sequence
  Description of Artificial Sequence: Synthetic oligonucleotide
cccgcttcatcgccgtgggctc

SEQ ID NO: 11621 - DNA, 22 bp, Artificial Sequence
  Description of Artificial Sequence: Synthetic oligonucleotide
ccgcttcatcgccgtgggctcc

SEQ ID NO: 11622 - DNA, 23 bp, Artificial Sequence
  Description of Artificial Sequence: Synthetic oligonucleotide
cgcttcatcgccgtgggctccgt

SEQ ID NO: 11623 - DNA, 23 bp, Artificial Sequence
  Description of Artificial Sequence: Synthetic oligonucleotide
gcttcatcgccgtgggctccgtg

SEQ ID NO: 11624 - DNA, 24 bp, Artificial Sequence
  Description of Artificial Sequence: Synthetic oligonucleotide
cttcatcgccgtgggctccgtgga

SEQ ID NO: 11625 - DNA, 24 bp, Artificial Sequence
  Description of Artificial Sequence: Synthetic oligonucleotide
ttcatcgccgtgggctccgtggac

SEQ ID NO: 11626 - DNA, 23 bp, Artificial Sequence
  Description of Artificial Sequence: Synthetic oligonucleotide
tcatcgccgtgggctccgtggac

SEQ ID NO: 11627 - DNA, 22 bp, Artificial Sequence
  Description of Artificial Sequence: Synthetic oligonucleotide
catcgccgtgggctccgtggac

SEQ ID NO: 11628 - DNA, 23 bp, Artificial Sequence
  Description of Artificial Sequence: Synthetic oligonucleotide
atcgccgtgggctccgtggacga

SEQ ID NO: 11629 - DNA, 22 bp, Artificial Sequence
  Description of Artificial Sequence: Synthetic oligonucleotide
tcgccgtgggctccgtggacga

SEQ ID NO: 11630 - DNA, 21 bp, Artificial Sequence
  Description of Artificial Sequence: Synthetic oligonucleotide
cgccgtgggctccgtggacga

SEQ ID NO: 11631 - DNA, 22 bp, Artificial Sequence
  Description of Artificial Sequence: Synthetic oligonucleotide
gccgtgggctccgtggacgaca

SEQ ID NO: 11632 - DNA, 22 bp, Artificial Sequence
  Description of Artificial Sequence: Synthetic oligonucleotide
ccgtgggctccgtggacgacac

SEQ ID NO: 11633 - DNA, 22 bp, Artificial Sequence
  Description of Artificial Sequence: Synthetic oligonucleotide
cgtgggctccgtggacgacacg

SEQ ID NO: 11634 - DNA, 23 bp, Artificial Sequence
  Description of Artificial Sequence: Synthetic oligonucleotide
gtgggctccgtggacgacacgca

SEQ ID NO: 11635 - DNA, 25 bp, Artificial Sequence
  Description of Artificial Sequence: Synthetic oligonucleotide
tgggctccgtggacgacacgcagtt

SEQ ID NO: 11636 - DNA, 24 bp, Artificial Sequence
  Description of Artificial Sequence: Synthetic oligonucleotide
gggctccgtggacgacacgcagtt

SEQ ID NO: 11637 - DNA, 24 bp, Artificial Sequence
  Description of Artificial Sequence: Synthetic oligonucleotide
ggctccgtggacgacacgcagttc

SEQ ID NO: 11638 - DNA, 25 bp, Artificial Sequence
  Description of Artificial Sequence: Synthetic oligonucleotide
gctccgtggacgacacgcagttcgt

SEQ ID NO: 11639 - DNA, 25 bp, Artificial Sequence
  Description of Artificial Sequence: Synthetic oligonucleotide
ctccgtggacgacacgcagttcgtg

SEQ ID NO: 11640 - DNA, 25 bp, Artificial Sequence
  Description of Artificial Sequence: Synthetic oligonucleotide
tccgtggacgacacgcagttcgtgc

SEQ ID NO: 11641 - DNA, 24 bp, Artificial Sequence
  Description of Artificial Sequence: Synthetic oligonucleotide
ccgtggacgacacgcagttcgtgc

SEQ ID NO: 11642 - DNA, 20 bp, Artificial Sequence
  Description of Artificial Sequence: Synthetic oligonucleotide
ggaggcggcccatgaggcgg

SEQ ID NO: 11643 - DNA, 20 bp, Artificial Sequence
  Description of Artificial Sequence: Synthetic oligonucleotide
gaggcggcccatgaggcggg

SEQ ID NO: 11644 - DNA, 20 bp, Artificial Sequence
  Description of Artificial Sequence: Synthetic oligonucleotide
aggcggcccatgaggcgggg

SEQ ID NO: 11645 - DNA, 20 bp, Artificial Sequence
  Description of Artificial Sequence: Synthetic oligonucleotide
ggcggcccatgaggcggggt

SEQ ID NO: 11646 - DNA, 20 bp, Artificial Sequence
  Description of Artificial Sequence: Synthetic oligonucleotide
gcggcccatgaggcggggca

SEQ ID NO: 11647 - DNA, 22 bp, Artificial Sequence
  Description of Artificial Sequence: Synthetic oligonucleotide
cggcccatgaggcggggcagtt

SEQ ID NO: 11648 - DNA, 23 bp, Artificial Sequence
  Description of Artificial Sequence: Synthetic oligonucleotide
ggcccatgaggcggggcagttga

SEQ ID NO: 11649 - DNA, 24 bp, Artificial Sequence
  Description of Artificial Sequence: Synthetic oligonucleotide
gcccatgaggcggggcagttgaga

SEQ ID NO: 11650 - DNA, 24 bp, Artificial Sequence
  Description of Artificial Sequence: Synthetic oligonucleotide
cccatgaggcggggcagttgagag

SEQ ID NO: 11651 - DNA, 24 bp, Artificial Sequence
  Description of Artificial Sequence: Synthetic oligonucleotide
ccatgaggcggggcagttgagagc

SEQ ID NO: 11652 - DNA, 26 bp, Artificial Sequence
  Description of Artificial Sequence: Synthetic oligonucleotide
catgaggcggggcagttgagagccta

SEQ ID NO: 11653 - DNA, 26 bp, Artificial Sequence
  Description of Artificial Sequence: Synthetic oligonucleotide
atgaggcggggcagttgagagcctac

SEQ ID NO: 11654 - DNA, 25 bp, Artificial Sequence
  Description of Artificial Sequence: Synthetic oligonucleotide
tgaggcggggcagttgagagcctac

SEQ ID NO: 11655 - DNA, 24 bp, Artificial Sequence
  Description of Artificial Sequence: Synthetic oligonucleotide
gaggcggggcagttgagagcctac

SEQ ID NO: 11656 - DNA, 25 bp, Artificial Sequence
  Description of Artificial Sequence: Synthetic oligonucleotide
aggcggggcagttgagagcctacct

SEQ ID NO: 11657 - DNA, 24 bp, Artificial Sequence
  Description of Artificial Sequence: Synthetic oligonucleotide
ggcggggcagttgagagcctacct

SEQ ID NO: 11658 - DNA, 24 bp, Artificial Sequence
  Description of Artificial Sequence: Synthetic oligonucleotide
gcggggcagttgagagcctacctg

SEQ ID NO: 11659 - DNA, 26 bp, Artificial Sequence
  Description of Artificial Sequence: Synthetic oligonucleotide
cggggcagttgagagcctacctggat

SEQ ID NO: 11660 - DNA, 26 bp, Artificial Sequence
  Description of Artificial Sequence: Synthetic oligonucleotide
ggggcagttgagagcctacctggatg

SEQ ID NO: 11661 - DNA, 26 bp, Artificial Sequence
  Description of Artificial Sequence: Synthetic oligonucleotide
gggcagttgagagcctacctggatgg

SEQ ID NO: 11662 - DNA, 27 bp, Artificial Sequence
  Description of Artificial Sequence: Synthetic oligonucleotide
ggcagttgagagcctacctggatggca

SEQ ID NO: 11663 - DNA, 22 bp, Artificial Sequence
  Description of Artificial Sequence: Synthetic oligonucleotide
gcggcccatgaggcggagcagt

SEQ ID NO: 11664 - DNA, 26 bp, Artificial Sequence
  Description of Artificial Sequence: Synthetic oligonucleotide
cggagcagtggagagcctacctggat

SEQ ID NO: 11665 - DNA, 26 bp, Artificial Sequence
  Description of Artificial Sequence: Synthetic oligonucleotide
ggagcagtggagagcctacctggatg

SEQ ID NO: 11666 - DNA, 26 bp, Artificial Sequence
  Description of Artificial Sequence: Synthetic oligonucleotide
gagcagtggagagcctacctggatgg

SEQ ID NO: 11667 - DNA, 27 bp, Artificial Sequence
  Description of Artificial Sequence: Synthetic oligonucleotide
agcagtggagagcctacctggatggca

SEQ ID NO: 11668 - DNA, 26 bp, Artificial Sequence
  Description of Artificial Sequence: Synthetic oligonucleotide
gcagtggagagcctacctggatggca

SEQ ID NO: 11669 - DNA, 26 bp, Artificial Sequence
  Description of Artificial Sequence: Synthetic oligonucleotide
cagtggagagcctacctggatggcac

SEQ ID NO: 11670 - DNA, 27 bp, Artificial Sequence
  Description of Artificial Sequence: Synthetic oligonucleotide
agtggagagcctacctggatggcacgt

SEQ ID NO: 11671 - DNA, 26 bp, Artificial Sequence
  Description of Artificial Sequence: Synthetic oligonucleotide
gtggagagcctacctggatggcacgt

SEQ ID NO: 11672 - DNA, 26 bp, Artificial Sequence
  Description of Artificial Sequence: Synthetic oligonucleotide
tggagagcctacctggatggcacgtg

SEQ ID NO: 11673 - DNA, 25 bp, Artificial Sequence
  Description of Artificial Sequence: Synthetic oligonucleotide
ggagagcctacctggatggcacgtg

SEQ ID NO: 11674 - DNA, 22 bp, Artificial Sequence
  Description of Artificial Sequence: Synthetic oligonucleotide
ctcttggaccgcggcggacacc

SEQ ID NO: 11675 - DNA, 22 bp, Artificial Sequence
  Description of Artificial Sequence: Synthetic oligonucleotide
tcttggaccgcggcggacaccg

SEQ ID NO: 11676 - DNA, 21 bp, Artificial Sequence
  Description of Artificial Sequence: Synthetic oligonucleotide
cttggaccgcggcggacaccg

SEQ ID NO: 11677 - DNA, 21 bp, Artificial Sequence
  Description of Artificial Sequence: Synthetic oligonucleotide
ttggaccgcggcggacaccgc

SEQ ID NO: 11678 - DNA, 20 bp, Artificial Sequence
  Description of Artificial Sequence: Synthetic oligonucleotide
tggaccgcggcggacaccgc

SEQ ID NO: 11679 - DNA, 20 bp, Artificial Sequence
  Description of Artificial Sequence: Synthetic oligonucleotide
ggaccgcggcggacaccgct

SEQ ID NO: 11680 - DNA, 20 bp, Artificial Sequence
  Description of Artificial Sequence: Synthetic oligonucleotide
gaccgcggcggacaccgcgt

SEQ ID NO: 11681 - DNA, 20 bp, Artificial Sequence
  Description of Artificial Sequence: Synthetic oligonucleotide
accgcggcggacaccgcggt

SEQ ID NO: 11682 - DNA, 20 bp, Artificial Sequence
  Description of Artificial Sequence: Synthetic oligonucleotide
ccgcggcggacaccgcggtt

SEQ ID NO: 11683 - DNA, 20 bp, Artificial Sequence
  Description of Artificial Sequence: Synthetic oligonucleotide
cgcggcggacaccgcggctt

SEQ ID NO: 11684 - DNA, 20 bp, Artificial Sequence
  Description of Artificial Sequence: Synthetic oligonucleotide
gcggcggacaccgcggctca

SEQ ID NO: 11685 - DNA, 22 bp, Artificial Sequence
  Description of Artificial Sequence: Synthetic oligonucleotide
cggcggacaccgcggctcagat

SEQ ID NO: 11686 - DNA, 23 bp, Artificial Sequence
  Description of Artificial Sequence: Synthetic oligonucleotide
ggcggacaccgcggctcagatca

SEQ ID NO: 11687 - DNA, 23 bp, Artificial Sequence
  Description of Artificial Sequence: Synthetic oligonucleotide
gcggacaccgcggctcagatcac

SEQ ID NO: 11688 - DNA, 25 bp, Artificial Sequence
  Description of Artificial Sequence: Synthetic oligonucleotide
cggacaccgcggctcagatcaccaa

SEQ ID NO: 11689 - DNA, 25 bp, Artificial Sequence
  Description of Artificial Sequence: Synthetic oligonucleotide
ggacaccgcggctcagatcaccaag

SEQ ID NO: 11690 - DNA, 25 bp, Artificial Sequence
  Description of Artificial Sequence: Synthetic oligonucleotide
gacaccgcggctcagatcaccaagc

SEQ ID NO: 11691 - DNA, 25 bp, Artificial Sequence
  Description of Artificial Sequence: Synthetic oligonucleotide
acaccgcggctcagatcaccaagcg

SEQ ID NO: 11692 - DNA, 24 bp, Artificial Sequence
  Description of Artificial Sequence: Synthetic oligonucleotide
caccgcggctcagatcaccaagcg

SEQ ID NO: 11693 - DNA, 26 bp, Artificial Sequence
  Description of Artificial Sequence: Synthetic oligonucleotide
accgcggctcagatcaccaagcgcaa

SEQ ID NO: 11694 - DNA, 25 bp, Artificial Sequence
  Description of Artificial Sequence: Synthetic oligonucleotide
ccgcggctcagatcaccaagcgcaa

SEQ ID NO: 11695 - DNA, 26 bp, Artificial Sequence
  Description of Artificial Sequence: Synthetic oligonucleotide
cgcggctcagatcaccaagcgcaagt

SEQ ID NO: 11696 - DNA, 24 bp, Artificial Sequence
  Description of Artificial Sequence: Synthetic oligonucleotide
ctcttggaccgcggcggacatggt

SEQ ID NO: 11697 - DNA, 24 bp, Artificial Sequence
  Description of Artificial Sequence: Synthetic oligonucleotide
tcttggaccgcggcggacatggtg

SEQ ID NO: 11698 - DNA, 23 bp, Artificial Sequence
  Description of Artificial Sequence: Synthetic oligonucleotide
cttggaccgcggcggacatggtg

SEQ ID NO: 11699 - DNA, 23 bp, Artificial Sequence
  Description of Artificial Sequence: Synthetic oligonucleotide
ttggaccgcggcggacatggtgg

SEQ ID NO: 11700 - DNA, 22 bp, Artificial Sequence
  Description of Artificial Sequence: Synthetic oligonucleotide
tggaccgcggcggacatggtgg

SEQ ID NO: 11701 - DNA, 21 bp, Artificial Sequence
  Description of Artificial Sequence: Synthetic oligonucleotide
ggaccgcggcggacatggtgg

SEQ ID NO: 11702 - DNA, 22 bp, Artificial Sequence
  Description of Artificial Sequence: Synthetic oligonucleotide
gaccgcggcggacatggtggct

SEQ ID NO: 11703 - DNA, 23 bp, Artificial Sequence
  Description of Artificial Sequence: Synthetic oligonucleotide
accgcggcggacatggtggctca

SEQ ID NO: 11704 - DNA, 22 bp, Artificial Sequence
  Description of Artificial Sequence: Synthetic oligonucleotide
ccgcggcggacatggtggctca

SEQ ID NO: 11705 - DNA, 24 bp, Artificial Sequence
  Description of Artificial Sequence: Synthetic oligonucleotide
cgcggcggacatggtggctcagat

SEQ ID NO: 11706 - DNA, 25 bp, Artificial Sequence
  Description of Artificial Sequence: Synthetic oligonucleotide
gcggcggacatggtggctcagatca

SEQ ID NO: 11707 - DNA, 25 bp, Artificial Sequence
  Description of Artificial Sequence: Synthetic oligonucleotide
cggcggacatggtggctcagatcac

SEQ ID NO: 11708 - DNA, 27 bp, Artificial Sequence
  Description of Artificial Sequence: Synthetic oligonucleotide
ggcggacatggtggctcagatcaccaa

SEQ ID NO: 11709 - DNA, 27 bp, Artificial Sequence
  Description of Artificial Sequence: Synthetic oligonucleotide
gcggacatggtggctcagatcaccaag

SEQ ID NO: 11710 - DNA, 27 bp, Artificial Sequence
  Description of Artificial Sequence: Synthetic oligonucleotide
cggacatggtggctcagatcaccaagc

SEQ ID NO: 11711 - DNA, 27 bp, Artificial Sequence
  Description of Artificial Sequence: Synthetic oligonucleotide
ggacatggtggctcagatcaccaagcg

SEQ ID NO: 11712 - DNA, 27 bp, Artificial Sequence
  Description of Artificial Sequence: Synthetic oligonucleotide
gacatggtggctcagatcaccaagcgc

SEQ ID NO: 11713 - DNA, 29 bp, Artificial Sequence
  Description of Artificial Sequence: Synthetic oligonucleotide
acatggtggctcagatcaccaagcgcaag

SEQ ID NO: 11714 - DNA, 28 bp, Artificial Sequence
  Description of Artificial Sequence: Synthetic oligonucleotide
catggtggctcagatcaccaagcgcaag

SEQ ID NO: 11715 - DNA, 29 bp, Artificial Sequence
  Description of Artificial Sequence: Synthetic oligonucleotide
atggtggctcagatcaccaagcgcaagtg

SEQ ID NO: 11716 - DNA, 28 bp, Artificial Sequence
  Description of Artificial Sequence: Synthetic oligonucleotide
tggtggctcagatcaccaagcgcaagtg

SEQ ID NO: 11717 - DNA, 27 bp, Artificial Sequence
  Description of Artificial Sequence: Synthetic oligonucleotide
ggtggctcagatcaccaagcgcaagtg

SEQ ID NO: 11718 - DNA, 27 bp, Artificial Sequence
  Description of Artificial Sequence: Synthetic oligonucleotide
gtggctcagatcaccaagcgcaagtgg

SEQ ID NO: 11719 - DNA, 27 bp, Artificial Sequence
  Description of Artificial Sequence: Synthetic oligonucleotide
tggctcagatcaccaagcgcaagtggg

SEQ ID NO: 11720 - DNA, 21 bp, Artificial Sequence
  Description of Artificial Sequence: Synthetic oligonucleotide
acgggcgcttcctccgcgggt

SEQ ID NO: 11721 - DNA, 20 bp, Artificial Sequence
  Description of Artificial Sequence: Synthetic oligonucleotide
cgggcgcttcctccgcgggt

SEQ ID NO: 11722 - DNA, 20 bp, Artificial Sequence
  Description of Artificial Sequence: Synthetic oligonucleotide
gggcgcttcctccgcgggtg

SEQ ID NO: 11723 - DNA, 20 bp, Artificial Sequence
  Description of Artificial Sequence: Synthetic oligonucleotide
ggcgcttcctccgcgggtgc

SEQ ID NO: 11724 - DNA, 20 bp, Artificial Sequence
  Description of Artificial Sequence: Synthetic oligonucleotide
gcgcttcctccgcgggtgcc

SEQ ID NO: 11725 - DNA, 20 bp, Artificial Sequence
  Description of Artificial Sequence: Synthetic oligonucleotide
cgcttcctccgcgggtgccg

SEQ ID NO: 11726 - DNA, 20 bp, Artificial Sequence
  Description of Artificial Sequence: Synthetic oligonucleotide
gcttcctccgcgggtgccgg

SEQ ID NO: 11727 - DNA, 21 bp, Artificial Sequence
  Description of Artificial Sequence: Synthetic oligonucleotide
cttcctccgcgggtgccggca

SEQ ID NO: 11728 - DNA, 21 bp, Artificial Sequence
  Description of Artificial Sequence: Synthetic oligonucleotide
ttcctccgcgggtgccggcag

SEQ ID NO: 11729 - DNA, 20 bp, Artificial Sequence
  Description of Artificial Sequence: Synthetic oligonucleotide
tcctccgcgggtgccggcag

SEQ ID NO: 11730 - DNA, 20 bp, Artificial Sequence
  Description of Artificial Sequence: Synthetic oligonucleotide
cctccgcgggtgccggcagt

SEQ ID NO: 11731 - DNA, 20 bp, Artificial Sequence
  Description of Artificial Sequence: Synthetic oligonucleotide
ctccgcgggtgccggcagga

SEQ ID NO: 11732 - DNA, 20 bp, Artificial Sequence
  Description of Artificial Sequence: Synthetic oligonucleotide
tccgcgggtgccggcaggac

SEQ ID NO: 11733 - DNA, 20 bp, Artificial Sequence
  Description of Artificial Sequence: Synthetic oligonucleotide
ccgcgggtgccggcaggact

SEQ ID NO: 11734 - DNA, 20 bp, Artificial Sequence
  Description of Artificial Sequence: Synthetic oligonucleotide
cgcgggtgccggcaggacgt

SEQ ID NO: 11735 - DNA, 20 bp, Artificial Sequence
  Description of Artificial Sequence: Synthetic oligonucleotide
gcgggtgccggcaggacgct

SEQ ID NO: 11736 - DNA, 21 bp, Artificial Sequence
  Description of Artificial Sequence: Synthetic oligonucleotide
cgggtgccggcaggacgccta

SEQ ID NO: 11737 - DNA, 21 bp, Artificial Sequence
  Description of Artificial Sequence: Synthetic oligonucleotide
gggtgccggcaggacgcctac

SEQ ID NO: 11738 - DNA, 22 bp, Artificial Sequence
  Description of Artificial Sequence: Synthetic oligonucleotide
ggtgccggcaggacgcctacga

SEQ ID NO: 11739 - DNA, 22 bp, Artificial Sequence
  Description of Artificial Sequence: Synthetic oligonucleotide
gtgccggcaggacgcctacgac

SEQ ID NO: 11740 - DNA, 22 bp, Artificial Sequence
  Description of Artificial Sequence: Synthetic oligonucleotide
tgccggcaggacgcctacgacg

SEQ ID NO: 11741 - DNA, 21 bp, Artificial Sequence
  Description of Artificial Sequence: Synthetic oligonucleotide
gccggcaggacgcctacgacg

SEQ ID NO: 11742 - DNA, 24 bp, Artificial Sequence
  Description of Artificial Sequence: Synthetic oligonucleotide
caagtgggaggcggcccatgaggt

SEQ ID NO: 11743 - DNA, 24 bp, Artificial Sequence
  Description of Artificial Sequence: Synthetic oligonucleotide
aagtgggaggcggcccatgaggtg

SEQ ID NO: 11744 - DNA, 23 bp, Artificial Sequence
  Description of Artificial Sequence: Synthetic oligonucleotide
agtgggaggcggcccatgaggtg

SEQ ID NO: 11745 - DNA, 22 bp, Artificial Sequence
  Description of Artificial Sequence: Synthetic oligonucleotide
gtgggaggcggcccatgaggtg

SEQ ID NO: 11746 - DNA, 23 bp, Artificial Sequence
  Description of Artificial Sequence: Synthetic oligonucleotide
tgggaggcggcccatgaggtgga

SEQ ID NO: 11747 - DNA, 22 bp, Artificial Sequence
  Description of Artificial Sequence: Synthetic oligonucleotide
gggaggcggcccatgaggtgga

SEQ ID NO: 11748 - DNA, 22 bp, Artificial Sequence
  Description of Artificial Sequence: Synthetic oligonucleotide
ggaggcggcccatgaggtggag

SEQ ID NO: 11749 - DNA, 23 bp, Artificial Sequence
  Description of Artificial Sequence: Synthetic oligonucleotide
gaggcggcccatgaggtggagca

SEQ ID NO: 11750 - DNA, 25 bp, Artificial Sequence
  Description of Artificial Sequence: Synthetic oligonucleotide
aggcggcccatgaggtggagcagtt

SEQ ID NO: 11751 - DNA, 24 bp, Artificial Sequence
  Description of Artificial Sequence: Synthetic oligonucleotide
ggcggcccatgaggtggagcagtt

SEQ ID NO: 11752 - DNA, 25 bp, Artificial Sequence
  Description of Artificial Sequence: Synthetic oligonucleotide
gcggcccatgaggtggagcagttga

SEQ ID NO: 11753 - DNA, 26 bp, Artificial Sequence
  Description of Artificial Sequence: Synthetic oligonucleotide
cggcccatgaggtggagcagttgaga

SEQ ID NO: 11754 - DNA, 26 bp, Artificial Sequence
  Description of Artificial Sequence: Synthetic oligonucleotide
ggcccatgaggtggagcagttgagag

SEQ ID NO: 11755 - DNA, 26 bp, Artificial Sequence
  Description of Artificial Sequence: Synthetic oligonucleotide
gcccatgaggtggagcagttgagagc

SEQ ID NO: 11756 - DNA, 27 bp, Artificial Sequence
  Description of Artificial Sequence: Synthetic oligonucleotide
cccatgaggtggagcagttgagagcct

SEQ ID NO: 11757 - DNA, 28 bp, Artificial Sequence
  Description of Artificial Sequence: Synthetic oligonucleotide
ccatgaggtggagcagttgagagcctac

SEQ ID NO: 11758 - DNA, 28 bp, Artificial Sequence
  Description of Artificial Sequence: Synthetic oligonucleotide
catgaggtggagcagttgagagcctacc

SEQ ID NO: 11759 - DNA, 29 bp, Artificial Sequence
  Description of Artificial Sequence: Synthetic oligonucleotide
atgaggtggagcagttgagagcctacctg

SEQ ID NO: 11760 - DNA, 28 bp, Artificial Sequence
  Description of Artificial Sequence: Synthetic oligonucleotide
tgaggtggagcagttgagagcctacctg

SEQ ID NO: 11761 - DNA, 27 bp, Artificial Sequence
  Description of Artificial Sequence: Synthetic oligonucleotide
gaggtggagcagttgagagcctacctg

SEQ ID NO: 11762 - DNA, 27 bp, Artificial Sequence
  Description of Artificial Sequence: Synthetic oligonucleotide
aggtggagcagttgagagcctacctgg

SEQ ID NO: 11763 - DNA, 28 bp, Artificial Sequence
  Description of Artificial Sequence: Synthetic oligonucleotide
gtggagcagttgagagcctacctggatg

SEQ ID NO: 11764 - DNA, 28 bp, Artificial Sequence
  Description of Artificial Sequence: Synthetic oligonucleotide
tggagcagttgagagcctacctggatgg

SEQ ID NO: 11765 - DNA, 26 bp, Artificial Sequence
  Description of Artificial Sequence: Synthetic oligonucleotide
tggggaccctgcgcggctactacaaa

SEQ ID NO: 11766 - DNA, 25 bp, Artificial Sequence
  Description of Artificial Sequence: Synthetic oligonucleotide
ggggaccctgcgcggctactacaaa

SEQ ID NO: 11767 - DNA, 26 bp, Artificial Sequence
  Description of Artificial Sequence: Synthetic oligonucleotide
gggaccctgcgcggctactacaaaca

SEQ ID NO: 11768 - DNA, 27 bp, Artificial Sequence
  Description of Artificial Sequence: Synthetic oligonucleotide
ggaccctgcgcggctactacaaacaga

SEQ ID NO: 11769 - DNA, 27 bp, Artificial Sequence
  Description of Artificial Sequence: Synthetic oligonucleotide
gaccctgcgcggctactacaaacagag

SEQ ID NO: 11770 - DNA, 27 bp, Artificial Sequence
  Description of Artificial Sequence: Synthetic oligonucleotide
accctgcgcggctactacaaacagagc

SEQ ID NO: 11771 - DNA, 26 bp, Artificial Sequence
  Description of Artificial Sequence: Synthetic oligonucleotide
ccctgcgcggctactacaaacagagc

SEQ ID NO: 11772 - DNA, 27 bp, Artificial Sequence
  Description of Artificial Sequence: Synthetic oligonucleotide
cctgcgcggctactacaaacagagcga

SEQ ID NO: 11773 - DNA, 27 bp, Artificial Sequence
  Description of Artificial Sequence: Synthetic oligonucleotide
ctgcgcggctactacaaacagagcgag

SEQ ID NO: 11774 - DNA, 27 bp, Artificial Sequence
  Description of Artificial Sequence: Synthetic oligonucleotide
tgcgcggctactacaaacagagcgagg

SEQ ID NO: 11775 - DNA, 26 bp, Artificial Sequence
  Description of Artificial Sequence: Synthetic oligonucleotide
gcgcggctactacaaacagagcgagg

SEQ ID NO: 11776 - DNA, 26 bp, Artificial Sequence
  Description of Artificial Sequence: Synthetic oligonucleotide
cgcggctactacaaacagagcgaggc

SEQ ID NO: 11777 - DNA, 26 bp, Artificial Sequence
  Description of Artificial Sequence: Synthetic oligonucleotide
gcggctactacaaacagagcgaggcc

SEQ ID NO: 11778 - DNA, 26 bp, Artificial Sequence
  Description of Artificial Sequence: Synthetic oligonucleotide
cggctactacaaacagagcgaggccg

SEQ ID NO: 11779 - DNA, 27 bp, Artificial Sequence
  Description of Artificial Sequence: Synthetic oligonucleotide
ggctactacaaacagagcgaggccggt

SEQ ID NO: 11780 - DNA, 28 bp, Artificial Sequence
  Description of Artificial Sequence: Synthetic oligonucleotide
gctactacaaacagagcgaggccggttc

SEQ ID NO: 11781 - DNA, 29 bp, Artificial Sequence
  Description of Artificial Sequence: Synthetic oligonucleotide
ctactacaaacagagcgaggccggttctc

SEQ ID NO: 11782 - DNA, 30 bp, Artificial Sequence
  Description of Artificial Sequence: Synthetic oligonucleotide
tactacaaacagagcgaggccggttctcac

SEQ ID NO: 11783 - DNA, 29 bp, Artificial Sequence
  Description of Artificial Sequence: Synthetic oligonucleotide
actacaaacagagcgaggccggttctcac

SEQ ID NO: 11784 - DNA, 28 bp, Artificial Sequence
  Description of Artificial Sequence: Synthetic oligonucleotide
ctacaaacagagcgaggccggttctcac

SEQ ID NO: 11785 - DNA, 29 bp, Artificial Sequence
  Description of Artificial Sequence: Synthetic oligonucleotide
tacaaacagagcgaggccggttctcacac

SEQ ID NO: 11786 - DNA, 28 bp, Artificial Sequence
  Description of Artificial Sequence: Synthetic oligonucleotide
acaaacagagcgaggccggttctcacac

SEQ ID NO: 11787 - DNA, 27 bp, Artificial Sequence
  Description of Artificial Sequence: Synthetic oligonucleotide
caaacagagcgaggccggttctcacac

SEQ ID NO: 11788 - DNA, 27 bp, Artificial Sequence
  Description of Artificial Sequence: Synthetic oligonucleotide
aaacagagcgaggccggttctcacacc

SEQ ID NO: 11789 - DNA, 27 bp, Artificial Sequence
  Description of Artificial Sequence: Synthetic oligonucleotide
aacagagcgaggccggttctcacacca

SEQ ID NO: 11790 - DNA, 27 bp, Artificial Sequence
  Description of Artificial Sequence: Synthetic oligonucleotide
acagagcgaggccggttctcacaccat

SEQ ID NO: 11791 - DNA, 27 bp, Artificial Sequence
  Description of Artificial Sequence: Synthetic oligonucleotide
tggacgacacgcagttcgtgcggttca

SEQ ID NO: 11792 - DNA, 27 bp, Artificial Sequence
  Description of Artificial Sequence: Synthetic oligonucleotide
ggacgacacgcagttcgtgcggttcaa

SEQ ID NO: 11793 - DNA, 27 bp, Artificial Sequence
  Description of Artificial Sequence: Synthetic oligonucleotide
gacgacacgcagttcgtgcggttcaac

SEQ ID NO: 11794 - DNA, 28 bp, Artificial Sequence
  Description of Artificial Sequence: Synthetic oligonucleotide
acgacacgcagttcgtgcggttcaacag

SEQ ID NO: 11795 - DNA, 27 bp, Artificial Sequence
  Description of Artificial Sequence: Synthetic oligonucleotide
cgacacgcagttcgtgcggttcaacag

SEQ ID NO: 11796 - DNA, 27 bp, Artificial Sequence
  Description of Artificial Sequence: Synthetic oligonucleotide
gacacgcagttcgtgcggttcaacagc

SEQ ID NO: 11797 - DNA, 27 bp, Artificial Sequence
  Description of Artificial Sequence: Synthetic oligonucleotide
acacgcagttcgtgcggttcaacagcg

SEQ ID NO: 11798 - DNA, 27 bp, Artificial Sequence
  Description of Artificial Sequence: Synthetic oligonucleotide
cacgcagttcgtgcggttcaacagcga

SEQ ID NO: 11799 - DNA, 27 bp, Artificial Sequence
  Description of Artificial Sequence: Synthetic oligonucleotide
acgcagttcgtgcggttcaacagcgac

SEQ ID NO: 11800 - DNA, 26 bp, Artificial Sequence
  Description of Artificial Sequence: Synthetic oligonucleotide
cgcagttcgtgcggttcaacagcgac

SEQ ID NO: 11801 - DNA, 26 bp, Artificial Sequence
  Description of Artificial Sequence: Synthetic oligonucleotide
gcagttcgtgcggttcaacagcgacg

SEQ ID NO: 11802 - DNA, 26 bp, Artificial Sequence
  Description of Artificial Sequence: Synthetic oligonucleotide
cagttcgtgcggttcaacagcgacgc

SEQ ID NO: 11803 - DNA, 26 bp, Artificial Sequence
  Description of Artificial Sequence: Synthetic oligonucleotide
agttcgtgcggttcaacagcgacgcc

SEQ ID NO: 11804 - DNA, 25 bp, Artificial Sequence
  Description of Artificial Sequence: Synthetic oligonucleotide
gttcgtgcggttcaacagcgacgcc

SEQ ID NO: 11805 - DNA, 25 bp, Artificial Sequence
  Description of Artificial Sequence: Synthetic oligonucleotide
ttcgtgcggttcaacagcgacgccg

SEQ ID NO: 11806 - DNA, 24 bp, Artificial Sequence
  Description of Artificial Sequence: Synthetic oligonucleotide
tcgtgcggttcaacagcgacgccg

SEQ ID NO: 11807 - DNA, 23 bp, Artificial Sequence
  Description of Artificial Sequence: Synthetic oligonucleotide
cgtgcggttcaacagcgacgccg

SEQ ID NO: 11808 - DNA, 23 bp, Artificial Sequence
  Description of Artificial Sequence: Synthetic oligonucleotide
gtgcggttcaacagcgacgccgc

SEQ ID NO: 11809 - DNA, 24 bp, Artificial Sequence
  Description of Artificial Sequence: Synthetic oligonucleotide
tgcggttcaacagcgacgccgcga

SEQ ID NO: 11810 - DNA, 23 bp, Artificial Sequence
  Description of Artificial Sequence: Synthetic oligonucleotide
gcggttcaacagcgacgccgcga

SEQ ID NO: 11811 - DNA, 23 bp, Artificial Sequence
  Description of Artificial Sequence: Synthetic oligonucleotide
cggttcaacagcgacgccgcgag

SEQ ID NO: 11812 - DNA, 23 bp, Artificial Sequence
  Description of Artificial Sequence: Synthetic oligonucleotide
ggttcaacagcgacgccgcgagc

SEQ ID NO: 11813 - DNA, 24 bp, Artificial Sequence
  Description of Artificial Sequence: Synthetic oligonucleotide
gttcaacagcgacgccgcgagcca

SEQ ID NO: 11814 - DNA, 25 bp, Artificial Sequence
  Description of Artificial Sequence: Synthetic oligonucleotide
ttcaacagcgacgccgcgagccaga

SEQ ID NO: 11815 - DNA, 24 bp, Artificial Sequence
  Description of Artificial Sequence: Synthetic oligonucleotide
tcaacagcgacgccgcgagccaga

SEQ ID NO: 11816 - DNA, 23 bp, Artificial Sequence
  Description of Artificial Sequence: Synthetic oligonucleotide
caacagcgacgccgcgagccaga

SEQ ID NO: 11817 - DNA, 23 bp, Artificial Sequence
  Description of Artificial Sequence: Synthetic oligonucleotide
aacagcgacgccgcgagccagag

SEQ ID NO: 11818 - DNA, 31 bp, Artificial Sequence
  Description of Artificial Sequence: Synthetic oligonucleotide
gctcccactccatgaggtgtttcttcacatc

SEQ ID NO: 11819 - DNA, 31 bp, Artificial Sequence
  Description of Artificial Sequence: Synthetic oligonucleotide
ctcccactccatgaggtgtttcttcacatcc

SEQ ID NO: 11820 - DNA, 31 bp, Artificial Sequence
  Description of Artificial Sequence: Synthetic oligonucleotide
tcccactccatgaggtgtttcttcacatccg

SEQ ID NO: 11821 - DNA, 30 bp, Artificial Sequence
  Description of Artificial Sequence: Synthetic oligonucleotide
cccactccatgaggtgtttcttcacatccg

SEQ ID NO: 11822 - DNA, 31 bp, Artificial Sequence
  Description of Artificial Sequence: Synthetic oligonucleotide
ccactccatgaggtgtttcttcacatccgtg

SEQ ID NO: 11823 - DNA, 32 bp, Artificial Sequence
  Description of Artificial Sequence: Synthetic oligonucleotide
cactccatgaggtgtttcttcacatccgtgtc

SEQ ID NO: 11824 - DNA, 32 bp, Artificial Sequence
  Description of Artificial Sequence: Synthetic oligonucleotide
actccatgaggtgtttcttcacatccgtgtcc

SEQ ID NO: 11825 - DNA, 31 bp, Artificial Sequence
  Description of Artificial Sequence: Synthetic oligonucleotide
ctccatgaggtgtttcttcacatccgtgtcc

SEQ ID NO: 11826 - DNA, 31 bp, Artificial Sequence
  Description of Artificial Sequence: Synthetic oligonucleotide
tccatgaggtgtttcttcacatccgtgtccc

SEQ ID NO: 11827 - DNA, 30 bp, Artificial Sequence
  Description of Artificial Sequence: Synthetic oligonucleotide
ccatgaggtgtttcttcacatccgtgtccc

SEQ ID NO: 11828 - DNA, 30 bp, Artificial Sequence
  Description of Artificial Sequence: Synthetic oligonucleotide
catgaggtgtttcttcacatccgtgtcccg

SEQ ID NO: 11829 - DNA, 30 bp, Artificial Sequence
  Description of Artificial Sequence: Synthetic oligonucleotide
atgaggtgtttcttcacatccgtgtcccgg

SEQ ID NO: 11830 - DNA, 29 bp, Artificial Sequence
  Description of Artificial Sequence: Synthetic oligonucleotide
tgaggtgtttcttcacatccgtgtcccgg

SEQ ID NO: 11831 - DNA, 28 bp, Artificial Sequence
  Description of Artificial Sequence: Synthetic oligonucleotide
gaggtgtttcttcacatccgtgtcccgg

SEQ ID NO: 11832 - DNA, 28 bp, Artificial Sequence
  Description of Artificial Sequence: Synthetic oligonucleotide
aggtgtttcttcacatccgtgtcccggc

SEQ ID NO: 11833 - DNA, 27 bp, Artificial Sequence
  Description of Artificial Sequence: Synthetic oligonucleotide
ggtgtttcttcacatccgtgtcccggc

SEQ ID NO: 11834 - DNA, 27 bp, Artificial Sequence
  Description of Artificial Sequence: Synthetic oligonucleotide
gtgtttcttcacatccgtgtcccggcc

SEQ ID NO: 11835 - DNA, 27 bp, Artificial Sequence
  Description of Artificial Sequence: Synthetic oligonucleotide
tgtttcttcacatccgtgtcccggccc

SEQ ID NO: 11836 - DNA, 26 bp, Artificial Sequence
  Description of Artificial Sequence: Synthetic oligonucleotide
gtttcttcacatccgtgtcccggccc

SEQ ID NO: 11837 - DNA, 30 bp, Artificial Sequence
  Description of Artificial Sequence: Synthetic oligonucleotide
ataatgtatggctgcgacgtggggtcgatc

SEQ ID NO: 11838 - DNA, 29 bp, Artificial Sequence
  Description of Artificial Sequence: Synthetic oligonucleotide
taatgtatggctgcgacgtggggtcgatc

SEQ ID NO: 11839 - DNA, 28 bp, Artificial Sequence
  Description of Artificial Sequence: Synthetic oligonucleotide
aatgtatggctgcgacgtggggtcgatc

SEQ ID NO: 11840 - DNA, 27 bp, Artificial Sequence
  Description of Artificial Sequence: Synthetic oligonucleotide
atgtatggctgcgacgtggggtcgatc

SEQ ID NO: 11841 - DNA, 26 bp, Artificial Sequence
  Description of Artificial Sequence: Synthetic oligonucleotide
tgtatggctgcgacgtggggtcgatc

SEQ ID NO: 11842 - DNA, 25 bp, Artificial Sequence
  Description of Artificial Sequence: Synthetic oligonucleotide
gtatggctgcgacgtggggtcgatc

SEQ ID NO: 11843 - DNA, 25 bp, Artificial Sequence
  Description of Artificial Sequence: Synthetic oligonucleotide
tatggctgcgacgtggggtcgatcg

SEQ ID NO: 11844 - DNA, 24 bp, Artificial Sequence
  Description of Artificial Sequence: Synthetic oligonucleotide
atggctgcgacgtggggtcgatcg

SEQ ID NO: 11845 - DNA, 23 bp, Artificial Sequence
  Description of Artificial Sequence: Synthetic oligonucleotide
tggctgcgacgtggggtcgatcg

SEQ ID NO: 11846 - DNA, 22 bp, Artificial Sequence
  Description of Artificial Sequence: Synthetic oligonucleotide
ggctgcgacgtggggtcgatcg

SEQ ID NO: 11847 - DNA, 22 bp, Artificial Sequence
  Description of Artificial Sequence: Synthetic oligonucleotide
gctgcgacgtggggtcgatcgg

SEQ ID NO: 11848 - DNA, 22 bp, Artificial Sequence
  Description of Artificial Sequence: Synthetic oligonucleotide
ctgcgacgtggggtcgatcggg

SEQ ID NO: 11849 - DNA, 22 bp, Artificial Sequence
  Description of Artificial Sequence: Synthetic oligonucleotide
tgcgacgtggggtcgatcgggc

SEQ ID NO: 11850 - DNA, 21 bp, Artificial Sequence
  Description of Artificial Sequence: Synthetic oligonucleotide
gcgacgtggggtcgatcgggc

SEQ ID NO: 11851 - DNA, 21 bp, Artificial Sequence
  Description of Artificial Sequence: Synthetic oligonucleotide
cgacgtggggtcgatcgggcg

SEQ ID NO: 11852 - DNA, 23 bp, Artificial Sequence
  Description of Artificial Sequence: Synthetic oligonucleotide
gacgtggggtcgatcgggcgctt

SEQ ID NO: 11853 - DNA, 23 bp, Artificial Sequence
  Description of Artificial Sequence: Synthetic oligonucleotide
acgtggggtcgatcgggcgcttc

SEQ ID NO: 11854 - DNA, 22 bp, Artificial Sequence
  Description of Artificial Sequence: Synthetic oligonucleotide
cgtggggtcgatcgggcgcttc

SEQ ID NO: 11855 - DNA, 23 bp, Artificial Sequence
  Description of Artificial Sequence: Synthetic oligonucleotide
gtggggtcgatcgggcgcttcct

SEQ ID NO: 11856 - DNA, 23 bp, Artificial Sequence
  Description of Artificial Sequence: Synthetic oligonucleotide
tggggtcgatcgggcgcttcctc

SEQ ID NO: 11857 - DNA, 22 bp, Artificial Sequence
  Description of Artificial Sequence: Synthetic oligonucleotide
ggggtcgatcgggcgcttcctc

SEQ ID NO: 11858 - DNA, 22 bp, Artificial Sequence
  Description of Artificial Sequence: Synthetic oligonucleotide
gggtcgatcgggcgcttcctcc

SEQ ID NO: 11859 - DNA, 22 bp, Artificial Sequence
  Description of Artificial Sequence: Synthetic oligonucleotide
ggtcgatcgggcgcttcctccg

SEQ ID NO: 11860 - DNA, 22 bp, Artificial Sequence
  Description of Artificial Sequence: Synthetic oligonucleotide
gtcgatcgggcgcttcctccgc

SEQ ID NO: 11861 - DNA, 22 bp, Artificial Sequence
  Description of Artificial Sequence: Synthetic oligonucleotide
tcgatcgggcgcttcctccgcg

SEQ ID NO: 11862 - DNA, 21 bp, Artificial Sequence
  Description of Artificial Sequence: Synthetic oligonucleotide
cgatcgggcgcttcctccgcg

SEQ ID NO: 11863 - DNA, 21 bp, Artificial Sequence
  Description of Artificial Sequence: Synthetic oligonucleotide
gatcgggcgcttcctccgcgg

SEQ ID NO: 11864 - DNA, 23 bp, Artificial Sequence
  Description of Artificial Sequence: Synthetic oligonucleotide
atcgggcgcttcctccgcgggta

SEQ ID NO: 11865 - DNA, 22 bp, Artificial Sequence
  Description of Artificial Sequence: Synthetic oligonucleotide
tcgggcgcttcctccgcgggta

SEQ ID NO: 11866 - DNA, 32 bp, Artificial Sequence
  Description of Artificial Sequence: Synthetic oligonucleotide
accatccagataatgtatggctgcgacgtgag

SEQ ID NO: 11867 - DNA, 31 bp, Artificial Sequence
  Description of Artificial Sequence: Synthetic oligonucleotide
ccatccagataatgtatggctgcgacgtgag

SEQ ID NO: 11868 - DNA, 31 bp, Artificial Sequence
  Description of Artificial Sequence: Synthetic oligonucleotide
catccagataatgtatggctgcgacgtgagg

SEQ ID NO: 11869 - DNA, 32 bp, Artificial Sequence
  Description of Artificial Sequence: Synthetic oligonucleotide
atccagataatgtatggctgcgacgtgaggtc

SEQ ID NO: 11870 - DNA, 31 bp, Artificial Sequence
  Description of Artificial Sequence: Synthetic oligonucleotide
tccagataatgtatggctgcgacgtgaggtc

SEQ ID NO: 11871 - DNA, 30 bp, Artificial Sequence
  Description of Artificial Sequence: Synthetic oligonucleotide
ccagataatgtatggctgcgacgtgaggtc

SEQ ID NO: 11872 - DNA, 30 bp, Artificial Sequence
  Description of Artificial Sequence: Synthetic oligonucleotide
cagataatgtatggctgcgacgtgaggtcg

SEQ ID NO: 11873 - DNA, 30 bp, Artificial Sequence
  Description of Artificial Sequence: Synthetic oligonucleotide
agataatgtatggctgcgacgtgaggtcgg

SEQ ID NO: 11874 - DNA, 29 bp, Artificial Sequence
  Description of Artificial Sequence: Synthetic oligonucleotide
gataatgtatggctgcgacgtgaggtcgg

SEQ ID NO: 11875 - DNA, 30 bp, Artificial Sequence
  Description of Artificial Sequence: Synthetic oligonucleotide
ataatgtatggctgcgacgtgaggtcggac

SEQ ID NO: 11876 - DNA, 29 bp, Artificial Sequence
  Description of Artificial Sequence: Synthetic oligonucleotide
taatgtatggctgcgacgtgaggtcggac

SEQ ID NO: 11877 - DNA, 28 bp, Artificial Sequence
  Description of Artificial Sequence: Synthetic oligonucleotide
aatgtatggctgcgacgtgaggtcggac

SEQ ID NO: 11878 - DNA, 27 bp, Artificial Sequence
  Description of Artificial Sequence: Synthetic oligonucleotide
atgtatggctgcgacgtgaggtcggac

SEQ ID NO: 11879 - DNA, 26 bp, Artificial Sequence
  Description of Artificial Sequence: Synthetic oligonucleotide
tgtatggctgcgacgtgaggtcggac

SEQ ID NO: 11880 - DNA, 25 bp, Artificial Sequence
  Description of Artificial Sequence: Synthetic oligonucleotide
gtatggctgcgacgtgaggtcggac

SEQ ID NO: 11881 - DNA, 25 bp, Artificial Sequence
  Description of Artificial Sequence: Synthetic oligonucleotide
tatggctgcgacgtgaggtcggacg

SEQ ID NO: 11882 - DNA, 24 bp, Artificial Sequence
  Description of Artificial Sequence: Synthetic oligonucleotide
atggctgcgacgtgaggtcggacg

SEQ ID NO: 11883 - DNA, 23 bp, Artificial Sequence
  Description of Artificial Sequence: Synthetic oligonucleotide
tggctgcgacgtgaggtcggacg

SEQ ID NO: 11884 - DNA, 22 bp, Artificial Sequence
  Description of Artificial Sequence: Synthetic oligonucleotide
ggctgcgacgtgaggtcggacg

SEQ ID NO: 11885 - DNA, 22 bp, Artificial Sequence
  Description of Artificial Sequence: Synthetic oligonucleotide
gctgcgacgtgaggtcggacgg

SEQ ID NO: 11886 - DNA, 22 bp, Artificial Sequence
  Description of Artificial Sequence: Synthetic oligonucleotide
ctgcgacgtgaggtcggacggg

SEQ ID NO: 11887 - DNA, 22 bp, Artificial Sequence
  Description of Artificial Sequence: Synthetic oligonucleotide
tgcgacgtgaggtcggacgggc

SEQ ID NO: 11888 - DNA, 21 bp, Artificial Sequence
  Description of Artificial Sequence: Synthetic oligonucleotide
gcgacgtgaggtcggacgggc

SEQ ID NO: 11889 - DNA, 21 bp, Artificial Sequence
  Description of Artificial Sequence: Synthetic oligonucleotide
cgacgtgaggtcggacgggcg

SEQ ID NO: 11890 - DNA, 23 bp, Artificial Sequence
  Description of Artificial Sequence: Synthetic oligonucleotide
gacgtgaggtcggacgggcgctt

SEQ ID NO: 11891 - DNA, 23 bp, Artificial Sequence
  Description of Artificial Sequence: Synthetic oligonucleotide
acgtgaggtcggacgggcgcttc

SEQ ID NO: 11892 - DNA, 22 bp, Artificial Sequence
  Description of Artificial Sequence: Synthetic oligonucleotide
cgtgaggtcggacgggcgcttc

SEQ ID NO: 11893 - DNA, 23 bp, Artificial Sequence
  Description of Artificial Sequence: Synthetic oligonucleotide
gtgaggtcggacgggcgcttcct

SEQ ID NO: 11894 - DNA, 23 bp, Artificial Sequence
  Description of Artificial Sequence: Synthetic oligonucleotide
tgaggtcggacgggcgcttcctc

SEQ ID NO: 11895 - DNA, 22 bp, Artificial Sequence
  Description of Artificial Sequence: Synthetic oligonucleotide
gaggtcggacgggcgcttcctc

SEQ ID NO: 11896 - DNA, 22 bp, Artificial Sequence
  Description of Artificial Sequence: Synthetic oligonucleotide
aggtcggacgggcgcttcctcc

SEQ ID NO: 11897 - DNA, 26 bp, Artificial Sequence
  Description of Artificial Sequence: Synthetic oligonucleotide
cggctactacaaccagagcgaggcca

SEQ ID NO: 11898 - DNA, 27 bp, Artificial Sequence
  Description of Artificial Sequence: Synthetic oligonucleotide
ggctactacaaccagagcgaggccagt

SEQ ID NO: 11899 - DNA, 28 bp, Artificial Sequence
  Description of Artificial Sequence: Synthetic oligonucleotide
gctactacaaccagagcgaggccagttc

SEQ ID NO: 11900 - DNA, 29 bp, Artificial Sequence
  Description of Artificial Sequence: Synthetic oligonucleotide
ctactacaaccagagcgaggccagttctc

SEQ ID NO: 11901 - DNA, 30 bp, Artificial Sequence
  Description of Artificial Sequence: Synthetic oligonucleotide
tactacaaccagagcgaggccagttctcac

SEQ ID NO: 11902 - DNA, 29 bp, Artificial Sequence
  Description of Artificial Sequence: Synthetic oligonucleotide
actacaaccagagcgaggccagttctcac

SEQ ID NO: 11903 - DNA, 28 bp, Artificial Sequence
  Description of Artificial Sequence: Synthetic oligonucleotide
ctacaaccagagcgaggccagttctcac

SEQ ID NO: 11904 - DNA, 29 bp, Artificial Sequence
  Description of Artificial Sequence: Synthetic oligonucleotide
tacaaccagagcgaggccagttctcacac

SEQ ID NO: 11905 - DNA, 28 bp, Artificial Sequence
  Description of Artificial Sequence: Synthetic oligonucleotide
acaaccagagcgaggccagttctcacac

SEQ ID NO: 11906 - DNA, 27 bp, Artificial Sequence
  Description of Artificial Sequence: Synthetic oligonucleotide
caaccagagcgaggccagttctcacac

SEQ ID NO: 11907 - DNA, 27 bp, Artificial Sequence
  Description of Artificial Sequence: Synthetic oligonucleotide
aaccagagcgaggccagttctcacacc

SEQ ID NO: 11908 - DNA, 27 bp, Artificial Sequence
  Description of Artificial Sequence: Synthetic oligonucleotide
accagagcgaggccagttctcacacca

SEQ ID NO: 11909 - DNA, 27 bp, Artificial Sequence
  Description of Artificial Sequence: Synthetic oligonucleotide
ccagagcgaggccagttctcacaccat

SEQ ID NO: 11910 - DNA, 27 bp, Artificial Sequence
  Description of Artificial Sequence: Synthetic oligonucleotide
cagagcgaggccagttctcacaccatc

SEQ ID NO: 11911 - DNA, 27 bp, Artificial Sequence
  Description of Artificial Sequence: Synthetic oligonucleotide
agagcgaggccagttctcacaccatcc

SEQ ID NO: 11912 - DNA, 27 bp, Artificial Sequence
  Description of Artificial Sequence: Synthetic oligonucleotide
gagcgaggccagttctcacaccatcca

SEQ ID NO: 11913 - DNA, 27 bp, Artificial Sequence
  Description of Artificial Sequence: Synthetic oligonucleotide
agcgaggccagttctcacaccatccag

SEQ ID NO: 11914 - DNA, 27 bp, Artificial Sequence
  Description of Artificial Sequence: Synthetic oligonucleotide
gcgaggccagttctcacaccatccaga

SEQ ID NO: 11915 - DNA, 31 bp, Artificial Sequence
  Description of Artificial Sequence: Synthetic oligonucleotide
cgaggccagttctcacaccatccagataatg

SEQ ID NO: 11916 - DNA, 34 bp, Artificial Sequence
  Description of Artificial Sequence: Synthetic oligonucleotide
gaggccagttctcacaccatccagataatgtatg

SEQ ID NO: 11917 - DNA, 34 bp, Artificial Sequence
  Description of Artificial Sequence: Synthetic oligonucleotide
aggccagttctcacaccatccagataatgtatgg

SEQ ID NO: 11918 - DNA, 33 bp, Artificial Sequence
  Description of Artificial Sequence: Synthetic oligonucleotide
ggccagttctcacaccatccagataatgtatgg

SEQ ID NO: 11919 - DNA, 33 bp, Artificial Sequence
  Description of Artificial Sequence: Synthetic oligonucleotide
gccagttctcacaccatccagataatgtatggc

SEQ ID NO: 11920 - DNA, 34 bp, Artificial Sequence
  Description of Artificial Sequence: Synthetic oligonucleotide
ccagttctcacaccatccagataatgtatggctg

SEQ ID NO: 11921 - DNA, 34 bp, Artificial Sequence
  Description of Artificial Sequence: Synthetic oligonucleotide
cagttctcacaccatccagataatgtatggctgc

SEQ ID NO: 11922 - DNA, 34 bp, Artificial Sequence
  Description of Artificial Sequence: Synthetic oligonucleotide
agttctcacaccatccagataatgtatggctgcg

SEQ ID NO: 11923 - DNA, 23 bp, Artificial Sequence
  Description of Artificial Sequence: Synthetic oligonucleotide
gcaagtgggaggcggcccatgac

SEQ ID NO: 11924 - DNA, 23 bp, Artificial Sequence
  Description of Artificial Sequence: Synthetic oligonucleotide
caagtgggaggcggcccatgacg

SEQ ID NO: 11925 - DNA, 23 bp, Artificial Sequence
  Description of Artificial Sequence: Synthetic oligonucleotide
aagtgggaggcggcccatgacgc

SEQ ID NO: 11926 - DNA, 22 bp, Artificial Sequence
  Description of Artificial Sequence: Synthetic oligonucleotide
agtgggaggcggcccatgacgc

SEQ ID NO: 11927 - DNA, 21 bp, Artificial Sequence
  Description of Artificial Sequence: Synthetic oligonucleotide
gtgggaggcggcccatgacgc

SEQ ID NO: 11928 - DNA, 21 bp, Artificial Sequence
  Description of Artificial Sequence: Synthetic oligonucleotide
tgggaggcggcccatgacgcg

SEQ ID NO: 11929 - DNA, 20 bp, Artificial Sequence
  Description of Artificial Sequence: Synthetic oligonucleotide
gggaggcggcccatgacgcg

SEQ ID NO: 11930 - DNA, 21 bp, Artificial Sequence
  Description of Artificial Sequence: Synthetic oligonucleotide
ggaggcggcccatgacgcgga

SEQ ID NO: 11931 - DNA, 21 bp, Artificial Sequence
  Description of Artificial Sequence: Synthetic oligonucleotide
gaggcggcccatgacgcggag

SEQ ID NO: 11932 - DNA, 22 bp, Artificial Sequence
  Description of Artificial Sequence: Synthetic oligonucleotide
aggcggcccatgacgcggagca

SEQ ID NO: 11933 - DNA, 21 bp, Artificial Sequence
  Description of Artificial Sequence: Synthetic oligonucleotide
ggcggcccatgacgcggagca

SEQ ID NO: 11934 - DNA, 23 bp, Artificial Sequence
  Description of Artificial Sequence: Synthetic oligonucleotide
gcggcccatgacgcggagcagtt

SEQ ID NO: 11935 - DNA, 24 bp, Artificial Sequence
  Description of Artificial Sequence: Synthetic oligonucleotide
cggcccatgacgcggagcagttga

SEQ ID NO: 11936 - DNA, 25 bp, Artificial Sequence
  Description of Artificial Sequence: Synthetic oligonucleotide
ggcccatgacgcggagcagttgaga

SEQ ID NO: 11937 - DNA, 25 bp, Artificial Sequence
  Description of Artificial Sequence: Synthetic oligonucleotide
gcccatgacgcggagcagttgagag

SEQ ID NO: 11938 - DNA, 25 bp, Artificial Sequence
  Description of Artificial Sequence: Synthetic oligonucleotide
cccatgacgcggagcagttgagagc

SEQ ID NO: 11939 - DNA, 27 bp, Artificial Sequence
  Description of Artificial Sequence: Synthetic oligonucleotide
ccatgacgcggagcagttgagagccta

SEQ ID NO: 11940 - DNA, 27 bp, Artificial Sequence
  Description of Artificial Sequence: Synthetic oligonucleotide
catgacgcggagcagttgagagcctac

SEQ ID NO: 11941 - DNA, 27 bp, Artificial Sequence
  Description of Artificial Sequence: Synthetic oligonucleotide
atgacgcggagcagttgagagcctacc

SEQ ID NO: 11942 - DNA, 27 bp, Artificial Sequence
  Description of Artificial Sequence: Synthetic oligonucleotide
tgacgcggagcagttgagagcctacct

SEQ ID NO: 11943 - DNA, 26 bp, Artificial Sequence
  Description of Artificial Sequence: Synthetic oligonucleotide
gacgcggagcagttgagagcctacct

SEQ ID NO: 11944 - DNA, 26 bp, Artificial Sequence
  Description of Artificial Sequence: Synthetic oligonucleotide
acgcggagcagttgagagcctacctg

SEQ ID NO: 11945 - DNA, 25 bp, Artificial Sequence
  Description of Artificial Sequence: Synthetic oligonucleotide
cgcggagcagttgagagcctacctg

SEQ ID NO: 11946 - DNA, 21 bp, Artificial Sequence
  Description of Artificial Sequence: Synthetic oligonucleotide
cggcccatgaggcggagcagc

SEQ ID NO: 11947 - DNA, 21 bp, Artificial Sequence
  Description of Artificial Sequence: Synthetic oligonucleotide
ggcccatgaggcggagcagcg

SEQ ID NO: 11948 - DNA, 22 bp, Artificial Sequence
  Description of Artificial Sequence: Synthetic oligonucleotide
gcccatgaggcggagcagcgga

SEQ ID NO: 11949 - DNA, 23 bp, Artificial Sequence
  Description of Artificial Sequence: Synthetic oligonucleotide
cccatgaggcggagcagcggaga

SEQ ID NO: 11950 - DNA, 23 bp, Artificial Sequence
  Description of Artificial Sequence: Synthetic oligonucleotide
ccatgaggcggagcagcggagag

SEQ ID NO: 11951 - DNA, 23 bp, Artificial Sequence
  Description of Artificial Sequence: Synthetic oligonucleotide
catgaggcggagcagcggagagc

SEQ ID NO: 11952 - DNA, 25 bp, Artificial Sequence
  Description of Artificial Sequence: Synthetic oligonucleotide
atgaggcggagcagcggagagccta

SEQ ID NO: 11953 - DNA, 24 bp, Artificial Sequence
  Description of Artificial Sequence: Synthetic oligonucleotide
tgaggcggagcagcggagagccta

SEQ ID NO: 11954 - DNA, 23 bp, Artificial Sequence
  Description of Artificial Sequence: Synthetic oligonucleotide
gaggcggagcagcggagagccta

SEQ ID NO: 11955 - DNA, 23 bp, Artificial Sequence
  Description of Artificial Sequence: Synthetic oligonucleotide
aggcggagcagcggagagcctac

SEQ ID NO: 11956 - DNA, 25 bp, Artificial Sequence
  Description of Artificial Sequence: Synthetic oligonucleotide
ggagcagcggagagcctacctggat

SEQ ID NO: 11957 - DNA, 25 bp, Artificial Sequence
  Description of Artificial Sequence: Synthetic oligonucleotide
gagcagcggagagcctacctggatg

SEQ ID NO: 11958 - DNA, 25 bp, Artificial Sequence
  Description of Artificial Sequence: Synthetic oligonucleotide
agcagcggagagcctacctggatgg

SEQ ID NO: 11959 - DNA, 24 bp, Artificial Sequence
  Description of Artificial Sequence: Synthetic oligonucleotide
gcagcggagagcctacctggatgg

SEQ ID NO: 11960 - DNA, 25 bp, Artificial Sequence
  Description of Artificial Sequence: Synthetic oligonucleotide
cagcggagagcctacctggatggca

SEQ ID NO: 11961 - DNA, 25 bp, Artificial Sequence
  Description of Artificial Sequence: Synthetic oligonucleotide
agcggagagcctacctggatggcac

SEQ ID NO: 11962 - DNA, 24 bp, Artificial Sequence
  Description of Artificial Sequence: Synthetic oligonucleotide
gcggagagcctacctggatggcac

SEQ ID NO: 11963 - DNA, 25 bp, Artificial Sequence
  Description of Artificial Sequence: Synthetic oligonucleotide
cggagagcctacctggatggcacgt

SEQ ID NO: 11964 - DNA, 22 bp, Artificial Sequence
  Description of Artificial Sequence: Synthetic oligonucleotide
agcgacgccgcgagccagagga

SEQ ID NO: 11965 - DNA, 21 bp, Artificial Sequence
  Description of Artificial Sequence: Synthetic oligonucleotide
gcgacgccgcgagccagagga

SEQ ID NO: 11966 - DNA, 21 bp, Artificial Sequence
  Description of Artificial Sequence: Synthetic oligonucleotide
cgacgccgcgagccagaggac

SEQ ID NO: 11967 - DNA, 21 bp, Artificial Sequence
  Description of Artificial Sequence: Synthetic oligonucleotide
gacgccgcgagccagaggacg

SEQ ID NO: 11968 - DNA, 22 bp, Artificial Sequence
  Description of Artificial Sequence: Synthetic oligonucleotide
acgccgcgagccagaggacgga

SEQ ID NO: 11969 - DNA, 21 bp, Artificial Sequence
  Description of Artificial Sequence: Synthetic oligonucleotide
cgccgcgagccagaggacgga

SEQ ID NO: 11970 - DNA, 21 bp, Artificial Sequence
  Description of Artificial Sequence: Synthetic oligonucleotide
gccgcgagccagaggacggag

SEQ ID NO: 11971 - DNA, 21 bp, Artificial Sequence
  Description of Artificial Sequence: Synthetic oligonucleotide
ccgcgagccagaggacggagc

SEQ ID NO: 11972 - DNA, 21 bp, Artificial Sequence
  Description of Artificial Sequence: Synthetic oligonucleotide
cgcgagccagaggacggagcc

SEQ ID NO: 11973 - DNA, 21 bp, Artificial Sequence
  Description of Artificial Sequence: Synthetic oligonucleotide
gcgagccagaggacggagccg

SEQ ID NO: 11974 - DNA, 21 bp, Artificial Sequence
  Description of Artificial Sequence: Synthetic oligonucleotide
cgagccagaggacggagccgc

SEQ ID NO: 11975 - DNA, 21 bp, Artificial Sequence
  Description of Artificial Sequence: Synthetic oligonucleotide
gagccagaggacggagccgcg

SEQ ID NO: 11976 - DNA, 21 bp, Artificial Sequence
  Description of Artificial Sequence: Synthetic oligonucleotide
agccagaggacggagccgcgg

SEQ ID NO: 11977 - DNA, 20 bp, Artificial Sequence
  Description of Artificial Sequence: Synthetic oligonucleotide
gccagaggacggagccgcgg

SEQ ID NO: 11978 - DNA, 20 bp, Artificial Sequence
  Description of Artificial Sequence: Synthetic oligonucleotide
ccagaggacggagccgcggg

SEQ ID NO: 11979 - DNA, 20 bp, Artificial Sequence
  Description of Artificial Sequence: Synthetic oligonucleotide
cagaggacggagccgcgggc

SEQ ID NO: 11980 - DNA, 20 bp, Artificial Sequence
  Description of Artificial Sequence: Synthetic oligonucleotide
agaggacggagccgcgggcg

SEQ ID NO: 11981 - DNA, 20 bp, Artificial Sequence
  Description of Artificial Sequence: Synthetic oligonucleotide
gaggacggagccgcgggcgt

SEQ ID NO: 11982 - DNA, 20 bp, Artificial Sequence
  Description of Artificial Sequence: Synthetic oligonucleotide
aggacggagccgcgggcgct

SEQ ID NO: 11983 - DNA, 20 bp, Artificial Sequence
  Description of Artificial Sequence: Synthetic oligonucleotide
ggacggagccgcgggcgctt

SEQ ID NO: 11984 - DNA, 20 bp, Artificial Sequence
  Description of Artificial Sequence: Synthetic oligonucleotide
gacggagccgcgggcgcctt

SEQ ID NO: 11985 - DNA, 20 bp, Artificial Sequence
  Description of Artificial Sequence: Synthetic oligonucleotide
acggagccgcgggcgccgtt

SEQ ID NO: 11986 - DNA, 20 bp, Artificial Sequence
  Description of Artificial Sequence: Synthetic oligonucleotide
cggagccgcgggcgccgttt

SEQ ID NO: 11987 - DNA, 26 bp, Artificial Sequence
  Description of Artificial Sequence: Synthetic oligonucleotide
gggaccctgcgcggctactacaacta

SEQ ID NO: 11988 - DNA, 27 bp, Artificial Sequence
  Description of Artificial Sequence: Synthetic oligonucleotide
ggaccctgcgcggctactacaactaga

SEQ ID NO: 11989 - DNA, 27 bp, Artificial Sequence
  Description of Artificial Sequence: Synthetic oligonucleotide
gaccctgcgcggctactacaactagag

SEQ ID NO: 11990 - DNA, 27 bp, Artificial Sequence
  Description of Artificial Sequence: Synthetic oligonucleotide
accctgcgcggctactacaactagagc

SEQ ID NO: 11991 - DNA, 26 bp, Artificial Sequence
  Description of Artificial Sequence: Synthetic oligonucleotide
ccctgcgcggctactacaactagagc

SEQ ID NO: 11992 - DNA, 27 bp, Artificial Sequence
  Description of Artificial Sequence: Synthetic oligonucleotide
cctgcgcggctactacaactagagcga

SEQ ID NO: 11993 - DNA, 27 bp, Artificial Sequence
  Description of Artificial Sequence: Synthetic oligonucleotide
ctgcgcggctactacaactagagcgag

SEQ ID NO: 11994 - DNA, 27 bp, Artificial Sequence
  Description of Artificial Sequence: Synthetic oligonucleotide
tgcgcggctactacaactagagcgagg

SEQ ID NO: 11995 - DNA, 26 bp, Artificial Sequence
  Description of Artificial Sequence: Synthetic oligonucleotide
gcgcggctactacaactagagcgagg

SEQ ID NO: 11996 - DNA, 26 bp, Artificial Sequence
  Description of Artificial Sequence: Synthetic oligonucleotide
cgcggctactacaactagagcgaggc

SEQ ID NO: 11997 - DNA, 26 bp, Artificial Sequence
  Description of Artificial Sequence: Synthetic oligonucleotide
gcggctactacaactagagcgaggcc

SEQ ID NO: 11998 - DNA, 26 bp, Artificial Sequence
  Description of Artificial Sequence: Synthetic oligonucleotide
cggctactacaactagagcgaggccg

SEQ ID NO: 11999 - DNA, 27 bp, Artificial Sequence
  Description of Artificial Sequence: Synthetic oligonucleotide
ggctactacaactagagcgaggccggt

SEQ ID NO: 12000 - DNA, 28 bp, Artificial Sequence
  Description of Artificial Sequence: Synthetic oligonucleotide
gctactacaactagagcgaggccggttc

SEQ ID NO: 12001 - DNA, 29 bp, Artificial Sequence
  Description of Artificial Sequence: Synthetic oligonucleotide
ctactacaactagagcgaggccggttctc

SEQ ID NO: 12002 - DNA, 30 bp, Artificial Sequence
  Description of Artificial Sequence: Synthetic oligonucleotide
tactacaactagagcgaggccggttctcac

SEQ ID NO: 12003 - DNA, 29 bp, Artificial Sequence
  Description of Artificial Sequence: Synthetic oligonucleotide
actacaactagagcgaggccggttctcac

SEQ ID NO: 12004 - DNA, 28 bp, Artificial Sequence
  Description of Artificial Sequence: Synthetic oligonucleotide
ctacaactagagcgaggccggttctcac

SEQ ID NO: 12005 - DNA, 29 bp, Artificial Sequence
  Description of Artificial Sequence: Synthetic oligonucleotide
tacaactagagcgaggccggttctcacac

SEQ ID NO: 12006 - DNA, 28 bp, Artificial Sequence
  Description of Artificial Sequence: Synthetic oligonucleotide
acaactagagcgaggccggttctcacac

SEQ ID NO: 12007 - DNA, 27 bp, Artificial Sequence
  Description of Artificial Sequence: Synthetic oligonucleotide
caactagagcgaggccggttctcacac

SEQ ID NO: 12008 - DNA, 27 bp, Artificial Sequence
  Description of Artificial Sequence: Synthetic oligonucleotide
aactagagcgaggccggttctcacacc

SEQ ID NO: 12009 - DNA, 27 bp, Artificial Sequence
  Description of Artificial Sequence: Synthetic oligonucleotide
actagagcgaggccggttctcacacca

SEQ ID NO: 12010 - DNA, 27 bp, Artificial Sequence
  Description of Artificial Sequence: Synthetic oligonucleotide
ctagagcgaggccggttctcacaccat

SEQ ID NO: 12011 - DNA, 27 bp, Artificial Sequence
  Description of Artificial Sequence: Synthetic oligonucleotide
tagagcgaggccggttctcacaccatc

SEQ ID NO: 12012 - DNA, 23 bp, Artificial Sequence
  Description of Artificial Sequence: Synthetic oligonucleotide
gcggcccatgaggcggagcagta

SEQ ID NO: 12013 - DNA, 24 bp, Artificial Sequence
  Description of Artificial Sequence: Synthetic oligonucleotide
cggcccatgaggcggagcagtaga

SEQ ID NO: 12014 - DNA, 25 bp, Artificial Sequence
  Description of Artificial Sequence: Synthetic oligonucleotide
ggcccatgaggcggagcagtagaga

SEQ ID NO: 12015 - DNA, 25 bp, Artificial Sequence
  Description of Artificial Sequence: Synthetic oligonucleotide
gcccatgaggcggagcagtagagag

SEQ ID NO: 12016 - DNA, 25 bp, Artificial Sequence
  Description of Artificial Sequence: Synthetic oligonucleotide
cccatgaggcggagcagtagagagc

SEQ ID NO: 12017 - DNA, 27 bp, Artificial Sequence
  Description of Artificial Sequence: Synthetic oligonucleotide
ccatgaggcggagcagtagagagccta

SEQ ID NO: 12018 - DNA, 27 bp, Artificial Sequence
  Description of Artificial Sequence: Synthetic oligonucleotide
catgaggcggagcagtagagagcctac

SEQ ID NO: 12019 - DNA, 27 bp, Artificial Sequence
  Description of Artificial Sequence: Synthetic oligonucleotide
atgaggcggagcagtagagagcctacc

SEQ ID NO: 12020 - DNA, 27 bp, Artificial Sequence
  Description of Artificial Sequence: Synthetic oligonucleotide
tgaggcggagcagtagagagcctacct

SEQ ID NO: 12021 - DNA, 26 bp, Artificial Sequence
  Description of Artificial Sequence: Synthetic oligonucleotide
gaggcggagcagtagagagcctacct

SEQ ID NO: 12022 - DNA, 26 bp, Artificial Sequence
  Description of Artificial Sequence: Synthetic oligonucleotide
aggcggagcagtagagagcctacctg

SEQ ID NO: 12023 - DNA, 27 bp, Artificial Sequence
  Description of Artificial Sequence: Synthetic oligonucleotide
gcggagcagtagagagcctacctggat

SEQ ID NO: 12024 - DNA, 27 bp, Artificial Sequence
  Description of Artificial Sequence: Synthetic oligonucleotide
cggagcagtagagagcctacctggatg

SEQ ID NO: 12025 - DNA, 27 bp, Artificial Sequence
  Description of Artificial Sequence: Synthetic oligonucleotide
ggagcagtagagagcctacctggatgg

SEQ ID NO: 12026 - DNA, 27 bp, Artificial Sequence
  Description of Artificial Sequence: Synthetic oligonucleotide
gagcagtagagagcctacctggatggc

SEQ ID NO: 12027 - DNA, 28 bp, Artificial Sequence
  Description of Artificial Sequence: Synthetic oligonucleotide
agcagtagagagcctacctggatggcac

SEQ ID NO: 12028 - DNA, 27 bp, Artificial Sequence
  Description of Artificial Sequence: Synthetic oligonucleotide
gcagtagagagcctacctggatggcac

SEQ ID NO: 12029 - DNA, 27 bp, Artificial Sequence
  Description of Artificial Sequence: Synthetic oligonucleotide
cagtagagagcctacctggatggcacg

SEQ ID NO: 12030 - DNA, 28 bp, Artificial Sequence
  Description of Artificial Sequence: Synthetic oligonucleotide
agtagagagcctacctggatggcacgtg

SEQ ID NO: 12031 - DNA, 27 bp, Artificial Sequence
  Description of Artificial Sequence: Synthetic oligonucleotide
gtagagagcctacctggatggcacgtg

SEQ ID NO: 12032 - DNA, 27 bp, Artificial Sequence
  Description of Artificial Sequence: Synthetic oligonucleotide
tagagagcctacctggatggcacgtgc

SEQ ID NO: 12033 - DNA, 30 bp, Artificial Sequence
  Description of Artificial Sequence: Synthetic oligonucleotide
cggagtattgggaccaggagacatggaatg

SEQ ID NO: 12034 - DNA, 31 bp, Artificial Sequence
  Description of Artificial Sequence: Synthetic oligonucleotide
ggagtattgggaccaggagacatggaatgtg

SEQ ID NO: 12035 - DNA, 33 bp, Artificial Sequence
  Description of Artificial Sequence: Synthetic oligonucleotide
gagtattgggaccaggagacatggaatgtgaag

SEQ ID NO: 12036 - DNA, 33 bp, Artificial Sequence
  Description of Artificial Sequence: Synthetic oligonucleotide
agtattgggaccaggagacatggaatgtgaagg

SEQ ID NO: 12037 - DNA, 32 bp, Artificial Sequence
  Description of Artificial Sequence: Synthetic oligonucleotide
gtattgggaccaggagacatggaatgtgaagg

SEQ ID NO: 12038 - DNA, 32 bp, Artificial Sequence
  Description of Artificial Sequence: Synthetic oligonucleotide
tattgggaccaggagacatggaatgtgaaggc

SEQ ID NO: 12039 - DNA, 31 bp, Artificial Sequence
  Description of Artificial Sequence: Synthetic oligonucleotide
attgggaccaggagacatggaatgtgaaggc

SEQ ID NO: 12040 - DNA, 30 bp, Artificial Sequence
  Description of Artificial Sequence: Synthetic oligonucleotide
ttgggaccaggagacatggaatgtgaaggc

SEQ ID NO: 12041 - DNA, 29 bp, Artificial Sequence
  Description of Artificial Sequence: Synthetic oligonucleotide
tgggaccaggagacatggaatgtgaaggc

SEQ ID NO: 12042 - DNA, 28 bp, Artificial Sequence
  Description of Artificial Sequence: Synthetic oligonucleotide
gggaccaggagacatggaatgtgaaggc

SEQ ID NO: 12043 - DNA, 28 bp, Artificial Sequence
  Description of Artificial Sequence: Synthetic oligonucleotide
ggaccaggagacatggaatgtgaaggcc

SEQ ID NO: 12044 - DNA, 28 bp, Artificial Sequence
  Description of Artificial Sequence: Synthetic oligonucleotide
gaccaggagacatggaatgtgaaggccc

SEQ ID NO: 12045 - DNA, 29 bp, Artificial Sequence
  Description of Artificial Sequence: Synthetic oligonucleotide
accaggagacatggaatgtgaaggcccag

SEQ ID NO: 12046 - DNA, 28 bp, Artificial Sequence
  Description of Artificial Sequence: Synthetic oligonucleotide
ccaggagacatggaatgtgaaggcccag

SEQ ID NO: 12047 - DNA, 29 bp, Artificial Sequence
  Description of Artificial Sequence: Synthetic oligonucleotide
caggagacatggaatgtgaaggcccagtc

SEQ ID NO: 12048 - DNA, 30 bp, Artificial Sequence
  Description of Artificial Sequence: Synthetic oligonucleotide
aggagacatggaatgtgaaggcccagtcac

SEQ ID NO: 12049 - DNA, 29 bp, Artificial Sequence
  Description of Artificial Sequence: Synthetic oligonucleotide
ggagacatggaatgtgaaggcccagtcac

SEQ ID NO: 12050 - DNA, 30 bp, Artificial Sequence
  Description of Artificial Sequence: Synthetic oligonucleotide
gagacatggaatgtgaaggcccagtcacag

SEQ ID NO: 12051 - DNA, 31 bp, Artificial Sequence
  Description of Artificial Sequence: Synthetic oligonucleotide
agacatggaatgtgaaggcccagtcacagac

SEQ ID NO: 12052 - DNA, 30 bp, Artificial Sequence
  Description of Artificial Sequence: Synthetic oligonucleotide
gacatggaatgtgaaggcccagtcacagac

SEQ ID NO: 12053 - DNA, 31 bp, Artificial Sequence
  Description of Artificial Sequence: Synthetic oligonucleotide
acatggaatgtgaaggcccagtcacagactg

SEQ ID NO: 12054 - DNA, 30 bp, Artificial Sequence
  Description of Artificial Sequence: Synthetic oligonucleotide
catggaatgtgaaggcccagtcacagactg

SEQ ID NO: 12055 - DNA, 31 bp, Artificial Sequence
  Description of Artificial Sequence: Synthetic oligonucleotide
atggaatgtgaaggcccagtcacagactgac

SEQ ID NO: 12056 - DNA, 30 bp, Artificial Sequence
  Description of Artificial Sequence: Synthetic oligonucleotide
tggaatgtgaaggcccagtcacagactgac

SEQ ID NO: 12057 - DNA, 20 bp, Artificial Sequence
  Description of Artificial Sequence: Synthetic oligonucleotide
gagccgcgggcgccgtggat

SEQ ID NO: 12058 - DNA, 20 bp, Artificial Sequence
  Description of Artificial Sequence: Synthetic oligonucleotide
agccgcgggcgccgtggatg

SEQ ID NO: 12059 - DNA, 20 bp, Artificial Sequence
  Description of Artificial Sequence: Synthetic oligonucleotide
gccgcgggcgccgtggatgt

SEQ ID NO: 12060 - DNA, 20 bp, Artificial Sequence
  Description of Artificial Sequence: Synthetic oligonucleotide
ccgcgggcgccgtggatgga

SEQ ID NO: 12061 - DNA, 20 bp, Artificial Sequence
  Description of Artificial Sequence: Synthetic oligonucleotide
cgcgggcgccgtggatggag

SEQ ID NO: 12062 - DNA, 21 bp, Artificial Sequence
  Description of Artificial Sequence: Synthetic oligonucleotide
gcgggcgccgtggatggagca

SEQ ID NO: 12063 - DNA, 21 bp, Artificial Sequence
  Description of Artificial Sequence: Synthetic oligonucleotide
cgggcgccgtggatggagcag

SEQ ID NO: 12064 - DNA, 22 bp, Artificial Sequence
  Description of Artificial Sequence: Synthetic oligonucleotide
gggcgccgtggatggagcagga

SEQ ID NO: 12065 - DNA, 22 bp, Artificial Sequence
  Description of Artificial Sequence: Synthetic oligonucleotide
ggcgccgtggatggagcaggag

SEQ ID NO: 12066 - DNA, 22 bp, Artificial Sequence
  Description of Artificial Sequence: Synthetic oligonucleotide
gcgccgtggatggagcaggagg

SEQ ID NO: 12067 - DNA, 22 bp, Artificial Sequence
  Description of Artificial Sequence: Synthetic oligonucleotide
cgccgtggatggagcaggaggg

SEQ ID NO: 12068 - DNA, 22 bp, Artificial Sequence
  Description of Artificial Sequence: Synthetic oligonucleotide
gccgtggatggagcaggagggg

SEQ ID NO: 12069 - DNA, 22 bp, Artificial Sequence
  Description of Artificial Sequence: Synthetic oligonucleotide
ccgtggatggagcaggaggggc

SEQ ID NO: 12070 - DNA, 22 bp, Artificial Sequence
  Description of Artificial Sequence: Synthetic oligonucleotide
cgtggatggagcaggaggggcc

SEQ ID NO: 12071 - DNA, 22 bp, Artificial Sequence
  Description of Artificial Sequence: Synthetic oligonucleotide
gtggatggagcaggaggggccg

SEQ ID NO: 12072 - DNA, 23 bp, Artificial Sequence
  Description of Artificial Sequence: Synthetic oligonucleotide
tggatggagcaggaggggccgga

SEQ ID NO: 12073 - DNA, 22 bp, Artificial Sequence
  Description of Artificial Sequence: Synthetic oligonucleotide
ggatggagcaggaggggccgga

SEQ ID NO: 12074 - DNA, 26 bp, Artificial Sequence
  Description of Artificial Sequence: Synthetic oligonucleotide
gatggagcaggaggggccggagtatt

SEQ ID NO: 12075 - DNA, 26 bp, Artificial Sequence
  Description of Artificial Sequence: Synthetic oligonucleotide
atggagcaggaggggccggagtattg

SEQ ID NO: 12076 - DNA, 25 bp, Artificial Sequence
  Description of Artificial Sequence: Synthetic oligonucleotide
tggagcaggaggggccggagtattg

SEQ ID NO: 12077 - DNA, 24 bp, Artificial Sequence
  Description of Artificial Sequence: Synthetic oligonucleotide
ggagcaggaggggccggagtattg

SEQ ID NO: 12078 - DNA, 26 bp, Artificial Sequence
  Description of Artificial Sequence: Synthetic oligonucleotide
ctggatggcacgtgcgtggagtggtt

SEQ ID NO: 12079 - DNA, 26 bp, Artificial Sequence
  Description of Artificial Sequence: Synthetic oligonucleotide
tggatggcacgtgcgtggagtggttc

SEQ ID NO: 12080 - DNA, 25 bp, Artificial Sequence
  Description of Artificial Sequence: Synthetic oligonucleotide
ggatggcacgtgcgtggagtggttc

SEQ ID NO: 12081 - DNA, 25 bp, Artificial Sequence
  Description of Artificial Sequence: Synthetic oligonucleotide
gatggcacgtgcgtggagtggttcc

SEQ ID NO: 12082 - DNA, 25 bp, Artificial Sequence
  Description of Artificial Sequence: Synthetic oligonucleotide
atggcacgtgcgtggagtggttccg

SEQ ID NO: 12083 - DNA, 24 bp, Artificial Sequence
  Description of Artificial Sequence: Synthetic oligonucleotide
tggcacgtgcgtggagtggttccg

SEQ ID NO: 12084 - DNA, 23 bp, Artificial Sequence
  Description of Artificial Sequence: Synthetic oligonucleotide
ggcacgtgcgtggagtggttccg

SEQ ID NO: 12085 - DNA, 24 bp, Artificial Sequence
  Description of Artificial Sequence: Synthetic oligonucleotide
gcacgtgcgtggagtggttccgca

SEQ ID NO: 12086 - DNA, 27 bp, Artificial Sequence
  Description of Artificial Sequence: Synthetic oligonucleotide
cacgtgcgtggagtggttccgcagata

SEQ ID NO: 12087 - DNA, 27 bp, Artificial Sequence
  Description of Artificial Sequence: Synthetic oligonucleotide
acgtgcgtggagtggttccgcagatac

SEQ ID NO: 12088 - DNA, 26 bp, Artificial Sequence
  Description of Artificial Sequence: Synthetic oligonucleotide
cgtgcgtggagtggttccgcagatac

SEQ ID NO: 12089 - DNA, 27 bp, Artificial Sequence
  Description of Artificial Sequence: Synthetic oligonucleotide
gtgcgtggagtggttccgcagatacct

SEQ ID NO: 12090 - DNA, 27 bp, Artificial Sequence
  Description of Artificial Sequence: Synthetic oligonucleotide
tgcgtggagtggttccgcagatacctg

SEQ ID NO: 12091 - DNA, 26 bp, Artificial Sequence
  Description of Artificial Sequence: Synthetic oligonucleotide
gcgtggagtggttccgcagatacctg

SEQ ID NO: 12092 - DNA, 27 bp, Artificial Sequence
  Description of Artificial Sequence: Synthetic oligonucleotide
cgtggagtggttccgcagatacctgga

SEQ ID NO: 12093 - DNA, 27 bp, Artificial Sequence
  Description of Artificial Sequence: Synthetic oligonucleotide
gtggagtggttccgcagatacctggag

SEQ ID NO: 12094 - DNA, 29 bp, Artificial Sequence
  Description of Artificial Sequence: Synthetic oligonucleotide
tggagtggttccgcagatacctggagaac

SEQ ID NO: 12095 - DNA, 28 bp, Artificial Sequence
  Description of Artificial Sequence: Synthetic oligonucleotide
ggagtggttccgcagatacctggagaac

SEQ ID NO: 12096 - DNA, 28 bp, Artificial Sequence
  Description of Artificial Sequence: Synthetic oligonucleotide
gagtggttccgcagatacctggagaacg

SEQ ID NO: 12097 - DNA, 28 bp, Artificial Sequence
  Description of Artificial Sequence: Synthetic oligonucleotide
agtggttccgcagatacctggagaacgg

SEQ ID NO: 12098 - DNA, 27 bp, Artificial Sequence
  Description of Artificial Sequence: Synthetic oligonucleotide
gtggttccgcagatacctggagaacgg

SEQ ID NO: 12099 - DNA, 27 bp, Artificial Sequence
  Description of Artificial Sequence: Synthetic oligonucleotide
tggttccgcagatacctggagaacggg

SEQ ID NO: 12100 - DNA, 27 bp, Artificial Sequence
  Description of Artificial Sequence: Synthetic oligonucleotide
ggttccgcagatacctggagaacggga

SEQ ID NO: 12101 - DNA, 28 bp, Artificial Sequence
  Description of Artificial Sequence: Synthetic oligonucleotide
gttccgcagatacctggagaacgggaag

SEQ ID NO: 12102 - DNA, 28 bp, Artificial Sequence
  Description of Artificial Sequence: Synthetic oligonucleotide
ttccgcagatacctggagaacgggaagg

SEQ ID NO: 12103 - DNA, 28 bp, Artificial Sequence
  Description of Artificial Sequence: Synthetic oligonucleotide
tcagatcaccaagcgcaagtgggaggag

SEQ ID NO: 12104 - DNA, 27 bp, Artificial Sequence
  Description of Artificial Sequence: Synthetic oligonucleotide
cagatcaccaagcgcaagtgggaggag

SEQ ID NO: 12105 - DNA, 27 bp, Artificial Sequence
  Description of Artificial Sequence: Synthetic oligonucleotide
agatcaccaagcgcaagtgggaggagg

SEQ ID NO: 12106 - DNA, 26 bp, Artificial Sequence
  Description of Artificial Sequence: Synthetic oligonucleotide
gatcaccaagcgcaagtgggaggagg

SEQ ID NO: 12107 - DNA, 26 bp, Artificial Sequence
  Description of Artificial Sequence: Synthetic oligonucleotide
atcaccaagcgcaagtgggaggaggc

SEQ ID NO: 12108 - DNA, 25 bp, Artificial Sequence
  Description of Artificial Sequence: Synthetic oligonucleotide
tcaccaagcgcaagtgggaggaggc

SEQ ID NO: 12109 - DNA, 24 bp, Artificial Sequence
  Description of Artificial Sequence: Synthetic oligonucleotide
caccaagcgcaagtgggaggaggc

SEQ ID NO: 12110 - DNA, 24 bp, Artificial Sequence
  Description of Artificial Sequence: Synthetic oligonucleotide
accaagcgcaagtgggaggaggcc

SEQ ID NO: 12111 - DNA, 23 bp, Artificial Sequence
  Description of Artificial Sequence: Synthetic oligonucleotide
ccaagcgcaagtgggaggaggcc

SEQ ID NO: 12112 - DNA, 25 bp, Artificial Sequence
  Description of Artificial Sequence: Synthetic oligonucleotide
caagcgcaagtgggaggaggcccat

SEQ ID NO: 12113 - DNA, 26 bp, Artificial Sequence
  Description of Artificial Sequence: Synthetic oligonucleotide
aagcgcaagtgggaggaggcccatga

SEQ ID NO: 12114 - DNA, 25 bp, Artificial Sequence
  Description of Artificial Sequence: Synthetic oligonucleotide
agcgcaagtgggaggaggcccatga

SEQ ID NO: 12115 - DNA, 24 bp, Artificial Sequence
  Description of Artificial Sequence: Synthetic oligonucleotide
gcgcaagtgggaggaggcccatga

SEQ ID NO: 12116 - DNA, 24 bp, Artificial Sequence
  Description of Artificial Sequence: Synthetic oligonucleotide
cgcaagtgggaggaggcccatgag

SEQ ID NO: 12117 - DNA, 24 bp, Artificial Sequence
  Description of Artificial Sequence: Synthetic oligonucleotide
gcaagtgggaggaggcccatgagg

SEQ ID NO: 12118 - DNA, 24 bp, Artificial Sequence
  Description of Artificial Sequence: Synthetic oligonucleotide
caagtgggaggaggcccatgaggc

SEQ ID NO: 12119 - DNA, 24 bp, Artificial Sequence
  Description of Artificial Sequence: Synthetic oligonucleotide
aagtgggaggaggcccatgaggcg

SEQ ID NO: 12120 - DNA, 23 bp, Artificial Sequence
  Description of Artificial Sequence: Synthetic oligonucleotide
agtgggaggaggcccatgaggcg

SEQ ID NO: 12121 - DNA, 22 bp, Artificial Sequence
  Description of Artificial Sequence: Synthetic oligonucleotide
gtgggaggaggcccatgaggcg

SEQ ID NO: 12122 - DNA, 23 bp, Artificial Sequence
  Description of Artificial Sequence: Synthetic oligonucleotide
tgggaggaggcccatgaggcgga

SEQ ID NO: 12123 - DNA, 22 bp, Artificial Sequence
  Description of Artificial Sequence: Synthetic oligonucleotide
gggaggaggcccatgaggcgga

SEQ ID NO: 12124 - DNA, 22 bp, Artificial Sequence
  Description of Artificial Sequence: Synthetic oligonucleotide
ggaggaggcccatgaggcggag

SEQ ID NO: 12125 - DNA, 23 bp, Artificial Sequence
  Description of Artificial Sequence: Synthetic oligonucleotide
gaggaggcccatgaggcggagca

SEQ ID NO: 12126 - DNA, 25 bp, Artificial Sequence
  Description of Artificial Sequence: Synthetic oligonucleotide
aggaggcccatgaggcggagcagtt

SEQ ID NO: 12127 - DNA, 24 bp, Artificial Sequence
  Description of Artificial Sequence: Synthetic oligonucleotide
ggaggcccatgaggcggagcagtt

SEQ ID NO: 12128 - DNA, 25 bp, Artificial Sequence
  Description of Artificial Sequence: Synthetic oligonucleotide
gaggcccatgaggcggagcagttga

SEQ ID NO: 12129 - DNA, 26 bp, Artificial Sequence
  Description of Artificial Sequence: Synthetic oligonucleotide
aggcccatgaggcggagcagttgaga

SEQ ID NO: 12130 - DNA, 24 bp, Artificial Sequence
  Description of Artificial Sequence: Synthetic oligonucleotide
ctcttggaccgtggcggacatggc

SEQ ID NO: 12131 - DNA, 24 bp, Artificial Sequence
  Description of Artificial Sequence: Synthetic oligonucleotide
tcttggaccgtggcggacatggcg

SEQ ID NO: 12132 - DNA, 23 bp, Artificial Sequence
  Description of Artificial Sequence: Synthetic oligonucleotide
cttggaccgtggcggacatggcg

SEQ ID NO: 12133 - DNA, 23 bp, Artificial Sequence
  Description of Artificial Sequence: Synthetic oligonucleotide
ttggaccgtggcggacatggcgg

SEQ ID NO: 12134 - DNA, 22 bp, Artificial Sequence
  Description of Artificial Sequence: Synthetic oligonucleotide
tggaccgtggcggacatggcgg

SEQ ID NO: 12135 - DNA, 21 bp, Artificial Sequence
  Description of Artificial Sequence: Synthetic oligonucleotide
ggaccgtggcggacatggcgg

SEQ ID NO: 12136 - DNA, 22 bp, Artificial Sequence
  Description of Artificial Sequence: Synthetic oligonucleotide
gaccgtggcggacatggcggct

SEQ ID NO: 12137 - DNA, 23 bp, Artificial Sequence
  Description of Artificial Sequence: Synthetic oligonucleotide
accgtggcggacatggcggctca

SEQ ID NO: 12138 - DNA, 22 bp, Artificial Sequence
  Description of Artificial Sequence: Synthetic oligonucleotide
ccgtggcggacatggcggctca

SEQ ID NO: 12139 - DNA, 24 bp, Artificial Sequence
  Description of Artificial Sequence: Synthetic oligonucleotide
cgtggcggacatggcggctcagat

SEQ ID NO: 12140 - DNA, 25 bp, Artificial Sequence
  Description of Artificial Sequence: Synthetic oligonucleotide
gtggcggacatggcggctcagatca

SEQ ID NO: 12141 - DNA, 25 bp, Artificial Sequence
  Description of Artificial Sequence: Synthetic oligonucleotide
tggcggacatggcggctcagatcac

SEQ ID NO: 12142 - DNA, 28 bp, Artificial Sequence
  Description of Artificial Sequence: Synthetic oligonucleotide
tcagatcaccaagcgcaagtgggaggtg

SEQ ID NO: 12143 - DNA, 27 bp, Artificial Sequence
  Description of Artificial Sequence: Synthetic oligonucleotide
cagatcaccaagcgcaagtgggaggtg

SEQ ID NO: 12144 - DNA, 27 bp, Artificial Sequence
  Description of Artificial Sequence: Synthetic oligonucleotide
agatcaccaagcgcaagtgggaggtgg

SEQ ID NO: 12145 - DNA, 26 bp, Artificial Sequence
  Description of Artificial Sequence: Synthetic oligonucleotide
gatcaccaagcgcaagtgggaggtgg

SEQ ID NO: 12146 - DNA, 26 bp, Artificial Sequence
  Description of Artificial Sequence: Synthetic oligonucleotide
atcaccaagcgcaagtgggaggtggc

SEQ ID NO: 12147 - DNA, 25 bp, Artificial Sequence
  Description of Artificial Sequence: Synthetic oligonucleotide
tcaccaagcgcaagtgggaggtggc

SEQ ID NO: 12148 - DNA, 24 bp, Artificial Sequence
  Description of Artificial Sequence: Synthetic oligonucleotide
caccaagcgcaagtgggaggtggc

SEQ ID NO: 12149 - DNA, 24 bp, Artificial Sequence
  Description of Artificial Sequence: Synthetic oligonucleotide
accaagcgcaagtgggaggtggcc

SEQ ID NO: 12150 - DNA, 23 bp, Artificial Sequence
  Description of Artificial Sequence: Synthetic oligonucleotide
ccaagcgcaagtgggaggtggcc

SEQ ID NO: 12151 - DNA, 25 bp, Artificial Sequence
  Description of Artificial Sequence: Synthetic oligonucleotide
caagcgcaagtgggaggtggcccat

SEQ ID NO: 12152 - DNA, 26 bp, Artificial Sequence
  Description of Artificial Sequence: Synthetic oligonucleotide
aagcgcaagtgggaggtggcccatga

SEQ ID NO: 12153 - DNA, 25 bp, Artificial Sequence
  Description of Artificial Sequence: Synthetic oligonucleotide
agcgcaagtgggaggtggcccatga

SEQ ID NO: 12154 - DNA, 24 bp, Artificial Sequence
  Description of Artificial Sequence: Synthetic oligonucleotide
gcgcaagtgggaggtggcccatga

SEQ ID NO: 12155 - DNA, 24 bp, Artificial Sequence
  Description of Artificial Sequence: Synthetic oligonucleotide
cgcaagtgggaggtggcccatgag

SEQ ID NO: 12156 - DNA, 24 bp, Artificial Sequence
  Description of Artificial Sequence: Synthetic oligonucleotide
gcaagtgggaggtggcccatgagg

SEQ ID NO: 12157 - DNA, 24 bp, Artificial Sequence
  Description of Artificial Sequence: Synthetic oligonucleotide
caagtgggaggtggcccatgaggc

SEQ ID NO: 12158 - DNA, 24 bp, Artificial Sequence
  Description of Artificial Sequence: Synthetic oligonucleotide
aagtgggaggtggcccatgaggcg

SEQ ID NO: 12159 - DNA, 23 bp, Artificial Sequence
  Description of Artificial Sequence: Synthetic oligonucleotide
agtgggaggtggcccatgaggcg

SEQ ID NO: 12160 - DNA, 22 bp, Artificial Sequence
  Description of Artificial Sequence: Synthetic oligonucleotide
gtgggaggtggcccatgaggcg

SEQ ID NO: 12161 - DNA, 23 bp, Artificial Sequence
  Description of Artificial Sequence: Synthetic oligonucleotide
tgggaggtggcccatgaggcgga

SEQ ID NO: 12162 - DNA, 22 bp, Artificial Sequence
  Description of Artificial Sequence: Synthetic oligonucleotide
gggaggtggcccatgaggcgga

SEQ ID NO: 12163 - DNA, 22 bp, Artificial Sequence
  Description of Artificial Sequence: Synthetic oligonucleotide
ggaggtggcccatgaggcggag

SEQ ID NO: 12164 - DNA, 23 bp, Artificial Sequence
  Description of Artificial Sequence: Synthetic oligonucleotide
gaggtggcccatgaggcggagca

SEQ ID NO: 12165 - DNA, 25 bp, Artificial Sequence
  Description of Artificial Sequence: Synthetic oligonucleotide
aggtggcccatgaggcggagcagtt

SEQ ID NO: 12166 - DNA, 24 bp, Artificial Sequence
  Description of Artificial Sequence: Synthetic oligonucleotide
ggtggcccatgaggcggagcagtt

SEQ ID NO: 12167 - DNA, 25 bp, Artificial Sequence
  Description of Artificial Sequence: Synthetic oligonucleotide
gtggcccatgaggcggagcagttga

SEQ ID NO: 12168 - DNA, 26 bp, Artificial Sequence
  Description of Artificial Sequence: Synthetic oligonucleotide
tggcccatgaggcggagcagttgaga

SEQ ID NO: 12169 - DNA, 21 bp, Artificial Sequence
  Description of Artificial Sequence: Synthetic oligonucleotide
gcttcctccgcgggtaccggc

SEQ ID NO: 12170 - DNA, 21 bp, Artificial Sequence
  Description of Artificial Sequence: Synthetic oligonucleotide
cttcctccgcgggtaccggcg

SEQ ID NO: 12171 - DNA, 21 bp, Artificial Sequence
  Description of Artificial Sequence: Synthetic oligonucleotide
ttcctccgcgggtaccggcgg

SEQ ID NO: 12172 - DNA, 20 bp, Artificial Sequence
  Description of Artificial Sequence: Synthetic oligonucleotide
tcctccgcgggtaccggcgg

SEQ ID NO: 12173 - DNA, 20 bp, Artificial Sequence
  Description of Artificial Sequence: Synthetic oligonucleotide
cctccgcgggtaccggcggt

SEQ ID NO: 12174 - DNA, 20 bp, Artificial Sequence
  Description of Artificial Sequence: Synthetic oligonucleotide
ctccgcgggtaccggcggga

SEQ ID NO: 12175 - DNA, 20 bp, Artificial Sequence
  Description of Artificial Sequence: Synthetic oligonucleotide
tccgcgggtaccggcgggac

SEQ ID NO: 12176 - DNA, 20 bp, Artificial Sequence
  Description of Artificial Sequence: Synthetic oligonucleotide
ccgcgggtaccggcgggact

SEQ ID NO: 12177 - DNA, 20 bp, Artificial Sequence
  Description of Artificial Sequence: Synthetic oligonucleotide
cgcgggtaccggcgggacgt

SEQ ID NO: 12178 - DNA, 20 bp, Artificial Sequence
  Description of Artificial Sequence: Synthetic oligonucleotide
gcgggtaccggcgggacgct

SEQ ID NO: 12179 - DNA, 21 bp, Artificial Sequence
  Description of Artificial Sequence: Synthetic oligonucleotide
cgggtaccggcgggacgccta

SEQ ID NO: 12180 - DNA, 21 bp, Artificial Sequence
  Description of Artificial Sequence: Synthetic oligonucleotide
gggtaccggcgggacgcctac

SEQ ID NO: 12181 - DNA, 22 bp, Artificial Sequence
  Description of Artificial Sequence: Synthetic oligonucleotide
ggtaccggcgggacgcctacga

SEQ ID NO: 12182 - DNA, 22 bp, Artificial Sequence
  Description of Artificial Sequence: Synthetic oligonucleotide
gtaccggcgggacgcctacgac

SEQ ID NO: 12183 - DNA, 22 bp, Artificial Sequence
  Description of Artificial Sequence: Synthetic oligonucleotide
taccggcgggacgcctacgacg

SEQ ID NO: 12184 - DNA, 21 bp, Artificial Sequence
  Description of Artificial Sequence: Synthetic oligonucleotide
accggcgggacgcctacgacg

SEQ ID NO: 12185 - DNA, 20 bp, Artificial Sequence
  Description of Artificial Sequence: Synthetic oligonucleotide
ccggcgggacgcctacgacg

SEQ ID NO: 12186 - DNA, 20 bp, Artificial Sequence
  Description of Artificial Sequence: Synthetic oligonucleotide
cggcgggacgcctacgacgg

SEQ ID NO: 12187 - DNA, 22 bp, Artificial Sequence
  Description of Artificial Sequence: Synthetic oligonucleotide
ggcgggacgcctacgacggcaa

SEQ ID NO: 12188 - DNA, 22 bp, Artificial Sequence
  Description of Artificial Sequence: Synthetic oligonucleotide
gcgggacgcctacgacggcaag

SEQ ID NO: 12189 - DNA, 26 bp, Artificial Sequence
  Description of Artificial Sequence: Synthetic oligonucleotide
cgggacgcctacgacggcaaggatta

SEQ ID NO: 12190 - DNA, 27 bp, Artificial Sequence
  Description of Artificial Sequence: Synthetic oligonucleotide
gggacgcctacgacggcaaggattaca

SEQ ID NO: 12191 - DNA, 26 bp, Artificial Sequence
  Description of Artificial Sequence: Synthetic oligonucleotide
ctacgtggacgacacgcagttcgtgg

SEQ ID NO: 12192 - DNA, 26 bp, Artificial Sequence
  Description of Artificial Sequence: Synthetic oligonucleotide
tacgtggacgacacgcagttcgtggg

SEQ ID NO: 12193 - DNA, 25 bp, Artificial Sequence
  Description of Artificial Sequence: Synthetic oligonucleotide
acgtggacgacacgcagttcgtggg

SEQ ID NO: 12194 - DNA, 24 bp, Artificial Sequence
  Description of Artificial Sequence: Synthetic oligonucleotide
cgtggacgacacgcagttcgtggg

SEQ ID NO: 12195 - DNA, 26 bp, Artificial Sequence
  Description of Artificial Sequence: Synthetic oligonucleotide
gtggacgacacgcagttcgtggggtt

SEQ ID NO: 12196 - DNA, 26 bp, Artificial Sequence
  Description of Artificial Sequence: Synthetic oligonucleotide
tggacgacacgcagttcgtggggttc

SEQ ID NO: 12197 - DNA, 25 bp, Artificial Sequence
  Description of Artificial Sequence: Synthetic oligonucleotide
ggacgacacgcagttcgtggggttc

SEQ ID NO: 12198 - DNA, 26 bp, Artificial Sequence
  Description of Artificial Sequence: Synthetic oligonucleotide
gacgacacgcagttcgtggggttcga

SEQ ID NO: 12199 - DNA, 27 bp, Artificial Sequence
  Description of Artificial Sequence: Synthetic oligonucleotide
acgacacgcagttcgtggggttcgaca

SEQ ID NO: 12200 - DNA, 26 bp, Artificial Sequence
  Description of Artificial Sequence: Synthetic oligonucleotide
cgacacgcagttcgtggggttcgaca

SEQ ID NO: 12201 - DNA, 26 bp, Artificial Sequence
  Description of Artificial Sequence: Synthetic oligonucleotide
gacacgcagttcgtggggttcgacag

SEQ ID NO: 12202 - DNA, 26 bp, Artificial Sequence
  Description of Artificial Sequence: Synthetic oligonucleotide
acacgcagttcgtggggttcgacagc

SEQ ID NO: 12203 - DNA, 25 bp, Artificial Sequence
  Description of Artificial Sequence: Synthetic oligonucleotide
cacgcagttcgtggggttcgacagc

SEQ ID NO: 12204 - DNA, 26 bp, Artificial Sequence
  Description of Artificial Sequence: Synthetic oligonucleotide
acgcagttcgtggggttcgacagcga

SEQ ID NO: 12205 - DNA, 25 bp, Artificial Sequence
  Description of Artificial Sequence: Synthetic oligonucleotide
cgcagttcgtggggttcgacagcga

SEQ ID NO: 12206 - DNA, 25 bp, Artificial Sequence
  Description of Artificial Sequence: Synthetic oligonucleotide
gcagttcgtggggttcgacagcgac

SEQ ID NO: 12207 - DNA, 25 bp, Artificial Sequence
  Description of Artificial Sequence: Synthetic oligonucleotide
cagttcgtggggttcgacagcgacg

SEQ ID NO: 12208 - DNA, 25 bp, Artificial Sequence
  Description of Artificial Sequence: Synthetic oligonucleotide
agttcgtggggttcgacagcgacgc

SEQ ID NO: 12209 - DNA, 24 bp, Artificial Sequence
  Description of Artificial Sequence: Synthetic oligonucleotide
gttcgtggggttcgacagcgacgc

SEQ ID NO: 12210 - DNA, 24 bp, Artificial Sequence
  Description of Artificial Sequence: Synthetic oligonucleotide
ttcgtggggttcgacagcgacgcc

SEQ ID NO: 12211 - DNA, 23 bp, Artificial Sequence
  Description of Artificial Sequence: Synthetic oligonucleotide
tcgtggggttcgacagcgacgcc

SEQ ID NO: 12212 - DNA, 22 bp, Artificial Sequence
  Description of Artificial Sequence: Synthetic oligonucleotide
cgtggggttcgacagcgacgcc

SEQ ID NO: 12213 - DNA, 22 bp, Artificial Sequence
  Description of Artificial Sequence: Synthetic oligonucleotide
gtggggttcgacagcgacgccg

SEQ ID NO: 12214 - DNA, 22 bp, Artificial Sequence
  Description of Artificial Sequence: Synthetic oligonucleotide
tggggttcgacagcgacgccgc

SEQ ID NO: 12215 - DNA, 21 bp, Artificial Sequence
  Description of Artificial Sequence: Synthetic oligonucleotide
ggggttcgacagcgacgccgc

SEQ ID NO: 12216 - DNA, 22 bp, Artificial Sequence
  Description of Artificial Sequence: Synthetic oligonucleotide
gggttcgacagcgacgccgcga

SEQ ID NO: 12217 - DNA, 26 bp, Artificial Sequence
  Description of Artificial Sequence: Synthetic oligonucleotide
accgcggcagacatggcagctcagat

SEQ ID NO: 12218 - DNA, 25 bp, Artificial Sequence
  Description of Artificial Sequence: Synthetic oligonucleotide
ccgcggcagacatggcagctcagat

SEQ ID NO: 12219 - DNA, 26 bp, Artificial Sequence
  Description of Artificial Sequence: Synthetic oligonucleotide
cgcggcagacatggcagctcagatca

SEQ ID NO: 12220 - DNA, 26 bp, Artificial Sequence
  Description of Artificial Sequence: Synthetic oligonucleotide
gcggcagacatggcagctcagatcac

SEQ ID NO: 12221 - DNA, 27 bp, Artificial Sequence
  Description of Artificial Sequence: Synthetic oligonucleotide
cggcagacatggcagctcagatcacca

SEQ ID NO: 12222 - DNA, 28 bp, Artificial Sequence
  Description of Artificial Sequence: Synthetic oligonucleotide
ggcagacatggcagctcagatcaccaag

SEQ ID NO: 12223 - DNA, 28 bp, Artificial Sequence
  Description of Artificial Sequence: Synthetic oligonucleotide
gcagacatggcagctcagatcaccaagc

SEQ ID NO: 12224 - DNA, 28 bp, Artificial Sequence
  Description of Artificial Sequence: Synthetic oligonucleotide
cagacatggcagctcagatcaccaagcg

SEQ ID NO: 12225 - DNA, 28 bp, Artificial Sequence
  Description of Artificial Sequence: Synthetic oligonucleotide
agacatggcagctcagatcaccaagcgc

SEQ ID NO: 12226 - DNA, 23 bp, Artificial Sequence
  Description of Artificial Sequence: Synthetic oligonucleotide
gagtggacctggggaccctgcgt

SEQ ID NO: 12227 - DNA, 23 bp, Artificial Sequence
  Description of Artificial Sequence: Synthetic oligonucleotide
agtggacctggggaccctgcgtg

SEQ ID NO: 12228 - DNA, 22 bp, Artificial Sequence
  Description of Artificial Sequence: Synthetic oligonucleotide
gtggacctggggaccctgcgtg

SEQ ID NO: 12229 - DNA, 22 bp, Artificial Sequence
  Description of Artificial Sequence: Synthetic oligonucleotide
tggacctggggaccctgcgtgg

SEQ ID NO: 12230 - DNA, 21 bp, Artificial Sequence
  Description of Artificial Sequence: Synthetic oligonucleotide
ggacctggggaccctgcgtgg

SEQ ID NO: 12231 - DNA, 23 bp, Artificial Sequence
  Description of Artificial Sequence: Synthetic oligonucleotide
gacctggggaccctgcgtggcta

SEQ ID NO: 12232 - DNA, 25 bp, Artificial Sequence
  Description of Artificial Sequence: Synthetic oligonucleotide
acctggggaccctgcgtggctacta

SEQ ID NO: 12233 - DNA, 24 bp, Artificial Sequence
  Description of Artificial Sequence: Synthetic oligonucleotide
cctggggaccctgcgtggctacta

SEQ ID NO: 12234 - DNA, 26 bp, Artificial Sequence
  Description of Artificial Sequence: Synthetic oligonucleotide
ctggggaccctgcgtggctactacaa

SEQ ID NO: 12235 - DNA, 26 bp, Artificial Sequence
  Description of Artificial Sequence: Synthetic oligonucleotide
tggggaccctgcgtggctactacaac

SEQ ID NO: 12236 - DNA, 25 bp, Artificial Sequence
  Description of Artificial Sequence: Synthetic oligonucleotide
ggggaccctgcgtggctactacaac

SEQ ID NO: 12237 - DNA, 26 bp, Artificial Sequence
  Description of Artificial Sequence: Synthetic oligonucleotide
gggaccctgcgtggctactacaacca

SEQ ID NO: 12238 - DNA, 27 bp, Artificial Sequence
  Description of Artificial Sequence: Synthetic oligonucleotide
ggaccctgcgtggctactacaaccaga

SEQ ID NO: 12239 - DNA, 27 bp, Artificial Sequence
  Description of Artificial Sequence: Synthetic oligonucleotide
gaccctgcgtggctactacaaccagag

SEQ ID NO: 12240 - DNA, 27 bp, Artificial Sequence
  Description of Artificial Sequence: Synthetic oligonucleotide
accctgcgtggctactacaaccagagc

SEQ ID NO: 12241 - DNA, 26 bp, Artificial Sequence
  Description of Artificial Sequence: Synthetic oligonucleotide
ccctgcgtggctactacaaccagagc

SEQ ID NO: 12242 - DNA, 27 bp, Artificial Sequence
  Description of Artificial Sequence: Synthetic oligonucleotide
cctgcgtggctactacaaccagagcga

SEQ ID NO: 12243 - DNA, 27 bp, Artificial Sequence
  Description of Artificial Sequence: Synthetic oligonucleotide
ctgcgtggctactacaaccagagcgag

SEQ ID NO: 12244 - DNA, 27 bp, Artificial Sequence
  Description of Artificial Sequence: Synthetic oligonucleotide
tgcgtggctactacaaccagagcgagg

SEQ ID NO: 12245 - DNA, 27 bp, Artificial Sequence
  Description of Artificial Sequence: Synthetic oligonucleotide
gcgtggctactacaaccagagcgagga

SEQ ID NO: 12246 - DNA, 27 bp, Artificial Sequence
  Description of Artificial Sequence: Synthetic oligonucleotide
cgtggctactacaaccagagcgaggac

SEQ ID NO: 12247 - DNA, 27 bp, Artificial Sequence
  Description of Artificial Sequence: Synthetic oligonucleotide
gtggctactacaaccagagcgaggacg

SEQ ID NO: 12248 - DNA, 27 bp, Artificial Sequence
  Description of Artificial Sequence: Synthetic oligonucleotide
tggctactacaaccagagcgaggacgg

SEQ ID NO: 12249 - DNA, 32 bp, Artificial Sequence
  Description of Artificial Sequence: Synthetic oligonucleotide
tactacaaccagagcgaggacggttctcatac

SEQ ID NO: 12250 - DNA, 31 bp, Artificial Sequence
  Description of Artificial Sequence: Synthetic oligonucleotide
actacaaccagagcgaggacggttctcatac

SEQ ID NO: 12251 - DNA, 30 bp, Artificial Sequence
  Description of Artificial Sequence: Synthetic oligonucleotide
ctacaaccagagcgaggacggttctcatac

SEQ ID NO: 12252 - DNA, 30 bp, Artificial Sequence
  Description of Artificial Sequence: Synthetic oligonucleotide
tacaaccagagcgaggacggttctcatacc

SEQ ID NO: 12253 - DNA, 29 bp, Artificial Sequence
  Description of Artificial Sequence: Synthetic oligonucleotide
acaaccagagcgaggacggttctcatacc

SEQ ID NO: 12254 - DNA, 28 bp, Artificial Sequence
  Description of Artificial Sequence: Synthetic oligonucleotide
caaccagagcgaggacggttctcatacc

SEQ ID NO: 12255 - DNA, 30 bp, Artificial Sequence
  Description of Artificial Sequence: Synthetic oligonucleotide
aaccagagcgaggacggttctcataccatc

SEQ ID NO: 12256 - DNA, 29 bp, Artificial Sequence
  Description of Artificial Sequence: Synthetic oligonucleotide
accagagcgaggacggttctcataccatc

SEQ ID NO: 12257 - DNA, 28 bp, Artificial Sequence
  Description of Artificial Sequence: Synthetic oligonucleotide
ccagagcgaggacggttctcataccatc

SEQ ID NO: 12258 - DNA, 28 bp, Artificial Sequence
  Description of Artificial Sequence: Synthetic oligonucleotide
cagagcgaggacggttctcataccatcc

SEQ ID NO: 12259 - DNA, 29 bp, Artificial Sequence
  Description of Artificial Sequence: Synthetic oligonucleotide
agagcgaggacggttctcataccatccag

SEQ ID NO: 12260 - DNA, 28 bp, Artificial Sequence
  Description of Artificial Sequence: Synthetic oligonucleotide
gagcgaggacggttctcataccatccag

SEQ ID NO: 12261 - DNA, 33 bp, Artificial Sequence
  Description of Artificial Sequence: Synthetic oligonucleotide
agcgaggacggttctcataccatccagataatg

SEQ ID NO: 12262 - DNA, 32 bp, Artificial Sequence
  Description of Artificial Sequence: Synthetic oligonucleotide
gcgaggacggttctcataccatccagataatg

SEQ ID NO: 12263 - DNA, 35 bp, Artificial Sequence
  Description of Artificial Sequence: Synthetic oligonucleotide
cgaggacggttctcataccatccagataatgtatg

SEQ ID NO: 12264 - DNA, 35 bp, Artificial Sequence
  Description of Artificial Sequence: Synthetic oligonucleotide
gaggacggttctcataccatccagataatgtatgg

SEQ ID NO: 12265 - DNA, 35 bp, Artificial Sequence
  Description of Artificial Sequence: Synthetic oligonucleotide
aggacggttctcataccatccagataatgtatggc

SEQ ID NO: 12266 - DNA, 34 bp, Artificial Sequence
  Description of Artificial Sequence: Synthetic oligonucleotide
ggacggttctcataccatccagataatgtatggc

SEQ ID NO: 12267 - DNA, 35 bp, Artificial Sequence
  Description of Artificial Sequence: Synthetic oligonucleotide
gacggttctcataccatccagataatgtatggctg

SEQ ID NO: 12268 - DNA, 35 bp, Artificial Sequence
  Description of Artificial Sequence: Synthetic oligonucleotide
acggttctcataccatccagataatgtatggctgc

SEQ ID NO: 12269 - DNA, 34 bp, Artificial Sequence
  Description of Artificial Sequence: Synthetic oligonucleotide
cggttctcataccatccagataatgtatggctgc

SEQ ID NO: 12270 - DNA, 34 bp, Artificial Sequence
  Description of Artificial Sequence: Synthetic oligonucleotide
ggttctcataccatccagataatgtatggctgcg

SEQ ID NO: 12271 - DNA, 35 bp, Artificial Sequence
  Description of Artificial Sequence: Synthetic oligonucleotide
gttctcataccatccagataatgtatggctgcgac

SEQ ID NO: 12272 - DNA, 35 bp, Artificial Sequence
  Description of Artificial Sequence: Synthetic oligonucleotide
ttctcataccatccagataatgtatggctgcgacg

SEQ ID NO: 12273 - DNA, 34 bp, Artificial Sequence
  Description of Artificial Sequence: Synthetic oligonucleotide
tctcataccatccagataatgtatggctgcgacg

SEQ ID NO: 12274 - DNA, 33 bp, Artificial Sequence
  Description of Artificial Sequence: Synthetic oligonucleotide
ctcataccatccagataatgtatggctgcgacg

SEQ ID NO: 12275 - DNA, 34 bp, Artificial Sequence
  Description of Artificial Sequence: Synthetic oligonucleotide
tcataccatccagataatgtatggctgcgacgtg

SEQ ID NO: 12276 - DNA, 33 bp, Artificial Sequence
  Description of Artificial Sequence: Synthetic oligonucleotide
cataccatccagataatgtatggctgcgacgtg

SEQ ID NO: 12277 - DNA, 33 bp, Artificial Sequence
  Description of Artificial Sequence: Synthetic oligonucleotide
ataccatccagataatgtatggctgcgacgtgg

SEQ ID NO: 12278 - DNA, 32 bp, Artificial Sequence
  Description of Artificial Sequence: Synthetic oligonucleotide
taccatccagataatgtatggctgcgacgtgg

SEQ ID NO: 12279 - DNA, 27 bp, Artificial Sequence
  Description of Artificial Sequence: Synthetic oligonucleotide
ataatgtatggctgcgacgtggggccc

SEQ ID NO: 12280 - DNA, 26 bp, Artificial Sequence
  Description of Artificial Sequence: Synthetic oligonucleotide
taatgtatggctgcgacgtggggccc

SEQ ID NO: 12281 - DNA, 25 bp, Artificial Sequence
  Description of Artificial Sequence: Synthetic oligonucleotide
aatgtatggctgcgacgtggggccc

SEQ ID NO: 12282 - DNA, 24 bp, Artificial Sequence
  Description of Artificial Sequence: Synthetic oligonucleotide
atgtatggctgcgacgtggggccc

SEQ ID NO: 12283 - DNA, 23 bp, Artificial Sequence
  Description of Artificial Sequence: Synthetic oligonucleotide
tgtatggctgcgacgtggggccc

SEQ ID NO: 12284 - DNA, 22 bp, Artificial Sequence
  Description of Artificial Sequence: Synthetic oligonucleotide
gtatggctgcgacgtggggccc

SEQ ID NO: 12285 - DNA, 23 bp, Artificial Sequence
  Description of Artificial Sequence: Synthetic oligonucleotide
tatggctgcgacgtggggcccga

SEQ ID NO: 12286 - DNA, 22 bp, Artificial Sequence
  Description of Artificial Sequence: Synthetic oligonucleotide
atggctgcgacgtggggcccga

SEQ ID NO: 12287 - DNA, 21 bp, Artificial Sequence
  Description of Artificial Sequence: Synthetic oligonucleotide
tggctgcgacgtggggcccga

SEQ ID NO: 12288 - DNA, 20 bp, Artificial Sequence
  Description of Artificial Sequence: Synthetic oligonucleotide
ggctgcgacgtggggcccga

SEQ ID NO: 12289 - DNA, 20 bp, Artificial Sequence
  Description of Artificial Sequence: Synthetic oligonucleotide
gctgcgacgtggggcccgac

SEQ ID NO: 12290 - DNA, 20 bp, Artificial Sequence
  Description of Artificial Sequence: Synthetic oligonucleotide
ctgcgacgtggggcccgacg

SEQ ID NO: 12291 - DNA, 20 bp, Artificial Sequence
  Description of Artificial Sequence: Synthetic oligonucleotide
tgcgacgtggggcccgacgg

SEQ ID NO: 12292 - DNA, 20 bp, Artificial Sequence
  Description of Artificial Sequence: Synthetic oligonucleotide
gcgacgtggggcccgacggt

SEQ ID NO: 12293 - DNA, 20 bp, Artificial Sequence
  Description of Artificial Sequence: Synthetic oligonucleotide
cgacgtggggcccgacgggt

SEQ ID NO: 12294 - DNA, 20 bp, Artificial Sequence
  Description of Artificial Sequence: Synthetic oligonucleotide
gacgtggggcccgacgggct

SEQ ID NO: 12295 - DNA, 20 bp, Artificial Sequence
  Description of Artificial Sequence: Synthetic oligonucleotide
acgtggggcccgacgggcgt

SEQ ID NO: 12296 - DNA, 20 bp, Artificial Sequence
  Description of Artificial Sequence: Synthetic oligonucleotide
cgtggggcccgacgggcgtt

SEQ ID NO: 12297 - DNA, 20 bp, Artificial Sequence
  Description of Artificial Sequence: Synthetic oligonucleotide
gtggggcccgacgggcgctt

SEQ ID NO: 12298 - DNA, 20 bp, Artificial Sequence
  Description of Artificial Sequence: Synthetic oligonucleotide
tggggcccgacgggcgcttc

SEQ ID NO: 12299 - DNA, 20 bp, Artificial Sequence
  Description of Artificial Sequence: Synthetic oligonucleotide
ggggcccgacgggcgcttct

SEQ ID NO: 12300 - DNA, 20 bp, Artificial Sequence
  Description of Artificial Sequence: Synthetic oligonucleotide
gggcccgacgggcgcttcct

SEQ ID NO: 12301 - DNA, 20 bp, Artificial Sequence
  Description of Artificial Sequence: Synthetic oligonucleotide
ggcccgacgggcgcttcctc

SEQ ID NO: 12302 - DNA, 20 bp, Artificial Sequence
  Description of Artificial Sequence: Synthetic oligonucleotide
gcccgacgggcgcttcctcc

SEQ ID NO: 12303 - DNA, 20 bp, Artificial Sequence
  Description of Artificial Sequence: Synthetic oligonucleotide
cccgacgggcgcttcctccg

SEQ ID NO: 12304 - DNA, 20 bp, Artificial Sequence
  Description of Artificial Sequence: Synthetic oligonucleotide
ccgacgggcgcttcctccgc

SEQ ID NO: 12305 - DNA, 20 bp, Artificial Sequence
  Description of Artificial Sequence: Synthetic oligonucleotide
cgacgggcgcttcctccgcg

SEQ ID NO: 12306 - DNA, 23 bp, Artificial Sequence
  Description of Artificial Sequence: Synthetic oligonucleotide
agggccggtgcgtggagtggctt

SEQ ID NO: 12307 - DNA, 22 bp, Artificial Sequence
  Description of Artificial Sequence: Synthetic oligonucleotide
gggccggtgcgtggagtggctt

SEQ ID NO: 12308 - DNA, 22 bp, Artificial Sequence
  Description of Artificial Sequence: Synthetic oligonucleotide
ggccggtgcgtggagtggcttc

SEQ ID NO: 12309 - DNA, 22 bp, Artificial Sequence
  Description of Artificial Sequence: Synthetic oligonucleotide
gccggtgcgtggagtggcttcg

SEQ ID NO: 12310 - DNA, 23 bp, Artificial Sequence
  Description of Artificial Sequence: Synthetic oligonucleotide
ccggtgcgtggagtggcttcgca

SEQ ID NO: 12311 - DNA, 26 bp, Artificial Sequence
  Description of Artificial Sequence: Synthetic oligonucleotide
cggtgcgtggagtggcttcgcagata

SEQ ID NO: 12312 - DNA, 26 bp, Artificial Sequence
  Description of Artificial Sequence: Synthetic oligonucleotide
ggtgcgtggagtggcttcgcagatac

SEQ ID NO: 12313 - DNA, 27 bp, Artificial Sequence
  Description of Artificial Sequence: Synthetic oligonucleotide
gtgcgtggagtggcttcgcagatacct

SEQ ID NO: 12314 - DNA, 27 bp, Artificial Sequence
  Description of Artificial Sequence: Synthetic oligonucleotide
tgcgtggagtggcttcgcagatacctg

SEQ ID NO: 12315 - DNA, 26 bp, Artificial Sequence
  Description of Artificial Sequence: Synthetic oligonucleotide
gcgtggagtggcttcgcagatacctg

SEQ ID NO: 12316 - DNA, 27 bp, Artificial Sequence
  Description of Artificial Sequence: Synthetic oligonucleotide
cgtggagtggcttcgcagatacctgga

SEQ ID NO: 12317 - DNA, 27 bp, Artificial Sequence
  Description of Artificial Sequence: Synthetic oligonucleotide
gtggagtggcttcgcagatacctggag

SEQ ID NO: 12318 - DNA, 29 bp, Artificial Sequence
  Description of Artificial Sequence: Synthetic oligonucleotide
tggagtggcttcgcagatacctggagaac

SEQ ID NO: 12319 - DNA, 28 bp, Artificial Sequence
  Description of Artificial Sequence: Synthetic oligonucleotide
ggagtggcttcgcagatacctggagaac

SEQ ID NO: 12320 - DNA, 28 bp, Artificial Sequence
  Description of Artificial Sequence: Synthetic oligonucleotide
gagtggcttcgcagatacctggagaacg

SEQ ID NO: 12321 - DNA, 28 bp, Artificial Sequence
  Description of Artificial Sequence: Synthetic oligonucleotide
agtggcttcgcagatacctggagaacgg

SEQ ID NO: 12322 - DNA, 27 bp, Artificial Sequence
  Description of Artificial Sequence: Synthetic oligonucleotide
gtggcttcgcagatacctggagaacgg

SEQ ID NO: 12323 - DNA, 27 bp, Artificial Sequence
  Description of Artificial Sequence: Synthetic oligonucleotide
tggcttcgcagatacctggagaacggg

SEQ ID NO: 12324 - DNA, 27 bp, Artificial Sequence
  Description of Artificial Sequence: Synthetic oligonucleotide
ggcttcgcagatacctggagaacggga

SEQ ID NO: 12325 - DNA, 28 bp, Artificial Sequence
  Description of Artificial Sequence: Synthetic oligonucleotide
gcttcgcagatacctggagaacgggaag

SEQ ID NO: 12326 - DNA, 28 bp, Artificial Sequence
  Description of Artificial Sequence: Synthetic oligonucleotide
cttcgcagatacctggagaacgggaagg

SEQ ID NO: 12327 - DNA, 29 bp, Artificial Sequence
  Description of Artificial Sequence: Synthetic oligonucleotide
ttcgcagatacctggagaacgggaaggag

SEQ ID NO: 12328 - DNA, 28 bp, Artificial Sequence
  Description of Artificial Sequence: Synthetic oligonucleotide
tcgcagatacctggagaacgggaaggag

SEQ ID NO: 12329 - DNA, 20 bp, Artificial Sequence
  Description of Artificial Sequence: Synthetic oligonucleotide
ggccgcggggagccccgatt

SEQ ID NO: 12330 - DNA, 22 bp, Artificial Sequence
  Description of Artificial Sequence: Synthetic oligonucleotide
gccgcggggagccccgattcat

SEQ ID NO: 12331 - DNA, 22 bp, Artificial Sequence
  Description of Artificial Sequence: Synthetic oligonucleotide
ccgcggggagccccgattcatc

SEQ ID NO: 12332 - DNA, 22 bp, Artificial Sequence
  Description of Artificial Sequence: Synthetic oligonucleotide
cgcggggagccccgattcatcg

SEQ ID NO: 12333 - DNA, 22 bp, Artificial Sequence
  Description of Artificial Sequence: Synthetic oligonucleotide
gcggggagccccgattcatcgc

SEQ ID NO: 12334 - DNA, 22 bp, Artificial Sequence
  Description of Artificial Sequence: Synthetic oligonucleotide
cggggagccccgattcatcgcc

SEQ ID NO: 12335 - DNA, 23 bp, Artificial Sequence
  Description of Artificial Sequence: Synthetic oligonucleotide
ggggagccccgattcatcgccgt

SEQ ID NO: 12336 - DNA, 23 bp, Artificial Sequence
  Description of Artificial Sequence: Synthetic oligonucleotide
gggagccccgattcatcgccgtg

SEQ ID NO: 12337 - DNA, 23 bp, Artificial Sequence
  Description of Artificial Sequence: Synthetic oligonucleotide
ggagccccgattcatcgccgtgg

SEQ ID NO: 12338 - DNA, 23 bp, Artificial Sequence
  Description of Artificial Sequence: Synthetic oligonucleotide
gagccccgattcatcgccgtggg

SEQ ID NO: 12339 - DNA, 25 bp, Artificial Sequence
  Description of Artificial Sequence: Synthetic oligonucleotide
agccccgattcatcgccgtgggcta

SEQ ID NO: 12340 - DNA, 24 bp, Artificial Sequence
  Description of Artificial Sequence: Synthetic oligonucleotide
gccccgattcatcgccgtgggcta

SEQ ID NO: 12341 - DNA, 24 bp, Artificial Sequence
  Description of Artificial Sequence: Synthetic oligonucleotide
ccccgattcatcgccgtgggctac

SEQ ID NO: 12342 - DNA, 25 bp, Artificial Sequence
  Description of Artificial Sequence: Synthetic oligonucleotide
cccgattcatcgccgtgggctacgt

SEQ ID NO: 12343 - DNA, 25 bp, Artificial Sequence
  Description of Artificial Sequence: Synthetic oligonucleotide
ccgattcatcgccgtgggctacgtg

SEQ ID NO: 12344 - DNA, 26 bp, Artificial Sequence
  Description of Artificial Sequence: Synthetic oligonucleotide
cgattcatcgccgtgggctacgtgga

SEQ ID NO: 12345 - DNA, 26 bp, Artificial Sequence
  Description of Artificial Sequence: Synthetic oligonucleotide
gattcatcgccgtgggctacgtggac

SEQ ID NO: 12346 - DNA, 27 bp, Artificial Sequence
  Description of Artificial Sequence: Synthetic oligonucleotide
attcatcgccgtgggctacgtggacga

SEQ ID NO: 12347 - DNA, 31 bp, Artificial Sequence
  Description of Artificial Sequence: Synthetic oligonucleotide
acatggcagctcagatcaccaagcgcaaatg

SEQ ID NO: 12348 - DNA, 30 bp, Artificial Sequence
  Description of Artificial Sequence: Synthetic oligonucleotide
catggcagctcagatcaccaagcgcaaatg

SEQ ID NO: 12349 - DNA, 30 bp, Artificial Sequence
  Description of Artificial Sequence: Synthetic oligonucleotide
atggcagctcagatcaccaagcgcaaatgg

SEQ ID NO: 12350 - DNA, 29 bp, Artificial Sequence
  Description of Artificial Sequence: Synthetic oligonucleotide
tggcagctcagatcaccaagcgcaaatgg

SEQ ID NO: 12351 - DNA, 28 bp, Artificial Sequence
  Description of Artificial Sequence: Synthetic oligonucleotide
ggcagctcagatcaccaagcgcaaatgg

SEQ ID NO: 12352 - DNA, 28 bp, Artificial Sequence
  Description of Artificial Sequence: Synthetic oligonucleotide
gcagctcagatcaccaagcgcaaatggg

SEQ ID NO: 12353 - DNA, 29 bp, Artificial Sequence
  Description of Artificial Sequence: Synthetic oligonucleotide
cagctcagatcaccaagcgcaaatgggag

SEQ ID NO: 12354 - DNA, 29 bp, Artificial Sequence
  Description of Artificial Sequence: Synthetic oligonucleotide
agctcagatcaccaagcgcaaatgggagg

SEQ ID NO: 12355 - DNA, 28 bp, Artificial Sequence
  Description of Artificial Sequence: Synthetic oligonucleotide
gctcagatcaccaagcgcaaatgggagg

SEQ ID NO: 12356 - DNA, 28 bp, Artificial Sequence
  Description of Artificial Sequence: Synthetic oligonucleotide
ctcagatcaccaagcgcaaatgggaggc

SEQ ID NO: 12357 - DNA, 28 bp, Artificial Sequence
  Description of Artificial Sequence: Synthetic oligonucleotide
tcagatcaccaagcgcaaatgggaggcg

SEQ ID NO: 12358 - DNA, 27 bp, Artificial Sequence
  Description of Artificial Sequence: Synthetic oligonucleotide
cagatcaccaagcgcaaatgggaggcg

SEQ ID NO: 12359 - DNA, 27 bp, Artificial Sequence
  Description of Artificial Sequence: Synthetic oligonucleotide
agatcaccaagcgcaaatgggaggcgg

SEQ ID NO: 12360 - DNA, 26 bp, Artificial Sequence
  Description of Artificial Sequence: Synthetic oligonucleotide
gatcaccaagcgcaaatgggaggcgg

SEQ ID NO: 12361 - DNA, 26 bp, Artificial Sequence
  Description of Artificial Sequence: Synthetic oligonucleotide
atcaccaagcgcaaatgggaggcggc

SEQ ID NO: 12362 - DNA, 25 bp, Artificial Sequence
  Description of Artificial Sequence: Synthetic oligonucleotide
tcaccaagcgcaaatgggaggcggc

SEQ ID NO: 12363 - DNA, 24 bp, Artificial Sequence
  Description of Artificial Sequence: Synthetic oligonucleotide
caccaagcgcaaatgggaggcggc

SEQ ID NO: 12364 - DNA, 24 bp, Artificial Sequence
  Description of Artificial Sequence: Synthetic oligonucleotide
accaagcgcaaatgggaggcggcc

SEQ ID NO: 12365 - DNA, 23 bp, Artificial Sequence
  Description of Artificial Sequence: Synthetic oligonucleotide
ccaagcgcaaatgggaggcggcc

SEQ ID NO: 12366 - DNA, 25 bp, Artificial Sequence
  Description of Artificial Sequence: Synthetic oligonucleotide
caagcgcaaatgggaggcggcccat

SEQ ID NO: 12367 - DNA, 25 bp, Artificial Sequence
  Description of Artificial Sequence: Synthetic oligonucleotide
aagcgcaaatgggaggcggcccatg

SEQ ID NO: 12368 - DNA, 24 bp, Artificial Sequence
  Description of Artificial Sequence: Synthetic oligonucleotide
agcgcaaatgggaggcggcccatg

SEQ ID NO: 12369 - DNA, 23 bp, Artificial Sequence
  Description of Artificial Sequence: Synthetic oligonucleotide
gcgcaaatgggaggcggcccatg

SEQ ID NO: 12370 - DNA, 23 bp, Artificial Sequence
  Description of Artificial Sequence: Synthetic oligonucleotide
cgcaaatgggaggcggcccatgc

SEQ ID NO: 12371 - DNA, 23 bp, Artificial Sequence
  Description of Artificial Sequence: Synthetic oligonucleotide
gcaaatgggaggcggcccatgcg

SEQ ID NO: 12372 - DNA, 23 bp, Artificial Sequence
  Description of Artificial Sequence: Synthetic oligonucleotide
caaatgggaggcggcccatgcgg

SEQ ID NO: 12373 - DNA, 23 bp, Artificial Sequence
  Description of Artificial Sequence: Synthetic oligonucleotide
aaatgggaggcggcccatgcggc

SEQ ID NO: 12374 - DNA, 22 bp, Artificial Sequence
  Description of Artificial Sequence: Synthetic oligonucleotide
aatgggaggcggcccatgcggc

SEQ ID NO: 12375 - DNA, 21 bp, Artificial Sequence
  Description of Artificial Sequence: Synthetic oligonucleotide
atgggaggcggcccatgcggc

SEQ ID NO: 12376 - DNA, 27 bp, Artificial Sequence
  Description of Artificial Sequence: Synthetic oligonucleotide
tacatcgccctgaacgaggacctgcgt

SEQ ID NO: 12377 - DNA, 27 bp, Artificial Sequence
  Description of Artificial Sequence: Synthetic oligonucleotide
acatcgccctgaacgaggacctgcgtt

SEQ ID NO: 12378 - DNA, 26 bp, Artificial Sequence
  Description of Artificial Sequence: Synthetic oligonucleotide
catcgccctgaacgaggacctgcgtt

SEQ ID NO: 12379 - DNA, 27 bp, Artificial Sequence
  Description of Artificial Sequence: Synthetic oligonucleotide
atcgccctgaacgaggacctgcgttct

SEQ ID NO: 12380 - DNA, 27 bp, Artificial Sequence
  Description of Artificial Sequence: Synthetic oligonucleotide
tcgccctgaacgaggacctgcgttctt

SEQ ID NO: 12381 - DNA, 26 bp, Artificial Sequence
  Description of Artificial Sequence: Synthetic oligonucleotide
cgccctgaacgaggacctgcgttctt

SEQ ID NO: 12382 - DNA, 26 bp, Artificial Sequence
  Description of Artificial Sequence: Synthetic oligonucleotide
gccctgaacgaggacctgcgttcttg

SEQ ID NO: 12383 - DNA, 27 bp, Artificial Sequence
  Description of Artificial Sequence: Synthetic oligonucleotide
ccctgaacgaggacctgcgttcttgga

SEQ ID NO: 12384 - DNA, 27 bp, Artificial Sequence
  Description of Artificial Sequence: Synthetic oligonucleotide
cctgaacgaggacctgcgttcttggac

SEQ ID NO: 12385 - DNA, 27 bp, Artificial Sequence
  Description of Artificial Sequence: Synthetic oligonucleotide
ctgaacgaggacctgcgttcttggacc

SEQ ID NO: 12386 - DNA, 27 bp, Artificial Sequence
  Description of Artificial Sequence: Synthetic oligonucleotide
tgaacgaggacctgcgttcttggaccg

SEQ ID NO: 12387 - DNA, 26 bp, Artificial Sequence
  Description of Artificial Sequence: Synthetic oligonucleotide
gaacgaggacctgcgttcttggaccg

SEQ ID NO: 12388 - DNA, 26 bp, Artificial Sequence
  Description of Artificial Sequence: Synthetic oligonucleotide
aacgaggacctgcgttcttggaccgc

SEQ ID NO: 12389 - DNA, 25 bp, Artificial Sequence
  Description of Artificial Sequence: Synthetic oligonucleotide
acgaggacctgcgttcttggaccgc

SEQ ID NO: 12390 - DNA, 24 bp, Artificial Sequence
  Description of Artificial Sequence: Synthetic oligonucleotide
cgaggacctgcgttcttggaccgc

SEQ ID NO: 12391 - DNA, 24 bp, Artificial Sequence
  Description of Artificial Sequence: Synthetic oligonucleotide
gaggacctgcgttcttggaccgcg

SEQ ID NO: 12392 - DNA, 24 bp, Artificial Sequence
  Description of Artificial Sequence: Synthetic oligonucleotide
aggacctgcgttcttggaccgcgg

SEQ ID NO: 12393 - DNA, 23 bp, Artificial Sequence
  Description of Artificial Sequence: Synthetic oligonucleotide
ggacctgcgttcttggaccgcgg

SEQ ID NO: 12394 - DNA, 23 bp, Artificial Sequence
  Description of Artificial Sequence: Synthetic oligonucleotide
gacctgcgttcttggaccgcggc

SEQ ID NO: 12395 - DNA, 23 bp, Artificial Sequence
  Description of Artificial Sequence: Synthetic oligonucleotide
acctgcgttcttggaccgcggcg

SEQ ID NO: 12396 - DNA, 22 bp, Artificial Sequence
  Description of Artificial Sequence: Synthetic oligonucleotide
cctgcgttcttggaccgcggcg

SEQ ID NO: 12397 - DNA, 23 bp, Artificial Sequence
  Description of Artificial Sequence: Synthetic oligonucleotide
ctgcgttcttggaccgcggcgga

SEQ ID NO: 12398 - DNA, 25 bp, Artificial Sequence
  Description of Artificial Sequence: Synthetic oligonucleotide
tgcgttcttggaccgcggcggacat

SEQ ID NO: 12399 - DNA, 24 bp, Artificial Sequence
  Description of Artificial Sequence: Synthetic oligonucleotide
gcgttcttggaccgcggcggacat

SEQ ID NO: 12400 - DNA, 24 bp, Artificial Sequence
  Description of Artificial Sequence: Synthetic oligonucleotide
cgttcttggaccgcggcggacatg

SEQ ID NO: 12401 - DNA, 24 bp, Artificial Sequence
  Description of Artificial Sequence: Synthetic oligonucleotide
gttcttggaccgcggcggacatgg

SEQ ID NO: 12402 - DNA, 25 bp, Artificial Sequence
  Description of Artificial Sequence: Synthetic oligonucleotide
ttcttggaccgcggcggacatggca

SEQ ID NO: 12403 - DNA, 23 bp, Artificial Sequence
  Description of Artificial Sequence: Synthetic oligonucleotide
gcaagtgggaggcggcccatgca

SEQ ID NO: 12404 - DNA, 23 bp, Artificial Sequence
  Description of Artificial Sequence: Synthetic oligonucleotide
caagtgggaggcggcccatgcag

SEQ ID NO: 12405 - DNA, 23 bp, Artificial Sequence
  Description of Artificial Sequence: Synthetic oligonucleotide
aagtgggaggcggcccatgcagc

SEQ ID NO: 12406 - DNA, 22 bp, Artificial Sequence
  Description of Artificial Sequence: Synthetic oligonucleotide
agtgggaggcggcccatgcagc

SEQ ID NO: 12407 - DNA, 21 bp, Artificial Sequence
  Description of Artificial Sequence: Synthetic oligonucleotide
gtgggaggcggcccatgcagc

SEQ ID NO: 12408 - DNA, 21 bp, Artificial Sequence
  Description of Artificial Sequence: Synthetic oligonucleotide
tgggaggcggcccatgcagcg

SEQ ID NO: 12409 - DNA, 20 bp, Artificial Sequence
  Description of Artificial Sequence: Synthetic oligonucleotide
gggaggcggcccatgcagcg

SEQ ID NO: 12410 - DNA, 21 bp, Artificial Sequence
  Description of Artificial Sequence: Synthetic oligonucleotide
ggaggcggcccatgcagcgga

SEQ ID NO: 12411 - DNA, 21 bp, Artificial Sequence
  Description of Artificial Sequence: Synthetic oligonucleotide
gaggcggcccatgcagcggag

SEQ ID NO: 12412 - DNA, 22 bp, Artificial Sequence
  Description of Artificial Sequence: Synthetic oligonucleotide
aggcggcccatgcagcggagca

SEQ ID NO: 12413 - DNA, 21 bp, Artificial Sequence
  Description of Artificial Sequence: Synthetic oligonucleotide
ggcggcccatgcagcggagca

SEQ ID NO: 12414 - DNA, 21 bp, Artificial Sequence
  Description of Artificial Sequence: Synthetic oligonucleotide
gcggcccatgcagcggagcag

SEQ ID NO: 12415 - DNA, 22 bp, Artificial Sequence
  Description of Artificial Sequence: Synthetic oligonucleotide
cggcccatgcagcggagcagca

SEQ ID NO: 12416 - DNA, 23 bp, Artificial Sequence
  Description of Artificial Sequence: Synthetic oligonucleotide
ggcccatgcagcggagcagcaga

SEQ ID NO: 12417 - DNA, 24 bp, Artificial Sequence
  Description of Artificial Sequence: Synthetic oligonucleotide
gcccatgcagcggagcagcagaga

SEQ ID NO: 12418 - DNA, 24 bp, Artificial Sequence
  Description of Artificial Sequence: Synthetic oligonucleotide
cccatgcagcggagcagcagagag

SEQ ID NO: 12419 - DNA, 24 bp, Artificial Sequence
  Description of Artificial Sequence: Synthetic oligonucleotide
ccatgcagcggagcagcagagagc

SEQ ID NO: 12420 - DNA, 26 bp, Artificial Sequence
  Description of Artificial Sequence: Synthetic oligonucleotide
catgcagcggagcagcagagagccta

SEQ ID NO: 12421 - DNA, 26 bp, Artificial Sequence
  Description of Artificial Sequence: Synthetic oligonucleotide
atgcagcggagcagcagagagcctac

SEQ ID NO: 12422 - DNA, 25 bp, Artificial Sequence
  Description of Artificial Sequence: Synthetic oligonucleotide
tgcagcggagcagcagagagcctac

SEQ ID NO: 12423 - DNA, 24 bp, Artificial Sequence
  Description of Artificial Sequence: Synthetic oligonucleotide
gcagcggagcagcagagagcctac

SEQ ID NO: 12424 - DNA, 25 bp, Artificial Sequence
  Description of Artificial Sequence: Synthetic oligonucleotide
cagcggagcagcagagagcctacct

SEQ ID NO: 12425 - DNA, 25 bp, Artificial Sequence
  Description of Artificial Sequence: Synthetic oligonucleotide
agcggagcagcagagagcctacctg

SEQ ID NO: 12426 - DNA, 26 bp, Artificial Sequence
  Description of Artificial Sequence: Synthetic oligonucleotide
tgaacgaggacctgcgctcttggacg

SEQ ID NO: 12427 - DNA, 25 bp, Artificial Sequence
  Description of Artificial Sequence: Synthetic oligonucleotide
gaacgaggacctgcgctcttggacg

SEQ ID NO: 12428 - DNA, 25 bp, Artificial Sequence
  Description of Artificial Sequence: Synthetic oligonucleotide
aacgaggacctgcgctcttggacgg

SEQ ID NO: 12429 - DNA, 24 bp, Artificial Sequence
  Description of Artificial Sequence: Synthetic oligonucleotide
acgaggacctgcgctcttggacgg

SEQ ID NO: 12430 - DNA, 23 bp, Artificial Sequence
  Description of Artificial Sequence: Synthetic oligonucleotide
cgaggacctgcgctcttggacgg

SEQ ID NO: 12431 - DNA, 23 bp, Artificial Sequence
  Description of Artificial Sequence: Synthetic oligonucleotide
gaggacctgcgctcttggacggc

SEQ ID NO: 12432 - DNA, 23 bp, Artificial Sequence
  Description of Artificial Sequence: Synthetic oligonucleotide
aggacctgcgctcttggacggcg

SEQ ID NO: 12433 - DNA, 22 bp, Artificial Sequence
  Description of Artificial Sequence: Synthetic oligonucleotide
ggacctgcgctcttggacggcg

SEQ ID NO: 12434 - DNA, 22 bp, Artificial Sequence
  Description of Artificial Sequence: Synthetic oligonucleotide
gacctgcgctcttggacggcgg

SEQ ID NO: 12435 - DNA, 22 bp, Artificial Sequence
  Description of Artificial Sequence: Synthetic oligonucleotide
acctgcgctcttggacggcggc

SEQ ID NO: 12436 - DNA, 21 bp, Artificial Sequence
  Description of Artificial Sequence: Synthetic oligonucleotide
cctgcgctcttggacggcggc

SEQ ID NO: 12437 - DNA, 21 bp, Artificial Sequence
  Description of Artificial Sequence: Synthetic oligonucleotide
ctgcgctcttggacggcggcg

SEQ ID NO: 12438 - DNA, 22 bp, Artificial Sequence
  Description of Artificial Sequence: Synthetic oligonucleotide
tgcgctcttggacggcggcgga

SEQ ID NO: 12439 - DNA, 21 bp, Artificial Sequence
  Description of Artificial Sequence: Synthetic oligonucleotide
gcgctcttggacggcggcgga

SEQ ID NO: 12440 - DNA, 23 bp, Artificial Sequence
  Description of Artificial Sequence: Synthetic oligonucleotide
cgctcttggacggcggcggacat

SEQ ID NO: 12441 - DNA, 23 bp, Artificial Sequence
  Description of Artificial Sequence: Synthetic oligonucleotide
gctcttggacggcggcggacatg

SEQ ID NO: 12442 - DNA, 23 bp, Artificial Sequence
  Description of Artificial Sequence: Synthetic oligonucleotide
ctcttggacggcggcggacatgg

SEQ ID NO: 12443 - DNA, 24 bp, Artificial Sequence
  Description of Artificial Sequence: Synthetic oligonucleotide
tcttggacggcggcggacatggca

SEQ ID NO: 12444 - DNA, 23 bp, Artificial Sequence
  Description of Artificial Sequence: Synthetic oligonucleotide
cttggacggcggcggacatggca

SEQ ID NO: 12445 - DNA, 23 bp, Artificial Sequence
  Description of Artificial Sequence: Synthetic oligonucleotide
ttggacggcggcggacatggcag

SEQ ID NO: 12446 - DNA, 22 bp, Artificial Sequence
  Description of Artificial Sequence: Synthetic oligonucleotide
tggacggcggcggacatggcag

SEQ ID NO: 12447 - DNA, 21 bp, Artificial Sequence
  Description of Artificial Sequence: Synthetic oligonucleotide
ggacggcggcggacatggcag

SEQ ID NO: 12448 - DNA, 22 bp, Artificial Sequence
  Description of Artificial Sequence: Synthetic oligonucleotide
gacggcggcggacatggcagct

SEQ ID NO: 12449 - DNA, 23 bp, Artificial Sequence
  Description of Artificial Sequence: Synthetic oligonucleotide
acggcggcggacatggcagctca

SEQ ID NO: 12450 - DNA, 22 bp, Artificial Sequence
  Description of Artificial Sequence: Synthetic oligonucleotide
cggcggcggacatggcagctca

SEQ ID NO: 12451 - DNA, 24 bp, Artificial Sequence
  Description of Artificial Sequence: Synthetic oligonucleotide
ggcggcggacatggcagctcagat

SEQ ID NO: 12452 - DNA, 23 bp, Artificial Sequence
  Description of Artificial Sequence: Synthetic oligonucleotide
gcgggtaccggcaggacgcctat

SEQ ID NO: 12453 - DNA, 24 bp, Artificial Sequence
  Description of Artificial Sequence: Synthetic oligonucleotide
cgggtaccggcaggacgcctatga

SEQ ID NO: 12454 - DNA, 24 bp, Artificial Sequence
  Description of Artificial Sequence: Synthetic oligonucleotide
gggtaccggcaggacgcctatgac

SEQ ID NO: 12455 - DNA, 24 bp, Artificial Sequence
  Description of Artificial Sequence: Synthetic oligonucleotide
ggtaccggcaggacgcctatgacg

SEQ ID NO: 12456 - DNA, 24 bp, Artificial Sequence
  Description of Artificial Sequence: Synthetic oligonucleotide
gtaccggcaggacgcctatgacgg

SEQ ID NO: 12457 - DNA, 26 bp, Artificial Sequence
  Description of Artificial Sequence: Synthetic oligonucleotide
taccggcaggacgcctatgacggcaa

SEQ ID NO: 12458 - DNA, 25 bp, Artificial Sequence
  Description of Artificial Sequence: Synthetic oligonucleotide
accggcaggacgcctatgacggcaa

SEQ ID NO: 12459 - DNA, 24 bp, Artificial Sequence
  Description of Artificial Sequence: Synthetic oligonucleotide
ccggcaggacgcctatgacggcaa

SEQ ID NO: 12460 - DNA, 24 bp, Artificial Sequence
  Description of Artificial Sequence: Synthetic oligonucleotide
cggcaggacgcctatgacggcaag

SEQ ID NO: 12461 - DNA, 27 bp, Artificial Sequence
  Description of Artificial Sequence: Synthetic oligonucleotide
ggcaggacgcctatgacggcaaggatt

SEQ ID NO: 12462 - DNA, 28 bp, Artificial Sequence
  Description of Artificial Sequence: Synthetic oligonucleotide
gcaggacgcctatgacggcaaggattac

SEQ ID NO: 12463 - DNA, 30 bp, Artificial Sequence
  Description of Artificial Sequence: Synthetic oligonucleotide
caggacgcctatgacggcaaggattacatc

SEQ ID NO: 12464 - DNA, 30 bp, Artificial Sequence
  Description of Artificial Sequence: Synthetic oligonucleotide
aggacgcctatgacggcaaggattacatcg

SEQ ID NO: 12465 - DNA, 29 bp, Artificial Sequence
  Description of Artificial Sequence: Synthetic oligonucleotide
ggacgcctatgacggcaaggattacatcg

SEQ ID NO: 12466 - DNA, 29 bp, Artificial Sequence
  Description of Artificial Sequence: Synthetic oligonucleotide
gacgcctatgacggcaaggattacatcgc

SEQ ID NO: 12467 - DNA, 29 bp, Artificial Sequence
  Description of Artificial Sequence: Synthetic oligonucleotide
acgcctatgacggcaaggattacatcgcc

SEQ ID NO: 12468 - DNA, 28 bp, Artificial Sequence
  Description of Artificial Sequence: Synthetic oligonucleotide
cgcctatgacggcaaggattacatcgcc

SEQ ID NO: 12469 - DNA, 28 bp, Artificial Sequence
  Description of Artificial Sequence: Synthetic oligonucleotide
gcctatgacggcaaggattacatcgccc

SEQ ID NO: 12470 - DNA, 29 bp, Artificial Sequence
  Description of Artificial Sequence: Synthetic oligonucleotide
cctatgacggcaaggattacatcgccctg

SEQ ID NO: 12471 - DNA, 31 bp, Artificial Sequence
  Description of Artificial Sequence: Synthetic oligonucleotide
ctatgacggcaaggattacatcgccctgaac

SEQ ID NO: 12472 - DNA, 31 bp, Artificial Sequence
  Description of Artificial Sequence: Synthetic oligonucleotide
tatgacggcaaggattacatcgccctgaacg

SEQ ID NO: 12473 - DNA, 30 bp, Artificial Sequence
  Description of Artificial Sequence: Synthetic oligonucleotide
atgacggcaaggattacatcgccctgaacg

SEQ ID NO: 12474 - DNA, 29 bp, Artificial Sequence
  Description of Artificial Sequence: Synthetic oligonucleotide
tgacggcaaggattacatcgccctgaacg

SEQ ID NO: 12475 - DNA, 25 bp, Artificial Sequence
  Description of Artificial Sequence: Synthetic oligonucleotide
tacctggagggccggtgcgtggaat

SEQ ID NO: 12476 - DNA, 24 bp, Artificial Sequence
  Description of Artificial Sequence: Synthetic oligonucleotide
acctggagggccggtgcgtggaat

SEQ ID NO: 12477 - DNA, 23 bp, Artificial Sequence
  Description of Artificial Sequence: Synthetic oligonucleotide
cctggagggccggtgcgtggaat

SEQ ID NO: 12478 - DNA, 23 bp, Artificial Sequence
  Description of Artificial Sequence: Synthetic oligonucleotide
ctggagggccggtgcgtggaatg

SEQ ID NO: 12479 - DNA, 23 bp, Artificial Sequence
  Description of Artificial Sequence: Synthetic oligonucleotide
tggagggccggtgcgtggaatgg

SEQ ID NO: 12480 - DNA, 22 bp, Artificial Sequence
  Description of Artificial Sequence: Synthetic oligonucleotide
ggagggccggtgcgtggaatgg

SEQ ID NO: 12481 - DNA, 23 bp, Artificial Sequence
  Description of Artificial Sequence: Synthetic oligonucleotide
gagggccggtgcgtggaatggct

SEQ ID NO: 12482 - DNA, 23 bp, Artificial Sequence
  Description of Artificial Sequence: Synthetic oligonucleotide
agggccggtgcgtggaatggctc

SEQ ID NO: 12483 - DNA, 22 bp, Artificial Sequence
  Description of Artificial Sequence: Synthetic oligonucleotide
gggccggtgcgtggaatggctc

SEQ ID NO: 12484 - DNA, 22 bp, Artificial Sequence
  Description of Artificial Sequence: Synthetic oligonucleotide
ggccggtgcgtggaatggctcc

SEQ ID NO: 12485 - DNA, 22 bp, Artificial Sequence
  Description of Artificial Sequence: Synthetic oligonucleotide
gccggtgcgtggaatggctccg

SEQ ID NO: 12486 - DNA, 23 bp, Artificial Sequence
  Description of Artificial Sequence: Synthetic oligonucleotide
ccggtgcgtggaatggctccgca

SEQ ID NO: 12487 - DNA, 26 bp, Artificial Sequence
  Description of Artificial Sequence: Synthetic oligonucleotide
cggtgcgtggaatggctccgcagata

SEQ ID NO: 12488 - DNA, 26 bp, Artificial Sequence
  Description of Artificial Sequence: Synthetic oligonucleotide
ggtgcgtggaatggctccgcagatac

SEQ ID NO: 12489 - DNA, 27 bp, Artificial Sequence
  Description of Artificial Sequence: Synthetic oligonucleotide
gtgcgtggaatggctccgcagatacct

SEQ ID NO: 12490 - DNA, 27 bp, Artificial Sequence
  Description of Artificial Sequence: Synthetic oligonucleotide
tgcgtggaatggctccgcagatacctg

SEQ ID NO: 12491 - DNA, 26 bp, Artificial Sequence
  Description of Artificial Sequence: Synthetic oligonucleotide
gcgtggaatggctccgcagatacctg

SEQ ID NO: 12492 - DNA, 27 bp, Artificial Sequence
  Description of Artificial Sequence: Synthetic oligonucleotide
cgtggaatggctccgcagatacctgga

SEQ ID NO: 12493 - DNA, 27 bp, Artificial Sequence
  Description of Artificial Sequence: Synthetic oligonucleotide
gtggaatggctccgcagatacctggag

SEQ ID NO: 12494 - DNA, 29 bp, Artificial Sequence
  Description of Artificial Sequence: Synthetic oligonucleotide
tggaatggctccgcagatacctggagaac

SEQ ID NO: 12495 - DNA, 28 bp, Artificial Sequence
  Description of Artificial Sequence: Synthetic oligonucleotide
ggaatggctccgcagatacctggagaac

SEQ ID NO: 12496 - DNA, 28 bp, Artificial Sequence
  Description of Artificial Sequence: Synthetic oligonucleotide
gaatggctccgcagatacctggagaacg

SEQ ID NO: 12497 - DNA, 28 bp, Artificial Sequence
  Description of Artificial Sequence: Synthetic oligonucleotide
aatggctccgcagatacctggagaacgg

SEQ ID NO: 12498 - DNA, 27 bp, Artificial Sequence
  Description of Artificial Sequence: Synthetic oligonucleotide
atggctccgcagatacctggagaacgg

SEQ ID NO: 12499 - DNA, 25 bp, Artificial Sequence
  Description of Artificial Sequence: Synthetic oligonucleotide
ttcgacagcgacgccgcgagccaaa

SEQ ID NO: 12500 - DNA, 24 bp, Artificial Sequence
  Description of Artificial Sequence: Synthetic oligonucleotide
tcgacagcgacgccgcgagccaaa

SEQ ID NO: 12501 - DNA, 23 bp, Artificial Sequence
  Description of Artificial Sequence: Synthetic oligonucleotide
cgacagcgacgccgcgagccaaa

SEQ ID NO: 12502 - DNA, 23 bp, Artificial Sequence
  Description of Artificial Sequence: Synthetic oligonucleotide
gacagcgacgccgcgagccaaag

SEQ ID NO: 12503 - DNA, 25 bp, Artificial Sequence
  Description of Artificial Sequence: Synthetic oligonucleotide
acagcgacgccgcgagccaaaggat

SEQ ID NO: 12504 - DNA, 24 bp, Artificial Sequence
  Description of Artificial Sequence: Synthetic oligonucleotide
cagcgacgccgcgagccaaaggat

SEQ ID NO: 12505 - DNA, 24 bp, Artificial Sequence
  Description of Artificial Sequence: Synthetic oligonucleotide
agcgacgccgcgagccaaaggatg

SEQ ID NO: 12506 - DNA, 23 bp, Artificial Sequence
  Description of Artificial Sequence: Synthetic oligonucleotide
gcgacgccgcgagccaaaggatg

SEQ ID NO: 12507 - DNA, 24 bp, Artificial Sequence
  Description of Artificial Sequence: Synthetic oligonucleotide
cgacgccgcgagccaaaggatgga

SEQ ID NO: 12508 - DNA, 24 bp, Artificial Sequence
  Description of Artificial Sequence: Synthetic oligonucleotide
gacgccgcgagccaaaggatggag

SEQ ID NO: 12509 - DNA, 24 bp, Artificial Sequence
  Description of Artificial Sequence: Synthetic oligonucleotide
acgccgcgagccaaaggatggagc

SEQ ID NO: 12510 - DNA, 23 bp, Artificial Sequence
  Description of Artificial Sequence: Synthetic oligonucleotide
cgccgcgagccaaaggatggagc

SEQ ID NO: 12511 - DNA, 23 bp, Artificial Sequence
  Description of Artificial Sequence: Synthetic oligonucleotide
gccgcgagccaaaggatggagcc

SEQ ID NO: 12512 - DNA, 23 bp, Artificial Sequence
  Description of Artificial Sequence: Synthetic oligonucleotide
ccgcgagccaaaggatggagccg

SEQ ID NO: 12513 - DNA, 23 bp, Artificial Sequence
  Description of Artificial Sequence: Synthetic oligonucleotide
cgcgagccaaaggatggagccgc

SEQ ID NO: 12514 - DNA, 23 bp, Artificial Sequence
  Description of Artificial Sequence: Synthetic oligonucleotide
gcgagccaaaggatggagccgcg

SEQ ID NO: 12515 - DNA, 23 bp, Artificial Sequence
  Description of Artificial Sequence: Synthetic oligonucleotide
cgagccaaaggatggagccgcgg

SEQ ID NO: 12516 - DNA, 23 bp, Artificial Sequence
  Description of Artificial Sequence: Synthetic oligonucleotide
gagccaaaggatggagccgcggg

SEQ ID NO: 12517 - DNA, 23 bp, Artificial Sequence
  Description of Artificial Sequence: Synthetic oligonucleotide
agccaaaggatggagccgcgggc

SEQ ID NO: 12518 - DNA, 22 bp, Artificial Sequence
  Description of Artificial Sequence: Synthetic oligonucleotide
gccaaaggatggagccgcgggc

SEQ ID NO: 12519 - DNA, 22 bp, Artificial Sequence
  Description of Artificial Sequence: Synthetic oligonucleotide
ccaaaggatggagccgcgggcg

SEQ ID NO: 12520 - DNA, 22 bp, Artificial Sequence
  Description of Artificial Sequence: Synthetic oligonucleotide
caaaggatggagccgcgggcgc

SEQ ID NO: 12521 - DNA, 22 bp, Artificial Sequence
  Description of Artificial Sequence: Synthetic oligonucleotide
aaaggatggagccgcgggcgcc

SEQ ID NO: 12522 - DNA, 21 bp, Artificial Sequence
  Description of Artificial Sequence: Synthetic oligonucleotide
aaggatggagccgcgggcgcc

SEQ ID NO: 12523 - DNA, 26 bp, Artificial Sequence
  Description of Artificial Sequence: Synthetic oligonucleotide
tggggaccctgcgcggctactacaat

SEQ ID NO: 12524 - DNA, 25 bp, Artificial Sequence
  Description of Artificial Sequence: Synthetic oligonucleotide
ggggaccctgcgcggctactacaat

SEQ ID NO: 12525 - DNA, 26 bp, Artificial Sequence
  Description of Artificial Sequence: Synthetic oligonucleotide
gggaccctgcgcggctactacaatca

SEQ ID NO: 12526 - DNA, 27 bp, Artificial Sequence
  Description of Artificial Sequence: Synthetic oligonucleotide
ggaccctgcgcggctactacaatcaga

SEQ ID NO: 12527 - DNA, 27 bp, Artificial Sequence
  Description of Artificial Sequence: Synthetic oligonucleotide
gaccctgcgcggctactacaatcagag

SEQ ID NO: 12528 - DNA, 27 bp, Artificial Sequence
  Description of Artificial Sequence: Synthetic oligonucleotide
accctgcgcggctactacaatcagagc

SEQ ID NO: 12529 - DNA, 26 bp, Artificial Sequence
  Description of Artificial Sequence: Synthetic oligonucleotide
ccctgcgcggctactacaatcagagc

SEQ ID NO: 12530 - DNA, 27 bp, Artificial Sequence
  Description of Artificial Sequence: Synthetic oligonucleotide
cctgcgcggctactacaatcagagcga

SEQ ID NO: 12531 - DNA, 27 bp, Artificial Sequence
  Description of Artificial Sequence: Synthetic oligonucleotide
ctgcgcggctactacaatcagagcgag

SEQ ID NO: 12532 - DNA, 27 bp, Artificial Sequence
  Description of Artificial Sequence: Synthetic oligonucleotide
tgcgcggctactacaatcagagcgagg

SEQ ID NO: 12533 - DNA, 27 bp, Artificial Sequence
  Description of Artificial Sequence: Synthetic oligonucleotide
gcgcggctactacaatcagagcgagga

SEQ ID NO: 12534 - DNA, 27 bp, Artificial Sequence
  Description of Artificial Sequence: Synthetic oligonucleotide
cgcggctactacaatcagagcgaggac

SEQ ID NO: 12535 - DNA, 27 bp, Artificial Sequence
  Description of Artificial Sequence: Synthetic oligonucleotide
gcggctactacaatcagagcgaggacg

SEQ ID NO: 12536 - DNA, 27 bp, Artificial Sequence
  Description of Artificial Sequence: Synthetic oligonucleotide
cggctactacaatcagagcgaggacgg

SEQ ID NO: 12537 - DNA, 29 bp, Artificial Sequence
  Description of Artificial Sequence: Synthetic oligonucleotide
ggctactacaatcagagcgaggacggttc

SEQ ID NO: 12538 - DNA, 30 bp, Artificial Sequence
  Description of Artificial Sequence: Synthetic oligonucleotide
gctactacaatcagagcgaggacggttctc

SEQ ID NO: 12539 - DNA, 31 bp, Artificial Sequence
  Description of Artificial Sequence: Synthetic oligonucleotide
ctactacaatcagagcgaggacggttctcac

SEQ ID NO: 12540 - DNA, 32 bp, Artificial Sequence
  Description of Artificial Sequence: Synthetic oligonucleotide
tactacaatcagagcgaggacggttctcacac

SEQ ID NO: 12541 - DNA, 31 bp, Artificial Sequence
  Description of Artificial Sequence: Synthetic oligonucleotide
actacaatcagagcgaggacggttctcacac

SEQ ID NO: 12542 - DNA, 30 bp, Artificial Sequence
  Description of Artificial Sequence: Synthetic oligonucleotide
ctacaatcagagcgaggacggttctcacac

SEQ ID NO: 12543 - DNA, 30 bp, Artificial Sequence
  Description of Artificial Sequence: Synthetic oligonucleotide
tacaatcagagcgaggacggttctcacacc

SEQ ID NO: 12544 - DNA, 29 bp, Artificial Sequence
  Description of Artificial Sequence: Synthetic oligonucleotide
acaatcagagcgaggacggttctcacacc

SEQ ID NO: 12545 - DNA, 28 bp, Artificial Sequence
  Description of Artificial Sequence: Synthetic oligonucleotide
caatcagagcgaggacggttctcacacc

SEQ ID NO: 12546 - DNA, 30 bp, Artificial Sequence
  Description of Artificial Sequence: Synthetic oligonucleotide
aatcagagcgaggacggttctcacaccatc

SEQ ID NO: 12547 - DNA, 29 bp, Artificial Sequence
  Description of Artificial Sequence: Synthetic oligonucleotide
atcagagcgaggacggttctcacaccatc

SEQ ID NO: 12548 - DNA, 28 bp, Artificial Sequence
  Description of Artificial Sequence: Synthetic oligonucleotide
tcagagcgaggacggttctcacaccatc

SEQ ID NO: 12549 - DNA, 35 bp, Artificial Sequence
  Description of Artificial Sequence: Synthetic oligonucleotide
ttctcacaccatccagataatgtatggctgcgatg

SEQ ID NO: 12550 - DNA, 34 bp, Artificial Sequence
  Description of Artificial Sequence: Synthetic oligonucleotide
tctcacaccatccagataatgtatggctgcgatg

SEQ ID NO: 12551 - DNA, 33 bp, Artificial Sequence
  Description of Artificial Sequence: Synthetic oligonucleotide
ctcacaccatccagataatgtatggctgcgatg

SEQ ID NO: 12552 - DNA, 34 bp, Artificial Sequence
  Description of Artificial Sequence: Synthetic oligonucleotide
tcacaccatccagataatgtatggctgcgatgtg

SEQ ID NO: 12553 - DNA, 33 bp, Artificial Sequence
  Description of Artificial Sequence: Synthetic oligonucleotide
cacaccatccagataatgtatggctgcgatgtg

SEQ ID NO: 12554 - DNA, 33 bp, Artificial Sequence
  Description of Artificial Sequence: Synthetic oligonucleotide
acaccatccagataatgtatggctgcgatgtgg

SEQ ID NO: 12555 - DNA, 32 bp, Artificial Sequence
  Description of Artificial Sequence: Synthetic oligonucleotide
caccatccagataatgtatggctgcgatgtgg

SEQ ID NO: 12556 - DNA, 32 bp, Artificial Sequence
  Description of Artificial Sequence: Synthetic oligonucleotide
accatccagataatgtatggctgcgatgtggg

SEQ ID NO: 12557 - DNA, 31 bp, Artificial Sequence
  Description of Artificial Sequence: Synthetic oligonucleotide
ccatccagataatgtatggctgcgatgtggg

SEQ ID NO: 12558 - DNA, 31 bp, Artificial Sequence
  Description of Artificial Sequence: Synthetic oligonucleotide
catccagataatgtatggctgcgatgtgggg

SEQ ID NO: 12559 - DNA, 31 bp, Artificial Sequence
  Description of Artificial Sequence: Synthetic oligonucleotide
atccagataatgtatggctgcgatgtggggc

SEQ ID NO: 12560 - DNA, 30 bp, Artificial Sequence
  Description of Artificial Sequence: Synthetic oligonucleotide
tccagataatgtatggctgcgatgtggggc

SEQ ID NO: 12561 - DNA, 29 bp, Artificial Sequence
  Description of Artificial Sequence: Synthetic oligonucleotide
ccagataatgtatggctgcgatgtggggc

SEQ ID NO: 12562 - DNA, 29 bp, Artificial Sequence
  Description of Artificial Sequence: Synthetic oligonucleotide
cagataatgtatggctgcgatgtggggcc

SEQ ID NO: 12563 - DNA, 29 bp, Artificial Sequence
  Description of Artificial Sequence: Synthetic oligonucleotide
agataatgtatggctgcgatgtggggccg

SEQ ID NO: 12564 - DNA, 28 bp, Artificial Sequence
  Description of Artificial Sequence: Synthetic oligonucleotide
gataatgtatggctgcgatgtggggccg

SEQ ID NO: 12565 - DNA, 28 bp, Artificial Sequence
  Description of Artificial Sequence: Synthetic oligonucleotide
ataatgtatggctgcgatgtggggccgg

SEQ ID NO: 12566 - DNA, 27 bp, Artificial Sequence
  Description of Artificial Sequence: Synthetic oligonucleotide
taatgtatggctgcgatgtggggccgg

SEQ ID NO: 12567 - DNA, 27 bp, Artificial Sequence
  Description of Artificial Sequence: Synthetic oligonucleotide
aatgtatggctgcgatgtggggccgga

SEQ ID NO: 12568 - DNA, 26 bp, Artificial Sequence
  Description of Artificial Sequence: Synthetic oligonucleotide
atgtatggctgcgatgtggggccgga

SEQ ID NO: 12569 - DNA, 25 bp, Artificial Sequence
  Description of Artificial Sequence: Synthetic oligonucleotide
tgtatggctgcgatgtggggccgga

SEQ ID NO: 12570 - DNA, 24 bp, Artificial Sequence
  Description of Artificial Sequence: Synthetic oligonucleotide
gtatggctgcgatgtggggccgga

SEQ ID NO: 12571 - DNA, 24 bp, Artificial Sequence
  Description of Artificial Sequence: Synthetic oligonucleotide
tatggctgcgatgtggggccggac

SEQ ID NO: 12572 - DNA, 23 bp, Artificial Sequence
  Description of Artificial Sequence: Synthetic oligonucleotide
atggctgcgatgtggggccggac

SEQ ID NO: 12573 - DNA, 22 bp, Artificial Sequence
  Description of Artificial Sequence: Synthetic oligonucleotide
tggctgcgatgtggggccggac

SEQ ID NO: 12574 - DNA, 21 bp, Artificial Sequence
  Description of Artificial Sequence: Synthetic oligonucleotide
ggctgcgatgtggggccggac

SEQ ID NO: 12575 - DNA, 21 bp, Artificial Sequence
  Description of Artificial Sequence: Synthetic oligonucleotide
gctgcgatgtggggccggacg

SEQ ID NO: 12576 - DNA, 21 bp, Artificial Sequence
  Description of Artificial Sequence: Synthetic oligonucleotide
ctgcgatgtggggccggacgg

SEQ ID NO: 12577 - DNA, 21 bp, Artificial Sequence
  Description of Artificial Sequence: Synthetic oligonucleotide
tgcgatgtggggccggacggg

SEQ ID NO: 12578 - DNA, 20 bp, Artificial Sequence
  Description of Artificial Sequence: Synthetic oligonucleotide
gcgatgtggggccggacggg

SEQ ID NO: 12579 - DNA, 20 bp, Artificial Sequence
  Description of Artificial Sequence: Synthetic oligonucleotide
cgatgtggggccggacgggc

SEQ ID NO: 12580 - DNA, 20 bp, Artificial Sequence
  Description of Artificial Sequence: Synthetic oligonucleotide
gatgtggggccggacgggcg

SEQ ID NO: 12581 - DNA, 22 bp, Artificial Sequence
  Description of Artificial Sequence: Synthetic oligonucleotide
atgtggggccggacgggcgctt

SEQ ID NO: 12582 - DNA, 21 bp, Artificial Sequence
  Description of Artificial Sequence: Synthetic oligonucleotide
tgtggggccggacgggcgctt

SEQ ID NO: 12583 - DNA, 24 bp, Artificial Sequence
  Description of Artificial Sequence: Synthetic oligonucleotide
agagagcctacctggagggccgct

SEQ ID NO: 12584 - DNA, 23 bp, Artificial Sequence
  Description of Artificial Sequence: Synthetic oligonucleotide
gagagcctacctggagggccgct

SEQ ID NO: 12585 - DNA, 23 bp, Artificial Sequence
  Description of Artificial Sequence: Synthetic oligonucleotide
agagcctacctggagggccgctg

SEQ ID NO: 12586 - DNA, 22 bp, Artificial Sequence
  Description of Artificial Sequence: Synthetic oligonucleotide
gagcctacctggagggccgctg

SEQ ID NO: 12587 - DNA, 22 bp, Artificial Sequence
  Description of Artificial Sequence: Synthetic oligonucleotide
agcctacctggagggccgctgc

SEQ ID NO: 12588 - DNA, 21 bp, Artificial Sequence
  Description of Artificial Sequence: Synthetic oligonucleotide
gcctacctggagggccgctgc

SEQ ID NO: 12589 - DNA, 22 bp, Artificial Sequence
  Description of Artificial Sequence: Synthetic oligonucleotide
cctacctggagggccgctgcgt

SEQ ID NO: 12590 - DNA, 22 bp, Artificial Sequence
  Description of Artificial Sequence: Synthetic oligonucleotide
ctacctggagggccgctgcgtg

SEQ ID NO: 12591 - DNA, 23 bp, Artificial Sequence
  Description of Artificial Sequence: Synthetic oligonucleotide
tacctggagggccgctgcgtgga

SEQ ID NO: 12592 - DNA, 22 bp, Artificial Sequence
  Description of Artificial Sequence: Synthetic oligonucleotide
acctggagggccgctgcgtgga

SEQ ID NO: 12593 - DNA, 21 bp, Artificial Sequence
  Description of Artificial Sequence: Synthetic oligonucleotide
cctggagggccgctgcgtgga

SEQ ID NO: 12594 - DNA, 22 bp, Artificial Sequence
  Description of Artificial Sequence: Synthetic oligonucleotide
ctggagggccgctgcgtggagt

SEQ ID NO: 12595 - DNA, 22 bp, Artificial Sequence
  Description of Artificial Sequence: Synthetic oligonucleotide
tggagggccgctgcgtggagtg

SEQ ID NO: 12596 - DNA, 21 bp, Artificial Sequence
  Description of Artificial Sequence: Synthetic oligonucleotide
ggagggccgctgcgtggagtg

SEQ ID NO: 12597 - DNA, 21 bp, Artificial Sequence
  Description of Artificial Sequence: Synthetic oligonucleotide
gagggccgctgcgtggagtgg

SEQ ID NO: 12598 - DNA, 22 bp, Artificial Sequence
  Description of Artificial Sequence: Synthetic oligonucleotide
agggccgctgcgtggagtggct

SEQ ID NO: 12599 - DNA, 21 bp, Artificial Sequence
  Description of Artificial Sequence: Synthetic oligonucleotide
gggccgctgcgtggagtggct

SEQ ID NO: 12600 - DNA, 21 bp, Artificial Sequence
  Description of Artificial Sequence: Synthetic oligonucleotide
ggccgctgcgtggagtggctc

SEQ ID NO: 12601 - DNA, 21 bp, Artificial Sequence
  Description of Artificial Sequence: Synthetic oligonucleotide
gccgctgcgtggagtggctcc

SEQ ID NO: 12602 - DNA, 21 bp, Artificial Sequence
  Description of Artificial Sequence: Synthetic oligonucleotide
ccgctgcgtggagtggctccg

SEQ ID NO: 12603 - DNA, 22 bp, Artificial Sequence
  Description of Artificial Sequence: Synthetic oligonucleotide
cgctgcgtggagtggctccgca

SEQ ID NO: 12604 - DNA, 25 bp, Artificial Sequence
  Description of Artificial Sequence: Synthetic oligonucleotide
gctgcgtggagtggctccgcagata

SEQ ID NO: 12605 - DNA, 25 bp, Artificial Sequence
  Description of Artificial Sequence: Synthetic oligonucleotide
ctgcgtggagtggctccgcagatac

SEQ ID NO: 12606 - DNA, 27 bp, Artificial Sequence
  Description of Artificial Sequence: Synthetic oligonucleotide
cgtgggctacgtggacgacacgcaatt

SEQ ID NO: 12607 - DNA, 27 bp, Artificial Sequence
  Description of Artificial Sequence: Synthetic oligonucleotide
gtgggctacgtggacgacacgcaattc

SEQ ID NO: 12608 - DNA, 27 bp, Artificial Sequence
  Description of Artificial Sequence: Synthetic oligonucleotide
tgggctacgtggacgacacgcaattcg

SEQ ID NO: 12609 - DNA, 27 bp, Artificial Sequence
  Description of Artificial Sequence: Synthetic oligonucleotide
gggctacgtggacgacacgcaattcgt

SEQ ID NO: 12610 - DNA, 27 bp, Artificial Sequence
  Description of Artificial Sequence: Synthetic oligonucleotide
ggctacgtggacgacacgcaattcgtg

SEQ ID NO: 12611 - DNA, 27 bp, Artificial Sequence
  Description of Artificial Sequence: Synthetic oligonucleotide
gctacgtggacgacacgcaattcgtgc

SEQ ID NO: 12612 - DNA, 27 bp, Artificial Sequence
  Description of Artificial Sequence: Synthetic oligonucleotide
ctacgtggacgacacgcaattcgtgcg

SEQ ID NO: 12613 - DNA, 27 bp, Artificial Sequence
  Description of Artificial Sequence: Synthetic oligonucleotide
tacgtggacgacacgcaattcgtgcgg

SEQ ID NO: 12614 - DNA, 27 bp, Artificial Sequence
  Description of Artificial Sequence: Synthetic oligonucleotide
acgtggacgacacgcaattcgtgcggt

SEQ ID NO: 12615 - DNA, 27 bp, Artificial Sequence
  Description of Artificial Sequence: Synthetic oligonucleotide
cgtggacgacacgcaattcgtgcggtt

SEQ ID NO: 12616 - DNA, 27 bp, Artificial Sequence
  Description of Artificial Sequence: Synthetic oligonucleotide
gtggacgacacgcaattcgtgcggttc

SEQ ID NO: 12617 - DNA, 27 bp, Artificial Sequence
  Description of Artificial Sequence: Synthetic oligonucleotide
tggacgacacgcaattcgtgcggttcg

SEQ ID NO: 12618 - DNA, 27 bp, Artificial Sequence
  Description of Artificial Sequence: Synthetic oligonucleotide
ggacgacacgcaattcgtgcggttcga

SEQ ID NO: 12619 - DNA, 27 bp, Artificial Sequence
  Description of Artificial Sequence: Synthetic oligonucleotide
gacgacacgcaattcgtgcggttcgac

SEQ ID NO: 12620 - DNA, 28 bp, Artificial Sequence
  Description of Artificial Sequence: Synthetic oligonucleotide
acgacacgcaattcgtgcggttcgacag

SEQ ID NO: 12621 - DNA, 27 bp, Artificial Sequence
  Description of Artificial Sequence: Synthetic oligonucleotide
cgacacgcaattcgtgcggttcgacag

SEQ ID NO: 12622 - DNA, 27 bp, Artificial Sequence
  Description of Artificial Sequence: Synthetic oligonucleotide
gacacgcaattcgtgcggttcgacagc

SEQ ID NO: 12623 - DNA, 27 bp, Artificial Sequence
  Description of Artificial Sequence: Synthetic oligonucleotide
acacgcaattcgtgcggttcgacagcg

SEQ ID NO: 12624 - DNA, 27 bp, Artificial Sequence
  Description of Artificial Sequence: Synthetic oligonucleotide
cacgcaattcgtgcggttcgacagcga

SEQ ID NO: 12625 - DNA, 27 bp, Artificial Sequence
  Description of Artificial Sequence: Synthetic oligonucleotide
acgcaattcgtgcggttcgacagcgac

SEQ ID NO: 12626 - DNA, 26 bp, Artificial Sequence
  Description of Artificial Sequence: Synthetic oligonucleotide
cgcaattcgtgcggttcgacagcgac

SEQ ID NO: 12627 - DNA, 26 bp, Artificial Sequence
  Description of Artificial Sequence: Synthetic oligonucleotide
gcaattcgtgcggttcgacagcgacg

SEQ ID NO: 12628 - DNA, 26 bp, Artificial Sequence
  Description of Artificial Sequence: Synthetic oligonucleotide
caattcgtgcggttcgacagcgacgc

SEQ ID NO: 12629 - DNA, 26 bp, Artificial Sequence
  Description of Artificial Sequence: Synthetic oligonucleotide
aattcgtgcggttcgacagcgacgcc

SEQ ID NO: 12630 - DNA, 25 bp, Artificial Sequence
  Description of Artificial Sequence: Synthetic oligonucleotide
attcgtgcggttcgacagcgacgcc

SEQ ID NO: 12631 - DNA, 20 bp, Artificial Sequence
  Description of Artificial Sequence: Synthetic oligonucleotide
ccggcccggccgcgggaatt

SEQ ID NO: 12632 - DNA, 20 bp, Artificial Sequence
  Description of Artificial Sequence: Synthetic oligonucleotide
cggcccggccgcgggaagtt

SEQ ID NO: 12633 - DNA, 20 bp, Artificial Sequence
  Description of Artificial Sequence: Synthetic oligonucleotide
ggcccggccgcgggaagctt

SEQ ID NO: 12634 - DNA, 20 bp, Artificial Sequence
  Description of Artificial Sequence: Synthetic oligonucleotide
gcccggccgcgggaagcctt

SEQ ID NO: 12635 - DNA, 20 bp, Artificial Sequence
  Description of Artificial Sequence: Synthetic oligonucleotide
cccggccgcgggaagccctt

SEQ ID NO: 12636 - DNA, 20 bp, Artificial Sequence
  Description of Artificial Sequence: Synthetic oligonucleotide
ccggccgcgggaagcccctt

SEQ ID NO: 12637 - DNA, 20 bp, Artificial Sequence
  Description of Artificial Sequence: Synthetic oligonucleotide
cggccgcgggaagccccgtt

SEQ ID NO: 12638 - DNA, 20 bp, Artificial Sequence
  Description of Artificial Sequence: Synthetic oligonucleotide
ggccgcgggaagccccgctt

SEQ ID NO: 12639 - DNA, 22 bp, Artificial Sequence
  Description of Artificial Sequence: Synthetic oligonucleotide
gccgcgggaagccccgcttcat

SEQ ID NO: 12640 - DNA, 22 bp, Artificial Sequence
  Description of Artificial Sequence: Synthetic oligonucleotide
ccgcgggaagccccgcttcatc

SEQ ID NO: 12641 - DNA, 22 bp, Artificial Sequence
  Description of Artificial Sequence: Synthetic oligonucleotide
cgcgggaagccccgcttcatcg

SEQ ID NO: 12642 - DNA, 22 bp, Artificial Sequence
  Description of Artificial Sequence: Synthetic oligonucleotide
gcgggaagccccgcttcatcgc

SEQ ID NO: 12643 - DNA, 22 bp, Artificial Sequence
  Description of Artificial Sequence: Synthetic oligonucleotide
cgggaagccccgcttcatcgcc

SEQ ID NO: 12644 - DNA, 23 bp, Artificial Sequence
  Description of Artificial Sequence: Synthetic oligonucleotide
gggaagccccgcttcatcgccgt

SEQ ID NO: 12645 - DNA, 23 bp, Artificial Sequence
  Description of Artificial Sequence: Synthetic oligonucleotide
ggaagccccgcttcatcgccgtg

SEQ ID NO: 12646 - DNA, 23 bp, Artificial Sequence
  Description of Artificial Sequence: Synthetic oligonucleotide
gaagccccgcttcatcgccgtgg

SEQ ID NO: 12647 - DNA, 23 bp, Artificial Sequence
  Description of Artificial Sequence: Synthetic oligonucleotide
aagccccgcttcatcgccgtggg

SEQ ID NO: 12648 - DNA, 30 bp, Artificial Sequence
  Description of Artificial Sequence: Synthetic oligonucleotide
gaatgtgaaggcccagtcacagactgacag

SEQ ID NO: 12649 - DNA, 31 bp, Artificial Sequence
  Description of Artificial Sequence: Synthetic oligonucleotide
aatgtgaaggcccagtcacagactgacagag

SEQ ID NO: 12650 - DNA, 30 bp, Artificial Sequence
  Description of Artificial Sequence: Synthetic oligonucleotide
atgtgaaggcccagtcacagactgacagag

SEQ ID NO: 12651 - DNA, 29 bp, Artificial Sequence
  Description of Artificial Sequence: Synthetic oligonucleotide
tgtgaaggcccagtcacagactgacagag

SEQ ID NO: 12652 - DNA, 28 bp, Artificial Sequence
  Description of Artificial Sequence: Synthetic oligonucleotide
gtgaaggcccagtcacagactgacagag

SEQ ID NO: 12653 - DNA, 29 bp, Artificial Sequence
  Description of Artificial Sequence: Synthetic oligonucleotide
tgaaggcccagtcacagactgacagagtg

SEQ ID NO: 12654 - DNA, 28 bp, Artificial Sequence
  Description of Artificial Sequence: Synthetic oligonucleotide
gaaggcccagtcacagactgacagagtg

SEQ ID NO: 12655 - DNA, 28 bp, Artificial Sequence
  Description of Artificial Sequence: Synthetic oligonucleotide
aaggcccagtcacagactgacagagtgg

SEQ ID NO: 12656 - DNA, 27 bp, Artificial Sequence
  Description of Artificial Sequence: Synthetic oligonucleotide
aggcccagtcacagactgacagagtgg

SEQ ID NO: 12657 - DNA, 27 bp, Artificial Sequence
  Description of Artificial Sequence: Synthetic oligonucleotide
ggcccagtcacagactgacagagtgga

SEQ ID NO: 12658 - DNA, 27 bp, Artificial Sequence
  Description of Artificial Sequence: Synthetic oligonucleotide
gcccagtcacagactgacagagtggac

SEQ ID NO: 12659 - DNA, 27 bp, Artificial Sequence
  Description of Artificial Sequence: Synthetic oligonucleotide
cccagtcacagactgacagagtggacc

SEQ ID NO: 12660 - DNA, 28 bp, Artificial Sequence
  Description of Artificial Sequence: Synthetic oligonucleotide
ccagtcacagactgacagagtggacctg

SEQ ID NO: 12661 - DNA, 28 bp, Artificial Sequence
  Description of Artificial Sequence: Synthetic oligonucleotide
cagtcacagactgacagagtggacctgg

SEQ ID NO: 12662 - DNA, 28 bp, Artificial Sequence
  Description of Artificial Sequence: Synthetic oligonucleotide
agtcacagactgacagagtggacctggg

SEQ ID NO: 12663 - DNA, 27 bp, Artificial Sequence
  Description of Artificial Sequence: Synthetic oligonucleotide
gtcacagactgacagagtggacctggg

SEQ ID NO: 12664 - DNA, 27 bp, Artificial Sequence
  Description of Artificial Sequence: Synthetic oligonucleotide
tcacagactgacagagtggacctgggg

SEQ ID NO: 12665 - DNA, 27 bp, Artificial Sequence
  Description of Artificial Sequence: Synthetic oligonucleotide
cacagactgacagagtggacctgggga

SEQ ID NO: 12666 - DNA, 27 bp, Artificial Sequence
  Description of Artificial Sequence: Synthetic oligonucleotide
acagactgacagagtggacctggggac

SEQ ID NO: 12667 - DNA, 26 bp, Artificial Sequence
  Description of Artificial Sequence: Synthetic oligonucleotide
cagactgacagagtggacctggggac

SEQ ID NO: 12668 - DNA, 26 bp, Artificial Sequence
  Description of Artificial Sequence: Synthetic oligonucleotide
agactgacagagtggacctggggacc

SEQ ID NO: 12669 - DNA, 25 bp, Artificial Sequence
  Description of Artificial Sequence: Synthetic oligonucleotide
gactgacagagtggacctggggacc

SEQ ID NO: 12670 - DNA, 26 bp, Artificial Sequence
  Description of Artificial Sequence: Synthetic oligonucleotide
actgacagagtggacctggggaccct

SEQ ID NO: 12671 - DNA, 25 bp, Artificial Sequence
  Description of Artificial Sequence: Synthetic oligonucleotide
ctgacagagtggacctggggaccct

SEQ ID NO: 12672 - DNA, 25 bp, Artificial Sequence
  Description of Artificial Sequence: Synthetic oligonucleotide
tgacagagtggacctggggaccctg

SEQ ID NO: 12673 - DNA, 24 bp, Artificial Sequence
  Description of Artificial Sequence: Synthetic oligonucleotide
gacagagtggacctggggaccctg

SEQ ID NO: 12674 - DNA, 24 bp, Artificial Sequence
  Description of Artificial Sequence: Synthetic oligonucleotide
acagagtggacctggggaccctgc

SEQ ID NO: 12675 - DNA, 23 bp, Artificial Sequence
  Description of Artificial Sequence: Synthetic oligonucleotide
cagagtggacctggggaccctgc

SEQ ID NO: 12676 - DNA, 23 bp, Artificial Sequence
  Description of Artificial Sequence: Synthetic oligonucleotide
agagtggacctggggaccctgcg

SEQ ID NO: 12677 - DNA, 27 bp, Artificial Sequence
  Description of Artificial Sequence: Synthetic oligonucleotide
caccccatctctgaccatgaggccact

SEQ ID NO: 12678 - DNA, 27 bp, Artificial Sequence
  Description of Artificial Sequence: Synthetic oligonucleotide
accccatctctgaccatgaggccactc

SEQ ID NO: 12679 - DNA, 27 bp, Artificial Sequence
  Description of Artificial Sequence: Synthetic oligonucleotide
ccccatctctgaccatgaggccactct

SEQ ID NO: 12680 - DNA, 27 bp, Artificial Sequence
  Description of Artificial Sequence: Synthetic oligonucleotide
cccatctctgaccatgaggccactctg

SEQ ID NO: 12681 - DNA, 28 bp, Artificial Sequence
  Description of Artificial Sequence: Synthetic oligonucleotide
ccatctctgaccatgaggccactctgag

SEQ ID NO: 12682 - DNA, 28 bp, Artificial Sequence
  Description of Artificial Sequence: Synthetic oligonucleotide
catctctgaccatgaggccactctgagg

SEQ ID NO: 12683 - DNA, 29 bp, Artificial Sequence
  Description of Artificial Sequence: Synthetic oligonucleotide
atctctgaccatgaggccactctgaggtg

SEQ ID NO: 12684 - DNA, 28 bp, Artificial Sequence
  Description of Artificial Sequence: Synthetic oligonucleotide
tctctgaccatgaggccactctgaggtg

SEQ ID NO: 12685 - DNA, 27 bp, Artificial Sequence
  Description of Artificial Sequence: Synthetic oligonucleotide
ctctgaccatgaggccactctgaggtg

SEQ ID NO: 12686 - DNA, 27 bp, Artificial Sequence
  Description of Artificial Sequence: Synthetic oligonucleotide
tctgaccatgaggccactctgaggtgc

SEQ ID NO: 12687 - DNA, 27 bp, Artificial Sequence
  Description of Artificial Sequence: Synthetic oligonucleotide
ctgaccatgaggccactctgaggtgct

SEQ ID NO: 12688 - DNA, 27 bp, Artificial Sequence
  Description of Artificial Sequence: Synthetic oligonucleotide
tgaccatgaggccactctgaggtgctg

SEQ ID NO: 12689 - DNA, 26 bp, Artificial Sequence
  Description of Artificial Sequence: Synthetic oligonucleotide
gaccatgaggccactctgaggtgctg

SEQ ID NO: 12690 - DNA, 26 bp, Artificial Sequence
  Description of Artificial Sequence: Synthetic oligonucleotide
accatgaggccactctgaggtgctgg

SEQ ID NO: 12691 - DNA, 25 bp, Artificial Sequence
  Description of Artificial Sequence: Synthetic oligonucleotide
ccatgaggccactctgaggtgctgg

SEQ ID NO: 12692 - DNA, 25 bp, Artificial Sequence
  Description of Artificial Sequence: Synthetic oligonucleotide
catgaggccactctgaggtgctggg

SEQ ID NO: 12693 - DNA, 25 bp, Artificial Sequence
  Description of Artificial Sequence: Synthetic oligonucleotide
atgaggccactctgaggtgctgggc

SEQ ID NO: 12694 - DNA, 24 bp, Artificial Sequence
  Description of Artificial Sequence: Synthetic oligonucleotide
tgaggccactctgaggtgctgggc

SEQ ID NO: 12695 - DNA, 23 bp, Artificial Sequence
  Description of Artificial Sequence: Synthetic oligonucleotide
gaggccactctgaggtgctgggc

SEQ ID NO: 12696 - DNA, 23 bp, Artificial Sequence
  Description of Artificial Sequence: Synthetic oligonucleotide
aggccactctgaggtgctgggcc

SEQ ID NO: 12697 - DNA, 22 bp, Artificial Sequence
  Description of Artificial Sequence: Synthetic oligonucleotide
ggccactctgaggtgctgggcc

SEQ ID NO: 12698 - DNA, 23 bp, Artificial Sequence
  Description of Artificial Sequence: Synthetic oligonucleotide
ccactctgaggtgctgggccctg

SEQ ID NO: 12699 - DNA, 23 bp, Artificial Sequence
  Description of Artificial Sequence: Synthetic oligonucleotide
cactctgaggtgctgggccctgg

SEQ ID NO: 12700 - DNA, 23 bp, Artificial Sequence
  Description of Artificial Sequence: Synthetic oligonucleotide
actctgaggtgctgggccctggg

SEQ ID NO: 12701 - DNA, 22 bp, Artificial Sequence
  Description of Artificial Sequence: Synthetic oligonucleotide
ctctgaggtgctgggccctggg

SEQ ID NO: 12702 - DNA, 24 bp, Artificial Sequence
  Description of Artificial Sequence: Synthetic oligonucleotide
tctgaggtgctgggccctgggctt

SEQ ID NO: 12703 - DNA, 22 bp, Artificial Sequence
  Description of Artificial Sequence: Synthetic oligonucleotide
gcaagtgggaggcggcccgtga

SEQ ID NO: 12704 - DNA, 22 bp, Artificial Sequence
  Description of Artificial Sequence: Synthetic oligonucleotide
caagtgggaggcggcccgtgag

SEQ ID NO: 12705 - DNA, 22 bp, Artificial Sequence
  Description of Artificial Sequence: Synthetic oligonucleotide
aagtgggaggcggcccgtgagg

SEQ ID NO: 12706 - DNA, 21 bp, Artificial Sequence
  Description of Artificial Sequence: Synthetic oligonucleotide
agtgggaggcggcccgtgagg

SEQ ID NO: 12707 - DNA, 20 bp, Artificial Sequence
  Description of Artificial Sequence: Synthetic oligonucleotide
gtgggaggcggcccgtgagg

SEQ ID NO: 12708 - DNA, 20 bp, Artificial Sequence
  Description of Artificial Sequence: Synthetic oligonucleotide
tgggaggcggcccgtgaggc

SEQ ID NO: 12709 - DNA, 20 bp, Artificial Sequence
  Description of Artificial Sequence: Synthetic oligonucleotide
gggaggcggcccgtgaggct

SEQ ID NO: 12710 - DNA, 20 bp, Artificial Sequence
  Description of Artificial Sequence: Synthetic oligonucleotide
ggaggcggcccgtgaggcgt

SEQ ID NO: 12711 - DNA, 20 bp, Artificial Sequence
  Description of Artificial Sequence: Synthetic oligonucleotide
gaggcggcccgtgaggcgga

SEQ ID NO: 12712 - DNA, 20 bp, Artificial Sequence
  Description of Artificial Sequence: Synthetic oligonucleotide
aggcggcccgtgaggcggag

SEQ ID NO: 12713 - DNA, 20 bp, Artificial Sequence
  Description of Artificial Sequence: Synthetic oligonucleotide
ggcggcccgtgaggcggagt

SEQ ID NO: 12714 - DNA, 20 bp, Artificial Sequence
  Description of Artificial Sequence: Synthetic oligonucleotide
gcggcccgtgaggcggagca

SEQ ID NO: 12715 - DNA, 20 bp, Artificial Sequence
  Description of Artificial Sequence: Synthetic oligonucleotide
cggcccgtgaggcggagcag

SEQ ID NO: 12716 - DNA, 21 bp, Artificial Sequence
  Description of Artificial Sequence: Synthetic oligonucleotide
ggcccgtgaggcggagcagca

SEQ ID NO: 12717 - DNA, 22 bp, Artificial Sequence
  Description of Artificial Sequence: Synthetic oligonucleotide
gcccgtgaggcggagcagcaga

SEQ ID NO: 12718 - DNA, 23 bp, Artificial Sequence
  Description of Artificial Sequence: Synthetic oligonucleotide
cccgtgaggcggagcagcagaga

SEQ ID NO: 12719 - DNA, 23 bp, Artificial Sequence
  Description of Artificial Sequence: Synthetic oligonucleotide
ccgtgaggcggagcagcagagag

SEQ ID NO: 12720 - DNA, 23 bp, Artificial Sequence
  Description of Artificial Sequence: Synthetic oligonucleotide
cgtgaggcggagcagcagagagc

SEQ ID NO: 12721 - DNA, 25 bp, Artificial Sequence
  Description of Artificial Sequence: Synthetic oligonucleotide
gtgaggcggagcagcagagagccta

SEQ ID NO: 12722 - DNA, 26 bp, Artificial Sequence
  Description of Artificial Sequence: Synthetic oligonucleotide
gcggacatggcagctcagatcaccga

SEQ ID NO: 12723 - DNA, 26 bp, Artificial Sequence
  Description of Artificial Sequence: Synthetic oligonucleotide
cggacatggcagctcagatcaccgag

SEQ ID NO: 12724 - DNA, 26 bp, Artificial Sequence
  Description of Artificial Sequence: Synthetic oligonucleotide
ggacatggcagctcagatcaccgagc

SEQ ID NO: 12725 - DNA, 26 bp, Artificial Sequence
  Description of Artificial Sequence: Synthetic oligonucleotide
gacatggcagctcagatcaccgagcg

SEQ ID NO: 12726 - DNA, 27 bp, Artificial Sequence
  Description of Artificial Sequence: Synthetic oligonucleotide
acatggcagctcagatcaccgagcgca

SEQ ID NO: 12727 - DNA, 27 bp, Artificial Sequence
  Description of Artificial Sequence: Synthetic oligonucleotide
catggcagctcagatcaccgagcgcaa

SEQ ID NO: 12728 - DNA, 27 bp, Artificial Sequence
  Description of Artificial Sequence: Synthetic oligonucleotide
atggcagctcagatcaccgagcgcaag

SEQ ID NO: 12729 - DNA, 27 bp, Artificial Sequence
  Description of Artificial Sequence: Synthetic oligonucleotide
tggcagctcagatcaccgagcgcaagt

SEQ ID NO: 12730 - DNA, 26 bp, Artificial Sequence
  Description of Artificial Sequence: Synthetic oligonucleotide
ggcagctcagatcaccgagcgcaagt

SEQ ID NO: 12731 - DNA, 26 bp, Artificial Sequence
  Description of Artificial Sequence: Synthetic oligonucleotide
gcagctcagatcaccgagcgcaagtg

SEQ ID NO: 12732 - DNA, 26 bp, Artificial Sequence
  Description of Artificial Sequence: Synthetic oligonucleotide
cagctcagatcaccgagcgcaagtgg

SEQ ID NO: 12733 - DNA, 27 bp, Artificial Sequence
  Description of Artificial Sequence: Synthetic oligonucleotide
agctcagatcaccgagcgcaagtggga

SEQ ID NO: 12734 - DNA, 26 bp, Artificial Sequence
  Description of Artificial Sequence: Synthetic oligonucleotide
gctcagatcaccgagcgcaagtggga

SEQ ID NO: 12735 - DNA, 26 bp, Artificial Sequence
  Description of Artificial Sequence: Synthetic oligonucleotide
ctcagatcaccgagcgcaagtgggag

SEQ ID NO: 12736 - DNA, 26 bp, Artificial Sequence
  Description of Artificial Sequence: Synthetic oligonucleotide
tcagatcaccgagcgcaagtgggagg

SEQ ID NO: 12737 - DNA, 25 bp, Artificial Sequence
  Description of Artificial Sequence: Synthetic oligonucleotide
cagatcaccgagcgcaagtgggagg

SEQ ID NO: 12738 - DNA, 25 bp, Artificial Sequence
  Description of Artificial Sequence: Synthetic oligonucleotide
agatcaccgagcgcaagtgggaggc

SEQ ID NO: 12739 - DNA, 24 bp, Artificial Sequence
  Description of Artificial Sequence: Synthetic oligonucleotide
gatcaccgagcgcaagtgggaggc

SEQ ID NO: 12740 - DNA, 24 bp, Artificial Sequence
  Description of Artificial Sequence: Synthetic oligonucleotide
atcaccgagcgcaagtgggaggcg

SEQ ID NO: 12741 - DNA, 23 bp, Artificial Sequence
  Description of Artificial Sequence: Synthetic oligonucleotide
tcaccgagcgcaagtgggaggcg

SEQ ID NO: 12742 - DNA, 22 bp, Artificial Sequence
  Description of Artificial Sequence: Synthetic oligonucleotide
caccgagcgcaagtgggaggcg

SEQ ID NO: 12743 - DNA, 22 bp, Artificial Sequence
  Description of Artificial Sequence: Synthetic oligonucleotide
accgagcgcaagtgggaggcgg

SEQ ID NO: 12744 - DNA, 21 bp, Artificial Sequence
  Description of Artificial Sequence: Synthetic oligonucleotide
ccgagcgcaagtgggaggcgg

SEQ ID NO: 12745 - DNA, 21 bp, Artificial Sequence
  Description of Artificial Sequence: Synthetic oligonucleotide
cgagcgcaagtgggaggcggc

SEQ ID NO: 12746 - DNA, 21 bp, Artificial Sequence
  Description of Artificial Sequence: Synthetic oligonucleotide
gagcgcaagtgggaggcggcc

SEQ ID NO: 12747 - DNA, 35 bp, Artificial Sequence
  Description of Artificial Sequence: Synthetic oligonucleotide
aggaagagctcagatagaaaaggagggagttactc

SEQ ID NO: 12748 - DNA, 34 bp, Artificial Sequence
  Description of Artificial Sequence: Synthetic oligonucleotide
ggaagagctcagatagaaaaggagggagttactc

SEQ ID NO: 12749 - DNA, 35 bp, Artificial Sequence
  Description of Artificial Sequence: Synthetic oligonucleotide
gaagagctcagatagaaaaggagggagttactctc

SEQ ID NO: 12750 - DNA, 36 bp, Artificial Sequence
  Description of Artificial Sequence: Synthetic oligonucleotide
aagagctcagatagaaaaggagggagttactctcag

SEQ ID NO: 12751 - DNA, 35 bp, Artificial Sequence
  Description of Artificial Sequence: Synthetic oligonucleotide
agagctcagatagaaaaggagggagttactctcag

SEQ ID NO: 12752 - DNA, 34 bp, Artificial Sequence
  Description of Artificial Sequence: Synthetic oligonucleotide
gagctcagatagaaaaggagggagttactctcag

SEQ ID NO: 12753 - DNA, 34 bp, Artificial Sequence
  Description of Artificial Sequence: Synthetic oligonucleotide
agctcagatagaaaaggagggagttactctcagg

SEQ ID NO: 12754 - DNA, 33 bp, Artificial Sequence
  Description of Artificial Sequence: Synthetic oligonucleotide
gctcagatagaaaaggagggagttactctcagg

SEQ ID NO: 12755 - DNA, 33 bp, Artificial Sequence
  Description of Artificial Sequence: Synthetic oligonucleotide
ctcagatagaaaaggagggagttactctcaggc

SEQ ID NO: 12756 - DNA, 34 bp, Artificial Sequence
  Description of Artificial Sequence: Synthetic oligonucleotide
tcagatagaaaaggagggagttactctcaggctg

SEQ ID NO: 12757 - DNA, 33 bp, Artificial Sequence
  Description of Artificial Sequence: Synthetic oligonucleotide
cagatagaaaaggagggagttactctcaggctg

SEQ ID NO: 12758 - DNA, 33 bp, Artificial Sequence
  Description of Artificial Sequence: Synthetic oligonucleotide
agatagaaaaggagggagttactctcaggctgc

SEQ ID NO: 12759 - DNA, 32 bp, Artificial Sequence
  Description of Artificial Sequence: Synthetic oligonucleotide
gatagaaaaggagggagttactctcaggctgc

SEQ ID NO: 12760 - DNA, 34 bp, Artificial Sequence
  Description of Artificial Sequence: Synthetic oligonucleotide
atagaaaaggagggagttactctcaggctgcaag

SEQ ID NO: 12761 - DNA, 33 bp, Artificial Sequence
  Description of Artificial Sequence: Synthetic oligonucleotide
tagaaaaggagggagttactctcaggctgcaag

SEQ ID NO: 12762 - DNA, 32 bp, Artificial Sequence
  Description of Artificial Sequence: Synthetic oligonucleotide
agaaaaggagggagttactctcaggctgcaag

SEQ ID NO: 12763 - DNA, 31 bp, Artificial Sequence
  Description of Artificial Sequence: Synthetic oligonucleotide
gaaaaggagggagttactctcaggctgcaag

SEQ ID NO: 12764 - DNA, 31 bp, Artificial Sequence
  Description of Artificial Sequence: Synthetic oligonucleotide
aaaaggagggagttactctcaggctgcaagc

SEQ ID NO: 12765 - DNA, 30 bp, Artificial Sequence
  Description of Artificial Sequence: Synthetic oligonucleotide
aaaggagggagttactctcaggctgcaagc

SEQ ID NO: 12766 - DNA, 29 bp, Artificial Sequence
  Description of Artificial Sequence: Synthetic oligonucleotide
aaggagggagttactctcaggctgcaagc

SEQ ID NO: 12767 - DNA, 28 bp, Artificial Sequence
  Description of Artificial Sequence: Synthetic oligonucleotide
aggagggagttactctcaggctgcaagc

SEQ ID NO: 12768 - DNA, 27 bp, Artificial Sequence
  Description of Artificial Sequence: Synthetic oligonucleotide
ggagggagttactctcaggctgcaagc

SEQ ID NO: 12769 - DNA, 28 bp, Artificial Sequence
  Description of Artificial Sequence: Synthetic oligonucleotide
gagggagttactctcaggctgcaagcag

SEQ ID NO: 12770 - DNA, 29 bp, Artificial Sequence
  Description of Artificial Sequence: Synthetic oligonucleotide
agggagttactctcaggctgcaagcagtg

SEQ ID NO: 12771 - DNA, 28 bp, Artificial Sequence
  Description of Artificial Sequence: Synthetic oligonucleotide
gggagttactctcaggctgcaagcagtg

SEQ ID NO: 12772 - DNA, 29 bp, Artificial Sequence
  Description of Artificial Sequence: Synthetic oligonucleotide
ggagttactctcaggctgcaagcagtgac

SEQ ID NO: 12773 - DNA, 30 bp, Artificial Sequence
  Description of Artificial Sequence: Synthetic oligonucleotide
gagttactctcaggctgcaagcagtgacag

SEQ ID NO: 12774 - DNA, 31 bp, Artificial Sequence
  Description of Artificial Sequence: Synthetic oligonucleotide
agttactctcaggctgcaagcagtgacagtg

SEQ ID NO: 12775 - DNA, 30 bp, Artificial Sequence
  Description of Artificial Sequence: Synthetic oligonucleotide
gttactctcaggctgcaagcagtgacagtg

SEQ ID NO: 12776 - DNA, 30 bp, Artificial Sequence
  Description of Artificial Sequence: Synthetic oligonucleotide
ttactctcaggctgcaagcagtgacagtgc

SEQ ID NO: 12777 - DNA, 21 bp, Artificial Sequence
  Description of Artificial Sequence: Synthetic oligonucleotide
gtggggccggacgggcgctta

SEQ ID NO: 12778 - DNA, 22 bp, Artificial Sequence
  Description of Artificial Sequence: Synthetic oligonucleotide
tggggccggacgggcgcttact

SEQ ID NO: 12779 - DNA, 21 bp, Artificial Sequence
  Description of Artificial Sequence: Synthetic oligonucleotide
ggggccggacgggcgcttact

SEQ ID NO: 12780 - DNA, 21 bp, Artificial Sequence
  Description of Artificial Sequence: Synthetic oligonucleotide
gggccggacgggcgcttactc

SEQ ID NO: 12781 - DNA, 21 bp, Artificial Sequence
  Description of Artificial Sequence: Synthetic oligonucleotide
ggccggacgggcgcttactcc

SEQ ID NO: 12782 - DNA, 21 bp, Artificial Sequence
  Description of Artificial Sequence: Synthetic oligonucleotide
gccggacgggcgcttactccg

SEQ ID NO: 12783 - DNA, 21 bp, Artificial Sequence
  Description of Artificial Sequence: Synthetic oligonucleotide
ccggacgggcgcttactccgc

SEQ ID NO: 12784 - DNA, 21 bp, Artificial Sequence
  Description of Artificial Sequence: Synthetic oligonucleotide
cggacgggcgcttactccgcg

SEQ ID NO: 12785 - DNA, 21 bp, Artificial Sequence
  Description of Artificial Sequence: Synthetic oligonucleotide
ggacgggcgcttactccgcgg

SEQ ID NO: 12786 - DNA, 23 bp, Artificial Sequence
  Description of Artificial Sequence: Synthetic oligonucleotide
gacgggcgcttactccgcgggta

SEQ ID NO: 12787 - DNA, 23 bp, Artificial Sequence
  Description of Artificial Sequence: Synthetic oligonucleotide
acgggcgcttactccgcgggtac

SEQ ID NO: 12788 - DNA, 22 bp, Artificial Sequence
  Description of Artificial Sequence: Synthetic oligonucleotide
cgggcgcttactccgcgggtac

SEQ ID NO: 12789 - DNA, 22 bp, Artificial Sequence
  Description of Artificial Sequence: Synthetic oligonucleotide
gggcgcttactccgcgggtacc

SEQ ID NO: 12790 - DNA, 22 bp, Artificial Sequence
  Description of Artificial Sequence: Synthetic oligonucleotide
ggcgcttactccgcgggtaccg

SEQ ID NO: 12791 - DNA, 22 bp, Artificial Sequence
  Description of Artificial Sequence: Synthetic oligonucleotide
gcgcttactccgcgggtaccgg

SEQ ID NO: 12792 - DNA, 23 bp, Artificial Sequence
  Description of Artificial Sequence: Synthetic oligonucleotide
cgcttactccgcgggtaccggca

SEQ ID NO: 12793 - DNA, 23 bp, Artificial Sequence
  Description of Artificial Sequence: Synthetic oligonucleotide
gcttactccgcgggtaccggcag

SEQ ID NO: 12794 - DNA, 24 bp, Artificial Sequence
  Description of Artificial Sequence: Synthetic oligonucleotide
cttactccgcgggtaccggcagga

SEQ ID NO: 12795 - DNA, 24 bp, Artificial Sequence
  Description of Artificial Sequence: Synthetic oligonucleotide
ttactccgcgggtaccggcaggac

SEQ ID NO: 12796 - DNA, 23 bp, Artificial Sequence
  Description of Artificial Sequence: Synthetic oligonucleotide
tactccgcgggtaccggcaggac

SEQ ID NO: 12797 - DNA, 22 bp, Artificial Sequence
  Description of Artificial Sequence: Synthetic oligonucleotide
actccgcgggtaccggcaggac

SEQ ID NO: 12798 - DNA, 23 bp, Artificial Sequence
  Description of Artificial Sequence: Synthetic oligonucleotide
agcggagagcctacctggagggc

SEQ ID NO: 12799 - DNA, 22 bp, Artificial Sequence
  Description of Artificial Sequence: Synthetic oligonucleotide
gcggagagcctacctggagggc

SEQ ID NO: 12800 - DNA, 22 bp, Artificial Sequence
  Description of Artificial Sequence: Synthetic oligonucleotide
cggagagcctacctggagggcc

SEQ ID NO: 12801 - DNA, 25 bp, Artificial Sequence
  Description of Artificial Sequence: Synthetic oligonucleotide
cggagcagcagagagcctacctgca

SEQ ID NO: 12802 - DNA, 25 bp, Artificial Sequence
  Description of Artificial Sequence: Synthetic oligonucleotide
ggagcagcagagagcctacctgcag

SEQ ID NO: 12803 - DNA, 25 bp, Artificial Sequence
  Description of Artificial Sequence: Synthetic oligonucleotide
gagcagcagagagcctacctgcagg

SEQ ID NO: 12804 - DNA, 25 bp, Artificial Sequence
  Description of Artificial Sequence: Synthetic oligonucleotide
agcagcagagagcctacctgcaggg

SEQ ID NO: 12805 - DNA, 24 bp, Artificial Sequence
  Description of Artificial Sequence: Synthetic oligonucleotide
gcagcagagagcctacctgcaggg

SEQ ID NO: 12806 - DNA, 24 bp, Artificial Sequence
  Description of Artificial Sequence: Synthetic oligonucleotide
cagcagagagcctacctgcagggc

SEQ ID NO: 12807 - DNA, 24 bp, Artificial Sequence
  Description of Artificial Sequence: Synthetic oligonucleotide
agcagagagcctacctgcagggcc

SEQ ID NO: 12808 - DNA, 23 bp, Artificial Sequence
  Description of Artificial Sequence: Synthetic oligonucleotide
gcagagagcctacctgcagggcc

SEQ ID NO: 12809 - DNA, 23 bp, Artificial Sequence
  Description of Artificial Sequence: Synthetic oligonucleotide
cagagagcctacctgcagggccg

SEQ ID NO: 12810 - DNA, 24 bp, Artificial Sequence
  Description of Artificial Sequence: Synthetic oligonucleotide
agagagcctacctgcagggccggt

SEQ ID NO: 12811 - DNA, 23 bp, Artificial Sequence
  Description of Artificial Sequence: Synthetic oligonucleotide
gagagcctacctgcagggccggt

SEQ ID NO: 12812 - DNA, 23 bp, Artificial Sequence
  Description of Artificial Sequence: Synthetic oligonucleotide
agagcctacctgcagggccggtg

SEQ ID NO: 12813 - DNA, 22 bp, Artificial Sequence
  Description of Artificial Sequence: Synthetic oligonucleotide
gagcctacctgcagggccggtg

SEQ ID NO: 12814 - DNA, 22 bp, Artificial Sequence
  Description of Artificial Sequence: Synthetic oligonucleotide
agcctacctgcagggccggtgc

SEQ ID NO: 12815 - DNA, 21 bp, Artificial Sequence
  Description of Artificial Sequence: Synthetic oligonucleotide
gcctacctgcagggccggtgc

SEQ ID NO: 12816 - DNA, 22 bp, Artificial Sequence
  Description of Artificial Sequence: Synthetic oligonucleotide
cctacctgcagggccggtgcgt

SEQ ID NO: 12817 - DNA, 22 bp, Artificial Sequence
  Description of Artificial Sequence: Synthetic oligonucleotide
ctacctgcagggccggtgcgtg

SEQ ID NO: 12818 - DNA, 23 bp, Artificial Sequence
  Description of Artificial Sequence: Synthetic oligonucleotide
tacctgcagggccggtgcgtgga

SEQ ID NO: 12819 - DNA, 22 bp, Artificial Sequence
  Description of Artificial Sequence: Synthetic oligonucleotide
acctgcagggccggtgcgtgga

SEQ ID NO: 12820 - DNA, 21 bp, Artificial Sequence
  Description of Artificial Sequence: Synthetic oligonucleotide
cctgcagggccggtgcgtgga

SEQ ID NO: 12821 - DNA, 22 bp, Artificial Sequence
  Description of Artificial Sequence: Synthetic oligonucleotide
ctgcagggccggtgcgtggagt

SEQ ID NO: 12822 - DNA, 22 bp, Artificial Sequence
  Description of Artificial Sequence: Synthetic oligonucleotide
tgcagggccggtgcgtggagtg

SEQ ID NO: 12823 - DNA, 21 bp, Artificial Sequence
  Description of Artificial Sequence: Synthetic oligonucleotide
gcagggccggtgcgtggagtg

SEQ ID NO: 12824 - DNA, 21 bp, Artificial Sequence
  Description of Artificial Sequence: Synthetic oligonucleotide
cagggccggtgcgtggagtgg

SEQ ID NO: 12825 - DNA, 25 bp, Artificial Sequence
  Description of Artificial Sequence: Synthetic oligonucleotide
aggaggggccggagtattgggacct

SEQ ID NO: 12826 - DNA, 24 bp, Artificial Sequence
  Description of Artificial Sequence: Synthetic oligonucleotide
ggaggggccggagtattgggacct

SEQ ID NO: 12827 - DNA, 24 bp, Artificial Sequence
  Description of Artificial Sequence: Synthetic oligonucleotide
gaggggccggagtattgggacctg

SEQ ID NO: 12828 - DNA, 25 bp, Artificial Sequence
  Description of Artificial Sequence: Synthetic oligonucleotide
aggggccggagtattgggacctgca

SEQ ID NO: 12829 - DNA, 24 bp, Artificial Sequence
  Description of Artificial Sequence: Synthetic oligonucleotide
ggggccggagtattgggacctgca

SEQ ID NO: 12830 - DNA, 25 bp, Artificial Sequence
  Description of Artificial Sequence: Synthetic oligonucleotide
gggccggagtattgggacctgcaga

SEQ ID NO: 12831 - DNA, 26 bp, Artificial Sequence
  Description of Artificial Sequence: Synthetic oligonucleotide
ggccggagtattgggacctgcagaca

SEQ ID NO: 12832 - DNA, 26 bp, Artificial Sequence
  Description of Artificial Sequence: Synthetic oligonucleotide
gccggagtattgggacctgcagacac

SEQ ID NO: 12833 - DNA, 26 bp, Artificial Sequence
  Description of Artificial Sequence: Synthetic oligonucleotide
ccggagtattgggacctgcagacacg

SEQ ID NO: 12834 - DNA, 27 bp, Artificial Sequence
  Description of Artificial Sequence: Synthetic oligonucleotide
cggagtattgggacctgcagacacgga

SEQ ID NO: 12835 - DNA, 29 bp, Artificial Sequence
  Description of Artificial Sequence: Synthetic oligonucleotide
ggagtattgggacctgcagacacggaatg

SEQ ID NO: 12836 - DNA, 30 bp, Artificial Sequence
  Description of Artificial Sequence: Synthetic oligonucleotide
gagtattgggacctgcagacacggaatgtg

SEQ ID NO: 12837 - DNA, 32 bp, Artificial Sequence
  Description of Artificial Sequence: Synthetic oligonucleotide
agtattgggacctgcagacacggaatgtgaag

SEQ ID NO: 12838 - DNA, 31 bp, Artificial Sequence
  Description of Artificial Sequence: Synthetic oligonucleotide
gtattgggacctgcagacacggaatgtgaag

SEQ ID NO: 12839 - DNA, 31 bp, Artificial Sequence
  Description of Artificial Sequence: Synthetic oligonucleotide
tattgggacctgcagacacggaatgtgaagg

SEQ ID NO: 12840 - DNA, 30 bp, Artificial Sequence
  Description of Artificial Sequence: Synthetic oligonucleotide
attgggacctgcagacacggaatgtgaagg

SEQ ID NO: 12841 - DNA, 29 bp, Artificial Sequence
  Description of Artificial Sequence: Synthetic oligonucleotide
ttgggacctgcagacacggaatgtgaagg

SEQ ID NO: 12842 - DNA, 28 bp, Artificial Sequence
  Description of Artificial Sequence: Synthetic oligonucleotide
tgggacctgcagacacggaatgtgaagg

SEQ ID NO: 12843 - DNA, 27 bp, Artificial Sequence
  Description of Artificial Sequence: Synthetic oligonucleotide
gggacctgcagacacggaatgtgaagg

SEQ ID NO: 12844 - DNA, 27 bp, Artificial Sequence
  Description of Artificial Sequence: Synthetic oligonucleotide
ggacctgcagacacggaatgtgaaggc

SEQ ID NO: 12845 - DNA, 27 bp, Artificial Sequence
  Description of Artificial Sequence: Synthetic oligonucleotide
gacctgcagacacggaatgtgaaggcc

SEQ ID NO: 12846 - DNA, 27 bp, Artificial Sequence
  Description of Artificial Sequence: Synthetic oligonucleotide
acctgcagacacggaatgtgaaggccc

SEQ ID NO: 12847 - DNA, 27 bp, Artificial Sequence
  Description of Artificial Sequence: Synthetic oligonucleotide
cctgcagacacggaatgtgaaggccca

SEQ ID NO: 12848 - DNA, 27 bp, Artificial Sequence
  Description of Artificial Sequence: Synthetic oligonucleotide
ctgcagacacggaatgtgaaggcccag

SEQ ID NO: 12849 - DNA, 28 bp, Artificial Sequence
  Description of Artificial Sequence: Synthetic oligonucleotide
tgcagacacggaatgtgaaggcccagtc

SEQ ID NO: 12850 - DNA, 27 bp, Artificial Sequence
  Description of Artificial Sequence: Synthetic oligonucleotide
gcagacacggaatgtgaaggcccagtc

SEQ ID NO: 12851 - DNA, 28 bp, Artificial Sequence
  Description of Artificial Sequence: Synthetic oligonucleotide
cagacacggaatgtgaaggcccagtcac

SEQ ID NO: 12852 - DNA, 26 bp, Artificial Sequence
  Description of Artificial Sequence: Synthetic oligonucleotide
ggcggacatggcagctcagatcacca

SEQ ID NO: 12853 - DNA, 26 bp, Artificial Sequence
  Description of Artificial Sequence: Synthetic oligonucleotide
gcggacatggcagctcagatcaccag

SEQ ID NO: 12854 - DNA, 26 bp, Artificial Sequence
  Description of Artificial Sequence: Synthetic oligonucleotide
cggacatggcagctcagatcaccagg

SEQ ID NO: 12855 - DNA, 26 bp, Artificial Sequence
  Description of Artificial Sequence: Synthetic oligonucleotide
ggacatggcagctcagatcaccaggc

SEQ ID NO: 12856 - DNA, 26 bp, Artificial Sequence
  Description of Artificial Sequence: Synthetic oligonucleotide
gacatggcagctcagatcaccaggcg

SEQ ID NO: 12857 - DNA, 27 bp, Artificial Sequence
  Description of Artificial Sequence: Synthetic oligonucleotide
acatggcagctcagatcaccaggcgca

SEQ ID NO: 12858 - DNA, 27 bp, Artificial Sequence
  Description of Artificial Sequence: Synthetic oligonucleotide
catggcagctcagatcaccaggcgcaa

SEQ ID NO: 12859 - DNA, 27 bp, Artificial Sequence
  Description of Artificial Sequence: Synthetic oligonucleotide
atggcagctcagatcaccaggcgcaag

SEQ ID NO: 12860 - DNA, 27 bp, Artificial Sequence
  Description of Artificial Sequence: Synthetic oligonucleotide
tggcagctcagatcaccaggcgcaagt

SEQ ID NO: 12861 - DNA, 26 bp, Artificial Sequence
  Description of Artificial Sequence: Synthetic oligonucleotide
ggcagctcagatcaccaggcgcaagt

SEQ ID NO: 12862 - DNA, 26 bp, Artificial Sequence
  Description of Artificial Sequence: Synthetic oligonucleotide
gcagctcagatcaccaggcgcaagtg

SEQ ID NO: 12863 - DNA, 26 bp, Artificial Sequence
  Description of Artificial Sequence: Synthetic oligonucleotide
cagctcagatcaccaggcgcaagtgg

SEQ ID NO: 12864 - DNA, 27 bp, Artificial Sequence
  Description of Artificial Sequence: Synthetic oligonucleotide
agctcagatcaccaggcgcaagtggga

SEQ ID NO: 12865 - DNA, 26 bp, Artificial Sequence
  Description of Artificial Sequence: Synthetic oligonucleotide
gctcagatcaccaggcgcaagtggga

SEQ ID NO: 12866 - DNA, 26 bp, Artificial Sequence
  Description of Artificial Sequence: Synthetic oligonucleotide
ctcagatcaccaggcgcaagtgggag

SEQ ID NO: 12867 - DNA, 26 bp, Artificial Sequence
  Description of Artificial Sequence: Synthetic oligonucleotide
tcagatcaccaggcgcaagtgggagg

SEQ ID NO: 12868 - DNA, 25 bp, Artificial Sequence
  Description of Artificial Sequence: Synthetic oligonucleotide
cagatcaccaggcgcaagtgggagg

SEQ ID NO: 12869 - DNA, 25 bp, Artificial Sequence
  Description of Artificial Sequence: Synthetic oligonucleotide
agatcaccaggcgcaagtgggaggc

SEQ ID NO: 12870 - DNA, 24 bp, Artificial Sequence
  Description of Artificial Sequence: Synthetic oligonucleotide
gatcaccaggcgcaagtgggaggc

SEQ ID NO: 12871 - DNA, 24 bp, Artificial Sequence
  Description of Artificial Sequence: Synthetic oligonucleotide
atcaccaggcgcaagtgggaggcg

SEQ ID NO: 12872 - DNA, 23 bp, Artificial Sequence
  Description of Artificial Sequence: Synthetic oligonucleotide
tcaccaggcgcaagtgggaggcg

SEQ ID NO: 12873 - DNA, 22 bp, Artificial Sequence
  Description of Artificial Sequence: Synthetic oligonucleotide
caccaggcgcaagtgggaggcg

SEQ ID NO: 12874 - DNA, 22 bp, Artificial Sequence
  Description of Artificial Sequence: Synthetic oligonucleotide
accaggcgcaagtgggaggcgg

SEQ ID NO: 12875 - DNA, 21 bp, Artificial Sequence
  Description of Artificial Sequence: Synthetic oligonucleotide
ccaggcgcaagtgggaggcgg

SEQ ID NO: 12876 - DNA, 21 bp, Artificial Sequence
  Description of Artificial Sequence: Synthetic oligonucleotide
caggcgcaagtgggaggcggc

SEQ ID NO: 12877 - DNA, 21 bp, Artificial Sequence
  Description of Artificial Sequence: Synthetic oligonucleotide
aggcgcaagtgggaggcggcc

SEQ ID NO: 12878 - DNA, 20 bp, Artificial Sequence
  Description of Artificial Sequence: Synthetic oligonucleotide
ggcgcaagtgggaggcggcc

SEQ ID NO: 12879 - DNA, 20 bp, Artificial Sequence
  Description of Artificial Sequence: Synthetic oligonucleotide
gcccgtcgggcggagcagca

SEQ ID NO: 12880 - DNA, 21 bp, Artificial Sequence
  Description of Artificial Sequence: Synthetic oligonucleotide
cccgtcgggcggagcagcaga

SEQ ID NO: 12881 - DNA, 22 bp, Artificial Sequence
  Description of Artificial Sequence: Synthetic oligonucleotide
ccgtcgggcggagcagcagaga

SEQ ID NO: 12882 - DNA, 22 bp, Artificial Sequence
  Description of Artificial Sequence: Synthetic oligonucleotide
cgtcgggcggagcagcagagag

SEQ ID NO: 12883 - DNA, 22 bp, Artificial Sequence
  Description of Artificial Sequence: Synthetic oligonucleotide
gtcgggcggagcagcagagagc

SEQ ID NO: 12884 - DNA, 24 bp, Artificial Sequence
  Description of Artificial Sequence: Synthetic oligonucleotide
tcgggcggagcagcagagagccta

SEQ ID NO: 12885 - DNA, 23 bp, Artificial Sequence
  Description of Artificial Sequence: Synthetic oligonucleotide
cgggcggagcagcagagagccta

SEQ ID NO: 12886 - DNA, 23 bp, Artificial Sequence
  Description of Artificial Sequence: Synthetic oligonucleotide
gggcggagcagcagagagcctac

SEQ ID NO: 12887 - DNA, 22 bp, Artificial Sequence
  Description of Artificial Sequence: Synthetic oligonucleotide
cctacctggagggccggtgcct

SEQ ID NO: 12888 - DNA, 22 bp, Artificial Sequence
  Description of Artificial Sequence: Synthetic oligonucleotide
ctacctggagggccggtgcctg

SEQ ID NO: 12889 - DNA, 23 bp, Artificial Sequence
  Description of Artificial Sequence: Synthetic oligonucleotide
tacctggagggccggtgcctgga

SEQ ID NO: 12890 - DNA, 22 bp, Artificial Sequence
  Description of Artificial Sequence: Synthetic oligonucleotide
acctggagggccggtgcctgga

SEQ ID NO: 12891 - DNA, 21 bp, Artificial Sequence
  Description of Artificial Sequence: Synthetic oligonucleotide
cctggagggccggtgcctgga

SEQ ID NO: 12892 - DNA, 22 bp, Artificial Sequence
  Description of Artificial Sequence: Synthetic oligonucleotide
ctggagggccggtgcctggagt

SEQ ID NO: 12893 - DNA, 22 bp, Artificial Sequence
  Description of Artificial Sequence: Synthetic oligonucleotide
tggagggccggtgcctggagtg

SEQ ID NO: 12894 - DNA, 21 bp, Artificial Sequence
  Description of Artificial Sequence: Synthetic oligonucleotide
ggagggccggtgcctggagtg

SEQ ID NO: 12895 - DNA, 21 bp, Artificial Sequence
  Description of Artificial Sequence: Synthetic oligonucleotide
gagggccggtgcctggagtgg

SEQ ID NO: 12896 - DNA, 22 bp, Artificial Sequence
  Description of Artificial Sequence: Synthetic oligonucleotide
agggccggtgcctggagtggct

SEQ ID NO: 12897 - DNA, 21 bp, Artificial Sequence
  Description of Artificial Sequence: Synthetic oligonucleotide
gggccggtgcctggagtggct

SEQ ID NO: 12898 - DNA, 21 bp, Artificial Sequence
  Description of Artificial Sequence: Synthetic oligonucleotide
ggccggtgcctggagtggctc

SEQ ID NO: 12899 - DNA, 21 bp, Artificial Sequence
  Description of Artificial Sequence: Synthetic oligonucleotide
gccggtgcctggagtggctcc

SEQ ID NO: 12900 - DNA, 21 bp, Artificial Sequence
  Description of Artificial Sequence: Synthetic oligonucleotide
ccggtgcctggagtggctccg

SEQ ID NO: 12901 - DNA, 22 bp, Artificial Sequence
  Description of Artificial Sequence: Synthetic oligonucleotide
cggtgcctggagtggctccgca

SEQ ID NO: 12902 - DNA, 25 bp, Artificial Sequence
  Description of Artificial Sequence: Synthetic oligonucleotide
ggtgcctggagtggctccgcagata

SEQ ID NO: 12903 - DNA, 24 bp, Artificial Sequence
  Description of Artificial Sequence: Synthetic oligonucleotide
agcctacctggagggccggtgctt

SEQ ID NO: 12904 - DNA, 23 bp, Artificial Sequence
  Description of Artificial Sequence: Synthetic oligonucleotide
gcctacctggagggccggtgctt

SEQ ID NO: 12905 - DNA, 23 bp, Artificial Sequence
  Description of Artificial Sequence: Synthetic oligonucleotide
cctacctggagggccggtgcttg

SEQ ID NO: 12906 - DNA, 24 bp, Artificial Sequence
  Description of Artificial Sequence: Synthetic oligonucleotide
ctacctggagggccggtgcttgga

SEQ ID NO: 12907 - DNA, 25 bp, Artificial Sequence
  Description of Artificial Sequence: Synthetic oligonucleotide
tacctggagggccggtgcttggagt

SEQ ID NO: 12908 - DNA, 24 bp, Artificial Sequence
  Description of Artificial Sequence: Synthetic oligonucleotide
acctggagggccggtgcttggagt

SEQ ID NO: 12909 - DNA, 23 bp, Artificial Sequence
  Description of Artificial Sequence: Synthetic oligonucleotide
cctggagggccggtgcttggagt

SEQ ID NO: 12910 - DNA, 23 bp, Artificial Sequence
  Description of Artificial Sequence: Synthetic oligonucleotide
ctggagggccggtgcttggagtg

SEQ ID NO: 12911 - DNA, 23 bp, Artificial Sequence
  Description of Artificial Sequence: Synthetic oligonucleotide
tggagggccggtgcttggagtgg

SEQ ID NO: 12912 - DNA, 22 bp, Artificial Sequence
  Description of Artificial Sequence: Synthetic oligonucleotide
ggagggccggtgcttggagtgg

SEQ ID NO: 12913 - DNA, 23 bp, Artificial Sequence
  Description of Artificial Sequence: Synthetic oligonucleotide
gagggccggtgcttggagtggct

SEQ ID NO: 12914 - DNA, 23 bp, Artificial Sequence
  Description of Artificial Sequence: Synthetic oligonucleotide
agggccggtgcttggagtggctc

SEQ ID NO: 12915 - DNA, 22 bp, Artificial Sequence
  Description of Artificial Sequence: Synthetic oligonucleotide
gggccggtgcttggagtggctc

SEQ ID NO: 12916 - DNA, 22 bp, Artificial Sequence
  Description of Artificial Sequence: Synthetic oligonucleotide
ggccggtgcttggagtggctcc

SEQ ID NO: 12917 - DNA, 22 bp, Artificial Sequence
  Description of Artificial Sequence: Synthetic oligonucleotide
gccggtgcttggagtggctccg

SEQ ID NO: 12918 - DNA, 23 bp, Artificial Sequence
  Description of Artificial Sequence: Synthetic oligonucleotide
ccggtgcttggagtggctccgca

SEQ ID NO: 12919 - DNA, 26 bp, Artificial Sequence
  Description of Artificial Sequence: Synthetic oligonucleotide
cggtgcttggagtggctccgcagata

SEQ ID NO: 12920 - DNA, 26 bp, Artificial Sequence
  Description of Artificial Sequence: Synthetic oligonucleotide
ggtgcttggagtggctccgcagatac

SEQ ID NO: 12921 - DNA, 27 bp, Artificial Sequence
  Description of Artificial Sequence: Synthetic oligonucleotide
gtgcttggagtggctccgcagatacct

SEQ ID NO: 12922 - DNA, 27 bp, Artificial Sequence
  Description of Artificial Sequence: Synthetic oligonucleotide
tgcttggagtggctccgcagatacctg

SEQ ID NO: 12923 - DNA, 26 bp, Artificial Sequence
  Description of Artificial Sequence: Synthetic oligonucleotide
gcttggagtggctccgcagatacctg

SEQ ID NO: 12924 - DNA, 27 bp, Artificial Sequence
  Description of Artificial Sequence: Synthetic oligonucleotide
cttggagtggctccgcagatacctgga

SEQ ID NO: 12925 - DNA, 27 bp, Artificial Sequence
  Description of Artificial Sequence: Synthetic oligonucleotide
ttggagtggctccgcagatacctggag

SEQ ID NO: 12926 - DNA, 21 bp, Artificial Sequence
  Description of Artificial Sequence: Synthetic oligonucleotide
gcgcttcctccgcgggtaccc

SEQ ID NO: 12927 - DNA, 21 bp, Artificial Sequence
  Description of Artificial Sequence: Synthetic oligonucleotide
cgcttcctccgcgggtacccg

SEQ ID NO: 12928 - DNA, 22 bp, Artificial Sequence
  Description of Artificial Sequence: Synthetic oligonucleotide
gcttcctccgcgggtacccgca

SEQ ID NO: 12929 - DNA, 22 bp, Artificial Sequence
  Description of Artificial Sequence: Synthetic oligonucleotide
cttcctccgcgggtacccgcag

SEQ ID NO: 12930 - DNA, 23 bp, Artificial Sequence
  Description of Artificial Sequence: Synthetic oligonucleotide
ttcctccgcgggtacccgcagga

SEQ ID NO: 12931 - DNA, 22 bp, Artificial Sequence
  Description of Artificial Sequence: Synthetic oligonucleotide
tcctccgcgggtacccgcagga

SEQ ID NO: 12932 - DNA, 21 bp, Artificial Sequence
  Description of Artificial Sequence: Synthetic oligonucleotide
cctccgcgggtacccgcagga

SEQ ID NO: 12933 - DNA, 21 bp, Artificial Sequence
  Description of Artificial Sequence: Synthetic oligonucleotide
ctccgcgggtacccgcaggac

SEQ ID NO: 12934 - DNA, 21 bp, Artificial Sequence
  Description of Artificial Sequence: Synthetic oligonucleotide
tccgcgggtacccgcaggacg

SEQ ID NO: 12935 - DNA, 20 bp, Artificial Sequence
  Description of Artificial Sequence: Synthetic oligonucleotide
ccgcgggtacccgcaggacg

SEQ ID NO: 12936 - DNA, 20 bp, Artificial Sequence
  Description of Artificial Sequence: Synthetic oligonucleotide
cgcgggtacccgcaggacgc

SEQ ID NO: 12937 - DNA, 22 bp, Artificial Sequence
  Description of Artificial Sequence: Synthetic oligonucleotide
gcgggtacccgcaggacgccta

SEQ ID NO: 12938 - DNA, 22 bp, Artificial Sequence
  Description of Artificial Sequence: Synthetic oligonucleotide
cgggtacccgcaggacgcctac

SEQ ID NO: 12939 - DNA, 23 bp, Artificial Sequence
  Description of Artificial Sequence: Synthetic oligonucleotide
gggtacccgcaggacgcctacga

SEQ ID NO: 12940 - DNA, 23 bp, Artificial Sequence
  Description of Artificial Sequence: Synthetic oligonucleotide
ggtacccgcaggacgcctacgac

SEQ ID NO: 12941 - DNA, 23 bp, Artificial Sequence
  Description of Artificial Sequence: Synthetic oligonucleotide
gtacccgcaggacgcctacgacg

SEQ ID NO: 12942 - DNA, 23 bp, Artificial Sequence
  Description of Artificial Sequence: Synthetic oligonucleotide
tacccgcaggacgcctacgacgg

SEQ ID NO: 12943 - DNA, 22 bp, Artificial Sequence
  Description of Artificial Sequence: Synthetic oligonucleotide
acccgcaggacgcctacgacgg

SEQ ID NO: 12944 - DNA, 21 bp, Artificial Sequence
  Description of Artificial Sequence: Synthetic oligonucleotide
cccgcaggacgcctacgacgg

SEQ ID NO: 12945 - DNA, 23 bp, Artificial Sequence
  Description of Artificial Sequence: Synthetic oligonucleotide
ccgcaggacgcctacgacggcaa

SEQ ID NO: 12946 - DNA, 23 bp, Artificial Sequence
  Description of Artificial Sequence: Synthetic oligonucleotide
cgcaggacgcctacgacggcaag

SEQ ID NO: 12947 - DNA, 23 bp, Artificial Sequence
  Description of Artificial Sequence: Synthetic oligonucleotide
cccatgcggcggagcagcagaca

SEQ ID NO: 12948 - DNA, 23 bp, Artificial Sequence
  Description of Artificial Sequence: Synthetic oligonucleotide
ccatgcggcggagcagcagacag

SEQ ID NO: 12949 - DNA, 23 bp, Artificial Sequence
  Description of Artificial Sequence: Synthetic oligonucleotide
catgcggcggagcagcagacagc

SEQ ID NO: 12950 - DNA, 25 bp, Artificial Sequence
  Description of Artificial Sequence: Synthetic oligonucleotide
atgcggcggagcagcagacagccta

SEQ ID NO: 12951 - DNA, 24 bp, Artificial Sequence
  Description of Artificial Sequence: Synthetic oligonucleotide
tgcggcggagcagcagacagccta

SEQ ID NO: 12952 - DNA, 23 bp, Artificial Sequence
  Description of Artificial Sequence: Synthetic oligonucleotide
gcggcggagcagcagacagccta

SEQ ID NO: 12953 - DNA, 23 bp, Artificial Sequence
  Description of Artificial Sequence: Synthetic oligonucleotide
cggcggagcagcagacagcctac

SEQ ID NO: 12954 - DNA, 24 bp, Artificial Sequence
  Description of Artificial Sequence: Synthetic oligonucleotide
ggcggagcagcagacagcctacct

SEQ ID NO: 12955 - DNA, 24 bp, Artificial Sequence
  Description of Artificial Sequence: Synthetic oligonucleotide
gcggagcagcagacagcctacctg

SEQ ID NO: 12956 - DNA, 25 bp, Artificial Sequence
  Description of Artificial Sequence: Synthetic oligonucleotide
cggagcagcagacagcctacctgga

SEQ ID NO: 12957 - DNA, 25 bp, Artificial Sequence
  Description of Artificial Sequence: Synthetic oligonucleotide
ggagcagcagacagcctacctggag

SEQ ID NO: 12958 - DNA, 25 bp, Artificial Sequence
  Description of Artificial Sequence: Synthetic oligonucleotide
gagcagcagacagcctacctggagg

SEQ ID NO: 12959 - DNA, 25 bp, Artificial Sequence
  Description of Artificial Sequence: Synthetic oligonucleotide
agcagcagacagcctacctggaggg

SEQ ID NO: 12960 - DNA, 24 bp, Artificial Sequence
  Description of Artificial Sequence: Synthetic oligonucleotide
gcagcagacagcctacctggaggg

SEQ ID NO: 12961 - DNA, 24 bp, Artificial Sequence
  Description of Artificial Sequence: Synthetic oligonucleotide
cagcagacagcctacctggagggc

SEQ ID NO: 12962 - DNA, 24 bp, Artificial Sequence
  Description of Artificial Sequence: Synthetic oligonucleotide
agcagacagcctacctggagggcc

SEQ ID NO: 12963 - DNA, 23 bp, Artificial Sequence
  Description of Artificial Sequence: Synthetic oligonucleotide
gcagacagcctacctggagggcc

SEQ ID NO: 12964 - DNA, 23 bp, Artificial Sequence
  Description of Artificial Sequence: Synthetic oligonucleotide
cagacagcctacctggagggccg

SEQ ID NO: 12965 - DNA, 24 bp, Artificial Sequence
  Description of Artificial Sequence: Synthetic oligonucleotide
agacagcctacctggagggccggt

SEQ ID NO: 12966 - DNA, 23 bp, Artificial Sequence
  Description of Artificial Sequence: Synthetic oligonucleotide
gacagcctacctggagggccggt

SEQ ID NO: 12967 - DNA, 23 bp, Artificial Sequence
  Description of Artificial Sequence: Synthetic oligonucleotide
acagcctacctggagggccggtg

SEQ ID NO: 12968 - DNA, 22 bp, Artificial Sequence
  Description of Artificial Sequence: Synthetic oligonucleotide
cagcctacctggagggccggtg

SEQ ID NO: 12969 - DNA, 21 bp, Artificial Sequence
  Description of Artificial Sequence: Synthetic oligonucleotide
ggcccatgcggcggagcagct

SEQ ID NO: 12970 - DNA, 22 bp, Artificial Sequence
  Description of Artificial Sequence: Synthetic oligonucleotide
gcccatgcggcggagcagctga

SEQ ID NO: 12971 - DNA, 23 bp, Artificial Sequence
  Description of Artificial Sequence: Synthetic oligonucleotide
cccatgcggcggagcagctgaga

SEQ ID NO: 12972 - DNA, 23 bp, Artificial Sequence
  Description of Artificial Sequence: Synthetic oligonucleotide
ccatgcggcggagcagctgagag

SEQ ID NO: 12973 - DNA, 23 bp, Artificial Sequence
  Description of Artificial Sequence: Synthetic oligonucleotide
catgcggcggagcagctgagagc

SEQ ID NO: 12974 - DNA, 25 bp, Artificial Sequence
  Description of Artificial Sequence: Synthetic oligonucleotide
atgcggcggagcagctgagagccta

SEQ ID NO: 12975 - DNA, 24 bp, Artificial Sequence
  Description of Artificial Sequence: Synthetic oligonucleotide
tgcggcggagcagctgagagccta

SEQ ID NO: 12976 - DNA, 23 bp, Artificial Sequence
  Description of Artificial Sequence: Synthetic oligonucleotide
gcggcggagcagctgagagccta

SEQ ID NO: 12977 - DNA, 23 bp, Artificial Sequence
  Description of Artificial Sequence: Synthetic oligonucleotide
cggcggagcagctgagagcctac

SEQ ID NO: 12978 - DNA, 24 bp, Artificial Sequence
  Description of Artificial Sequence: Synthetic oligonucleotide
cagctgagagcctacctggagggc

SEQ ID NO: 12979 - DNA, 24 bp, Artificial Sequence
  Description of Artificial Sequence: Synthetic oligonucleotide
agctgagagcctacctggagggcc

SEQ ID NO: 12980 - DNA, 23 bp, Artificial Sequence
  Description of Artificial Sequence: Synthetic oligonucleotide
gctgagagcctacctggagggcc

SEQ ID NO: 12981 - DNA, 23 bp, Artificial Sequence
  Description of Artificial Sequence: Synthetic oligonucleotide
ctgagagcctacctggagggccg

SEQ ID NO: 12982 - DNA, 22 bp, Artificial Sequence
  Description of Artificial Sequence: Synthetic oligonucleotide
cggcccatgcggcggagcagtt

SEQ ID NO: 12983 - DNA, 23 bp, Artificial Sequence
  Description of Artificial Sequence: Synthetic oligonucleotide
ggcccatgcggcggagcagttga

SEQ ID NO: 12984 - DNA, 24 bp, Artificial Sequence
  Description of Artificial Sequence: Synthetic oligonucleotide
gcccatgcggcggagcagttgaga

SEQ ID NO: 12985 - DNA, 24 bp, Artificial Sequence
  Description of Artificial Sequence: Synthetic oligonucleotide
cccatgcggcggagcagttgagag

SEQ ID NO: 12986 - DNA, 26 bp, Artificial Sequence
  Description of Artificial Sequence: Synthetic oligonucleotide
tgcgtggagtggctccgcagatacca

SEQ ID NO: 12987 - DNA, 25 bp, Artificial Sequence
  Description of Artificial Sequence: Synthetic oligonucleotide
gcgtggagtggctccgcagatacca

SEQ ID NO: 12988 - DNA, 25 bp, Artificial Sequence
  Description of Artificial Sequence: Synthetic oligonucleotide
cgtggagtggctccgcagataccag

SEQ ID NO: 12989 - DNA, 26 bp, Artificial Sequence
  Description of Artificial Sequence: Synthetic oligonucleotide
gtggagtggctccgcagataccagga

SEQ ID NO: 12990 - DNA, 27 bp, Artificial Sequence
  Description of Artificial Sequence: Synthetic oligonucleotide
tggagtggctccgcagataccaggaga

SEQ ID NO: 12991 - DNA, 27 bp, Artificial Sequence
  Description of Artificial Sequence: Synthetic oligonucleotide
ggagtggctccgcagataccaggagaa

SEQ ID NO: 12992 - DNA, 27 bp, Artificial Sequence
  Description of Artificial Sequence: Synthetic oligonucleotide
gagtggctccgcagataccaggagaac

SEQ ID NO: 12993 - DNA, 27 bp, Artificial Sequence
  Description of Artificial Sequence: Synthetic oligonucleotide
agtggctccgcagataccaggagaacg

SEQ ID NO: 12994 - DNA, 26 bp, Artificial Sequence
  Description of Artificial Sequence: Synthetic oligonucleotide
gtggctccgcagataccaggagaacg

SEQ ID NO: 12995 - DNA, 26 bp, Artificial Sequence
  Description of Artificial Sequence: Synthetic oligonucleotide
tggctccgcagataccaggagaacgg

SEQ ID NO: 12996 - DNA, 25 bp, Artificial Sequence
  Description of Artificial Sequence: Synthetic oligonucleotide
ggctccgcagataccaggagaacgg

SEQ ID NO: 12997 - DNA, 27 bp, Artificial Sequence
  Description of Artificial Sequence: Synthetic oligonucleotide
gctccgcagataccaggagaacgggaa

SEQ ID NO: 12998 - DNA, 27 bp, Artificial Sequence
  Description of Artificial Sequence: Synthetic oligonucleotide
ctccgcagataccaggagaacgggaag

SEQ ID NO: 12999 - DNA, 27 bp, Artificial Sequence
  Description of Artificial Sequence: Synthetic oligonucleotide
tccgcagataccaggagaacgggaagg

SEQ ID NO: 13000 - DNA, 27 bp, Artificial Sequence
  Description of Artificial Sequence: Synthetic oligonucleotide
ccgcagataccaggagaacgggaagga

SEQ ID NO: 13001 - DNA, 27 bp, Artificial Sequence
  Description of Artificial Sequence: Synthetic oligonucleotide
cgcagataccaggagaacgggaaggag

SEQ ID NO: 13002 - DNA, 28 bp, Artificial Sequence
  Description of Artificial Sequence: Synthetic oligonucleotide
gcagataccaggagaacgggaaggagac

SEQ ID NO: 13003 - DNA, 28 bp, Artificial Sequence
  Description of Artificial Sequence: Synthetic oligonucleotide
cagataccaggagaacgggaaggagacg

SEQ ID NO: 13004 - DNA, 28 bp, Artificial Sequence
  Description of Artificial Sequence: Synthetic oligonucleotide
agataccaggagaacgggaaggagacgc

SEQ ID NO: 13005 - DNA, 27 bp, Artificial Sequence
  Description of Artificial Sequence: Synthetic oligonucleotide
gataccaggagaacgggaaggagacgc

SEQ ID NO: 13006 - DNA, 28 bp, Artificial Sequence
  Description of Artificial Sequence: Synthetic oligonucleotide
ataccaggagaacgggaaggagacgctg

SEQ ID NO: 13007 - DNA, 27 bp, Artificial Sequence
  Description of Artificial Sequence: Synthetic oligonucleotide
taccaggagaacgggaaggagacgctg

SEQ ID NO: 13008 - DNA, 26 bp, Artificial Sequence
  Description of Artificial Sequence: Synthetic oligonucleotide
accaggagaacgggaaggagacgctg

SEQ ID NO: 13009 - DNA, 25 bp, Artificial Sequence
  Description of Artificial Sequence: Synthetic oligonucleotide
ccaggagaacgggaaggagacgctg

SEQ ID NO: 13010 - DNA, 26 bp, Artificial Sequence
  Description of Artificial Sequence: Synthetic oligonucleotide
caggagaacgggaaggagacgctgca

SEQ ID NO: 13011 - DNA, 26 bp, Artificial Sequence
  Description of Artificial Sequence: Synthetic oligonucleotide
aggagaacgggaaggagacgctgcag

SEQ ID NO: 13012 - DNA, 22 bp, Artificial Sequence
  Description of Artificial Sequence: Synthetic oligonucleotide
aaggagacgctgcagcgcgcgg

SEQ ID NO: 13013 - DNA, 24 bp, Artificial Sequence
  Description of Artificial Sequence: Synthetic oligonucleotide
agcctacctggagggccggtgcat

SEQ ID NO: 13014 - DNA, 23 bp, Artificial Sequence
  Description of Artificial Sequence: Synthetic oligonucleotide
gcctacctggagggccggtgcat

SEQ ID NO: 13015 - DNA, 23 bp, Artificial Sequence
  Description of Artificial Sequence: Synthetic oligonucleotide
cctacctggagggccggtgcatg

SEQ ID NO: 13016 - DNA, 24 bp, Artificial Sequence
  Description of Artificial Sequence: Synthetic oligonucleotide
ctacctggagggccggtgcatgga

SEQ ID NO: 13017 - DNA, 25 bp, Artificial Sequence
  Description of Artificial Sequence: Synthetic oligonucleotide
tacctggagggccggtgcatggagt

SEQ ID NO: 13018 - DNA, 24 bp, Artificial Sequence
  Description of Artificial Sequence: Synthetic oligonucleotide
acctggagggccggtgcatggagt

SEQ ID NO: 13019 - DNA, 23 bp, Artificial Sequence
  Description of Artificial Sequence: Synthetic oligonucleotide
cctggagggccggtgcatggagt

SEQ ID NO: 13020 - DNA, 23 bp, Artificial Sequence
  Description of Artificial Sequence: Synthetic oligonucleotide
ctggagggccggtgcatggagtg

SEQ ID NO: 13021 - DNA, 23 bp, Artificial Sequence
  Description of Artificial Sequence: Synthetic oligonucleotide
tggagggccggtgcatggagtgg

SEQ ID NO: 13022 - DNA, 22 bp, Artificial Sequence
  Description of Artificial Sequence: Synthetic oligonucleotide
ggagggccggtgcatggagtgg

SEQ ID NO: 13023 - DNA, 23 bp, Artificial Sequence
  Description of Artificial Sequence: Synthetic oligonucleotide
gagggccggtgcatggagtggct

SEQ ID NO: 13024 - DNA, 23 bp, Artificial Sequence
  Description of Artificial Sequence: Synthetic oligonucleotide
agggccggtgcatggagtggctc

SEQ ID NO: 13025 - DNA, 22 bp, Artificial Sequence
  Description of Artificial Sequence: Synthetic oligonucleotide
gggccggtgcatggagtggctc

SEQ ID NO: 13026 - DNA, 22 bp, Artificial Sequence
  Description of Artificial Sequence: Synthetic oligonucleotide
ggccggtgcatggagtggctcc

SEQ ID NO: 13027 - DNA, 22 bp, Artificial Sequence
  Description of Artificial Sequence: Synthetic oligonucleotide
gccggtgcatggagtggctccg

SEQ ID NO: 13028 - DNA, 23 bp, Artificial Sequence
  Description of Artificial Sequence: Synthetic oligonucleotide
ccggtgcatggagtggctccgca

SEQ ID NO: 13029 - DNA, 26 bp, Artificial Sequence
  Description of Artificial Sequence: Synthetic oligonucleotide
cggtgcatggagtggctccgcagata

SEQ ID NO: 13030 - DNA, 26 bp, Artificial Sequence
  Description of Artificial Sequence: Synthetic oligonucleotide
ggtgcatggagtggctccgcagatac

SEQ ID NO: 13031 - DNA, 32 bp, Artificial Sequence
  Description of Artificial Sequence: Synthetic oligonucleotide
gaggacggttctcacaccatccagataatgtg

SEQ ID NO: 13032 - DNA, 33 bp, Artificial Sequence
  Description of Artificial Sequence: Synthetic oligonucleotide
aggacggttctcacaccatccagataatgtgtg

SEQ ID NO: 13033 - DNA, 32 bp, Artificial Sequence
  Description of Artificial Sequence: Synthetic oligonucleotide
ggacggttctcacaccatccagataatgtgtg

SEQ ID NO: 13034 - DNA, 32 bp, Artificial Sequence
  Description of Artificial Sequence: Synthetic oligonucleotide
gacggttctcacaccatccagataatgtgtgg

SEQ ID NO: 13035 - DNA, 32 bp, Artificial Sequence
  Description of Artificial Sequence: Synthetic oligonucleotide
acggttctcacaccatccagataatgtgtggc

SEQ ID NO: 13036 - DNA, 31 bp, Artificial Sequence
  Description of Artificial Sequence: Synthetic oligonucleotide
cggttctcacaccatccagataatgtgtggc

SEQ ID NO: 13037 - DNA, 32 bp, Artificial Sequence
  Description of Artificial Sequence: Synthetic oligonucleotide
ggttctcacaccatccagataatgtgtggctg

SEQ ID NO: 13038 - DNA, 32 bp, Artificial Sequence
  Description of Artificial Sequence: Synthetic oligonucleotide
gttctcacaccatccagataatgtgtggctgc

SEQ ID NO: 13039 - DNA, 32 bp, Artificial Sequence
  Description of Artificial Sequence: Synthetic oligonucleotide
ttctcacaccatccagataatgtgtggctgcg

SEQ ID NO: 13040 - DNA, 31 bp, Artificial Sequence
  Description of Artificial Sequence: Synthetic oligonucleotide
tctcacaccatccagataatgtgtggctgcg

SEQ ID NO: 13041 - DNA, 30 bp, Artificial Sequence
  Description of Artificial Sequence: Synthetic oligonucleotide
ctcacaccatccagataatgtgtggctgcg

SEQ ID NO: 13042 - DNA, 31 bp, Artificial Sequence
  Description of Artificial Sequence: Synthetic oligonucleotide
tcacaccatccagataatgtgtggctgcgac

SEQ ID NO: 13043 - DNA, 30 bp, Artificial Sequence
  Description of Artificial Sequence: Synthetic oligonucleotide
cacaccatccagataatgtgtggctgcgac

SEQ ID NO: 13044 - DNA, 30 bp, Artificial Sequence
  Description of Artificial Sequence: Synthetic oligonucleotide
acaccatccagataatgtgtggctgcgacg

SEQ ID NO: 13045 - DNA, 29 bp, Artificial Sequence
  Description of Artificial Sequence: Synthetic oligonucleotide
caccatccagataatgtgtggctgcgacg

SEQ ID NO: 13046 - DNA, 30 bp, Artificial Sequence
  Description of Artificial Sequence: Synthetic oligonucleotide
accatccagataatgtgtggctgcgacgtg

SEQ ID NO: 13047 - DNA, 29 bp, Artificial Sequence
  Description of Artificial Sequence: Synthetic oligonucleotide
ccatccagataatgtgtggctgcgacgtg

SEQ ID NO: 13048 - DNA, 29 bp, Artificial Sequence
  Description of Artificial Sequence: Synthetic oligonucleotide
catccagataatgtgtggctgcgacgtgg

SEQ ID NO: 13049 - DNA, 29 bp, Artificial Sequence
  Description of Artificial Sequence: Synthetic oligonucleotide
atccagataatgtgtggctgcgacgtggg

SEQ ID NO: 13050 - DNA, 28 bp, Artificial Sequence
  Description of Artificial Sequence: Synthetic oligonucleotide
tccagataatgtgtggctgcgacgtggg

SEQ ID NO: 13051 - DNA, 27 bp, Artificial Sequence
  Description of Artificial Sequence: Synthetic oligonucleotide
ccagataatgtgtggctgcgacgtggg

SEQ ID NO: 13052 - DNA, 27 bp, Artificial Sequence
  Description of Artificial Sequence: Synthetic oligonucleotide
cagataatgtgtggctgcgacgtgggg

SEQ ID NO: 13053 - DNA, 27 bp, Artificial Sequence
  Description of Artificial Sequence: Synthetic oligonucleotide
agataatgtgtggctgcgacgtggggc

SEQ ID NO: 13054 - DNA, 26 bp, Artificial Sequence
  Description of Artificial Sequence: Synthetic oligonucleotide
gataatgtgtggctgcgacgtggggc

SEQ ID NO: 13055 - DNA, 26 bp, Artificial Sequence
  Description of Artificial Sequence: Synthetic oligonucleotide
ataatgtgtggctgcgacgtggggcc

SEQ ID NO: 13056 - DNA, 25 bp, Artificial Sequence
  Description of Artificial Sequence: Synthetic oligonucleotide
taatgtgtggctgcgacgtggggcc

SEQ ID NO: 13057 - DNA, 24 bp, Artificial Sequence
  Description of Artificial Sequence: Synthetic oligonucleotide
aatgtgtggctgcgacgtggggcc

SEQ ID NO: 13058 - DNA, 23 bp, Artificial Sequence
  Description of Artificial Sequence: Synthetic oligonucleotide
atgtgtggctgcgacgtggggcc

SEQ ID NO: 13059 - DNA, 22 bp, Artificial Sequence
  Description of Artificial Sequence: Synthetic oligonucleotide
tgtgtggctgcgacgtggggcc

SEQ ID NO: 13060 - DNA, 21 bp, Artificial Sequence
  Description of Artificial Sequence: Synthetic oligonucleotide
gtgtggctgcgacgtggggcc

SEQ ID NO: 13061 - DNA, 21 bp, Artificial Sequence
  Description of Artificial Sequence: Synthetic oligonucleotide
tgtggctgcgacgtggggccg

SEQ ID NO: 13062 - DNA, 20 bp, Artificial Sequence
  Description of Artificial Sequence: Synthetic oligonucleotide
gtggctgcgacgtggggccg

SEQ ID NO: 13063 - DNA, 23 bp, Artificial Sequence
  Description of Artificial Sequence: Synthetic oligonucleotide
cgcgagccagaggatggagccgt

SEQ ID NO: 13064 - DNA, 23 bp, Artificial Sequence
  Description of Artificial Sequence: Synthetic oligonucleotide
gcgagccagaggatggagccgtg

SEQ ID NO: 13065 - DNA, 23 bp, Artificial Sequence
  Description of Artificial Sequence: Synthetic oligonucleotide
cgagccagaggatggagccgtgg

SEQ ID NO: 13066 - DNA, 23 bp, Artificial Sequence
  Description of Artificial Sequence: Synthetic oligonucleotide
gagccagaggatggagccgtggg

SEQ ID NO: 13067 - DNA, 23 bp, Artificial Sequence
  Description of Artificial Sequence: Synthetic oligonucleotide
agccagaggatggagccgtgggc

SEQ ID NO: 13068 - DNA, 22 bp, Artificial Sequence
  Description of Artificial Sequence: Synthetic oligonucleotide
gccagaggatggagccgtgggc

SEQ ID NO: 13069 - DNA, 22 bp, Artificial Sequence
  Description of Artificial Sequence: Synthetic oligonucleotide
ccagaggatggagccgtgggcg

SEQ ID NO: 13070 - DNA, 22 bp, Artificial Sequence
  Description of Artificial Sequence: Synthetic oligonucleotide
cagaggatggagccgtgggcgc

SEQ ID NO: 13071 - DNA, 22 bp, Artificial Sequence
  Description of Artificial Sequence: Synthetic oligonucleotide
agaggatggagccgtgggcgcc

SEQ ID NO: 13072 - DNA, 21 bp, Artificial Sequence
  Description of Artificial Sequence: Synthetic oligonucleotide
gaggatggagccgtgggcgcc

SEQ ID NO: 13073 - DNA, 22 bp, Artificial Sequence
  Description of Artificial Sequence: Synthetic oligonucleotide
aggatggagccgtgggcgccgt

SEQ ID NO: 13074 - DNA, 21 bp, Artificial Sequence
  Description of Artificial Sequence: Synthetic oligonucleotide
ggatggagccgtgggcgccgt

SEQ ID NO: 13075 - DNA, 21 bp, Artificial Sequence
  Description of Artificial Sequence: Synthetic oligonucleotide
gatggagccgtgggcgccgtg

SEQ ID NO: 13076 - DNA, 24 bp, Artificial Sequence
  Description of Artificial Sequence: Synthetic oligonucleotide
atggagccgtgggcgccgtggata

SEQ ID NO: 13077 - DNA, 23 bp, Artificial Sequence
  Description of Artificial Sequence: Synthetic oligonucleotide
tggagccgtgggcgccgtggata

SEQ ID NO: 13078 - DNA, 22 bp, Artificial Sequence
  Description of Artificial Sequence: Synthetic oligonucleotide
ggagccgtgggcgccgtggata

SEQ ID NO: 13079 - DNA, 23 bp, Artificial Sequence
  Description of Artificial Sequence: Synthetic oligonucleotide
gagccgtgggcgccgtggataga

SEQ ID NO: 13080 - DNA, 23 bp, Artificial Sequence
  Description of Artificial Sequence: Synthetic oligonucleotide
agccgtgggcgccgtggatagag

SEQ ID NO: 13081 - DNA, 22 bp, Artificial Sequence
  Description of Artificial Sequence: Synthetic oligonucleotide
gccgtgggcgccgtggatagag

SEQ ID NO: 13082 - DNA, 23 bp, Artificial Sequence
  Description of Artificial Sequence: Synthetic oligonucleotide
ccgtgggcgccgtggatagagca

SEQ ID NO: 13083 - DNA, 23 bp, Artificial Sequence
  Description of Artificial Sequence: Synthetic oligonucleotide
cgtgggcgccgtggatagagcag

SEQ ID NO: 13084 - DNA, 24 bp, Artificial Sequence
  Description of Artificial Sequence: Synthetic oligonucleotide
gtgggcgccgtggatagagcagga

SEQ ID NO: 13085 - DNA, 24 bp, Artificial Sequence
  Description of Artificial Sequence: Synthetic oligonucleotide
tgggcgccgtggatagagcaggag

SEQ ID NO: 13086 - DNA, 23 bp, Artificial Sequence
  Description of Artificial Sequence: Synthetic oligonucleotide
gtaccggcaggacgcctacgacc

SEQ ID NO: 13087 - DNA, 23 bp, Artificial Sequence
  Description of Artificial Sequence: Synthetic oligonucleotide
taccggcaggacgcctacgaccg

SEQ ID NO: 13088 - DNA, 22 bp, Artificial Sequence
  Description of Artificial Sequence: Synthetic oligonucleotide
accggcaggacgcctacgaccg

SEQ ID NO: 13089 - DNA, 21 bp, Artificial Sequence
  Description of Artificial Sequence: Synthetic oligonucleotide
ccggcaggacgcctacgaccg

SEQ ID NO: 13090 - DNA, 23 bp, Artificial Sequence
  Description of Artificial Sequence: Synthetic oligonucleotide
cggcaggacgcctacgaccgcaa

SEQ ID NO: 13091 - DNA, 23 bp, Artificial Sequence
  Description of Artificial Sequence: Synthetic oligonucleotide
ggcaggacgcctacgaccgcaag

SEQ ID NO: 13092 - DNA, 27 bp, Artificial Sequence
  Description of Artificial Sequence: Synthetic oligonucleotide
gcaggacgcctacgaccgcaaggatta

SEQ ID NO: 13093 - DNA, 27 bp, Artificial Sequence
  Description of Artificial Sequence: Synthetic oligonucleotide
caggacgcctacgaccgcaaggattac

SEQ ID NO: 13094 - DNA, 29 bp, Artificial Sequence
  Description of Artificial Sequence: Synthetic oligonucleotide
aggacgcctacgaccgcaaggattacatc

SEQ ID NO: 13095 - DNA, 28 bp, Artificial Sequence
  Description of Artificial Sequence: Synthetic oligonucleotide
ggacgcctacgaccgcaaggattacatc

SEQ ID NO: 13096 - DNA, 28 bp, Artificial Sequence
  Description of Artificial Sequence: Synthetic oligonucleotide
gacgcctacgaccgcaaggattacatcg

SEQ ID NO: 13097 - DNA, 28 bp, Artificial Sequence
  Description of Artificial Sequence: Synthetic oligonucleotide
acgcctacgaccgcaaggattacatcgc

SEQ ID NO: 13098 - DNA, 27 bp, Artificial Sequence
  Description of Artificial Sequence: Synthetic oligonucleotide
cgcctacgaccgcaaggattacatcgc

SEQ ID NO: 13099 - DNA, 27 bp, Artificial Sequence
  Description of Artificial Sequence: Synthetic oligonucleotide
gcctacgaccgcaaggattacatcgcc

SEQ ID NO: 13100 - DNA, 27 bp, Artificial Sequence
  Description of Artificial Sequence: Synthetic oligonucleotide
cctacgaccgcaaggattacatcgccc

SEQ ID NO: 13101 - DNA, 28 bp, Artificial Sequence
  Description of Artificial Sequence: Synthetic oligonucleotide
ctacgaccgcaaggattacatcgccctg

SEQ ID NO: 13102 - DNA, 30 bp, Artificial Sequence
  Description of Artificial Sequence: Synthetic oligonucleotide
tacgaccgcaaggattacatcgccctgaac

SEQ ID NO: 13103 - DNA, 29 bp, Artificial Sequence
  Description of Artificial Sequence: Synthetic oligonucleotide
acgaccgcaaggattacatcgccctgaac

SEQ ID NO: 13104 - DNA, 28 bp, Artificial Sequence
  Description of Artificial Sequence: Synthetic oligonucleotide
cgaccgcaaggattacatcgccctgaac

SEQ ID NO: 13105 - DNA, 28 bp, Artificial Sequence
  Description of Artificial Sequence: Synthetic oligonucleotide
gaccgcaaggattacatcgccctgaacg

SEQ ID NO: 13106 - DNA, 29 bp, Artificial Sequence
  Description of Artificial Sequence: Synthetic oligonucleotide
accgcaaggattacatcgccctgaacgag

SEQ ID NO: 13107 - DNA, 28 bp, Artificial Sequence
  Description of Artificial Sequence: Synthetic oligonucleotide
ccgcaaggattacatcgccctgaacgag

SEQ ID NO: 13108 - DNA, 28 bp, Artificial Sequence
  Description of Artificial Sequence: Synthetic oligonucleotide
cgcaaggattacatcgccctgaacgagg

SEQ ID NO: 13109 - DNA, 23 bp, Artificial Sequence
  Description of Artificial Sequence: Synthetic oligonucleotide
cgggcgccgtggatagagcaggt

SEQ ID NO: 13110 - DNA, 23 bp, Artificial Sequence
  Description of Artificial Sequence: Synthetic oligonucleotide
gggcgccgtggatagagcaggtg

SEQ ID NO: 13111 - DNA, 23 bp, Artificial Sequence
  Description of Artificial Sequence: Synthetic oligonucleotide
ggcgccgtggatagagcaggtgg

SEQ ID NO: 13112 - DNA, 23 bp, Artificial Sequence
  Description of Artificial Sequence: Synthetic oligonucleotide
gcgccgtggatagagcaggtggg

SEQ ID NO: 13113 - DNA, 23 bp, Artificial Sequence
  Description of Artificial Sequence: Synthetic oligonucleotide
cgccgtggatagagcaggtgggg

SEQ ID NO: 13114 - DNA, 23 bp, Artificial Sequence
  Description of Artificial Sequence: Synthetic oligonucleotide
gccgtggatagagcaggtggggc

SEQ ID NO: 13115 - DNA, 23 bp, Artificial Sequence
  Description of Artificial Sequence: Synthetic oligonucleotide
ccgtggatagagcaggtggggcc

SEQ ID NO: 13116 - DNA, 23 bp, Artificial Sequence
  Description of Artificial Sequence: Synthetic oligonucleotide
cgtggatagagcaggtggggccg

SEQ ID NO: 13117 - DNA, 24 bp, Artificial Sequence
  Description of Artificial Sequence: Synthetic oligonucleotide
gtggatagagcaggtggggccgga

SEQ ID NO: 13118 - DNA, 27 bp, Artificial Sequence
  Description of Artificial Sequence: Synthetic oligonucleotide
tggatagagcaggtggggccggagtat

SEQ ID NO: 13119 - DNA, 27 bp, Artificial Sequence
  Description of Artificial Sequence: Synthetic oligonucleotide
ggatagagcaggtggggccggagtatt

SEQ ID NO: 13120 - DNA, 27 bp, Artificial Sequence
  Description of Artificial Sequence: Synthetic oligonucleotide
gatagagcaggtggggccggagtattg

SEQ ID NO: 13121 - DNA, 27 bp, Artificial Sequence
  Description of Artificial Sequence: Synthetic oligonucleotide
atagagcaggtggggccggagtattgg

SEQ ID NO: 13122 - DNA, 26 bp, Artificial Sequence
  Description of Artificial Sequence: Synthetic oligonucleotide
tagagcaggtggggccggagtattgg

SEQ ID NO: 13123 - DNA, 25 bp, Artificial Sequence
  Description of Artificial Sequence: Synthetic oligonucleotide
agagcaggtggggccggagtattgg

SEQ ID NO: 13124 - DNA, 24 bp, Artificial Sequence
  Description of Artificial Sequence: Synthetic oligonucleotide
gagcaggtggggccggagtattgg

SEQ ID NO: 13125 - DNA, 25 bp, Artificial Sequence
  Description of Artificial Sequence: Synthetic oligonucleotide
agcaggtggggccggagtattggga

SEQ ID NO: 13126 - DNA, 24 bp, Artificial Sequence
  Description of Artificial Sequence: Synthetic oligonucleotide
gcaggtggggccggagtattggga

SEQ ID NO: 13127 - DNA, 24 bp, Artificial Sequence
  Description of Artificial Sequence: Synthetic oligonucleotide
caggtggggccggagtattgggac

SEQ ID NO: 13128 - DNA, 25 bp, Artificial Sequence
  Description of Artificial Sequence: Synthetic oligonucleotide
aggtggggccggagtattgggacca

SEQ ID NO: 13129 - DNA, 24 bp, Artificial Sequence
  Description of Artificial Sequence: Synthetic oligonucleotide
ggtggggccggagtattgggacca

SEQ ID NO: 13130 - DNA, 24 bp, Artificial Sequence
  Description of Artificial Sequence: Synthetic oligonucleotide
gtggggccggagtattgggaccag

SEQ ID NO: 13131 - DNA, 25 bp, Artificial Sequence
  Description of Artificial Sequence: Synthetic oligonucleotide
tggggccggagtattgggaccagga

SEQ ID NO: 13132 - DNA, 31 bp, Artificial Sequence
  Description of Artificial Sequence: Synthetic oligonucleotide
gctcccactccatgaggtatttcaccacatc

SEQ ID NO: 13133 - DNA, 31 bp, Artificial Sequence
  Description of Artificial Sequence: Synthetic oligonucleotide
ctcccactccatgaggtatttcaccacatcc

SEQ ID NO: 13134 - DNA, 31 bp, Artificial Sequence
  Description of Artificial Sequence: Synthetic oligonucleotide
tcccactccatgaggtatttcaccacatccg

SEQ ID NO: 13135 - DNA, 30 bp, Artificial Sequence
  Description of Artificial Sequence: Synthetic oligonucleotide
cccactccatgaggtatttcaccacatccg

SEQ ID NO: 13136 - DNA, 31 bp, Artificial Sequence
  Description of Artificial Sequence: Synthetic oligonucleotide
ccactccatgaggtatttcaccacatccgtg

SEQ ID NO: 13137 - DNA, 22 bp, Artificial Sequence
  Description of Artificial Sequence: Synthetic oligonucleotide
catgcggcggagcagcggagag

SEQ ID NO: 13138 - DNA, 22 bp, Artificial Sequence
  Description of Artificial Sequence: Synthetic oligonucleotide
atgcggcggagcagcggagagc

SEQ ID NO: 13139 - DNA, 21 bp, Artificial Sequence
  Description of Artificial Sequence: Synthetic oligonucleotide
tgcggcggagcagcggagagc

SEQ ID NO: 13140 - DNA, 20 bp, Artificial Sequence
  Description of Artificial Sequence: Synthetic oligonucleotide
gcggcggagcagcggagagc

SEQ ID NO: 13141 - DNA, 22 bp, Artificial Sequence
  Description of Artificial Sequence: Synthetic oligonucleotide
cggcggagcagcggagagccta

SEQ ID NO: 13142 - DNA, 24 bp, Artificial Sequence
  Description of Artificial Sequence: Synthetic oligonucleotide
gcccagtcacagactgaccgagcg

SEQ ID NO: 13143 - DNA, 25 bp, Artificial Sequence
  Description of Artificial Sequence: Synthetic oligonucleotide
cccagtcacagactgaccgagcgga

SEQ ID NO: 13144 - DNA, 25 bp, Artificial Sequence
  Description of Artificial Sequence: Synthetic oligonucleotide
ccagtcacagactgaccgagcggac

SEQ ID NO: 13145 - DNA, 26 bp, Artificial Sequence
  Description of Artificial Sequence: Synthetic oligonucleotide
cagtcacagactgaccgagcggacct

SEQ ID NO: 13146 - DNA, 26 bp, Artificial Sequence
  Description of Artificial Sequence: Synthetic oligonucleotide
agtcacagactgaccgagcggacctg

SEQ ID NO: 13147 - DNA, 25 bp, Artificial Sequence
  Description of Artificial Sequence: Synthetic oligonucleotide
gtcacagactgaccgagcggacctg

SEQ ID NO: 13148 - DNA, 25 bp, Artificial Sequence
  Description of Artificial Sequence: Synthetic oligonucleotide
tcacagactgaccgagcggacctgg

SEQ ID NO: 13149 - DNA, 24 bp, Artificial Sequence
  Description of Artificial Sequence: Synthetic oligonucleotide
cacagactgaccgagcggacctgg

SEQ ID NO: 13150 - DNA, 24 bp, Artificial Sequence
  Description of Artificial Sequence: Synthetic oligonucleotide
acagactgaccgagcggacctggg

SEQ ID NO: 13151 - DNA, 23 bp, Artificial Sequence
  Description of Artificial Sequence: Synthetic oligonucleotide
cagactgaccgagcggacctggg

SEQ ID NO: 13152 - DNA, 24 bp, Artificial Sequence
  Description of Artificial Sequence: Synthetic oligonucleotide
agactgaccgagcggacctgggga

SEQ ID NO: 13153 - DNA, 23 bp, Artificial Sequence
  Description of Artificial Sequence: Synthetic oligonucleotide
gactgaccgagcggacctgggga

SEQ ID NO: 13154 - DNA, 23 bp, Artificial Sequence
  Description of Artificial Sequence: Synthetic oligonucleotide
actgaccgagcggacctggggac

SEQ ID NO: 13155 - DNA, 22 bp, Artificial Sequence
  Description of Artificial Sequence: Synthetic oligonucleotide
ctgaccgagcggacctggggac

SEQ ID NO: 13156 - DNA, 22 bp, Artificial Sequence
  Description of Artificial Sequence: Synthetic oligonucleotide
tgaccgagcggacctggggacc

SEQ ID NO: 13157 - DNA, 21 bp, Artificial Sequence
  Description of Artificial Sequence: Synthetic oligonucleotide
gaccgagcggacctggggacc

SEQ ID NO: 13158 - DNA, 22 bp, Artificial Sequence
  Description of Artificial Sequence: Synthetic oligonucleotide
accgagcggacctggggaccct

SEQ ID NO: 13159 - DNA, 21 bp, Artificial Sequence
  Description of Artificial Sequence: Synthetic oligonucleotide
ccgagcggacctggggaccct

SEQ ID NO: 13160 - DNA, 21 bp, Artificial Sequence
  Description of Artificial Sequence: Synthetic oligonucleotide
cgagcggacctggggaccctg

SEQ ID NO: 13161 - DNA, 21 bp, Artificial Sequence
  Description of Artificial Sequence: Synthetic oligonucleotide
gagcggacctggggaccctgc

SEQ ID NO: 13162 - DNA, 21 bp, Artificial Sequence
  Description of Artificial Sequence: Synthetic oligonucleotide
agcggacctggggaccctgcg

SEQ ID NO: 13163 - DNA, 20 bp, Artificial Sequence
  Description of Artificial Sequence: Synthetic oligonucleotide
gcggacctggggaccctgcg

SEQ ID NO: 13164 - DNA, 20 bp, Artificial Sequence
  Description of Artificial Sequence: Synthetic oligonucleotide
cggacctggggaccctgcgc

SEQ ID NO: 13165 - DNA, 24 bp, Artificial Sequence
  Description of Artificial Sequence: Synthetic oligonucleotide
tggggaccctgcgcggctactaca

SEQ ID NO: 13166 - DNA, 23 bp, Artificial Sequence
  Description of Artificial Sequence: Synthetic oligonucleotide
ggggaccctgcgcggctactaca

SEQ ID NO: 13167 - DNA, 23 bp, Artificial Sequence
  Description of Artificial Sequence: Synthetic oligonucleotide
gggaccctgcgcggctactacag

SEQ ID NO: 13168 - DNA, 23 bp, Artificial Sequence
  Description of Artificial Sequence: Synthetic oligonucleotide
ggaccctgcgcggctactacagc

SEQ ID NO: 13169 - DNA, 24 bp, Artificial Sequence
  Description of Artificial Sequence: Synthetic oligonucleotide
gaccctgcgcggctactacagcca

SEQ ID NO: 13170 - DNA, 25 bp, Artificial Sequence
  Description of Artificial Sequence: Synthetic oligonucleotide
accctgcgcggctactacagccaga

SEQ ID NO: 13171 - DNA, 24 bp, Artificial Sequence
  Description of Artificial Sequence: Synthetic oligonucleotide
ccctgcgcggctactacagccaga

SEQ ID NO: 13172 - DNA, 24 bp, Artificial Sequence
  Description of Artificial Sequence: Synthetic oligonucleotide
cctgcgcggctactacagccagag

SEQ ID NO: 13173 - DNA, 24 bp, Artificial Sequence
  Description of Artificial Sequence: Synthetic oligonucleotide
ctgcgcggctactacagccagagc

SEQ ID NO: 13174 - DNA, 25 bp, Artificial Sequence
  Description of Artificial Sequence: Synthetic oligonucleotide
tgcgcggctactacagccagagcga

SEQ ID NO: 13175 - DNA, 24 bp, Artificial Sequence
  Description of Artificial Sequence: Synthetic oligonucleotide
gcgcggctactacagccagagcga

SEQ ID NO: 13176 - DNA, 24 bp, Artificial Sequence
  Description of Artificial Sequence: Synthetic oligonucleotide
cgcggctactacagccagagcgag

SEQ ID NO: 13177 - DNA, 25 bp, Artificial Sequence
  Description of Artificial Sequence: Synthetic oligonucleotide
gcggctactacagccagagcgagga

SEQ ID NO: 13178 - DNA, 25 bp, Artificial Sequence
  Description of Artificial Sequence: Synthetic oligonucleotide
cggctactacagccagagcgaggac

SEQ ID NO: 13179 - DNA, 25 bp, Artificial Sequence
  Description of Artificial Sequence: Synthetic oligonucleotide
ggctactacagccagagcgaggacg

SEQ ID NO: 13180 - DNA, 27 bp, Artificial Sequence
  Description of Artificial Sequence: Synthetic oligonucleotide
gctactacagccagagcgaggacggtt

SEQ ID NO: 13181 - DNA, 27 bp, Artificial Sequence
  Description of Artificial Sequence: Synthetic oligonucleotide
ctactacagccagagcgaggacggttc

SEQ ID NO: 13182 - DNA, 28 bp, Artificial Sequence
  Description of Artificial Sequence: Synthetic oligonucleotide
tactacagccagagcgaggacggttctc

SEQ ID NO: 13183 - DNA, 27 bp, Artificial Sequence
  Description of Artificial Sequence: Synthetic oligonucleotide
actacagccagagcgaggacggttctc

SEQ ID NO: 13184 - DNA, 27 bp, Artificial Sequence
  Description of Artificial Sequence: Synthetic oligonucleotide
ctacagccagagcgaggacggttctca

SEQ ID NO: 13185 - DNA, 27 bp, Artificial Sequence
  Description of Artificial Sequence: Synthetic oligonucleotide
tacagccagagcgaggacggttctcac

SEQ ID NO: 13186 - DNA, 27 bp, Artificial Sequence
  Description of Artificial Sequence: Synthetic oligonucleotide
acagccagagcgaggacggttctcaca

SEQ ID NO: 13187 - DNA, 26 bp, Artificial Sequence
  Description of Artificial Sequence: Synthetic oligonucleotide
cagccagagcgaggacggttctcaca

SEQ ID NO: 13188 - DNA, 26 bp, Artificial Sequence
  Description of Artificial Sequence: Synthetic oligonucleotide
agccagagcgaggacggttctcacac

SEQ ID NO: 13189 - DNA, 25 bp, Artificial Sequence
  Description of Artificial Sequence: Synthetic oligonucleotide
gccagagcgaggacggttctcacac

SEQ ID NO: 13190 - DNA, 29 bp, Artificial Sequence
  Description of Artificial Sequence: Synthetic oligonucleotide
gctcccactccatgaggtatttccacacc

SEQ ID NO: 13191 - DNA, 30 bp, Artificial Sequence
  Description of Artificial Sequence: Synthetic oligonucleotide
ctcccactccatgaggtatttccacacctc

SEQ ID NO: 13192 - DNA, 30 bp, Artificial Sequence
  Description of Artificial Sequence: Synthetic oligonucleotide
tcccactccatgaggtatttccacacctcc

SEQ ID NO: 13193 - DNA, 29 bp, Artificial Sequence
  Description of Artificial Sequence: Synthetic oligonucleotide
cccactccatgaggtatttccacacctcc

SEQ ID NO: 13194 - DNA, 29 bp, Artificial Sequence
  Description of Artificial Sequence: Synthetic oligonucleotide
ccactccatgaggtatttccacacctccg

SEQ ID NO: 13195 - DNA, 30 bp, Artificial Sequence
  Description of Artificial Sequence: Synthetic oligonucleotide
cactccatgaggtatttccacacctccgtg

SEQ ID NO: 13196 - DNA, 31 bp, Artificial Sequence
  Description of Artificial Sequence: Synthetic oligonucleotide
actccatgaggtatttccacacctccgtgtc

SEQ ID NO: 13197 - DNA, 30 bp, Artificial Sequence
  Description of Artificial Sequence: Synthetic oligonucleotide
ctccatgaggtatttccacacctccgtgtc

SEQ ID NO: 13198 - DNA, 30 bp, Artificial Sequence
  Description of Artificial Sequence: Synthetic oligonucleotide
tccatgaggtatttccacacctccgtgtcc

SEQ ID NO: 13199 - DNA, 29 bp, Artificial Sequence
  Description of Artificial Sequence: Synthetic oligonucleotide
ccatgaggtatttccacacctccgtgtcc

SEQ ID NO: 13200 - DNA, 29 bp, Artificial Sequence
  Description of Artificial Sequence: Synthetic oligonucleotide
catgaggtatttccacacctccgtgtccc

SEQ ID NO: 13201 - DNA, 29 bp, Artificial Sequence
  Description of Artificial Sequence: Synthetic oligonucleotide
atgaggtatttccacacctccgtgtcccg

SEQ ID NO: 13202 - DNA, 28 bp, Artificial Sequence
  Description of Artificial Sequence: Synthetic oligonucleotide
tgaggtatttccacacctccgtgtcccg

SEQ ID NO: 13203 - DNA, 27 bp, Artificial Sequence
  Description of Artificial Sequence: Synthetic oligonucleotide
gaggtatttccacacctccgtgtcccg

SEQ ID NO: 13204 - DNA, 27 bp, Artificial Sequence
  Description of Artificial Sequence: Synthetic oligonucleotide
aggtatttccacacctccgtgtcccgg

SEQ ID NO: 13205 - DNA, 26 bp, Artificial Sequence
  Description of Artificial Sequence: Synthetic oligonucleotide
ggtatttccacacctccgtgtcccgg

SEQ ID NO: 13206 - DNA, 26 bp, Artificial Sequence
  Description of Artificial Sequence: Synthetic oligonucleotide
gtatttccacacctccgtgtcccggc

SEQ ID NO: 13207 - DNA, 26 bp, Artificial Sequence
  Description of Artificial Sequence: Synthetic oligonucleotide
tatttccacacctccgtgtcccggcc

SEQ ID NO: 13208 - DNA, 25 bp, Artificial Sequence
  Description of Artificial Sequence: Synthetic oligonucleotide
atttccacacctccgtgtcccggcc

SEQ ID NO: 13209 - DNA, 24 bp, Artificial Sequence
  Description of Artificial Sequence: Synthetic oligonucleotide
tttccacacctccgtgtcccggcc

SEQ ID NO: 13210 - DNA, 23 bp, Artificial Sequence
  Description of Artificial Sequence: Synthetic oligonucleotide
ttccacacctccgtgtcccggcc

SEQ ID NO: 13211 - DNA, 22 bp, Artificial Sequence
  Description of Artificial Sequence: Synthetic oligonucleotide
tccacacctccgtgtcccggcc

SEQ ID NO: 13212 - DNA, 21 bp, Artificial Sequence
  Description of Artificial Sequence: Synthetic oligonucleotide
ccacacctccgtgtcccggcc

SEQ ID NO: 13213 - DNA, 21 bp, Artificial Sequence
  Description of Artificial Sequence: Synthetic oligonucleotide
cacacctccgtgtcccggccc

SEQ ID NO: 13214 - DNA, 21 bp, Artificial Sequence
  Description of Artificial Sequence: Synthetic oligonucleotide
ccccgcttcatcgccgtgggc

SEQ ID NO: 13215 - DNA, 22 bp, Artificial Sequence
  Description of Artificial Sequence: Synthetic oligonucleotide
cccgcttcatcgccgtgggcca

SEQ ID NO: 13216 - DNA, 22 bp, Artificial Sequence
  Description of Artificial Sequence: Synthetic oligonucleotide
ccgcttcatcgccgtgggccac

SEQ ID NO: 13217 - DNA, 23 bp, Artificial Sequence
  Description of Artificial Sequence: Synthetic oligonucleotide
cgcttcatcgccgtgggccacgt

SEQ ID NO: 13218 - DNA, 23 bp, Artificial Sequence
  Description of Artificial Sequence: Synthetic oligonucleotide
gcttcatcgccgtgggccacgtg

SEQ ID NO: 13219 - DNA, 24 bp, Artificial Sequence
  Description of Artificial Sequence: Synthetic oligonucleotide
cttcatcgccgtgggccacgtgga

SEQ ID NO: 13220 - DNA, 24 bp, Artificial Sequence
  Description of Artificial Sequence: Synthetic oligonucleotide
ttcatcgccgtgggccacgtggac

SEQ ID NO: 13221 - DNA, 23 bp, Artificial Sequence
  Description of Artificial Sequence: Synthetic oligonucleotide
tcatcgccgtgggccacgtggac

SEQ ID NO: 13222 - DNA, 22 bp, Artificial Sequence
  Description of Artificial Sequence: Synthetic oligonucleotide
catcgccgtgggccacgtggac

SEQ ID NO: 13223 - DNA, 23 bp, Artificial Sequence
  Description of Artificial Sequence: Synthetic oligonucleotide
atcgccgtgggccacgtggacga

SEQ ID NO: 13224 - DNA, 22 bp, Artificial Sequence
  Description of Artificial Sequence: Synthetic oligonucleotide
tcgccgtgggccacgtggacga

SEQ ID NO: 13225 - DNA, 21 bp, Artificial Sequence
  Description of Artificial Sequence: Synthetic oligonucleotide
cgccgtgggccacgtggacga

SEQ ID NO: 13226 - DNA, 22 bp, Artificial Sequence
  Description of Artificial Sequence: Synthetic oligonucleotide
gccgtgggccacgtggacgaca

SEQ ID NO: 13227 - DNA, 22 bp, Artificial Sequence
  Description of Artificial Sequence: Synthetic oligonucleotide
ccgtgggccacgtggacgacac

SEQ ID NO: 13228 - DNA, 22 bp, Artificial Sequence
  Description of Artificial Sequence: Synthetic oligonucleotide
cgtgggccacgtggacgacacg

SEQ ID NO: 13229 - DNA, 23 bp, Artificial Sequence
  Description of Artificial Sequence: Synthetic oligonucleotide
gtgggccacgtggacgacacgca

SEQ ID NO: 13230 - DNA, 25 bp, Artificial Sequence
  Description of Artificial Sequence: Synthetic oligonucleotide
tgggccacgtggacgacacgcagtt

SEQ ID NO: 13231 - DNA, 24 bp, Artificial Sequence
  Description of Artificial Sequence: Synthetic oligonucleotide
gggccacgtggacgacacgcagtt

SEQ ID NO: 13232 - DNA, 24 bp, Artificial Sequence
  Description of Artificial Sequence: Synthetic oligonucleotide
ggccacgtggacgacacgcagttc

SEQ ID NO: 13233 - DNA, 25 bp, Artificial Sequence
  Description of Artificial Sequence: Synthetic oligonucleotide
gccacgtggacgacacgcagttcgt

SEQ ID NO: 13234 - DNA, 25 bp, Artificial Sequence
  Description of Artificial Sequence: Synthetic oligonucleotide
ccacgtggacgacacgcagttcgtg

SEQ ID NO: 13235 - DNA, 25 bp, Artificial Sequence
  Description of Artificial Sequence: Synthetic oligonucleotide
cacgtggacgacacgcagttcgtgc

SEQ ID NO: 13236 - DNA, 25 bp, Artificial Sequence
  Description of Artificial Sequence: Synthetic oligonucleotide
agcggagagtctacctggagggcga

SEQ ID NO: 13237 - DNA, 24 bp, Artificial Sequence
  Description of Artificial Sequence: Synthetic oligonucleotide
gcggagagtctacctggagggcga

SEQ ID NO: 13238 - DNA, 26 bp, Artificial Sequence
  Description of Artificial Sequence: Synthetic oligonucleotide
cggagagtctacctggagggcgagtt

SEQ ID NO: 13239 - DNA, 26 bp, Artificial Sequence
  Description of Artificial Sequence: Synthetic oligonucleotide
ggagagtctacctggagggcgagttc

SEQ ID NO: 13240 - DNA, 27 bp, Artificial Sequence
  Description of Artificial Sequence: Synthetic oligonucleotide
gagagtctacctggagggcgagttcgt

SEQ ID NO: 13241 - DNA, 27 bp, Artificial Sequence
  Description of Artificial Sequence: Synthetic oligonucleotide
agagtctacctggagggcgagttcgtg

SEQ ID NO: 13242 - DNA, 26 bp, Artificial Sequence
  Description of Artificial Sequence: Synthetic oligonucleotide
gagtctacctggagggcgagttcgtg

SEQ ID NO: 13243 - DNA, 27 bp, Artificial Sequence
  Description of Artificial Sequence: Synthetic oligonucleotide
agtctacctggagggcgagttcgtgga

SEQ ID NO: 13244 - DNA, 26 bp, Artificial Sequence
  Description of Artificial Sequence: Synthetic oligonucleotide
gtctacctggagggcgagttcgtgga

SEQ ID NO: 13245 - DNA, 27 bp, Artificial Sequence
  Description of Artificial Sequence: Synthetic oligonucleotide
tctacctggagggcgagttcgtggagt

SEQ ID NO: 13246 - DNA, 26 bp, Artificial Sequence
  Description of Artificial Sequence: Synthetic oligonucleotide
ctacctggagggcgagttcgtggagt

SEQ ID NO: 13247 - DNA, 26 bp, Artificial Sequence
  Description of Artificial Sequence: Synthetic oligonucleotide
tacctggagggcgagttcgtggagtg

SEQ ID NO: 13248 - DNA, 25 bp, Artificial Sequence
  Description of Artificial Sequence: Synthetic oligonucleotide
acctggagggcgagttcgtggagtg

SEQ ID NO: 13249 - DNA, 24 bp, Artificial Sequence
  Description of Artificial Sequence: Synthetic oligonucleotide
cctggagggcgagttcgtggagtg

SEQ ID NO: 13250 - DNA, 24 bp, Artificial Sequence
  Description of Artificial Sequence: Synthetic oligonucleotide
ctggagggcgagttcgtggagtgg

SEQ ID NO: 13251 - DNA, 25 bp, Artificial Sequence
  Description of Artificial Sequence: Synthetic oligonucleotide
tggagggcgagttcgtggagtggct

SEQ ID NO: 13252 - DNA, 24 bp, Artificial Sequence
  Description of Artificial Sequence: Synthetic oligonucleotide
ggagggcgagttcgtggagtggct

SEQ ID NO: 13253 - DNA, 24 bp, Artificial Sequence
  Description of Artificial Sequence: Synthetic oligonucleotide
gagggcgagttcgtggagtggctc

SEQ ID NO: 13254 - DNA, 24 bp, Artificial Sequence
  Description of Artificial Sequence: Synthetic oligonucleotide
agggcgagttcgtggagtggctcc

SEQ ID NO: 13255 - DNA, 23 bp, Artificial Sequence
  Description of Artificial Sequence: Synthetic oligonucleotide
gggcgagttcgtggagtggctcc

SEQ ID NO: 13256 - DNA, 23 bp, Artificial Sequence
  Description of Artificial Sequence: Synthetic oligonucleotide
ggcgagttcgtggagtggctccg

SEQ ID NO: 13257 - DNA, 24 bp, Artificial Sequence
  Description of Artificial Sequence: Synthetic oligonucleotide
gcgagttcgtggagtggctccgca

SEQ ID NO: 13258 - DNA, 27 bp, Artificial Sequence
  Description of Artificial Sequence: Synthetic oligonucleotide
cgagttcgtggagtggctccgcagata

SEQ ID NO: 13259 - DNA, 27 bp, Artificial Sequence
  Description of Artificial Sequence: Synthetic oligonucleotide
gagttcgtggagtggctccgcagatac

SEQ ID NO: 13260 - DNA, 27 bp, Artificial Sequence
  Description of Artificial Sequence: Synthetic oligonucleotide
agttcgtggagtggctccgcagatacc

SEQ ID NO: 13261 - DNA, 27 bp, Artificial Sequence
  Description of Artificial Sequence: Synthetic oligonucleotide
gttcgtggagtggctccgcagatacct

SEQ ID NO: 13262 - DNA, 27 bp, Artificial Sequence
  Description of Artificial Sequence: Synthetic oligonucleotide
ttcgtggagtggctccgcagatacctg

SEQ ID NO: 13263 - DNA, 26 bp, Artificial Sequence
  Description of Artificial Sequence: Synthetic oligonucleotide
tcgtggagtggctccgcagatacctg

SEQ ID NO: 13264 - DNA, 21 bp, Artificial Sequence
  Description of Artificial Sequence: Synthetic oligonucleotide
agacgctgcagcgcgcggacc

SEQ ID NO: 13265 - DNA, 20 bp, Artificial Sequence
  Description of Artificial Sequence: Synthetic oligonucleotide
gacgctgcagcgcgcggacc

SEQ ID NO: 13266 - DNA, 20 bp, Artificial Sequence
  Description of Artificial Sequence: Synthetic oligonucleotide
acgctgcagcgcgcggaccc

SEQ ID NO: 13267 - DNA, 20 bp, Artificial Sequence
  Description of Artificial Sequence: Synthetic oligonucleotide
cgctgcagcgcgcggaccct

SEQ ID NO: 13268 - DNA, 20 bp, Artificial Sequence
  Description of Artificial Sequence: Synthetic oligonucleotide
gctgcagcgcgcggacccct

SEQ ID NO: 13269 - DNA, 20 bp, Artificial Sequence
  Description of Artificial Sequence: Synthetic oligonucleotide
ctgcagcgcgcggaccccct

SEQ ID NO: 13270 - DNA, 20 bp, Artificial Sequence
  Description of Artificial Sequence: Synthetic oligonucleotide
tgcagcgcgcggacccccct

SEQ ID NO: 13271 - DNA, 20 bp, Artificial Sequence
  Description of Artificial Sequence: Synthetic oligonucleotide
gcagcgcgcggacccccctt

SEQ ID NO: 13272 - DNA, 20 bp, Artificial Sequence
  Description of Artificial Sequence: Synthetic oligonucleotide
cagcgcgcggacccccccaa

SEQ ID NO: 13273 - DNA, 21 bp, Artificial Sequence
  Description of Artificial Sequence: Synthetic oligonucleotide
agcgcgcggacccccccaaga

SEQ ID NO: 13274 - DNA, 20 bp, Artificial Sequence
  Description of Artificial Sequence: Synthetic oligonucleotide
gcgcgcggacccccccaaga

SEQ ID NO: 13275 - DNA, 21 bp, Artificial Sequence
  Description of Artificial Sequence: Synthetic oligonucleotide
cgcgcggacccccccaagaca

SEQ ID NO: 13276 - DNA, 25 bp, Artificial Sequence
  Description of Artificial Sequence: Synthetic oligonucleotide
gcgcggacccccccaagacacatat

SEQ ID NO: 13277 - DNA, 26 bp, Artificial Sequence
  Description of Artificial Sequence: Synthetic oligonucleotide
cgcggacccccccaagacacatatga

SEQ ID NO: 13278 - DNA, 26 bp, Artificial Sequence
  Description of Artificial Sequence: Synthetic oligonucleotide
gcggacccccccaagacacatatgac

SEQ ID NO: 13279 - DNA, 20 bp, Artificial Sequence
  Description of Artificial Sequence: Synthetic oligonucleotide
cgtgtcccggcccggccctt

SEQ ID NO: 13280 - DNA, 20 bp, Artificial Sequence
  Description of Artificial Sequence: Synthetic oligonucleotide
gtgtcccggcccggcccctt

SEQ ID NO: 13281 - DNA, 20 bp, Artificial Sequence
  Description of Artificial Sequence: Synthetic oligonucleotide
tgtcccggcccggccccgtt

SEQ ID NO: 13282 - DNA, 20 bp, Artificial Sequence
  Description of Artificial Sequence: Synthetic oligonucleotide
gtcccggcccggccccgttt

SEQ ID NO: 13283 - DNA, 20 bp, Artificial Sequence
  Description of Artificial Sequence: Synthetic oligonucleotide
tcccggcccggccccggttt

SEQ ID NO: 13284 - DNA, 20 bp, Artificial Sequence
  Description of Artificial Sequence: Synthetic oligonucleotide
cccggcccggccccggtttt

SEQ ID NO: 13285 - DNA, 20 bp, Artificial Sequence
  Description of Artificial Sequence: Synthetic oligonucleotide
ccggcccggccccgggtttt

SEQ ID NO: 13286 - DNA, 20 bp, Artificial Sequence
  Description of Artificial Sequence: Synthetic oligonucleotide
cggcccggccccggggattt

SEQ ID NO: 13287 - DNA, 20 bp, Artificial Sequence
  Description of Artificial Sequence: Synthetic oligonucleotide
ggcccggccccggggagttt

SEQ ID NO: 13288 - DNA, 20 bp, Artificial Sequence
  Description of Artificial Sequence: Synthetic oligonucleotide
gcccggccccggggagcttt

SEQ ID NO: 13289 - DNA, 20 bp, Artificial Sequence
  Description of Artificial Sequence: Synthetic oligonucleotide
cccggccccggggagccttt

SEQ ID NO: 13290 - DNA, 20 bp, Artificial Sequence
  Description of Artificial Sequence: Synthetic oligonucleotide
ccggccccggggagcccttt

SEQ ID NO: 13291 - DNA, 20 bp, Artificial Sequence
  Description of Artificial Sequence: Synthetic oligonucleotide
cggccccggggagccccttt

SEQ ID NO: 13292 - DNA, 20 bp, Artificial Sequence
  Description of Artificial Sequence: Synthetic oligonucleotide
ggccccggggagccccgttt

SEQ ID NO: 13293 - DNA, 20 bp, Artificial Sequence
  Description of Artificial Sequence: Synthetic oligonucleotide
gccccggggagccccgcttt

SEQ ID NO: 13294 - DNA, 21 bp, Artificial Sequence
  Description of Artificial Sequence: Synthetic oligonucleotide
ccccggggagccccgcttcat

SEQ ID NO: 13295 - DNA, 21 bp, Artificial Sequence
  Description of Artificial Sequence: Synthetic oligonucleotide
cccggggagccccgcttcatc

SEQ ID NO: 13296 - DNA, 21 bp, Artificial Sequence
  Description of Artificial Sequence: Synthetic oligonucleotide
ccggggagccccgcttcatcg

SEQ ID NO: 13297 - DNA, 30 bp, Artificial Sequence
  Description of Artificial Sequence: Synthetic oligonucleotide
gctcccactccatgaggtatttctacaccg

SEQ ID NO: 13298 - DNA, 31 bp, Artificial Sequence
  Description of Artificial Sequence: Synthetic oligonucleotide
ctcccactccatgaggtatttctacaccgtg

SEQ ID NO: 13299 - DNA, 32 bp, Artificial Sequence
  Description of Artificial Sequence: Synthetic oligonucleotide
tcccactccatgaggtatttctacaccgtgtc

SEQ ID NO: 13300 - DNA, 31 bp, Artificial Sequence
  Description of Artificial Sequence: Synthetic oligonucleotide
cccactccatgaggtatttctacaccgtgtc

SEQ ID NO: 13301 - DNA, 31 bp, Artificial Sequence
  Description of Artificial Sequence: Synthetic oligonucleotide
ccactccatgaggtatttctacaccgtgtcc

SEQ ID NO: 13302 - DNA, 31 bp, Artificial Sequence
  Description of Artificial Sequence: Synthetic oligonucleotide
cactccatgaggtatttctacaccgtgtccc

SEQ ID NO: 13303 - DNA, 31 bp, Artificial Sequence
  Description of Artificial Sequence: Synthetic oligonucleotide
actccatgaggtatttctacaccgtgtcccg

SEQ ID NO: 13304 - DNA, 30 bp, Artificial Sequence
  Description of Artificial Sequence: Synthetic oligonucleotide
ctccatgaggtatttctacaccgtgtcccg

SEQ ID NO: 13305 - DNA, 30 bp, Artificial Sequence
  Description of Artificial Sequence: Synthetic oligonucleotide
tccatgaggtatttctacaccgtgtcccgg

SEQ ID NO: 13306 - DNA, 29 bp, Artificial Sequence
  Description of Artificial Sequence: Synthetic oligonucleotide
ccatgaggtatttctacaccgtgtcccgg

SEQ ID NO: 13307 - DNA, 29 bp, Artificial Sequence
  Description of Artificial Sequence: Synthetic oligonucleotide
catgaggtatttctacaccgtgtcccggc

SEQ ID NO: 13308 - DNA, 29 bp, Artificial Sequence
  Description of Artificial Sequence: Synthetic oligonucleotide
atgaggtatttctacaccgtgtcccggcc

SEQ ID NO: 13309 - DNA, 28 bp, Artificial Sequence
  Description of Artificial Sequence: Synthetic oligonucleotide
tgaggtatttctacaccgtgtcccggcc

SEQ ID NO: 13310 - DNA, 27 bp, Artificial Sequence
  Description of Artificial Sequence: Synthetic oligonucleotide
gaggtatttctacaccgtgtcccggcc

SEQ ID NO: 13311 - DNA, 27 bp, Artificial Sequence
  Description of Artificial Sequence: Synthetic oligonucleotide
aggtatttctacaccgtgtcccggccc

SEQ ID NO: 13312 - DNA, 26 bp, Artificial Sequence
  Description of Artificial Sequence: Synthetic oligonucleotide
ggtatttctacaccgtgtcccggccc

SEQ ID NO: 13313 - DNA, 26 bp, Artificial Sequence
  Description of Artificial Sequence: Synthetic oligonucleotide
gtatttctacaccgtgtcccggcccg

SEQ ID NO: 13314 - DNA, 26 bp, Artificial Sequence
  Description of Artificial Sequence: Synthetic oligonucleotide
tatttctacaccgtgtcccggcccgg

SEQ ID NO: 13315 - DNA, 25 bp, Artificial Sequence
  Description of Artificial Sequence: Synthetic oligonucleotide
atttctacaccgtgtcccggcccgg

SEQ ID NO: 13316 - DNA, 24 bp, Artificial Sequence
  Description of Artificial Sequence: Synthetic oligonucleotide
tttctacaccgtgtcccggcccgg

SEQ ID NO: 13317 - DNA, 23 bp, Artificial Sequence
  Description of Artificial Sequence: Synthetic oligonucleotide
ttctacaccgtgtcccggcccgg

SEQ ID NO: 13318 - DNA, 22 bp, Artificial Sequence
  Description of Artificial Sequence: Synthetic oligonucleotide
tctacaccgtgtcccggcccgg

SEQ ID NO: 13319 - DNA, 21 bp, Artificial Sequence
  Description of Artificial Sequence: Synthetic oligonucleotide
ctacaccgtgtcccggcccgg

SEQ ID NO: 13320 - DNA, 21 bp, Artificial Sequence
  Description of Artificial Sequence: Synthetic oligonucleotide
tacaccgtgtcccggcccggc

SEQ ID NO: 13321 - DNA, 20 bp, Artificial Sequence
  Description of Artificial Sequence: Synthetic oligonucleotide
acaccgtgtcccggcccggc

SEQ ID NO: 13322 - DNA, 20 bp, Artificial Sequence
  Description of Artificial Sequence: Synthetic oligonucleotide
caccgtgtcccggcccggct

SEQ ID NO: 13323 - DNA, 20 bp, Artificial Sequence
  Description of Artificial Sequence: Synthetic oligonucleotide
accgtgtcccggcccggcct

SEQ ID NO: 13324 - DNA, 21 bp, Artificial Sequence
  Description of Artificial Sequence: Synthetic oligonucleotide
gctgcgacgtggggccggaca

SEQ ID NO: 13325 - DNA, 21 bp, Artificial Sequence
  Description of Artificial Sequence: Synthetic oligonucleotide
ctgcgacgtggggccggacag

SEQ ID NO: 13326 - DNA, 21 bp, Artificial Sequence
  Description of Artificial Sequence: Synthetic oligonucleotide
tgcgacgtggggccggacagg

SEQ ID NO: 13327 - DNA, 20 bp, Artificial Sequence
  Description of Artificial Sequence: Synthetic oligonucleotide
gcgacgtggggccggacagg

SEQ ID NO: 13328 - DNA, 20 bp, Artificial Sequence
  Description of Artificial Sequence: Synthetic oligonucleotide
cgacgtggggccggacaggc

SEQ ID NO: 13329 - DNA, 20 bp, Artificial Sequence
  Description of Artificial Sequence: Synthetic oligonucleotide
gacgtggggccggacaggcg

SEQ ID NO: 13330 - DNA, 22 bp, Artificial Sequence
  Description of Artificial Sequence: Synthetic oligonucleotide
acgtggggccggacaggcgctt

SEQ ID NO: 13331 - DNA, 21 bp, Artificial Sequence
  Description of Artificial Sequence: Synthetic oligonucleotide
cgtggggccggacaggcgctt

SEQ ID NO: 13332 - DNA, 21 bp, Artificial Sequence
  Description of Artificial Sequence: Synthetic oligonucleotide
gtggggccggacaggcgcttc

SEQ ID NO: 13333 - DNA, 22 bp, Artificial Sequence
  Description of Artificial Sequence: Synthetic oligonucleotide
tggggccggacaggcgcttcct

SEQ ID NO: 13334 - DNA, 21 bp, Artificial Sequence
  Description of Artificial Sequence: Synthetic oligonucleotide
ggggccggacaggcgcttcct

SEQ ID NO: 13335 - DNA, 21 bp, Artificial Sequence
  Description of Artificial Sequence: Synthetic oligonucleotide
gggccggacaggcgcttcctc

SEQ ID NO: 13336 - DNA, 21 bp, Artificial Sequence
  Description of Artificial Sequence: Synthetic oligonucleotide
ggccggacaggcgcttcctcc

SEQ ID NO: 13337 - DNA, 21 bp, Artificial Sequence
  Description of Artificial Sequence: Synthetic oligonucleotide
gccggacaggcgcttcctccg

SEQ ID NO: 13338 - DNA, 21 bp, Artificial Sequence
  Description of Artificial Sequence: Synthetic oligonucleotide
ccggacaggcgcttcctccgc

SEQ ID NO: 13339 - DNA, 21 bp, Artificial Sequence
  Description of Artificial Sequence: Synthetic oligonucleotide
cggacaggcgcttcctccgcg

SEQ ID NO: 13340 - DNA, 21 bp, Artificial Sequence
  Description of Artificial Sequence: Synthetic oligonucleotide
ggacaggcgcttcctccgcgg

SEQ ID NO: 13341 - DNA, 23 bp, Artificial Sequence
  Description of Artificial Sequence: Synthetic oligonucleotide
gacaggcgcttcctccgcgggta

SEQ ID NO: 13342 - DNA, 23 bp, Artificial Sequence
  Description of Artificial Sequence: Synthetic oligonucleotide
acaggcgcttcctccgcgggtac

SEQ ID NO: 13343 - DNA, 22 bp, Artificial Sequence
  Description of Artificial Sequence: Synthetic oligonucleotide
caggcgcttcctccgcgggtac

SEQ ID NO: 13344 - DNA, 22 bp, Artificial Sequence
  Description of Artificial Sequence: Synthetic oligonucleotide
aggcgcttcctccgcgggtacc

SEQ ID NO: 13345 - DNA, 24 bp, Artificial Sequence
  Description of Artificial Sequence: Synthetic oligonucleotide
gggaccctgcgcggctactacaag

SEQ ID NO: 13346 - DNA, 25 bp, Artificial Sequence
  Description of Artificial Sequence: Synthetic oligonucleotide
ggaccctgcgcggctactacaagca

SEQ ID NO: 13347 - DNA, 26 bp, Artificial Sequence
  Description of Artificial Sequence: Synthetic oligonucleotide
gaccctgcgcggctactacaagcaga

SEQ ID NO: 13348 - DNA, 26 bp, Artificial Sequence
  Description of Artificial Sequence: Synthetic oligonucleotide
accctgcgcggctactacaagcagag

SEQ ID NO: 13349 - DNA, 25 bp, Artificial Sequence
  Description of Artificial Sequence: Synthetic oligonucleotide
ccctgcgcggctactacaagcagag

SEQ ID NO: 13350 - DNA, 25 bp, Artificial Sequence
  Description of Artificial Sequence: Synthetic oligonucleotide
cctgcgcggctactacaagcagagc

SEQ ID NO: 13351 - DNA, 26 bp, Artificial Sequence
  Description of Artificial Sequence: Synthetic oligonucleotide
ctgcgcggctactacaagcagagcga

SEQ ID NO: 13352 - DNA, 26 bp, Artificial Sequence
  Description of Artificial Sequence: Synthetic oligonucleotide
tgcgcggctactacaagcagagcgag

SEQ ID NO: 13353 - DNA, 25 bp, Artificial Sequence
  Description of Artificial Sequence: Synthetic oligonucleotide
gcgcggctactacaagcagagcgag

SEQ ID NO: 13354 - DNA, 26 bp, Artificial Sequence
  Description of Artificial Sequence: Synthetic oligonucleotide
cgcggctactacaagcagagcgagga

SEQ ID NO: 13355 - DNA, 26 bp, Artificial Sequence
  Description of Artificial Sequence: Synthetic oligonucleotide
gcggctactacaagcagagcgaggac

SEQ ID NO: 13356 - DNA, 26 bp, Artificial Sequence
  Description of Artificial Sequence: Synthetic oligonucleotide
cggctactacaagcagagcgaggacg

SEQ ID NO: 13357 - DNA, 27 bp, Artificial Sequence
  Description of Artificial Sequence: Synthetic oligonucleotide
ggctactacaagcagagcgaggacggt

SEQ ID NO: 13358 - DNA, 28 bp, Artificial Sequence
  Description of Artificial Sequence: Synthetic oligonucleotide
gctactacaagcagagcgaggacggttc

SEQ ID NO: 13359 - DNA, 29 bp, Artificial Sequence
  Description of Artificial Sequence: Synthetic oligonucleotide
ctactacaagcagagcgaggacggttctc

SEQ ID NO: 13360 - DNA, 30 bp, Artificial Sequence
  Description of Artificial Sequence: Synthetic oligonucleotide
tactacaagcagagcgaggacggttctcac

SEQ ID NO: 13361 - DNA, 29 bp, Artificial Sequence
  Description of Artificial Sequence: Synthetic oligonucleotide
actacaagcagagcgaggacggttctcac

SEQ ID NO: 13362 - DNA, 28 bp, Artificial Sequence
  Description of Artificial Sequence: Synthetic oligonucleotide
ctacaagcagagcgaggacggttctcac

SEQ ID NO: 13363 - DNA, 29 bp, Artificial Sequence
  Description of Artificial Sequence: Synthetic oligonucleotide
tacaagcagagcgaggacggttctcacac

SEQ ID NO: 13364 - DNA, 28 bp, Artificial Sequence
  Description of Artificial Sequence: Synthetic oligonucleotide
acaagcagagcgaggacggttctcacac

SEQ ID NO: 13365 - DNA, 27 bp, Artificial Sequence
  Description of Artificial Sequence: Synthetic oligonucleotide
caagcagagcgaggacggttctcacac

SEQ ID NO: 13366 - DNA, 27 bp, Artificial Sequence
  Description of Artificial Sequence: Synthetic oligonucleotide
aagcagagcgaggacggttctcacacc

SEQ ID NO: 13367 - DNA, 27 bp, Artificial Sequence
  Description of Artificial Sequence: Synthetic oligonucleotide
agcagagcgaggacggttctcacacca

SEQ ID NO: 13368 - DNA, 27 bp, Artificial Sequence
  Description of Artificial Sequence: Synthetic oligonucleotide
gcagagcgaggacggttctcacaccat

SEQ ID NO: 13369 - DNA, 23 bp, Artificial Sequence
  Description of Artificial Sequence: Synthetic oligonucleotide
ctgacccagacctgggcgggcta

SEQ ID NO: 13370 - DNA, 23 bp, Artificial Sequence
  Description of Artificial Sequence: Synthetic oligonucleotide
tgacccagacctgggcgggctac

SEQ ID NO: 13371 - DNA, 22 bp, Artificial Sequence
  Description of Artificial Sequence: Synthetic oligonucleotide
gacccagacctgggcgggctac

SEQ ID NO: 13372 - DNA, 23 bp, Artificial Sequence
  Description of Artificial Sequence: Synthetic oligonucleotide
acccagacctgggcgggctacca

SEQ ID NO: 13373 - DNA, 22 bp, Artificial Sequence
  Description of Artificial Sequence: Synthetic oligonucleotide
cccagacctgggcgggctacca

SEQ ID NO: 13374 - DNA, 23 bp, Artificial Sequence
  Description of Artificial Sequence: Synthetic oligonucleotide
ccagacctgggcgggctaccact

SEQ ID NO: 13375 - DNA, 23 bp, Artificial Sequence
  Description of Artificial Sequence: Synthetic oligonucleotide
cagacctgggcgggctaccactc

SEQ ID NO: 13376 - DNA, 25 bp, Artificial Sequence
  Description of Artificial Sequence: Synthetic oligonucleotide
agacctgggcgggctaccactccat

SEQ ID NO: 13377 - DNA, 24 bp, Artificial Sequence
  Description of Artificial Sequence: Synthetic oligonucleotide
gacctgggcgggctaccactccat

SEQ ID NO: 13378 - DNA, 25 bp, Artificial Sequence
  Description of Artificial Sequence: Synthetic oligonucleotide
acctgggcgggctaccactccatga

SEQ ID NO: 13379 - DNA, 24 bp, Artificial Sequence
  Description of Artificial Sequence: Synthetic oligonucleotide
cctgggcgggctaccactccatga

SEQ ID NO: 13380 - DNA, 24 bp, Artificial Sequence
  Description of Artificial Sequence: Synthetic oligonucleotide
ctgggcgggctaccactccatgag

SEQ ID NO: 13381 - DNA, 27 bp, Artificial Sequence
  Description of Artificial Sequence: Synthetic oligonucleotide
tgggcgggctaccactccatgaggtat

SEQ ID NO: 13382 - DNA, 27 bp, Artificial Sequence
  Description of Artificial Sequence: Synthetic oligonucleotide
gggcgggctaccactccatgaggtatt

SEQ ID NO: 13383 - DNA, 28 bp, Artificial Sequence
  Description of Artificial Sequence: Synthetic oligonucleotide
ggcgggctaccactccatgaggtatttc

SEQ ID NO: 13384 - DNA, 30 bp, Artificial Sequence
  Description of Artificial Sequence: Synthetic oligonucleotide
gcgggctaccactccatgaggtatttctac

SEQ ID NO: 13385 - DNA, 31 bp, Artificial Sequence
  Description of Artificial Sequence: Synthetic oligonucleotide
cgggctaccactccatgaggtatttctacac

SEQ ID NO: 13386 - DNA, 31 bp, Artificial Sequence
  Description of Artificial Sequence: Synthetic oligonucleotide
gggctaccactccatgaggtatttctacacc

SEQ ID NO: 13387 - DNA, 32 bp, Artificial Sequence
  Description of Artificial Sequence: Synthetic oligonucleotide
ggctaccactccatgaggtatttctacacctc

SEQ ID NO: 13388 - DNA, 32 bp, Artificial Sequence
  Description of Artificial Sequence: Synthetic oligonucleotide
gctaccactccatgaggtatttctacacctcc

SEQ ID NO: 13389 - DNA, 32 bp, Artificial Sequence
  Description of Artificial Sequence: Synthetic oligonucleotide
ctaccactccatgaggtatttctacacctccg

SEQ ID NO: 13390 - DNA, 33 bp, Artificial Sequence
  Description of Artificial Sequence: Synthetic oligonucleotide
taccactccatgaggtatttctacacctccgtg

SEQ ID NO: 13391 - DNA, 32 bp, Artificial Sequence
  Description of Artificial Sequence: Synthetic oligonucleotide
accactccatgaggtatttctacacctccgtg

SEQ ID NO: 13392 - DNA, 21 bp, Artificial Sequence
  Description of Artificial Sequence: Synthetic oligonucleotide
gggagccccgcttcatcgccg

SEQ ID NO: 13393 - DNA, 21 bp, Artificial Sequence
  Description of Artificial Sequence: Synthetic oligonucleotide
ggagccccgcttcatcgccgc

SEQ ID NO: 13394 - DNA, 21 bp, Artificial Sequence
  Description of Artificial Sequence: Synthetic oligonucleotide
gagccccgcttcatcgccgcg

SEQ ID NO: 13395 - DNA, 21 bp, Artificial Sequence
  Description of Artificial Sequence: Synthetic oligonucleotide
agccccgcttcatcgccgcgg

SEQ ID NO: 13396 - DNA, 20 bp, Artificial Sequence
  Description of Artificial Sequence: Synthetic oligonucleotide
gccccgcttcatcgccgcgg

SEQ ID NO: 13397 - DNA, 20 bp, Artificial Sequence
  Description of Artificial Sequence: Synthetic oligonucleotide
ccccgcttcatcgccgcggg

SEQ ID NO: 13398 - DNA, 22 bp, Artificial Sequence
  Description of Artificial Sequence: Synthetic oligonucleotide
cccgcttcatcgccgcgggcta

SEQ ID NO: 13399 - DNA, 22 bp, Artificial Sequence
  Description of Artificial Sequence: Synthetic oligonucleotide
ccgcttcatcgccgcgggctac

SEQ ID NO: 13400 - DNA, 23 bp, Artificial Sequence
  Description of Artificial Sequence: Synthetic oligonucleotide
cgcttcatcgccgcgggctacgt

SEQ ID NO: 13401 - DNA, 23 bp, Artificial Sequence
  Description of Artificial Sequence: Synthetic oligonucleotide
gcttcatcgccgcgggctacgtg

SEQ ID NO: 13402 - DNA, 24 bp, Artificial Sequence
  Description of Artificial Sequence: Synthetic oligonucleotide
cttcatcgccgcgggctacgtgga

SEQ ID NO: 13403 - DNA, 24 bp, Artificial Sequence
  Description of Artificial Sequence: Synthetic oligonucleotide
ttcatcgccgcgggctacgtggac

SEQ ID NO: 13404 - DNA, 23 bp, Artificial Sequence
  Description of Artificial Sequence: Synthetic oligonucleotide
tcatcgccgcgggctacgtggac

SEQ ID NO: 13405 - DNA, 22 bp, Artificial Sequence
  Description of Artificial Sequence: Synthetic oligonucleotide
catcgccgcgggctacgtggac

SEQ ID NO: 13406 - DNA, 23 bp, Artificial Sequence
  Description of Artificial Sequence: Synthetic oligonucleotide
atcgccgcgggctacgtggacga

SEQ ID NO: 13407 - DNA, 22 bp, Artificial Sequence
  Description of Artificial Sequence: Synthetic oligonucleotide
tcgccgcgggctacgtggacga

SEQ ID NO: 13408 - DNA, 21 bp, Artificial Sequence
  Description of Artificial Sequence: Synthetic oligonucleotide
cgccgcgggctacgtggacga

SEQ ID NO: 13409 - DNA, 22 bp, Artificial Sequence
  Description of Artificial Sequence: Synthetic oligonucleotide
gccgcgggctacgtggacgaca

SEQ ID NO: 13410 - DNA, 22 bp, Artificial Sequence
  Description of Artificial Sequence: Synthetic oligonucleotide
ccgcgggctacgtggacgacac

SEQ ID NO: 13411 - DNA, 22 bp, Artificial Sequence
  Description of Artificial Sequence: Synthetic oligonucleotide
cgcgggctacgtggacgacacg

SEQ ID NO: 13412 - DNA, 23 bp, Artificial Sequence
  Description of Artificial Sequence: Synthetic oligonucleotide
gcgggctacgtggacgacacgca

SEQ ID NO: 13413 - DNA, 25 bp, Artificial Sequence
  Description of Artificial Sequence: Synthetic oligonucleotide
cgggctacgtggacgacacgcagtt

SEQ ID NO: 13414 - DNA, 21 bp, Artificial Sequence
  Description of Artificial Sequence: Synthetic oligonucleotide
ggcgcttcctccgcgggtacg

SEQ ID NO: 13415 - DNA, 21 bp, Artificial Sequence
  Description of Artificial Sequence: Synthetic oligonucleotide
gcgcttcctccgcgggtacgg

SEQ ID NO: 13416 - DNA, 21 bp, Artificial Sequence
  Description of Artificial Sequence: Synthetic oligonucleotide
cgcttcctccgcgggtacggg

SEQ ID NO: 13417 - DNA, 22 bp, Artificial Sequence
  Description of Artificial Sequence: Synthetic oligonucleotide
gcttcctccgcgggtacgggca

SEQ ID NO: 13418 - DNA, 22 bp, Artificial Sequence
  Description of Artificial Sequence: Synthetic oligonucleotide
cttcctccgcgggtacgggcag

SEQ ID NO: 13419 - DNA, 23 bp, Artificial Sequence
  Description of Artificial Sequence: Synthetic oligonucleotide
ttcctccgcgggtacgggcagga

SEQ ID NO: 13420 - DNA, 22 bp, Artificial Sequence
  Description of Artificial Sequence: Synthetic oligonucleotide
tcctccgcgggtacgggcagga

SEQ ID NO: 13421 - DNA, 21 bp, Artificial Sequence
  Description of Artificial Sequence: Synthetic oligonucleotide
cctccgcgggtacgggcagga

SEQ ID NO: 13422 - DNA, 21 bp, Artificial Sequence
  Description of Artificial Sequence: Synthetic oligonucleotide
ctccgcgggtacgggcaggac

SEQ ID NO: 13423 - DNA, 21 bp, Artificial Sequence
  Description of Artificial Sequence: Synthetic oligonucleotide
tccgcgggtacgggcaggacg

SEQ ID NO: 13424 - DNA, 20 bp, Artificial Sequence
  Description of Artificial Sequence: Synthetic oligonucleotide
ccgcgggtacgggcaggacg

SEQ ID NO: 13425 - DNA, 20 bp, Artificial Sequence
  Description of Artificial Sequence: Synthetic oligonucleotide
cgcgggtacgggcaggacgc

SEQ ID NO: 13426 - DNA, 22 bp, Artificial Sequence
  Description of Artificial Sequence: Synthetic oligonucleotide
gcgggtacgggcaggacgccta

SEQ ID NO: 13427 - DNA, 22 bp, Artificial Sequence
  Description of Artificial Sequence: Synthetic oligonucleotide
cgggtacgggcaggacgcctac

SEQ ID NO: 13428 - DNA, 23 bp, Artificial Sequence
  Description of Artificial Sequence: Synthetic oligonucleotide
gggtacgggcaggacgcctacga

SEQ ID NO: 13429 - DNA, 23 bp, Artificial Sequence
  Description of Artificial Sequence: Synthetic oligonucleotide
ggtacgggcaggacgcctacgac

SEQ ID NO: 13430 - DNA, 23 bp, Artificial Sequence
  Description of Artificial Sequence: Synthetic oligonucleotide
gtacgggcaggacgcctacgacg

SEQ ID NO: 13431 - DNA, 23 bp, Artificial Sequence
  Description of Artificial Sequence: Synthetic oligonucleotide
tacgggcaggacgcctacgacgg

SEQ ID NO: 13432 - DNA, 22 bp, Artificial Sequence
  Description of Artificial Sequence: Synthetic oligonucleotide
acgggcaggacgcctacgacgg

SEQ ID NO: 13433 - DNA, 21 bp, Artificial Sequence
  Description of Artificial Sequence: Synthetic oligonucleotide
cgggcaggacgcctacgacgg

SEQ ID NO: 13434 - DNA, 23 bp, Artificial Sequence
  Description of Artificial Sequence: Synthetic oligonucleotide
gggcaggacgcctacgacggcaa

SEQ ID NO: 13435 - DNA, 20 bp, Artificial Sequence
  Description of Artificial Sequence: Synthetic oligonucleotide
cggcccgtgtggcggagcag

SEQ ID NO: 13436 - DNA, 21 bp, Artificial Sequence
  Description of Artificial Sequence: Synthetic oligonucleotide
ggcccgtgtggcggagcagca

SEQ ID NO: 13437 - DNA, 22 bp, Artificial Sequence
  Description of Artificial Sequence: Synthetic oligonucleotide
gcccgtgtggcggagcagcaga

SEQ ID NO: 13438 - DNA, 23 bp, Artificial Sequence
  Description of Artificial Sequence: Synthetic oligonucleotide
cccgtgtggcggagcagcagaga

SEQ ID NO: 13439 - DNA, 23 bp, Artificial Sequence
  Description of Artificial Sequence: Synthetic oligonucleotide
ccgtgtggcggagcagcagagag

SEQ ID NO: 13440 - DNA, 23 bp, Artificial Sequence
  Description of Artificial Sequence: Synthetic oligonucleotide
cgtgtggcggagcagcagagagc

SEQ ID NO: 13441 - DNA, 25 bp, Artificial Sequence
  Description of Artificial Sequence: Synthetic oligonucleotide
gtgtggcggagcagcagagagccta

SEQ ID NO: 13442 - DNA, 29 bp, Artificial Sequence
  Description of Artificial Sequence: Synthetic oligonucleotide
gagtattgggaccaggagacacggaatgc

SEQ ID NO: 13443 - DNA, 29 bp, Artificial Sequence
  Description of Artificial Sequence: Synthetic oligonucleotide
agtattgggaccaggagacacggaatgcg

SEQ ID NO: 13444 - DNA, 28 bp, Artificial Sequence
  Description of Artificial Sequence: Synthetic oligonucleotide
gtattgggaccaggagacacggaatgcg

SEQ ID NO: 13445 - DNA, 30 bp, Artificial Sequence
  Description of Artificial Sequence: Synthetic oligonucleotide
tattgggaccaggagacacggaatgcgaag

SEQ ID NO: 13446 - DNA, 29 bp, Artificial Sequence
  Description of Artificial Sequence: Synthetic oligonucleotide
attgggaccaggagacacggaatgcgaag

SEQ ID NO: 13447 - DNA, 28 bp, Artificial Sequence
  Description of Artificial Sequence: Synthetic oligonucleotide
ttgggaccaggagacacggaatgcgaag

SEQ ID NO: 13448 - DNA, 27 bp, Artificial Sequence
  Description of Artificial Sequence: Synthetic oligonucleotide
tgggaccaggagacacggaatgcgaag

SEQ ID NO: 13449 - DNA, 26 bp, Artificial Sequence
  Description of Artificial Sequence: Synthetic oligonucleotide
gggaccaggagacacggaatgcgaag

SEQ ID NO: 13450 - DNA, 26 bp, Artificial Sequence
  Description of Artificial Sequence: Synthetic oligonucleotide
ggaccaggagacacggaatgcgaagg

SEQ ID NO: 13451 - DNA, 26 bp, Artificial Sequence
  Description of Artificial Sequence: Synthetic oligonucleotide
gaccaggagacacggaatgcgaaggc

SEQ ID NO: 13452 - DNA, 26 bp, Artificial Sequence
  Description of Artificial Sequence: Synthetic oligonucleotide
accaggagacacggaatgcgaaggcc

SEQ ID NO: 13453 - DNA, 25 bp, Artificial Sequence
  Description of Artificial Sequence: Synthetic oligonucleotide
ccaggagacacggaatgcgaaggcc

SEQ ID NO: 13454 - DNA, 26 bp, Artificial Sequence
  Description of Artificial Sequence: Synthetic oligonucleotide
caggagacacggaatgcgaaggccca

SEQ ID NO: 13455 - DNA, 27 bp, Artificial Sequence
  Description of Artificial Sequence: Synthetic oligonucleotide
aggagacacggaatgcgaaggcccagt

SEQ ID NO: 13456 - DNA, 26 bp, Artificial Sequence
  Description of Artificial Sequence: Synthetic oligonucleotide
ggagacacggaatgcgaaggcccagt

SEQ ID NO: 13457 - DNA, 27 bp, Artificial Sequence
  Description of Artificial Sequence: Synthetic oligonucleotide
gagacacggaatgcgaaggcccagtca

SEQ ID NO: 13458 - DNA, 27 bp, Artificial Sequence
  Description of Artificial Sequence: Synthetic oligonucleotide
agacacggaatgcgaaggcccagtcac

SEQ ID NO: 13459 - DNA, 27 bp, Artificial Sequence
  Description of Artificial Sequence: Synthetic oligonucleotide
gacacggaatgcgaaggcccagtcaca

SEQ ID NO: 13460 - DNA, 27 bp, Artificial Sequence
  Description of Artificial Sequence: Synthetic oligonucleotide
acacggaatgcgaaggcccagtcacag

SEQ ID NO: 13461 - DNA, 27 bp, Artificial Sequence
  Description of Artificial Sequence: Synthetic oligonucleotide
cacggaatgcgaaggcccagtcacaga

SEQ ID NO: 13462 - DNA, 27 bp, Artificial Sequence
  Description of Artificial Sequence: Synthetic oligonucleotide
acggaatgcgaaggcccagtcacagac

SEQ ID NO: 13463 - DNA, 27 bp, Artificial Sequence
  Description of Artificial Sequence: Synthetic oligonucleotide
cggaatgcgaaggcccagtcacagact

SEQ ID NO: 13464 - DNA, 27 bp, Artificial Sequence
  Description of Artificial Sequence: Synthetic oligonucleotide
ggaatgcgaaggcccagtcacagactg

SEQ ID NO: 13465 - DNA, 28 bp, Artificial Sequence
  Description of Artificial Sequence: Synthetic oligonucleotide
gaatgcgaaggcccagtcacagactgac

SEQ ID NO: 13466 - DNA, 28 bp, Artificial Sequence
  Description of Artificial Sequence: Synthetic oligonucleotide
aatgcgaaggcccagtcacagactgacc

SEQ ID NO: 13467 - DNA, 27 bp, Artificial Sequence
  Description of Artificial Sequence: Synthetic oligonucleotide
atgcgaaggcccagtcacagactgacc

SEQ ID NO: 13468 - DNA, 26 bp, Artificial Sequence
  Description of Artificial Sequence: Synthetic oligonucleotide
tgcgaaggcccagtcacagactgacc

SEQ ID NO: 13469 - DNA, 25 bp, Artificial Sequence
  Description of Artificial Sequence: Synthetic oligonucleotide
gcgaaggcccagtcacagactgacc

SEQ ID NO: 13470 - DNA, 26 bp, Artificial Sequence
  Description of Artificial Sequence: Synthetic oligonucleotide
cgaaggcccagtcacagactgaccga

SEQ ID NO: 13471 - DNA, 23 bp, Artificial Sequence
  Description of Artificial Sequence: Synthetic oligonucleotide
gggtaccggcaggacgcctacca

SEQ ID NO: 13472 - DNA, 23 bp, Artificial Sequence
  Description of Artificial Sequence: Synthetic oligonucleotide
ggtaccggcaggacgcctaccac

SEQ ID NO: 13473 - DNA, 23 bp, Artificial Sequence
  Description of Artificial Sequence: Synthetic oligonucleotide
gtaccggcaggacgcctaccacg

SEQ ID NO: 13474 - DNA, 23 bp, Artificial Sequence
  Description of Artificial Sequence: Synthetic oligonucleotide
taccggcaggacgcctaccacgg

SEQ ID NO: 13475 - DNA, 22 bp, Artificial Sequence
  Description of Artificial Sequence: Synthetic oligonucleotide
accggcaggacgcctaccacgg

SEQ ID NO: 13476 - DNA, 21 bp, Artificial Sequence
  Description of Artificial Sequence: Synthetic oligonucleotide
ccggcaggacgcctaccacgg

SEQ ID NO: 13477 - DNA, 23 bp, Artificial Sequence
  Description of Artificial Sequence: Synthetic oligonucleotide
cggcaggacgcctaccacggcaa

SEQ ID NO: 13478 - DNA, 23 bp, Artificial Sequence
  Description of Artificial Sequence: Synthetic oligonucleotide
ggcaggacgcctaccacggcaag

SEQ ID NO: 13479 - DNA, 27 bp, Artificial Sequence
  Description of Artificial Sequence: Synthetic oligonucleotide
gcaggacgcctaccacggcaaggatta

SEQ ID NO: 13480 - DNA, 27 bp, Artificial Sequence
  Description of Artificial Sequence: Synthetic oligonucleotide
caggacgcctaccacggcaaggattac

SEQ ID NO: 13481 - DNA, 29 bp, Artificial Sequence
  Description of Artificial Sequence: Synthetic oligonucleotide
aggacgcctaccacggcaaggattacatc

SEQ ID NO: 13482 - DNA, 28 bp, Artificial Sequence
  Description of Artificial Sequence: Synthetic oligonucleotide
ggacgcctaccacggcaaggattacatc

SEQ ID NO: 13483 - DNA, 28 bp, Artificial Sequence
  Description of Artificial Sequence: Synthetic oligonucleotide
gacgcctaccacggcaaggattacatcg

SEQ ID NO: 13484 - DNA, 28 bp, Artificial Sequence
  Description of Artificial Sequence: Synthetic oligonucleotide
acgcctaccacggcaaggattacatcgc

SEQ ID NO: 13485 - DNA, 27 bp, Artificial Sequence
  Description of Artificial Sequence: Synthetic oligonucleotide
cgcctaccacggcaaggattacatcgc

SEQ ID NO: 13486 - DNA, 27 bp, Artificial Sequence
  Description of Artificial Sequence: Synthetic oligonucleotide
gcctaccacggcaaggattacatcgcc

SEQ ID NO: 13487 - DNA, 27 bp, Artificial Sequence
  Description of Artificial Sequence: Synthetic oligonucleotide
cctaccacggcaaggattacatcgccc

SEQ ID NO: 13488 - DNA, 28 bp, Artificial Sequence
  Description of Artificial Sequence: Synthetic oligonucleotide
ctaccacggcaaggattacatcgccctg

SEQ ID NO: 13489 - DNA, 30 bp, Artificial Sequence
  Description of Artificial Sequence: Synthetic oligonucleotide
taccacggcaaggattacatcgccctgaac

SEQ ID NO: 13490 - DNA, 29 bp, Artificial Sequence
  Description of Artificial Sequence: Synthetic oligonucleotide
accacggcaaggattacatcgccctgaac

SEQ ID NO: 13491 - DNA, 28 bp, Artificial Sequence
  Description of Artificial Sequence: Synthetic oligonucleotide
ccacggcaaggattacatcgccctgaac

SEQ ID NO: 13492 - DNA, 28 bp, Artificial Sequence
  Description of Artificial Sequence: Synthetic oligonucleotide
cacggcaaggattacatcgccctgaacg

SEQ ID NO: 13493 - DNA, 23 bp, Artificial Sequence
  Description of Artificial Sequence: Synthetic oligonucleotide
cgggcgccgtggatagagcagca

SEQ ID NO: 13494 - DNA, 23 bp, Artificial Sequence
  Description of Artificial Sequence: Synthetic oligonucleotide
gggcgccgtggatagagcagcag

SEQ ID NO: 13495 - DNA, 23 bp, Artificial Sequence
  Description of Artificial Sequence: Synthetic oligonucleotide
ggcgccgtggatagagcagcagg

SEQ ID NO: 13496 - DNA, 23 bp, Artificial Sequence
  Description of Artificial Sequence: Synthetic oligonucleotide
gcgccgtggatagagcagcaggg

SEQ ID NO: 13497 - DNA, 23 bp, Artificial Sequence
  Description of Artificial Sequence: Synthetic oligonucleotide
cgccgtggatagagcagcagggg

SEQ ID NO: 13498 - DNA, 23 bp, Artificial Sequence
  Description of Artificial Sequence: Synthetic oligonucleotide
gccgtggatagagcagcaggggc

SEQ ID NO: 13499 - DNA, 23 bp, Artificial Sequence
  Description of Artificial Sequence: Synthetic oligonucleotide
ccgtggatagagcagcaggggcc

SEQ ID NO: 13500 - DNA, 23 bp, Artificial Sequence
  Description of Artificial Sequence: Synthetic oligonucleotide
cgtggatagagcagcaggggccg

SEQ ID NO: 13501 - DNA, 24 bp, Artificial Sequence
  Description of Artificial Sequence: Synthetic oligonucleotide
gtggatagagcagcaggggccgga

SEQ ID NO: 13502 - DNA, 27 bp, Artificial Sequence
  Description of Artificial Sequence: Synthetic oligonucleotide
tggatagagcagcaggggccggagtat

SEQ ID NO: 13503 - DNA, 27 bp, Artificial Sequence
  Description of Artificial Sequence: Synthetic oligonucleotide
ggatagagcagcaggggccggagtatt

SEQ ID NO: 13504 - DNA, 27 bp, Artificial Sequence
  Description of Artificial Sequence: Synthetic oligonucleotide
gatagagcagcaggggccggagtattg

SEQ ID NO: 13505 - DNA, 27 bp, Artificial Sequence
  Description of Artificial Sequence: Synthetic oligonucleotide
atagagcagcaggggccggagtattgg

SEQ ID NO: 13506 - DNA, 26 bp, Artificial Sequence
  Description of Artificial Sequence: Synthetic oligonucleotide
tagagcagcaggggccggagtattgg

SEQ ID NO: 13507 - DNA, 25 bp, Artificial Sequence
  Description of Artificial Sequence: Synthetic oligonucleotide
agagcagcaggggccggagtattgg

SEQ ID NO: 13508 - DNA, 24 bp, Artificial Sequence
  Description of Artificial Sequence: Synthetic oligonucleotide
gagcagcaggggccggagtattgg

SEQ ID NO: 13509 - DNA, 25 bp, Artificial Sequence
  Description of Artificial Sequence: Synthetic oligonucleotide
agcagcaggggccggagtattggga

SEQ ID NO: 13510 - DNA, 24 bp, Artificial Sequence
  Description of Artificial Sequence: Synthetic oligonucleotide
gcagcaggggccggagtattggga

SEQ ID NO: 13511 - DNA, 24 bp, Artificial Sequence
  Description of Artificial Sequence: Synthetic oligonucleotide
cagcaggggccggagtattgggac

SEQ ID NO: 13512 - DNA, 25 bp, Artificial Sequence
  Description of Artificial Sequence: Synthetic oligonucleotide
agcaggggccggagtattgggacca

SEQ ID NO: 13513 - DNA, 24 bp, Artificial Sequence
  Description of Artificial Sequence: Synthetic oligonucleotide
gcaggggccggagtattgggacca

SEQ ID NO: 13514 - DNA, 24 bp, Artificial Sequence
  Description of Artificial Sequence: Synthetic oligonucleotide
caggggccggagtattgggaccag

SEQ ID NO: 13515 - DNA, 20 bp, Artificial Sequence
  Description of Artificial Sequence: Synthetic oligonucleotide
acctggggaccctgcgcggc

SEQ ID NO: 13516 - DNA, 20 bp, Artificial Sequence
  Description of Artificial Sequence: Synthetic oligonucleotide
cctggggaccctgcgcggct

SEQ ID NO: 13517 - DNA, 20 bp, Artificial Sequence
  Description of Artificial Sequence: Synthetic oligonucleotide
ctggggaccctgcgcggcca

SEQ ID NO: 13518 - DNA, 22 bp, Artificial Sequence
  Description of Artificial Sequence: Synthetic oligonucleotide
tggggaccctgcgcggccacta

SEQ ID NO: 13519 - DNA, 21 bp, Artificial Sequence
  Description of Artificial Sequence: Synthetic oligonucleotide
ggggaccctgcgcggccacta

SEQ ID NO: 13520 - DNA, 23 bp, Artificial Sequence
  Description of Artificial Sequence: Synthetic oligonucleotide
gggaccctgcgcggccactacaa

SEQ ID NO: 13521 - DNA, 23 bp, Artificial Sequence
  Description of Artificial Sequence: Synthetic oligonucleotide
ggaccctgcgcggccactacaac

SEQ ID NO: 13522 - DNA, 24 bp, Artificial Sequence
  Description of Artificial Sequence: Synthetic oligonucleotide
gaccctgcgcggccactacaacca

SEQ ID NO: 13523 - DNA, 25 bp, Artificial Sequence
  Description of Artificial Sequence: Synthetic oligonucleotide
accctgcgcggccactacaaccaga

SEQ ID NO: 13524 - DNA, 24 bp, Artificial Sequence
  Description of Artificial Sequence: Synthetic oligonucleotide
ccctgcgcggccactacaaccaga

SEQ ID NO: 13525 - DNA, 24 bp, Artificial Sequence
  Description of Artificial Sequence: Synthetic oligonucleotide
cctgcgcggccactacaaccagag

SEQ ID NO: 13526 - DNA, 24 bp, Artificial Sequence
  Description of Artificial Sequence: Synthetic oligonucleotide
ctgcgcggccactacaaccagagc

SEQ ID NO: 13527 - DNA, 25 bp, Artificial Sequence
  Description of Artificial Sequence: Synthetic oligonucleotide
tgcgcggccactacaaccagagcga

SEQ ID NO: 13528 - DNA, 24 bp, Artificial Sequence
  Description of Artificial Sequence: Synthetic oligonucleotide
gcgcggccactacaaccagagcga

SEQ ID NO: 13529 - DNA, 24 bp, Artificial Sequence
  Description of Artificial Sequence: Synthetic oligonucleotide
cgcggccactacaaccagagcgag

SEQ ID NO: 13530 - DNA, 25 bp, Artificial Sequence
  Description of Artificial Sequence: Synthetic oligonucleotide
gcggccactacaaccagagcgagga

SEQ ID NO: 13531 - DNA, 25 bp, Artificial Sequence
  Description of Artificial Sequence: Synthetic oligonucleotide
cggccactacaaccagagcgaggac

SEQ ID NO: 13532 - DNA, 25 bp, Artificial Sequence
  Description of Artificial Sequence: Synthetic oligonucleotide
ggccactacaaccagagcgaggacg

SEQ ID NO: 13533 - DNA, 27 bp, Artificial Sequence
  Description of Artificial Sequence: Synthetic oligonucleotide
gccactacaaccagagcgaggacggtt

SEQ ID NO: 13534 - DNA, 27 bp, Artificial Sequence
  Description of Artificial Sequence: Synthetic oligonucleotide
ccactacaaccagagcgaggacggttc

SEQ ID NO: 13535 - DNA, 28 bp, Artificial Sequence
  Description of Artificial Sequence: Synthetic oligonucleotide
cactacaaccagagcgaggacggttctc

SEQ ID NO: 13536 - DNA, 23 bp, Artificial Sequence
  Description of Artificial Sequence: Synthetic oligonucleotide
ctcgtcctgctactctcgggggc

SEQ ID NO: 13537 - DNA, 23 bp, Artificial Sequence
  Description of Artificial Sequence: Synthetic oligonucleotide
tcgtcctgctactctcgggggcc

SEQ ID NO: 13538 - DNA, 22 bp, Artificial Sequence
  Description of Artificial Sequence: Synthetic oligonucleotide
cgtcctgctactctcgggggcc

SEQ ID NO: 13539 - DNA, 23 bp, Artificial Sequence
  Description of Artificial Sequence: Synthetic oligonucleotide
gtcctgctactctcgggggccct

SEQ ID NO: 13540 - DNA, 23 bp, Artificial Sequence
  Description of Artificial Sequence: Synthetic oligonucleotide
tggccctgacccagacctgggca

SEQ ID NO: 13541 - DNA, 22 bp, Artificial Sequence
  Description of Artificial Sequence: Synthetic oligonucleotide
ggccctgacccagacctgggca

SEQ ID NO: 13542 - DNA, 22 bp, Artificial Sequence
  Description of Artificial Sequence: Synthetic oligonucleotide
gccctgacccagacctgggcag

SEQ ID NO: 13543 - DNA, 22 bp, Artificial Sequence
  Description of Artificial Sequence: Synthetic oligonucleotide
ccctgacccagacctgggcagg

SEQ ID NO: 13544 - DNA, 23 bp, Artificial Sequence
  Description of Artificial Sequence: Synthetic oligonucleotide
cctgacccagacctgggcaggct

SEQ ID NO: 13545 - DNA, 23 bp, Artificial Sequence
  Description of Artificial Sequence: Synthetic oligonucleotide
ctgacccagacctgggcaggctc

SEQ ID NO: 13546 - DNA, 23 bp, Artificial Sequence
  Description of Artificial Sequence: Synthetic oligonucleotide
tgacccagacctgggcaggctcc

SEQ ID NO: 13547 - DNA, 22 bp, Artificial Sequence
  Description of Artificial Sequence: Synthetic oligonucleotide
gacccagacctgggcaggctcc

SEQ ID NO: 13548 - DNA, 23 bp, Artificial Sequence
  Description of Artificial Sequence: Synthetic oligonucleotide
acccagacctgggcaggctccca

SEQ ID NO: 13549 - DNA, 22 bp, Artificial Sequence
  Description of Artificial Sequence: Synthetic oligonucleotide
cccagacctgggcaggctccca

SEQ ID NO: 13550 - DNA, 23 bp, Artificial Sequence
  Description of Artificial Sequence: Synthetic oligonucleotide
ccagacctgggcaggctcccact

SEQ ID NO: 13551 - DNA, 23 bp, Artificial Sequence
  Description of Artificial Sequence: Synthetic oligonucleotide
cagacctgggcaggctcccactc

SEQ ID NO: 13552 - DNA, 25 bp, Artificial Sequence
  Description of Artificial Sequence: Synthetic oligonucleotide
agacctgggcaggctcccactccat

SEQ ID NO: 13553 - DNA, 24 bp, Artificial Sequence
  Description of Artificial Sequence: Synthetic oligonucleotide
gacctgggcaggctcccactccat

SEQ ID NO: 13554 - DNA, 25 bp, Artificial Sequence
  Description of Artificial Sequence: Synthetic oligonucleotide
acctgggcaggctcccactccatga

SEQ ID NO: 13555 - DNA, 24 bp, Artificial Sequence
  Description of Artificial Sequence: Synthetic oligonucleotide
cctgggcaggctcccactccatga

SEQ ID NO: 13556 - DNA, 24 bp, Artificial Sequence
  Description of Artificial Sequence: Synthetic oligonucleotide
ctgggcaggctcccactccatgag

SEQ ID NO: 13557 - DNA, 27 bp, Artificial Sequence
  Description of Artificial Sequence: Synthetic oligonucleotide
tgggcaggctcccactccatgaggtat

SEQ ID NO: 13558 - DNA, 27 bp, Artificial Sequence
  Description of Artificial Sequence: Synthetic oligonucleotide
gggcaggctcccactccatgaggtatt

SEQ ID NO: 13559 - DNA, 28 bp, Artificial Sequence
  Description of Artificial Sequence: Synthetic oligonucleotide
ggcaggctcccactccatgaggtatttc

SEQ ID NO: 13560 - DNA, 29 bp, Artificial Sequence
  Description of Artificial Sequence: Synthetic oligonucleotide
gcaggctcccactccatgaggtatttctc

SEQ ID NO: 13561 - DNA, 29 bp, Artificial Sequence
  Description of Artificial Sequence: Synthetic oligonucleotide
caggctcccactccatgaggtatttctcc

SEQ ID NO: 13562 - DNA, 30 bp, Artificial Sequence
  Description of Artificial Sequence: Synthetic oligonucleotide
aggctcccactccatgaggtatttctccac

SEQ ID NO: 13563 - DNA, 30 bp, Artificial Sequence
  Description of Artificial Sequence: Synthetic oligonucleotide
catctctgaccatgaggccactctgagatg

SEQ ID NO: 13564 - DNA, 30 bp, Artificial Sequence
  Description of Artificial Sequence: Synthetic oligonucleotide
atctctgaccatgaggccactctgagatgc

SEQ ID NO: 13565 - DNA, 29 bp, Artificial Sequence
  Description of Artificial Sequence: Synthetic oligonucleotide
tctctgaccatgaggccactctgagatgc

SEQ ID NO: 13566 - DNA, 28 bp, Artificial Sequence
  Description of Artificial Sequence: Synthetic oligonucleotide
ctctgaccatgaggccactctgagatgc

SEQ ID NO: 13567 - DNA, 29 bp, Artificial Sequence
  Description of Artificial Sequence: Synthetic oligonucleotide
tctgaccatgaggccactctgagatgctg

SEQ ID NO: 13568 - DNA, 28 bp, Artificial Sequence
  Description of Artificial Sequence: Synthetic oligonucleotide
ctgaccatgaggccactctgagatgctg

SEQ ID NO: 13569 - DNA, 28 bp, Artificial Sequence
  Description of Artificial Sequence: Synthetic oligonucleotide
tgaccatgaggccactctgagatgctgg

SEQ ID NO: 13570 - DNA, 27 bp, Artificial Sequence
  Description of Artificial Sequence: Synthetic oligonucleotide
gaccatgaggccactctgagatgctgg

SEQ ID NO: 13571 - DNA, 27 bp, Artificial Sequence
  Description of Artificial Sequence: Synthetic oligonucleotide
accatgaggccactctgagatgctggg

SEQ ID NO: 13572 - DNA, 26 bp, Artificial Sequence
  Description of Artificial Sequence: Synthetic oligonucleotide
ccatgaggccactctgagatgctggg

SEQ ID NO: 13573 - DNA, 26 bp, Artificial Sequence
  Description of Artificial Sequence: Synthetic oligonucleotide
catgaggccactctgagatgctgggc

SEQ ID NO: 13574 - DNA, 26 bp, Artificial Sequence
  Description of Artificial Sequence: Synthetic oligonucleotide
atgaggccactctgagatgctgggcc

SEQ ID NO: 13575 - DNA, 25 bp, Artificial Sequence
  Description of Artificial Sequence: Synthetic oligonucleotide
tgaggccactctgagatgctgggcc

SEQ ID NO: 13576 - DNA, 24 bp, Artificial Sequence
  Description of Artificial Sequence: Synthetic oligonucleotide
gaggccactctgagatgctgggcc

SEQ ID NO: 13577 - DNA, 25 bp, Artificial Sequence
  Description of Artificial Sequence: Synthetic oligonucleotide
aggccactctgagatgctgggccct

SEQ ID NO: 13578 - DNA, 24 bp, Artificial Sequence
  Description of Artificial Sequence: Synthetic oligonucleotide
ggccactctgagatgctgggccct

SEQ ID NO: 13579 - DNA, 24 bp, Artificial Sequence
  Description of Artificial Sequence: Synthetic oligonucleotide
gccactctgagatgctgggccctg

SEQ ID NO: 13580 - DNA, 24 bp, Artificial Sequence
  Description of Artificial Sequence: Synthetic oligonucleotide
ccactctgagatgctgggccctgg

SEQ ID NO: 13581 - DNA, 24 bp, Artificial Sequence
  Description of Artificial Sequence: Synthetic oligonucleotide
cactctgagatgctgggccctggg

SEQ ID NO: 13582 - DNA, 26 bp, Artificial Sequence
  Description of Artificial Sequence: Synthetic oligonucleotide
actctgagatgctgggccctgggctt

SEQ ID NO: 13583 - DNA, 25 bp, Artificial Sequence
  Description of Artificial Sequence: Synthetic oligonucleotide
ctctgagatgctgggccctgggctt

SEQ ID NO: 13584 - DNA, 27 bp, Artificial Sequence
  Description of Artificial Sequence: Synthetic oligonucleotide
tctgagatgctgggccctgggcttcta

SEQ ID NO: 13585 - DNA, 26 bp, Artificial Sequence
  Description of Artificial Sequence: Synthetic oligonucleotide
ctgagatgctgggccctgggcttcta

SEQ ID NO: 13586 - DNA, 26 bp, Artificial Sequence
  Description of Artificial Sequence: Synthetic oligonucleotide
tgagatgctgggccctgggcttctac

SEQ ID NO: 13587 - DNA, 25 bp, Artificial Sequence
  Description of Artificial Sequence: Synthetic oligonucleotide
gagatgctgggccctgggcttctac

SEQ ID NO: 13588 - DNA, 25 bp, Artificial Sequence
  Description of Artificial Sequence: Synthetic oligonucleotide
agatgctgggccctgggcttctacc

SEQ ID NO: 13589 - DNA, 24 bp, Artificial Sequence
  Description of Artificial Sequence: Synthetic oligonucleotide
gatgctgggccctgggcttctacc

SEQ ID NO: 13590 - DNA, 25 bp, Artificial Sequence
  Description of Artificial Sequence: Synthetic oligonucleotide
atgctgggccctgggcttctaccct

SEQ ID NO: 13591 - DNA, 27 bp, Artificial Sequence
  Description of Artificial Sequence: Synthetic oligonucleotide
ggggatggaaccttccagaagtgggca

SEQ ID NO: 13592 - DNA, 27 bp, Artificial Sequence
  Description of Artificial Sequence: Synthetic oligonucleotide
gggatggaaccttccagaagtgggcag

SEQ ID NO: 13593 - DNA, 27 bp, Artificial Sequence
  Description of Artificial Sequence: Synthetic oligonucleotide
ggatggaaccttccagaagtgggcagc

SEQ ID NO: 13594 - DNA, 28 bp, Artificial Sequence
  Description of Artificial Sequence: Synthetic oligonucleotide
gatggaaccttccagaagtgggcagctg

SEQ ID NO: 13595 - DNA, 29 bp, Artificial Sequence
  Description of Artificial Sequence: Synthetic oligonucleotide
atggaaccttccagaagtgggcagctgtg

SEQ ID NO: 13596 - DNA, 28 bp, Artificial Sequence
  Description of Artificial Sequence: Synthetic oligonucleotide
tggaaccttccagaagtgggcagctgtg

SEQ ID NO: 13597 - DNA, 27 bp, Artificial Sequence
  Description of Artificial Sequence: Synthetic oligonucleotide
ggaaccttccagaagtgggcagctgtg

SEQ ID NO: 13598 - DNA, 27 bp, Artificial Sequence
  Description of Artificial Sequence: Synthetic oligonucleotide
gaaccttccagaagtgggcagctgtgg

SEQ ID NO: 13599 - DNA, 28 bp, Artificial Sequence
  Description of Artificial Sequence: Synthetic oligonucleotide
aaccttccagaagtgggcagctgtggtg

SEQ ID NO: 13600 - DNA, 27 bp, Artificial Sequence
  Description of Artificial Sequence: Synthetic oligonucleotide
accttccagaagtgggcagctgtggtg

SEQ ID NO: 13601 - DNA, 26 bp, Artificial Sequence
  Description of Artificial Sequence: Synthetic oligonucleotide
ccttccagaagtgggcagctgtggtg

SEQ ID NO: 13602 - DNA, 27 bp, Artificial Sequence
  Description of Artificial Sequence: Synthetic oligonucleotide
cttccagaagtgggcagctgtggtggt

SEQ ID NO: 13603 - DNA, 28 bp, Artificial Sequence
  Description of Artificial Sequence: Synthetic oligonucleotide
ttccagaagtgggcagctgtggtggtac

SEQ ID NO: 13604 - DNA, 27 bp, Artificial Sequence
  Description of Artificial Sequence: Synthetic oligonucleotide
tccagaagtgggcagctgtggtggtac

SEQ ID NO: 13605 - DNA, 26 bp, Artificial Sequence
  Description of Artificial Sequence: Synthetic oligonucleotide
ccagaagtgggcagctgtggtggtac

SEQ ID NO: 13606 - DNA, 27 bp, Artificial Sequence
  Description of Artificial Sequence: Synthetic oligonucleotide
cagaagtgggcagctgtggtggtacct

SEQ ID NO: 13607 - DNA, 28 bp, Artificial Sequence
  Description of Artificial Sequence: Synthetic oligonucleotide
agaagtgggcagctgtggtggtaccttc

SEQ ID NO: 13608 - DNA, 27 bp, Artificial Sequence
  Description of Artificial Sequence: Synthetic oligonucleotide
gaagtgggcagctgtggtggtaccttc

SEQ ID NO: 13609 - DNA, 28 bp, Artificial Sequence
  Description of Artificial Sequence: Synthetic oligonucleotide
aagtgggcagctgtggtggtaccttctg

SEQ ID NO: 13610 - DNA, 27 bp, Artificial Sequence
  Description of Artificial Sequence: Synthetic oligonucleotide
agtgggcagctgtggtggtaccttctg

SEQ ID NO: 13611 - DNA, 26 bp, Artificial Sequence
  Description of Artificial Sequence: Synthetic oligonucleotide
gtgggcagctgtggtggtaccttctg

SEQ ID NO: 13612 - DNA, 27 bp, Artificial Sequence
  Description of Artificial Sequence: Synthetic oligonucleotide
tgggcagctgtggtggtaccttctgga

SEQ ID NO: 13613 - DNA, 26 bp, Artificial Sequence
  Description of Artificial Sequence: Synthetic oligonucleotide
gggcagctgtggtggtaccttctgga

SEQ ID NO: 13614 - DNA, 27 bp, Artificial Sequence
  Description of Artificial Sequence: Synthetic oligonucleotide
ggcagctgtggtggtaccttctggaga

SEQ ID NO: 13615 - DNA, 27 bp, Artificial Sequence
  Description of Artificial Sequence: Synthetic oligonucleotide
gcagctgtggtggtaccttctggagag

SEQ ID NO: 13616 - DNA, 27 bp, Artificial Sequence
  Description of Artificial Sequence: Synthetic oligonucleotide
cagctgtggtggtaccttctggagagg

SEQ ID NO: 13617 - DNA, 28 bp, Artificial Sequence
  Description of Artificial Sequence: Synthetic oligonucleotide
agctgtggtggtaccttctggagaggag

SEQ ID NO: 13618 - DNA, 27 bp, Artificial Sequence
  Description of Artificial Sequence: Synthetic oligonucleotide
gctgtggtggtaccttctggagaggag

SEQ ID NO: 13619 - DNA, 27 bp, Artificial Sequence
  Description of Artificial Sequence: Synthetic oligonucleotide
ctgtggtggtaccttctggagaggagc

SEQ ID NO: 13620 - DNA, 28 bp, Artificial Sequence
  Description of Artificial Sequence: Synthetic oligonucleotide
tgtggtggtaccttctggagaggagcag

SEQ ID NO: 13621 - DNA, 27 bp, Artificial Sequence
  Description of Artificial Sequence: Synthetic oligonucleotide
gtggtggtaccttctggagaggagcag

SEQ ID NO: 13622 - DNA, 28 bp, Artificial Sequence
  Description of Artificial Sequence: Synthetic oligonucleotide
tggtggtaccttctggagaggagcagag

SEQ ID NO: 13623 - DNA, 27 bp, Artificial Sequence
  Description of Artificial Sequence: Synthetic oligonucleotide
ggtggtaccttctggagaggagcagag

SEQ ID NO: 13624 - DNA, 30 bp, Artificial Sequence
  Description of Artificial Sequence: Synthetic oligonucleotide
gtggtaccttctggagaggagcagagatac

SEQ ID NO: 13625 - DNA, 31 bp, Artificial Sequence
  Description of Artificial Sequence: Synthetic oligonucleotide
tggtaccttctggagaggagcagagatacac

SEQ ID NO: 13626 - DNA, 30 bp, Artificial Sequence
  Description of Artificial Sequence: Synthetic oligonucleotide
ggtaccttctggagaggagcagagatacac

SEQ ID NO: 13627 - DNA, 30 bp, Artificial Sequence
  Description of Artificial Sequence: Synthetic oligonucleotide
gtaccttctggagaggagcagagatacacc

SEQ ID NO: 13628 - DNA, 31 bp, Artificial Sequence
  Description of Artificial Sequence: Synthetic oligonucleotide
taccttctggagaggagcagagatacacctg

SEQ ID NO: 13629 - DNA, 30 bp, Artificial Sequence
  Description of Artificial Sequence: Synthetic oligonucleotide
accttctggagaggagcagagatacacctg

SEQ ID NO: 13630 - DNA, 25 bp, Artificial Sequence
  Description of Artificial Sequence: Synthetic oligonucleotide
cccctcaccctgagatgggagccat

SEQ ID NO: 13631 - DNA, 27 bp, Artificial Sequence
  Description of Artificial Sequence: Synthetic oligonucleotide
ccctcaccctgagatgggagccatctt

SEQ ID NO: 13632 - DNA, 27 bp, Artificial Sequence
  Description of Artificial Sequence: Synthetic oligonucleotide
cctcaccctgagatgggagccatcttc

SEQ ID NO: 13633 - DNA, 27 bp, Artificial Sequence
  Description of Artificial Sequence: Synthetic oligonucleotide
ctcaccctgagatgggagccatcttcc

SEQ ID NO: 13634 - DNA, 27 bp, Artificial Sequence
  Description of Artificial Sequence: Synthetic oligonucleotide
tcaccctgagatgggagccatcttccc

SEQ ID NO: 13635 - DNA, 27 bp, Artificial Sequence
  Description of Artificial Sequence: Synthetic oligonucleotide
caccctgagatgggagccatcttccca

SEQ ID NO: 13636 - DNA, 27 bp, Artificial Sequence
  Description of Artificial Sequence: Synthetic oligonucleotide
accctgagatgggagccatcttcccag

SEQ ID NO: 13637 - DNA, 26 bp, Artificial Sequence
  Description of Artificial Sequence: Synthetic oligonucleotide
ccctgagatgggagccatcttcccag

SEQ ID NO: 13638 - DNA, 26 bp, Artificial Sequence
  Description of Artificial Sequence: Synthetic oligonucleotide
cctgagatgggagccatcttcccagc

SEQ ID NO: 13639 - DNA, 26 bp, Artificial Sequence
  Description of Artificial Sequence: Synthetic oligonucleotide
ctgagatgggagccatcttcccagcc

SEQ ID NO: 13640 - DNA, 27 bp, Artificial Sequence
  Description of Artificial Sequence: Synthetic oligonucleotide
tgagatgggagccatcttcccagccca

SEQ ID NO: 13641 - DNA, 26 bp, Artificial Sequence
  Description of Artificial Sequence: Synthetic oligonucleotide
gagatgggagccatcttcccagccca

SEQ ID NO: 13642 - DNA, 26 bp, Artificial Sequence
  Description of Artificial Sequence: Synthetic oligonucleotide
agatgggagccatcttcccagcccac

SEQ ID NO: 13643 - DNA, 25 bp, Artificial Sequence
  Description of Artificial Sequence: Synthetic oligonucleotide
gatgggagccatcttcccagcccac

SEQ ID NO: 13644 - DNA, 25 bp, Artificial Sequence
  Description of Artificial Sequence: Synthetic oligonucleotide
atgggagccatcttcccagcccacc

SEQ ID NO: 13645 - DNA, 24 bp, Artificial Sequence
  Description of Artificial Sequence: Synthetic oligonucleotide
tgggagccatcttcccagcccacc

SEQ ID NO: 13646 - DNA, 23 bp, Artificial Sequence
  Description of Artificial Sequence: Synthetic oligonucleotide
gggagccatcttcccagcccacc

SEQ ID NO: 13647 - DNA, 24 bp, Artificial Sequence
  Description of Artificial Sequence: Synthetic oligonucleotide
ggagccatcttcccagcccaccgt

SEQ ID NO: 13648 - DNA, 24 bp, Artificial Sequence
  Description of Artificial Sequence: Synthetic oligonucleotide
gagccatcttcccagcccaccgtc

SEQ ID NO: 13649 - DNA, 25 bp, Artificial Sequence
  Description of Artificial Sequence: Synthetic oligonucleotide
agccatcttcccagcccaccgtcca

SEQ ID NO: 13650 - DNA, 24 bp, Artificial Sequence
  Description of Artificial Sequence: Synthetic oligonucleotide
gccatcttcccagcccaccgtcca

SEQ ID NO: 13651 - DNA, 26 bp, Artificial Sequence
  Description of Artificial Sequence: Synthetic oligonucleotide
ccatcttcccagcccaccgtccacat

SEQ ID NO: 13652 - DNA, 26 bp, Artificial Sequence
  Description of Artificial Sequence: Synthetic oligonucleotide
catcttcccagcccaccgtccacatc

SEQ ID NO: 13653 - DNA, 27 bp, Artificial Sequence
  Description of Artificial Sequence: Synthetic oligonucleotide
atcttcccagcccaccgtccacatcgt

SEQ ID NO: 13654 - DNA, 26 bp, Artificial Sequence
  Description of Artificial Sequence: Synthetic oligonucleotide
tcttcccagcccaccgtccacatcgt

SEQ ID NO: 13655 - DNA, 25 bp, Artificial Sequence
  Description of Artificial Sequence: Synthetic oligonucleotide
cttcccagcccaccgtccacatcgt

SEQ ID NO: 13656 - DNA, 25 bp, Artificial Sequence
  Description of Artificial Sequence: Synthetic oligonucleotide
ttcccagcccaccgtccacatcgtg

SEQ ID NO: 13657 - DNA, 24 bp, Artificial Sequence
  Description of Artificial Sequence: Synthetic oligonucleotide
tcccagcccaccgtccacatcgtg

SEQ ID NO: 13658 - DNA, 23 bp, Artificial Sequence
  Description of Artificial Sequence: Synthetic oligonucleotide
cccagcccaccgtccacatcgtg

SEQ ID NO: 13659 - DNA, 23 bp, Artificial Sequence
  Description of Artificial Sequence: Synthetic oligonucleotide
ccagcccaccgtccacatcgtgg

SEQ ID NO: 13660 - DNA, 23 bp, Artificial Sequence
  Description of Artificial Sequence: Synthetic oligonucleotide
cagcccaccgtccacatcgtggg

SEQ ID NO: 13661 - DNA, 25 bp, Artificial Sequence
  Description of Artificial Sequence: Synthetic oligonucleotide
agcccaccgtccacatcgtgggcat

SEQ ID NO: 13662 - DNA, 24 bp, Artificial Sequence
  Description of Artificial Sequence: Synthetic oligonucleotide
gcccaccgtccacatcgtgggcat

SEQ ID NO: 13663 - DNA, 27 bp, Artificial Sequence
  Description of Artificial Sequence: Synthetic oligonucleotide
cccaccgtccacatcgtgggcatcatt

SEQ ID NO: 13664 - DNA, 27 bp, Artificial Sequence
  Description of Artificial Sequence: Synthetic oligonucleotide
ccaccgtccacatcgtgggcatcattg

SEQ ID NO: 13665 - DNA, 27 bp, Artificial Sequence
  Description of Artificial Sequence: Synthetic oligonucleotide
caccgtccacatcgtgggcatcattgc

SEQ ID NO: 13666 - DNA, 28 bp, Artificial Sequence
  Description of Artificial Sequence: Synthetic oligonucleotide
accgtccacatcgtgggcatcattgctg

SEQ ID NO: 13667 - DNA, 27 bp, Artificial Sequence
  Description of Artificial Sequence: Synthetic oligonucleotide
ccgtccacatcgtgggcatcattgctg

SEQ ID NO: 13668 - DNA, 27 bp, Artificial Sequence
  Description of Artificial Sequence: Synthetic oligonucleotide
cgtccacatcgtgggcatcattgctgg

SEQ ID NO: 13669 - DNA, 27 bp, Artificial Sequence
  Description of Artificial Sequence: Synthetic oligonucleotide
gtccacatcgtgggcatcattgctggc

SEQ ID NO: 13670 - DNA, 27 bp, Artificial Sequence
  Description of Artificial Sequence: Synthetic oligonucleotide
tccacatcgtgggcatcattgctggcc

SEQ ID NO: 13671 - DNA, 27 bp, Artificial Sequence
  Description of Artificial Sequence: Synthetic oligonucleotide
ccacatcgtgggcatcattgctggcct

SEQ ID NO: 13672 - DNA, 27 bp, Artificial Sequence
  Description of Artificial Sequence: Synthetic oligonucleotide
cacatcgtgggcatcattgctggcctg

SEQ ID NO: 13673 - DNA, 27 bp, Artificial Sequence
  Description of Artificial Sequence: Synthetic oligonucleotide
acatcgtgggcatcattgctggcctgg

SEQ ID NO: 13674 - DNA, 27 bp, Artificial Sequence
  Description of Artificial Sequence: Synthetic oligonucleotide
gtcgctgctgtgatgtggaggaggaac

SEQ ID NO: 13675 - DNA, 28 bp, Artificial Sequence
  Description of Artificial Sequence: Synthetic oligonucleotide
tcgctgctgtgatgtggaggaggaacag

SEQ ID NO: 13676 - DNA, 27 bp, Artificial Sequence
  Description of Artificial Sequence: Synthetic oligonucleotide
cgctgctgtgatgtggaggaggaacag

SEQ ID NO: 13677 - DNA, 27 bp, Artificial Sequence
  Description of Artificial Sequence: Synthetic oligonucleotide
gctgctgtgatgtggaggaggaacagc

SEQ ID NO: 13678 - DNA, 28 bp, Artificial Sequence
  Description of Artificial Sequence: Synthetic oligonucleotide
ctgctgtgatgtggaggaggaacagctc

SEQ ID NO: 13679 - DNA, 29 bp, Artificial Sequence
  Description of Artificial Sequence: Synthetic oligonucleotide
tgctgtgatgtggaggaggaacagctcag

SEQ ID NO: 13680 - DNA, 28 bp, Artificial Sequence
  Description of Artificial Sequence: Synthetic oligonucleotide
gctgtgatgtggaggaggaacagctcag

SEQ ID NO: 13681 - DNA, 31 bp, Artificial Sequence
  Description of Artificial Sequence: Synthetic oligonucleotide
ctgtgatgtggaggaggaacagctcagatag

SEQ ID NO: 13682 - DNA, 35 bp, Artificial Sequence
  Description of Artificial Sequence: Synthetic oligonucleotide
tgtgatgtggaggaggaacagctcagatagaaaag

SEQ ID NO: 13683 - DNA, 34 bp, Artificial Sequence
  Description of Artificial Sequence: Synthetic oligonucleotide
gtgatgtggaggaggaacagctcagatagaaaag

SEQ ID NO: 13684 - DNA, 34 bp, Artificial Sequence
  Description of Artificial Sequence: Synthetic oligonucleotide
tgatgtggaggaggaacagctcagatagaaaagg

SEQ ID NO: 13685 - DNA, 33 bp, Artificial Sequence
  Description of Artificial Sequence: Synthetic oligonucleotide
gatgtggaggaggaacagctcagatagaaaagg

SEQ ID NO: 13686 - DNA, 34 bp, Artificial Sequence
  Description of Artificial Sequence: Synthetic oligonucleotide
atgtggaggaggaacagctcagatagaaaaggag

SEQ ID NO: 13687 - DNA, 33 bp, Artificial Sequence
  Description of Artificial Sequence: Synthetic oligonucleotide
tgtggaggaggaacagctcagatagaaaaggag

SEQ ID NO: 13688 - DNA, 32 bp, Artificial Sequence
  Description of Artificial Sequence: Synthetic oligonucleotide
gtggaggaggaacagctcagatagaaaaggag

SEQ ID NO: 13689 - DNA, 32 bp, Artificial Sequence
  Description of Artificial Sequence: Synthetic oligonucleotide
tggaggaggaacagctcagatagaaaaggagg

SEQ ID NO: 13690 - DNA, 31 bp, Artificial Sequence
  Description of Artificial Sequence: Synthetic oligonucleotide
ggaggaggaacagctcagatagaaaaggagg

SEQ ID NO: 13691 - DNA, 31 bp, Artificial Sequence
  Description of Artificial Sequence: Synthetic oligonucleotide
gaggaggaacagctcagatagaaaaggaggg

SEQ ID NO: 13692 - DNA, 32 bp, Artificial Sequence
  Description of Artificial Sequence: Synthetic oligonucleotide
aggaggaacagctcagatagaaaaggagggag

SEQ ID NO: 13693 - DNA, 31 bp, Artificial Sequence
  Description of Artificial Sequence: Synthetic oligonucleotide
ggaggaacagctcagatagaaaaggagggag

SEQ ID NO: 13694 - DNA, 31 bp, Artificial Sequence
  Description of Artificial Sequence: Synthetic oligonucleotide
gaggaacagctcagatagaaaaggagggagc

SEQ ID NO: 13695 - DNA, 33 bp, Artificial Sequence
  Description of Artificial Sequence: Synthetic oligonucleotide
aggaacagctcagatagaaaaggagggagctac

SEQ ID NO: 13696 - DNA, 32 bp, Artificial Sequence
  Description of Artificial Sequence: Synthetic oligonucleotide
ggaacagctcagatagaaaaggagggagctac

SEQ ID NO: 13697 - DNA, 33 bp, Artificial Sequence
  Description of Artificial Sequence: Synthetic oligonucleotide
gaacagctcagatagaaaaggagggagctactc

SEQ ID NO: 13698 - DNA, 34 bp, Artificial Sequence
  Description of Artificial Sequence: Synthetic oligonucleotide
aacagctcagatagaaaaggagggagctactctc

SEQ ID NO: 13699 - DNA, 33 bp, Artificial Sequence
  Description of Artificial Sequence: Synthetic oligonucleotide
acagctcagatagaaaaggagggagctactctc

SEQ ID NO: 13700 - DNA, 32 bp, Artificial Sequence
  Description of Artificial Sequence: Synthetic oligonucleotide
cagctcagatagaaaaggagggagctactctc

SEQ ID NO: 13701 - DNA, 32 bp, Artificial Sequence
  Description of Artificial Sequence: Synthetic oligonucleotide
gctcccattccatgaggtatttctccacatcc

SEQ ID NO: 13702 - DNA, 32 bp, Artificial Sequence
  Description of Artificial Sequence: Synthetic oligonucleotide
ctcccattccatgaggtatttctccacatccg

SEQ ID NO: 13703 - DNA, 33 bp, Artificial Sequence
  Description of Artificial Sequence: Synthetic oligonucleotide
tcccattccatgaggtatttctccacatccgtg

SEQ ID NO: 13704 - DNA, 32 bp, Artificial Sequence
  Description of Artificial Sequence: Synthetic oligonucleotide
cccattccatgaggtatttctccacatccgtg

SEQ ID NO: 13705 - DNA, 33 bp, Artificial Sequence
  Description of Artificial Sequence: Synthetic oligonucleotide
ccattccatgaggtatttctccacatccgtgtc

SEQ ID NO: 13706 - DNA, 33 bp, Artificial Sequence
  Description of Artificial Sequence: Synthetic oligonucleotide
cattccatgaggtatttctccacatccgtgtcc

SEQ ID NO: 13707 - DNA, 33 bp, Artificial Sequence
  Description of Artificial Sequence: Synthetic oligonucleotide
attccatgaggtatttctccacatccgtgtccc

SEQ ID NO: 13708 - DNA, 32 bp, Artificial Sequence
  Description of Artificial Sequence: Synthetic oligonucleotide
ttccatgaggtatttctccacatccgtgtccc

SEQ ID NO: 13709 - DNA, 21 bp, Artificial Sequence
  Description of Artificial Sequence: Synthetic oligonucleotide
cggcccgtgtggcggagcagt

SEQ ID NO: 13710 - DNA, 21 bp, Artificial Sequence
  Description of Artificial Sequence: Synthetic oligonucleotide
ggcccgtgtggcggagcagtg

SEQ ID NO: 13711 - DNA, 22 bp, Artificial Sequence
  Description of Artificial Sequence: Synthetic oligonucleotide
gcccgtgtggcggagcagtgga

SEQ ID NO: 13712 - DNA, 23 bp, Artificial Sequence
  Description of Artificial Sequence: Synthetic oligonucleotide
cccgtgtggcggagcagtggaga

SEQ ID NO: 13713 - DNA, 23 bp, Artificial Sequence
  Description of Artificial Sequence: Synthetic oligonucleotide
ccgtgtggcggagcagtggagag

SEQ ID NO: 13714 - DNA, 23 bp, Artificial Sequence
  Description of Artificial Sequence: Synthetic oligonucleotide
cgtgtggcggagcagtggagagc

SEQ ID NO: 13715 - DNA, 25 bp, Artificial Sequence
  Description of Artificial Sequence: Synthetic oligonucleotide
gtgtggcggagcagtggagagccta

SEQ ID NO: 13716 - DNA, 28 bp, Artificial Sequence
  Description of Artificial Sequence: Synthetic oligonucleotide
gctcccactccatgaggtgtttctccac

SEQ ID NO: 13717 - DNA, 30 bp, Artificial Sequence
  Description of Artificial Sequence: Synthetic oligonucleotide
ctcccactccatgaggtgtttctccacatc

SEQ ID NO: 13718 - DNA, 30 bp, Artificial Sequence
  Description of Artificial Sequence: Synthetic oligonucleotide
tcccactccatgaggtgtttctccacatcc

SEQ ID NO: 13719 - DNA, 29 bp, Artificial Sequence
  Description of Artificial Sequence: Synthetic oligonucleotide
cccactccatgaggtgtttctccacatcc

SEQ ID NO: 13720 - DNA, 29 bp, Artificial Sequence
  Description of Artificial Sequence: Synthetic oligonucleotide
ccactccatgaggtgtttctccacatccg

SEQ ID NO: 13721 - DNA, 30 bp, Artificial Sequence
  Description of Artificial Sequence: Synthetic oligonucleotide
cactccatgaggtgtttctccacatccgtg

SEQ ID NO: 13722 - DNA, 31 bp, Artificial Sequence
  Description of Artificial Sequence: Synthetic oligonucleotide
actccatgaggtgtttctccacatccgtgtc

SEQ ID NO: 13723 - DNA, 30 bp, Artificial Sequence
  Description of Artificial Sequence: Synthetic oligonucleotide
ctccatgaggtgtttctccacatccgtgtc

SEQ ID NO: 13724 - DNA, 30 bp, Artificial Sequence
  Description of Artificial Sequence: Synthetic oligonucleotide
tccatgaggtgtttctccacatccgtgtcc

SEQ ID NO: 13725 - DNA, 29 bp, Artificial Sequence
  Description of Artificial Sequence: Synthetic oligonucleotide
ccatgaggtgtttctccacatccgtgtcc

SEQ ID NO: 13726 - DNA, 29 bp, Artificial Sequence
  Description of Artificial Sequence: Synthetic oligonucleotide
catgaggtgtttctccacatccgtgtccc

SEQ ID NO: 13727 - DNA, 29 bp, Artificial Sequence
  Description of Artificial Sequence: Synthetic oligonucleotide
atgaggtgtttctccacatccgtgtcccg

SEQ ID NO: 13728 - DNA, 28 bp, Artificial Sequence
  Description of Artificial Sequence: Synthetic oligonucleotide
tgaggtgtttctccacatccgtgtcccg

SEQ ID NO: 13729 - DNA, 27 bp, Artificial Sequence
  Description of Artificial Sequence: Synthetic oligonucleotide
gaggtgtttctccacatccgtgtcccg

SEQ ID NO: 13730 - DNA, 27 bp, Artificial Sequence
  Description of Artificial Sequence: Synthetic oligonucleotide
aggtgtttctccacatccgtgtcccgg

SEQ ID NO: 13731 - DNA, 26 bp, Artificial Sequence
  Description of Artificial Sequence: Synthetic oligonucleotide
ggtgtttctccacatccgtgtcccgg

SEQ ID NO: 13732 - DNA, 26 bp, Artificial Sequence
  Description of Artificial Sequence: Synthetic oligonucleotide
gtgtttctccacatccgtgtcccggc

SEQ ID NO: 13733 - DNA, 26 bp, Artificial Sequence
  Description of Artificial Sequence: Synthetic oligonucleotide
tgtttctccacatccgtgtcccggcc

SEQ ID NO: 13734 - DNA, 25 bp, Artificial Sequence
  Description of Artificial Sequence: Synthetic oligonucleotide
gtttctccacatccgtgtcccggcc

SEQ ID NO: 13735 - DNA, 26 bp, Artificial Sequence
  Description of Artificial Sequence: Synthetic oligonucleotide
cggatcgcgctccgctactacaacga

SEQ ID NO: 13736 - DNA, 27 bp, Artificial Sequence
  Description of Artificial Sequence: Synthetic oligonucleotide
ggatcgcgctccgctactacaacgaga

SEQ ID NO: 13737 - DNA, 27 bp, Artificial Sequence
  Description of Artificial Sequence: Synthetic oligonucleotide
gatcgcgctccgctactacaacgagag

SEQ ID NO: 13738 - DNA, 27 bp, Artificial Sequence
  Description of Artificial Sequence: Synthetic oligonucleotide
atcgcgctccgctactacaacgagagc

SEQ ID NO: 13739 - DNA, 26 bp, Artificial Sequence
  Description of Artificial Sequence: Synthetic oligonucleotide
tcgcgctccgctactacaacgagagc

SEQ ID NO: 13740 - DNA, 25 bp, Artificial Sequence
  Description of Artificial Sequence: Synthetic oligonucleotide
cgcgctccgctactacaacgagagc

SEQ ID NO: 13741 - DNA, 26 bp, Artificial Sequence
  Description of Artificial Sequence: Synthetic oligonucleotide
gcgctccgctactacaacgagagcga

SEQ ID NO: 13742 - DNA, 26 bp, Artificial Sequence
  Description of Artificial Sequence: Synthetic oligonucleotide
cgctccgctactacaacgagagcgag

SEQ ID NO: 13743 - DNA, 26 bp, Artificial Sequence
  Description of Artificial Sequence: Synthetic oligonucleotide
gctccgctactacaacgagagcgagg

SEQ ID NO: 13744 - DNA, 26 bp, Artificial Sequence
  Description of Artificial Sequence: Synthetic oligonucleotide
ctccgctactacaacgagagcgaggc

SEQ ID NO: 13745 - DNA, 26 bp, Artificial Sequence
  Description of Artificial Sequence: Synthetic oligonucleotide
tccgctactacaacgagagcgaggcc

SEQ ID NO: 13746 - DNA, 25 bp, Artificial Sequence
  Description of Artificial Sequence: Synthetic oligonucleotide
ccgctactacaacgagagcgaggcc

SEQ ID NO: 13747 - DNA, 25 bp, Artificial Sequence
  Description of Artificial Sequence: Synthetic oligonucleotide
cgctactacaacgagagcgaggccg

SEQ ID NO: 13748 - DNA, 25 bp, Artificial Sequence
  Description of Artificial Sequence: Synthetic oligonucleotide
ctacctggagggcacgtgagtggac

SEQ ID NO: 13749 - DNA, 25 bp, Artificial Sequence
  Description of Artificial Sequence: Synthetic oligonucleotide
tacctggagggcacgtgagtggacg

SEQ ID NO: 13750 - DNA, 24 bp, Artificial Sequence
  Description of Artificial Sequence: Synthetic oligonucleotide
acctggagggcacgtgagtggacg

SEQ ID NO: 13751 - DNA, 23 bp, Artificial Sequence
  Description of Artificial Sequence: Synthetic oligonucleotide
cctggagggcacgtgagtggacg

SEQ ID NO: 13752 - DNA, 23 bp, Artificial Sequence
  Description of Artificial Sequence: Synthetic oligonucleotide
ctggagggcacgtgagtggacgg

SEQ ID NO: 13753 - DNA, 23 bp, Artificial Sequence
  Description of Artificial Sequence: Synthetic oligonucleotide
tggagggcacgtgagtggacggg

SEQ ID NO: 13754 - DNA, 22 bp, Artificial Sequence
  Description of Artificial Sequence: Synthetic oligonucleotide
ggagggcacgtgagtggacggg

SEQ ID NO: 13755 - DNA, 23 bp, Artificial Sequence
  Description of Artificial Sequence: Synthetic oligonucleotide
gagggcacgtgagtggacgggct

SEQ ID NO: 13756 - DNA, 23 bp, Artificial Sequence
  Description of Artificial Sequence: Synthetic oligonucleotide
agggcacgtgagtggacgggctc

SEQ ID NO: 13757 - DNA, 22 bp, Artificial Sequence
  Description of Artificial Sequence: Synthetic oligonucleotide
gggcacgtgagtggacgggctc

SEQ ID NO: 13758 - DNA, 22 bp, Artificial Sequence
  Description of Artificial Sequence: Synthetic oligonucleotide
ggcacgtgagtggacgggctcc

SEQ ID NO: 13759 - DNA, 22 bp, Artificial Sequence
  Description of Artificial Sequence: Synthetic oligonucleotide
gcacgtgagtggacgggctccg

SEQ ID NO: 13760 - DNA, 23 bp, Artificial Sequence
  Description of Artificial Sequence: Synthetic oligonucleotide
cacgtgagtggacgggctccgca

SEQ ID NO: 13761 - DNA, 26 bp, Artificial Sequence
  Description of Artificial Sequence: Synthetic oligonucleotide
acgtgagtggacgggctccgcagata

SEQ ID NO: 13762 - DNA, 25 bp, Artificial Sequence
  Description of Artificial Sequence: Synthetic oligonucleotide
cgtgagtggacgggctccgcagata

SEQ ID NO: 13763 - DNA, 25 bp, Artificial Sequence
  Description of Artificial Sequence: Synthetic oligonucleotide
gtgagtggacgggctccgcagatac

SEQ ID NO: 13764 - DNA, 26 bp, Artificial Sequence
  Description of Artificial Sequence: Synthetic oligonucleotide
tgagtggacgggctccgcagatacct

SEQ ID NO: 13765 - DNA, 25 bp, Artificial Sequence
  Description of Artificial Sequence: Synthetic oligonucleotide
gagtggacgggctccgcagatacct

SEQ ID NO: 13766 - DNA, 25 bp, Artificial Sequence
  Description of Artificial Sequence: Synthetic oligonucleotide
agtggacgggctccgcagatacctg

SEQ ID NO: 13767 - DNA, 22 bp, Artificial Sequence
  Description of Artificial Sequence: Synthetic oligonucleotide
ccccgcttcatcgccgtgggca

SEQ ID NO: 13768 - DNA, 22 bp, Artificial Sequence
  Description of Artificial Sequence: Synthetic oligonucleotide
cccgcttcatcgccgtgggcag

SEQ ID NO: 13769 - DNA, 22 bp, Artificial Sequence
  Description of Artificial Sequence: Synthetic oligonucleotide
ccgcttcatcgccgtgggcagc

SEQ ID NO: 13770 - DNA, 22 bp, Artificial Sequence
  Description of Artificial Sequence: Synthetic oligonucleotide
cgcttcatcgccgtgggcagcc

SEQ ID NO: 13771 - DNA, 22 bp, Artificial Sequence
  Description of Artificial Sequence: Synthetic oligonucleotide
gcttcatcgccgtgggcagccc

SEQ ID NO: 13772 - DNA, 22 bp, Artificial Sequence
  Description of Artificial Sequence: Synthetic oligonucleotide
cttcatcgccgtgggcagcccc

SEQ ID NO: 13773 - DNA, 22 bp, Artificial Sequence
  Description of Artificial Sequence: Synthetic oligonucleotide
ttcatcgccgtgggcagccccg

SEQ ID NO: 13774 - DNA, 21 bp, Artificial Sequence
  Description of Artificial Sequence: Synthetic oligonucleotide
tcatcgccgtgggcagccccg

SEQ ID NO: 13775 - DNA, 20 bp, Artificial Sequence
  Description of Artificial Sequence: Synthetic oligonucleotide
catcgccgtgggcagccccg

SEQ ID NO: 13776 - DNA, 22 bp, Artificial Sequence
  Description of Artificial Sequence: Synthetic oligonucleotide
atcgccgtgggcagccccgctt

SEQ ID NO: 13777 - DNA, 21 bp, Artificial Sequence
  Description of Artificial Sequence: Synthetic oligonucleotide
tcgccgtgggcagccccgctt

SEQ ID NO: 13778 - DNA, 20 bp, Artificial Sequence
  Description of Artificial Sequence: Synthetic oligonucleotide
cgccgtgggcagccccgctt

SEQ ID NO: 13779 - DNA, 22 bp, Artificial Sequence
  Description of Artificial Sequence: Synthetic oligonucleotide
gccgtgggcagccccgcttcat

SEQ ID NO: 13780 - DNA, 22 bp, Artificial Sequence
  Description of Artificial Sequence: Synthetic oligonucleotide
ccgtgggcagccccgcttcatc

SEQ ID NO: 13781 - DNA, 22 bp, Artificial Sequence
  Description of Artificial Sequence: Synthetic oligonucleotide
cgtgggcagccccgcttcatcg

SEQ ID NO: 13782 - DNA, 22 bp, Artificial Sequence
  Description of Artificial Sequence: Synthetic oligonucleotide
gtgggcagccccgcttcatcgc

SEQ ID NO: 13783 - DNA, 22 bp, Artificial Sequence
  Description of Artificial Sequence: Synthetic oligonucleotide
tgggcagccccgcttcatcgcc

SEQ ID NO: 13784 - DNA, 21 bp, Artificial Sequence
  Description of Artificial Sequence: Synthetic oligonucleotide
gggcagccccgcttcatcgcc

SEQ ID NO: 13785 - DNA, 22 bp, Artificial Sequence
  Description of Artificial Sequence: Synthetic oligonucleotide
ggcagccccgcttcatcgccgt

SEQ ID NO: 13786 - DNA, 22 bp, Artificial Sequence
  Description of Artificial Sequence: Synthetic oligonucleotide
gcagccccgcttcatcgccgtg

SEQ ID NO: 13787 - DNA, 22 bp, Artificial Sequence
  Description of Artificial Sequence: Synthetic oligonucleotide
cagccccgcttcatcgccgtgg

SEQ ID NO: 13788 - DNA, 27 bp, Artificial Sequence
  Description of Artificial Sequence: Synthetic oligonucleotide
aggcccactcacagactcaccgagaga

SEQ ID NO: 13789 - DNA, 27 bp, Artificial Sequence
  Description of Artificial Sequence: Synthetic oligonucleotide
ggcccactcacagactcaccgagagaa

SEQ ID NO: 13790 - DNA, 27 bp, Artificial Sequence
  Description of Artificial Sequence: Synthetic oligonucleotide
gcccactcacagactcaccgagagaac

SEQ ID NO: 13791 - DNA, 27 bp, Artificial Sequence
  Description of Artificial Sequence: Synthetic oligonucleotide
cccactcacagactcaccgagagaacc

SEQ ID NO: 13792 - DNA, 28 bp, Artificial Sequence
  Description of Artificial Sequence: Synthetic oligonucleotide
ccactcacagactcaccgagagaacctg

SEQ ID NO: 13793 - DNA, 28 bp, Artificial Sequence
  Description of Artificial Sequence: Synthetic oligonucleotide
cactcacagactcaccgagagaacctgc

SEQ ID NO: 13794 - DNA, 28 bp, Artificial Sequence
  Description of Artificial Sequence: Synthetic oligonucleotide
actcacagactcaccgagagaacctgcg

SEQ ID NO: 13795 - DNA, 27 bp, Artificial Sequence
  Description of Artificial Sequence: Synthetic oligonucleotide
ctcacagactcaccgagagaacctgcg

SEQ ID NO: 13796 - DNA, 27 bp, Artificial Sequence
  Description of Artificial Sequence: Synthetic oligonucleotide
tcacagactcaccgagagaacctgcgg

SEQ ID NO: 13797 - DNA, 27 bp, Artificial Sequence
  Description of Artificial Sequence: Synthetic oligonucleotide
cacagactcaccgagagaacctgcgga

SEQ ID NO: 13798 - DNA, 28 bp, Artificial Sequence
  Description of Artificial Sequence: Synthetic oligonucleotide
acagactcaccgagagaacctgcggatc

SEQ ID NO: 13799 - DNA, 27 bp, Artificial Sequence
  Description of Artificial Sequence: Synthetic oligonucleotide
cagactcaccgagagaacctgcggatc

SEQ ID NO: 13800 - DNA, 27 bp, Artificial Sequence
  Description of Artificial Sequence: Synthetic oligonucleotide
agactcaccgagagaacctgcggatcg

SEQ ID NO: 13801 - DNA, 26 bp, Artificial Sequence
  Description of Artificial Sequence: Synthetic oligonucleotide
gactcaccgagagaacctgcggatcg

SEQ ID NO: 13802 - DNA, 26 bp, Artificial Sequence
  Description of Artificial Sequence: Synthetic oligonucleotide
actcaccgagagaacctgcggatcgc

SEQ ID NO: 13803 - DNA, 25 bp, Artificial Sequence
  Description of Artificial Sequence: Synthetic oligonucleotide
ctcaccgagagaacctgcggatcgc

SEQ ID NO: 13804 - DNA, 25 bp, Artificial Sequence
  Description of Artificial Sequence: Synthetic oligonucleotide
tcaccgagagaacctgcggatcgcg

SEQ ID NO: 13805 - DNA, 24 bp, Artificial Sequence
  Description of Artificial Sequence: Synthetic oligonucleotide
caccgagagaacctgcggatcgcg

SEQ ID NO: 13806 - DNA, 27 bp, Artificial Sequence
  Description of Artificial Sequence: Synthetic oligonucleotide
gaaggcccagtcacagactgaccgaga

SEQ ID NO: 13807 - DNA, 27 bp, Artificial Sequence
  Description of Artificial Sequence: Synthetic oligonucleotide
aaggcccagtcacagactgaccgagag

SEQ ID NO: 13808 - DNA, 27 bp, Artificial Sequence
  Description of Artificial Sequence: Synthetic oligonucleotide
aggcccagtcacagactgaccgagaga

SEQ ID NO: 13809 - DNA, 27 bp, Artificial Sequence
  Description of Artificial Sequence: Synthetic oligonucleotide
ggcccagtcacagactgaccgagagaa

SEQ ID NO: 13810 - DNA, 27 bp, Artificial Sequence
  Description of Artificial Sequence: Synthetic oligonucleotide
gcccagtcacagactgaccgagagaac

SEQ ID NO: 13811 - DNA, 27 bp, Artificial Sequence
  Description of Artificial Sequence: Synthetic oligonucleotide
cccagtcacagactgaccgagagaacc

SEQ ID NO: 13812 - DNA, 28 bp, Artificial Sequence
  Description of Artificial Sequence: Synthetic oligonucleotide
ccagtcacagactgaccgagagaacctg

SEQ ID NO: 13813 - DNA, 28 bp, Artificial Sequence
  Description of Artificial Sequence: Synthetic oligonucleotide
cagtcacagactgaccgagagaacctgc

SEQ ID NO: 13814 - DNA, 28 bp, Artificial Sequence
  Description of Artificial Sequence: Synthetic oligonucleotide
agtcacagactgaccgagagaacctgcg

SEQ ID NO: 13815 - DNA, 27 bp, Artificial Sequence
  Description of Artificial Sequence: Synthetic oligonucleotide
gtcacagactgaccgagagaacctgcg

SEQ ID NO: 13816 - DNA, 21 bp, Artificial Sequence
  Description of Artificial Sequence: Synthetic oligonucleotide
ggcccgtgtggcggagcagct

SEQ ID NO: 13817 - DNA, 22 bp, Artificial Sequence
  Description of Artificial Sequence: Synthetic oligonucleotide
gcccgtgtggcggagcagctga

SEQ ID NO: 13818 - DNA, 23 bp, Artificial Sequence
  Description of Artificial Sequence: Synthetic oligonucleotide
cccgtgtggcggagcagctgaga

SEQ ID NO: 13819 - DNA, 23 bp, Artificial Sequence
  Description of Artificial Sequence: Synthetic oligonucleotide
ccgtgtggcggagcagctgagag

SEQ ID NO: 13820 - DNA, 23 bp, Artificial Sequence
  Description of Artificial Sequence: Synthetic oligonucleotide
cgtgtggcggagcagctgagagc

SEQ ID NO: 13821 - DNA, 25 bp, Artificial Sequence
  Description of Artificial Sequence: Synthetic oligonucleotide
gtgtggcggagcagctgagagccta

SEQ ID NO: 13822 - DNA, 21 bp, Artificial Sequence
  Description of Artificial Sequence: Synthetic oligonucleotide
cgcggcggacatggcggctga

SEQ ID NO: 13823 - DNA, 23 bp, Artificial Sequence
  Description of Artificial Sequence: Synthetic oligonucleotide
gcggcggacatggcggctgagat

SEQ ID NO: 13824 - DNA, 24 bp, Artificial Sequence
  Description of Artificial Sequence: Synthetic oligonucleotide
cggcggacatggcggctgagatca

SEQ ID NO: 13825 - DNA, 24 bp, Artificial Sequence
  Description of Artificial Sequence: Synthetic oligonucleotide
ggcggacatggcggctgagatcac

SEQ ID NO: 13826 - DNA, 24 bp, Artificial Sequence
  Description of Artificial Sequence: Synthetic oligonucleotide
gcggacatggcggctgagatcacc

SEQ ID NO: 13827 - DNA, 25 bp, Artificial Sequence
  Description of Artificial Sequence: Synthetic oligonucleotide
cggacatggcggctgagatcaccca

SEQ ID NO: 13828 - DNA, 25 bp, Artificial Sequence
  Description of Artificial Sequence: Synthetic oligonucleotide
ggacatggcggctgagatcacccag

SEQ ID NO: 13829 - DNA, 25 bp, Artificial Sequence
  Description of Artificial Sequence: Synthetic oligonucleotide
gacatggcggctgagatcacccagc

SEQ ID NO: 13830 - DNA, 25 bp, Artificial Sequence
  Description of Artificial Sequence: Synthetic oligonucleotide
acatggcggctgagatcacccagcg

SEQ ID NO: 13831 - DNA, 24 bp, Artificial Sequence
  Description of Artificial Sequence: Synthetic oligonucleotide
catggcggctgagatcacccagcg

SEQ ID NO: 13832 - DNA, 26 bp, Artificial Sequence
  Description of Artificial Sequence: Synthetic oligonucleotide
atggcggctgagatcacccagcgcaa

SEQ ID NO: 13833 - DNA, 25 bp, Artificial Sequence
  Description of Artificial Sequence: Synthetic oligonucleotide
tggcggctgagatcacccagcgcaa

SEQ ID NO: 13834 - DNA, 24 bp, Artificial Sequence
  Description of Artificial Sequence: Synthetic oligonucleotide
ggcggctgagatcacccagcgcaa

SEQ ID NO: 13835 - DNA, 25 bp, Artificial Sequence
  Description of Artificial Sequence: Synthetic oligonucleotide
gcggctgagatcacccagcgcaagt

SEQ ID NO: 13836 - DNA, 25 bp, Artificial Sequence
  Description of Artificial Sequence: Synthetic oligonucleotide
cggctgagatcacccagcgcaagtg

SEQ ID NO: 13837 - DNA, 25 bp, Artificial Sequence
  Description of Artificial Sequence: Synthetic oligonucleotide
ggctgagatcacccagcgcaagtgg

SEQ ID NO: 13838 - DNA, 26 bp, Artificial Sequence
  Description of Artificial Sequence: Synthetic oligonucleotide
gctgagatcacccagcgcaagtggga

SEQ ID NO: 13839 - DNA, 26 bp, Artificial Sequence
  Description of Artificial Sequence: Synthetic oligonucleotide
ctgagatcacccagcgcaagtgggag

SEQ ID NO: 13840 - DNA, 26 bp, Artificial Sequence
  Description of Artificial Sequence: Synthetic oligonucleotide
tgagatcacccagcgcaagtgggagg

SEQ ID NO: 13841 - DNA, 25 bp, Artificial Sequence
  Description of Artificial Sequence: Synthetic oligonucleotide
gagatcacccagcgcaagtgggagg

SEQ ID NO: 13842 - DNA, 30 bp, Artificial Sequence
  Description of Artificial Sequence: Synthetic oligonucleotide
accctccagatgatgtttggctgcgacatg

SEQ ID NO: 13843 - DNA, 29 bp, Artificial Sequence
  Description of Artificial Sequence: Synthetic oligonucleotide
ccctccagatgatgtttggctgcgacatg

SEQ ID NO: 13844 - DNA, 29 bp, Artificial Sequence
  Description of Artificial Sequence: Synthetic oligonucleotide
cctccagatgatgtttggctgcgacatgg

SEQ ID NO: 13845 - DNA, 29 bp, Artificial Sequence
  Description of Artificial Sequence: Synthetic oligonucleotide
ctccagatgatgtttggctgcgacatggg

SEQ ID NO: 13846 - DNA, 29 bp, Artificial Sequence
  Description of Artificial Sequence: Synthetic oligonucleotide
tccagatgatgtttggctgcgacatgggg

SEQ ID NO: 13847 - DNA, 28 bp, Artificial Sequence
  Description of Artificial Sequence: Synthetic oligonucleotide
ccagatgatgtttggctgcgacatgggg

SEQ ID NO: 13848 - DNA, 29 bp, Artificial Sequence
  Description of Artificial Sequence: Synthetic oligonucleotide
cagatgatgtttggctgcgacatggggtc

SEQ ID NO: 13849 - DNA, 29 bp, Artificial Sequence
  Description of Artificial Sequence: Synthetic oligonucleotide
agatgatgtttggctgcgacatggggtcg

SEQ ID NO: 13850 - DNA, 28 bp, Artificial Sequence
  Description of Artificial Sequence: Synthetic oligonucleotide
gatgatgtttggctgcgacatggggtcg

SEQ ID NO: 13851 - DNA, 28 bp, Artificial Sequence
  Description of Artificial Sequence: Synthetic oligonucleotide
atgatgtttggctgcgacatggggtcgg

SEQ ID NO: 13852 - DNA, 27 bp, Artificial Sequence
  Description of Artificial Sequence: Synthetic oligonucleotide
tgatgtttggctgcgacatggggtcgg

SEQ ID NO: 13853 - DNA, 27 bp, Artificial Sequence
  Description of Artificial Sequence: Synthetic oligonucleotide
gatgtttggctgcgacatggggtcgga

SEQ ID NO: 13854 - DNA, 27 bp, Artificial Sequence
  Description of Artificial Sequence: Synthetic oligonucleotide
atgtttggctgcgacatggggtcggac

SEQ ID NO: 13855 - DNA, 26 bp, Artificial Sequence
  Description of Artificial Sequence: Synthetic oligonucleotide
tgtttggctgcgacatggggtcggac

SEQ ID NO: 13856 - DNA, 25 bp, Artificial Sequence
  Description of Artificial Sequence: Synthetic oligonucleotide
gtttggctgcgacatggggtcggac

SEQ ID NO: 13857 - DNA, 25 bp, Artificial Sequence
  Description of Artificial Sequence: Synthetic oligonucleotide
tttggctgcgacatggggtcggacg

SEQ ID NO: 13858 - DNA, 24 bp, Artificial Sequence
  Description of Artificial Sequence: Synthetic oligonucleotide
ttggctgcgacatggggtcggacg

SEQ ID NO: 13859 - DNA, 23 bp, Artificial Sequence
  Description of Artificial Sequence: Synthetic oligonucleotide
tggctgcgacatggggtcggacg

SEQ ID NO: 13860 - DNA, 22 bp, Artificial Sequence
  Description of Artificial Sequence: Synthetic oligonucleotide
ggctgcgacatggggtcggacg

SEQ ID NO: 13861 - DNA, 22 bp, Artificial Sequence
  Description of Artificial Sequence: Synthetic oligonucleotide
gctgcgacatggggtcggacgg

SEQ ID NO: 13862 - DNA, 22 bp, Artificial Sequence
  Description of Artificial Sequence: Synthetic oligonucleotide
ctgcgacatggggtcggacggg

SEQ ID NO: 13863 - DNA, 22 bp, Artificial Sequence
  Description of Artificial Sequence: Synthetic oligonucleotide
tgcgacatggggtcggacgggc

SEQ ID NO: 13864 - DNA, 21 bp, Artificial Sequence
  Description of Artificial Sequence: Synthetic oligonucleotide
gcgacatggggtcggacgggc

SEQ ID NO: 13865 - DNA, 21 bp, Artificial Sequence
  Description of Artificial Sequence: Synthetic oligonucleotide
cgacatggggtcggacgggcg

SEQ ID NO: 13866 - DNA, 23 bp, Artificial Sequence
  Description of Artificial Sequence: Synthetic oligonucleotide
gacatggggtcggacgggcgctt

SEQ ID NO: 13867 - DNA, 23 bp, Artificial Sequence
  Description of Artificial Sequence: Synthetic oligonucleotide
acatggggtcggacgggcgcttc

SEQ ID NO: 13868 - DNA, 22 bp, Artificial Sequence
  Description of Artificial Sequence: Synthetic oligonucleotide
catggggtcggacgggcgcttc

SEQ ID NO: 13869 - DNA, 23 bp, Artificial Sequence
  Description of Artificial Sequence: Synthetic oligonucleotide
atggggtcggacgggcgcttcct

SEQ ID NO: 13870 - DNA, 24 bp, Artificial Sequence
  Description of Artificial Sequence: Synthetic oligonucleotide
agccatcttcccagcccaccgtcc

SEQ ID NO: 13871 - DNA, 23 bp, Artificial Sequence
  Description of Artificial Sequence: Synthetic oligonucleotide
gccatcttcccagcccaccgtcc

SEQ ID NO: 13872 - DNA, 23 bp, Artificial Sequence
  Description of Artificial Sequence: Synthetic oligonucleotide
ccatcttcccagcccaccgtccc

SEQ ID NO: 13873 - DNA, 25 bp, Artificial Sequence
  Description of Artificial Sequence: Synthetic oligonucleotide
catcttcccagcccaccgtccccat

SEQ ID NO: 13874 - DNA, 25 bp, Artificial Sequence
  Description of Artificial Sequence: Synthetic oligonucleotide
atcttcccagcccaccgtccccatc

SEQ ID NO: 13875 - DNA, 24 bp, Artificial Sequence
  Description of Artificial Sequence: Synthetic oligonucleotide
tcttcccagcccaccgtccccatc

SEQ ID NO: 13876 - DNA, 23 bp, Artificial Sequence
  Description of Artificial Sequence: Synthetic oligonucleotide
cttcccagcccaccgtccccatc

SEQ ID NO: 13877 - DNA, 24 bp, Artificial Sequence
  Description of Artificial Sequence: Synthetic oligonucleotide
ttcccagcccaccgtccccatcgt

SEQ ID NO: 13878 - DNA, 23 bp, Artificial Sequence
  Description of Artificial Sequence: Synthetic oligonucleotide
tcccagcccaccgtccccatcgt

SEQ ID NO: 13879 - DNA, 22 bp, Artificial Sequence
  Description of Artificial Sequence: Synthetic oligonucleotide
cccagcccaccgtccccatcgt

SEQ ID NO: 13880 - DNA, 22 bp, Artificial Sequence
  Description of Artificial Sequence: Synthetic oligonucleotide
ccagcccaccgtccccatcgtg

SEQ ID NO: 13881 - DNA, 22 bp, Artificial Sequence
  Description of Artificial Sequence: Synthetic oligonucleotide
cagcccaccgtccccatcgtgg

SEQ ID NO: 13882 - DNA, 22 bp, Artificial Sequence
  Description of Artificial Sequence: Synthetic oligonucleotide
agcccaccgtccccatcgtggg

SEQ ID NO: 13883 - DNA, 21 bp, Artificial Sequence
  Description of Artificial Sequence: Synthetic oligonucleotide
gcccaccgtccccatcgtggg

SEQ ID NO: 13884 - DNA, 23 bp, Artificial Sequence
  Description of Artificial Sequence: Synthetic oligonucleotide
cccaccgtccccatcgtgggcat

SEQ ID NO: 13885 - DNA, 26 bp, Artificial Sequence
  Description of Artificial Sequence: Synthetic oligonucleotide
ccaccgtccccatcgtgggcatcatt

SEQ ID NO: 13886 - DNA, 26 bp, Artificial Sequence
  Description of Artificial Sequence: Synthetic oligonucleotide
caccgtccccatcgtgggcatcattg

SEQ ID NO: 13887 - DNA, 27 bp, Artificial Sequence
  Description of Artificial Sequence: Synthetic oligonucleotide
accgtccccatcgtgggcatcattgct

SEQ ID NO: 13888 - DNA, 26 bp, Artificial Sequence
  Description of Artificial Sequence: Synthetic oligonucleotide
ccgtccccatcgtgggcatcattgct

SEQ ID NO: 13889 - DNA, 26 bp, Artificial Sequence
  Description of Artificial Sequence: Synthetic oligonucleotide
cgtccccatcgtgggcatcattgctg

SEQ ID NO: 13890 - DNA, 26 bp, Artificial Sequence
  Description of Artificial Sequence: Synthetic oligonucleotide
gtccccatcgtgggcatcattgctgg

SEQ ID NO: 13891 - DNA, 25 bp, Artificial Sequence
  Description of Artificial Sequence: Synthetic oligonucleotide
ggaaggagacgctgcagcgcacgaa

SEQ ID NO: 13892 - DNA, 25 bp, Artificial Sequence
  Description of Artificial Sequence: Synthetic oligonucleotide
gaaggagacgctgcagcgcacgaac

SEQ ID NO: 13893 - DNA, 25 bp, Artificial Sequence
  Description of Artificial Sequence: Synthetic oligonucleotide
aaggagacgctgcagcgcacgaacc

SEQ ID NO: 13894 - DNA, 24 bp, Artificial Sequence
  Description of Artificial Sequence: Synthetic oligonucleotide
aggagacgctgcagcgcacgaacc

SEQ ID NO: 13895 - DNA, 23 bp, Artificial Sequence
  Description of Artificial Sequence: Synthetic oligonucleotide
ggagacgctgcagcgcacgaacc

SEQ ID NO: 13896 - DNA, 23 bp, Artificial Sequence
  Description of Artificial Sequence: Synthetic oligonucleotide
gagacgctgcagcgcacgaaccc

SEQ ID NO: 13897 - DNA, 23 bp, Artificial Sequence
  Description of Artificial Sequence: Synthetic oligonucleotide
agacgctgcagcgcacgaacccc

SEQ ID NO: 13898 - DNA, 22 bp, Artificial Sequence
  Description of Artificial Sequence: Synthetic oligonucleotide
gacgctgcagcgcacgaacccc

SEQ ID NO: 13899 - DNA, 22 bp, Artificial Sequence
  Description of Artificial Sequence: Synthetic oligonucleotide
acgctgcagcgcacgaaccccc

SEQ ID NO: 13900 - DNA, 21 bp, Artificial Sequence
  Description of Artificial Sequence: Synthetic oligonucleotide
cgctgcagcgcacgaaccccc

SEQ ID NO: 13901 - DNA, 21 bp, Artificial Sequence
  Description of Artificial Sequence: Synthetic oligonucleotide
gctgcagcgcacgaacccccc

SEQ ID NO: 13902 - DNA, 23 bp, Artificial Sequence
  Description of Artificial Sequence: Synthetic oligonucleotide
ctgcagcgcacgaacccccccaa

SEQ ID NO: 13903 - DNA, 24 bp, Artificial Sequence
  Description of Artificial Sequence: Synthetic oligonucleotide
tgcagcgcacgaacccccccaaga

SEQ ID NO: 13904 - DNA, 23 bp, Artificial Sequence
  Description of Artificial Sequence: Synthetic oligonucleotide
gcagcgcacgaacccccccaaga

SEQ ID NO: 13905 - DNA, 24 bp, Artificial Sequence
  Description of Artificial Sequence: Synthetic oligonucleotide
cagcgcacgaacccccccaagaca

SEQ ID NO: 13906 - DNA, 27 bp, Artificial Sequence
  Description of Artificial Sequence: Synthetic oligonucleotide
agcgcacgaacccccccaagacacata

SEQ ID NO: 13907 - DNA, 27 bp, Artificial Sequence
  Description of Artificial Sequence: Synthetic oligonucleotide
gcgcacgaacccccccaagacacatat

SEQ ID NO: 13908 - DNA, 27 bp, Artificial Sequence
  Description of Artificial Sequence: Synthetic oligonucleotide
cgcacgaacccccccaagacacatatg

SEQ ID NO: 13909 - DNA, 28 bp, Artificial Sequence
  Description of Artificial Sequence: Synthetic oligonucleotide
gcacgaacccccccaagacacatatgac

SEQ ID NO: 13910 - DNA, 28 bp, Artificial Sequence
  Description of Artificial Sequence: Synthetic oligonucleotide
cacgaacccccccaagacacatatgacc

SEQ ID NO: 13911 - DNA, 28 bp, Artificial Sequence
  Description of Artificial Sequence: Synthetic oligonucleotide
acgaacccccccaagacacatatgaccc

SEQ ID NO: 13912 - DNA, 27 bp, Artificial Sequence
  Description of Artificial Sequence: Synthetic oligonucleotide
cgaacccccccaagacacatatgaccc

SEQ ID NO: 13913 - DNA, 28 bp, Artificial Sequence
  Description of Artificial Sequence: Synthetic oligonucleotide
gaacccccccaagacacatatgacccac

SEQ ID NO: 13914 - DNA, 28 bp, Artificial Sequence
  Description of Artificial Sequence: Synthetic oligonucleotide
aacccccccaagacacatatgacccacc

SEQ ID NO: 13915 - DNA, 29 bp, Artificial Sequence
  Description of Artificial Sequence: Synthetic oligonucleotide
aggggatggaaccttccagaagtgggtag

SEQ ID NO: 13916 - DNA, 28 bp, Artificial Sequence
  Description of Artificial Sequence: Synthetic oligonucleotide
ggggatggaaccttccagaagtgggtag

SEQ ID NO: 13917 - DNA, 28 bp, Artificial Sequence
  Description of Artificial Sequence: Synthetic oligonucleotide
gggatggaaccttccagaagtgggtagc

SEQ ID NO: 13918 - DNA, 29 bp, Artificial Sequence
  Description of Artificial Sequence: Synthetic oligonucleotide
ggatggaaccttccagaagtgggtagctg

SEQ ID NO: 13919 - DNA, 30 bp, Artificial Sequence
  Description of Artificial Sequence: Synthetic oligonucleotide
gatggaaccttccagaagtgggtagctgtg

SEQ ID NO: 13920 - DNA, 30 bp, Artificial Sequence
  Description of Artificial Sequence: Synthetic oligonucleotide
atggaaccttccagaagtgggtagctgtgg

SEQ ID NO: 13921 - DNA, 29 bp, Artificial Sequence
  Description of Artificial Sequence: Synthetic oligonucleotide
tggaaccttccagaagtgggtagctgtgg

SEQ ID NO: 13922 - DNA, 28 bp, Artificial Sequence
  Description of Artificial Sequence: Synthetic oligonucleotide
ggaaccttccagaagtgggtagctgtgg

SEQ ID NO: 13923 - DNA, 29 bp, Artificial Sequence
  Description of Artificial Sequence: Synthetic oligonucleotide
gaaccttccagaagtgggtagctgtggtg

SEQ ID NO: 13924 - DNA, 29 bp, Artificial Sequence
  Description of Artificial Sequence: Synthetic oligonucleotide
aaccttccagaagtgggtagctgtggtgg

SEQ ID NO: 13925 - DNA, 28 bp, Artificial Sequence
  Description of Artificial Sequence: Synthetic oligonucleotide
accttccagaagtgggtagctgtggtgg

SEQ ID NO: 13926 - DNA, 27 bp, Artificial Sequence
  Description of Artificial Sequence: Synthetic oligonucleotide
ccttccagaagtgggtagctgtggtgg

SEQ ID NO: 13927 - DNA, 29 bp, Artificial Sequence
  Description of Artificial Sequence: Synthetic oligonucleotide
cttccagaagtgggtagctgtggtggtac

SEQ ID NO: 13928 - DNA, 29 bp, Artificial Sequence
  Description of Artificial Sequence: Synthetic oligonucleotide
ttccagaagtgggtagctgtggtggtacc

SEQ ID NO: 13929 - DNA, 28 bp, Artificial Sequence
  Description of Artificial Sequence: Synthetic oligonucleotide
tccagaagtgggtagctgtggtggtacc

SEQ ID NO: 13930 - DNA, 27 bp, Artificial Sequence
  Description of Artificial Sequence: Synthetic oligonucleotide
ccagaagtgggtagctgtggtggtacc

SEQ ID NO: 13931 - DNA, 29 bp, Artificial Sequence
  Description of Artificial Sequence: Synthetic oligonucleotide
cagaagtgggtagctgtggtggtaccttc

SEQ ID NO: 13932 - DNA, 30 bp, Artificial Sequence
  Description of Artificial Sequence: Synthetic oligonucleotide
agaagtgggtagctgtggtggtaccttctg

SEQ ID NO: 13933 - DNA, 29 bp, Artificial Sequence
  Description of Artificial Sequence: Synthetic oligonucleotide
gaagtgggtagctgtggtggtaccttctg

SEQ ID NO: 13934 - DNA, 29 bp, Artificial Sequence
  Description of Artificial Sequence: Synthetic oligonucleotide
aagtgggtagctgtggtggtaccttctgg

SEQ ID NO: 13935 - DNA, 28 bp, Artificial Sequence
  Description of Artificial Sequence: Synthetic oligonucleotide
agtgggtagctgtggtggtaccttctgg

SEQ ID NO: 13936 - DNA, 27 bp, Artificial Sequence
  Description of Artificial Sequence: Synthetic oligonucleotide
gtgggtagctgtggtggtaccttctgg

SEQ ID NO: 13937 - DNA, 28 bp, Artificial Sequence
  Description of Artificial Sequence: Synthetic oligonucleotide
tgggtagctgtggtggtaccttctggag

SEQ ID NO: 13938 - DNA, 27 bp, Artificial Sequence
  Description of Artificial Sequence: Synthetic oligonucleotide
gggtagctgtggtggtaccttctggag

SEQ ID NO: 13939 - DNA, 28 bp, Artificial Sequence
  Description of Artificial Sequence: Synthetic oligonucleotide
ggtagctgtggtggtaccttctggagag

SEQ ID NO: 13940 - DNA, 28 bp, Artificial Sequence
  Description of Artificial Sequence: Synthetic oligonucleotide
gtagctgtggtggtaccttctggagagg

SEQ ID NO: 13941 - DNA, 29 bp, Artificial Sequence
  Description of Artificial Sequence: Synthetic oligonucleotide
tagctgtggtggtaccttctggagaggag

SEQ ID NO: 13942 - DNA, 24 bp, Artificial Sequence
  Description of Artificial Sequence: Synthetic oligonucleotide
gccgtggatagagcaggagaggcc

SEQ ID NO: 13943 - DNA, 24 bp, Artificial Sequence
  Description of Artificial Sequence: Synthetic oligonucleotide
ccgtggatagagcaggagaggccg

SEQ ID NO: 13944 - DNA, 25 bp, Artificial Sequence
  Description of Artificial Sequence: Synthetic oligonucleotide
cgtggatagagcaggagaggccgga

SEQ ID NO: 13945 - DNA, 27 bp, Artificial Sequence
  Description of Artificial Sequence: Synthetic oligonucleotide
gtggatagagcaggagaggccggagta

SEQ ID NO: 13946 - DNA, 29 bp, Artificial Sequence
  Description of Artificial Sequence: Synthetic oligonucleotide
tggatagagcaggagaggccggagtattg

SEQ ID NO: 13947 - DNA, 28 bp, Artificial Sequence
  Description of Artificial Sequence: Synthetic oligonucleotide
ggatagagcaggagaggccggagtattg

SEQ ID NO: 13948 - DNA, 28 bp, Artificial Sequence
  Description of Artificial Sequence: Synthetic oligonucleotide
gatagagcaggagaggccggagtattgg

SEQ ID NO: 13949 - DNA, 28 bp, Artificial Sequence
  Description of Artificial Sequence: Synthetic oligonucleotide
atagagcaggagaggccggagtattggg

SEQ ID NO: 13950 - DNA, 27 bp, Artificial Sequence
  Description of Artificial Sequence: Synthetic oligonucleotide
tagagcaggagaggccggagtattggg

SEQ ID NO: 13951 - DNA, 27 bp, Artificial Sequence
  Description of Artificial Sequence: Synthetic oligonucleotide
agagcaggagaggccggagtattggga

SEQ ID NO: 13952 - DNA, 26 bp, Artificial Sequence
  Description of Artificial Sequence: Synthetic oligonucleotide
gagcaggagaggccggagtattggga

SEQ ID NO: 13953 - DNA, 26 bp, Artificial Sequence
  Description of Artificial Sequence: Synthetic oligonucleotide
agcaggagaggccggagtattgggac

SEQ ID NO: 13954 - DNA, 25 bp, Artificial Sequence
  Description of Artificial Sequence: Synthetic oligonucleotide
gcaggagaggccggagtattgggac

SEQ ID NO: 13955 - DNA, 26 bp, Artificial Sequence
  Description of Artificial Sequence: Synthetic oligonucleotide
caggagaggccggagtattgggacga

SEQ ID NO: 13956 - DNA, 26 bp, Artificial Sequence
  Description of Artificial Sequence: Synthetic oligonucleotide
aggagaggccggagtattgggacgag

SEQ ID NO: 13957 - DNA, 25 bp, Artificial Sequence
  Description of Artificial Sequence: Synthetic oligonucleotide
ggagaggccggagtattgggacgag

SEQ ID NO: 13958 - DNA, 26 bp, Artificial Sequence
  Description of Artificial Sequence: Synthetic oligonucleotide
gagaggccggagtattgggacgagga

SEQ ID NO: 13959 - DNA, 27 bp, Artificial Sequence
  Description of Artificial Sequence: Synthetic oligonucleotide
agaggccggagtattgggacgaggaga

SEQ ID NO: 13960 - DNA, 26 bp, Artificial Sequence
  Description of Artificial Sequence: Synthetic oligonucleotide
gaggccggagtattgggacgaggaga

SEQ ID NO: 13961 - DNA, 27 bp, Artificial Sequence
  Description of Artificial Sequence: Synthetic oligonucleotide
aggccggagtattgggacgaggagaca

SEQ ID NO: 13962 - DNA, 24 bp, Artificial Sequence
  Description of Artificial Sequence: Synthetic oligonucleotide
gggccggagtattgggacgaggag

SEQ ID NO: 13963 - DNA, 24 bp, Artificial Sequence
  Description of Artificial Sequence: Synthetic oligonucleotide
ggccggagtattgggacgaggagg

SEQ ID NO: 13964 - DNA, 25 bp, Artificial Sequence
  Description of Artificial Sequence: Synthetic oligonucleotide
gccggagtattgggacgaggaggca

SEQ ID NO: 13965 - DNA, 25 bp, Artificial Sequence
  Description of Artificial Sequence: Synthetic oligonucleotide
ccggagtattgggacgaggaggcag

SEQ ID NO: 13966 - DNA, 25 bp, Artificial Sequence
  Description of Artificial Sequence: Synthetic oligonucleotide
cggagtattgggacgaggaggcagg

SEQ ID NO: 13967 - DNA, 27 bp, Artificial Sequence
  Description of Artificial Sequence: Synthetic oligonucleotide
ggagtattgggacgaggaggcagggaa

SEQ ID NO: 13968 - DNA, 28 bp, Artificial Sequence
  Description of Artificial Sequence: Synthetic oligonucleotide
gagtattgggacgaggaggcagggaaag

SEQ ID NO: 13969 - DNA, 29 bp, Artificial Sequence
  Description of Artificial Sequence: Synthetic oligonucleotide
agtattgggacgaggaggcagggaaagtg

SEQ ID NO: 13970 - DNA, 28 bp, Artificial Sequence
  Description of Artificial Sequence: Synthetic oligonucleotide
gtattgggacgaggaggcagggaaagtg

SEQ ID NO: 13971 - DNA, 30 bp, Artificial Sequence
  Description of Artificial Sequence: Synthetic oligonucleotide
tattgggacgaggaggcagggaaagtgaag

SEQ ID NO: 13972 - DNA, 29 bp, Artificial Sequence
  Description of Artificial Sequence: Synthetic oligonucleotide
attgggacgaggaggcagggaaagtgaag

SEQ ID NO: 13973 - DNA, 28 bp, Artificial Sequence
  Description of Artificial Sequence: Synthetic oligonucleotide
ttgggacgaggaggcagggaaagtgaag

SEQ ID NO: 13974 - DNA, 27 bp, Artificial Sequence
  Description of Artificial Sequence: Synthetic oligonucleotide
tgggacgaggaggcagggaaagtgaag

SEQ ID NO: 13975 - DNA, 26 bp, Artificial Sequence
  Description of Artificial Sequence: Synthetic oligonucleotide
gggacgaggaggcagggaaagtgaag

SEQ ID NO: 13976 - DNA, 26 bp, Artificial Sequence
  Description of Artificial Sequence: Synthetic oligonucleotide
ggacgaggaggcagggaaagtgaagg

SEQ ID NO: 13977 - DNA, 26 bp, Artificial Sequence
  Description of Artificial Sequence: Synthetic oligonucleotide
gacgaggaggcagggaaagtgaaggc

SEQ ID NO: 13978 - DNA, 26 bp, Artificial Sequence
  Description of Artificial Sequence: Synthetic oligonucleotide
acgaggaggcagggaaagtgaaggcc

SEQ ID NO: 13979 - DNA, 25 bp, Artificial Sequence
  Description of Artificial Sequence: Synthetic oligonucleotide
cgaggaggcagggaaagtgaaggcc

SEQ ID NO: 13980 - DNA, 26 bp, Artificial Sequence
  Description of Artificial Sequence: Synthetic oligonucleotide
gaggaggcagggaaagtgaaggccca

SEQ ID NO: 13981 - DNA, 27 bp, Artificial Sequence
  Description of Artificial Sequence: Synthetic oligonucleotide
aggaggcagggaaagtgaaggcccact

SEQ ID NO: 13982 - DNA, 26 bp, Artificial Sequence
  Description of Artificial Sequence: Synthetic oligonucleotide
ggaggcagggaaagtgaaggcccact

SEQ ID NO: 13983 - DNA, 27 bp, Artificial Sequence
  Description of Artificial Sequence: Synthetic oligonucleotide
gaggcagggaaagtgaaggcccactca

SEQ ID NO: 13984 - DNA, 27 bp, Artificial Sequence
  Description of Artificial Sequence: Synthetic oligonucleotide
aggcagggaaagtgaaggcccactcac

SEQ ID NO: 13985 - DNA, 27 bp, Artificial Sequence
  Description of Artificial Sequence: Synthetic oligonucleotide
ggcagggaaagtgaaggcccactcaca

SEQ ID NO: 13986 - DNA, 27 bp, Artificial Sequence
  Description of Artificial Sequence: Synthetic oligonucleotide
gcagggaaagtgaaggcccactcacag

SEQ ID NO: 13987 - DNA, 32 bp, Artificial Sequence
  Description of Artificial Sequence: Synthetic oligonucleotide
aaggattacatcgccctgaaagaggacctgag

SEQ ID NO: 13988 - DNA, 31 bp, Artificial Sequence
  Description of Artificial Sequence: Synthetic oligonucleotide
aggattacatcgccctgaaagaggacctgag

SEQ ID NO: 13989 - DNA, 30 bp, Artificial Sequence
  Description of Artificial Sequence: Synthetic oligonucleotide
ggattacatcgccctgaaagaggacctgag

SEQ ID NO: 13990 - DNA, 30 bp, Artificial Sequence
  Description of Artificial Sequence: Synthetic oligonucleotide
gattacatcgccctgaaagaggacctgagc

SEQ ID NO: 13991 - DNA, 31 bp, Artificial Sequence
  Description of Artificial Sequence: Synthetic oligonucleotide
attacatcgccctgaaagaggacctgagctc

SEQ ID NO: 13992 - DNA, 30 bp, Artificial Sequence
  Description of Artificial Sequence: Synthetic oligonucleotide
ttacatcgccctgaaagaggacctgagctc

SEQ ID NO: 13993 - DNA, 29 bp, Artificial Sequence
  Description of Artificial Sequence: Synthetic oligonucleotide
tacatcgccctgaaagaggacctgagctc

SEQ ID NO: 13994 - DNA, 28 bp, Artificial Sequence
  Description of Artificial Sequence: Synthetic oligonucleotide
acatcgccctgaaagaggacctgagctc

SEQ ID NO: 13995 - DNA, 27 bp, Artificial Sequence
  Description of Artificial Sequence: Synthetic oligonucleotide
catcgccctgaaagaggacctgagctc

SEQ ID NO: 13996 - DNA, 27 bp, Artificial Sequence
  Description of Artificial Sequence: Synthetic oligonucleotide
atcgccctgaaagaggacctgagctcc

SEQ ID NO: 13997 - DNA, 27 bp, Artificial Sequence
  Description of Artificial Sequence: Synthetic oligonucleotide
tcgccctgaaagaggacctgagctcct

SEQ ID NO: 13998 - DNA, 26 bp, Artificial Sequence
  Description of Artificial Sequence: Synthetic oligonucleotide
cgccctgaaagaggacctgagctcct

SEQ ID NO: 13999 - DNA, 26 bp, Artificial Sequence
  Description of Artificial Sequence: Synthetic oligonucleotide
gccctgaaagaggacctgagctcctg

SEQ ID NO: 14000 - DNA, 27 bp, Artificial Sequence
  Description of Artificial Sequence: Synthetic oligonucleotide
ccctgaaagaggacctgagctcctgga

SEQ ID NO: 14001 - DNA, 27 bp, Artificial Sequence
  Description of Artificial Sequence: Synthetic oligonucleotide
cctgaaagaggacctgagctcctggac

SEQ ID NO: 14002 - DNA, 27 bp, Artificial Sequence
  Description of Artificial Sequence: Synthetic oligonucleotide
ctgaaagaggacctgagctcctggacc

SEQ ID NO: 14003 - DNA, 27 bp, Artificial Sequence
  Description of Artificial Sequence: Synthetic oligonucleotide
tgaaagaggacctgagctcctggaccg

SEQ ID NO: 14004 - DNA, 26 bp, Artificial Sequence
  Description of Artificial Sequence: Synthetic oligonucleotide
gaaagaggacctgagctcctggaccg

SEQ ID NO: 14005 - DNA, 26 bp, Artificial Sequence
  Description of Artificial Sequence: Synthetic oligonucleotide
aaagaggacctgagctcctggaccgc

SEQ ID NO: 14006 - DNA, 25 bp, Artificial Sequence
  Description of Artificial Sequence: Synthetic oligonucleotide
aagaggacctgagctcctggaccgc

SEQ ID NO: 14007 - DNA, 24 bp, Artificial Sequence
  Description of Artificial Sequence: Synthetic oligonucleotide
agaggacctgagctcctggaccgc

SEQ ID NO: 14008 - DNA, 23 bp, Artificial Sequence
  Description of Artificial Sequence: Synthetic oligonucleotide
gaggacctgagctcctggaccgc

SEQ ID NO: 14009 - DNA, 23 bp, Artificial Sequence
  Description of Artificial Sequence: Synthetic oligonucleotide
aggacctgagctcctggaccgcg

SEQ ID NO: 14010 - DNA, 22 bp, Artificial Sequence
  Description of Artificial Sequence: Synthetic oligonucleotide
ggacctgagctcctggaccgcg

SEQ ID NO: 14011 - DNA, 22 bp, Artificial Sequence
  Description of Artificial Sequence: Synthetic oligonucleotide
gacctgagctcctggaccgcgg

SEQ ID NO: 14012 - DNA, 22 bp, Artificial Sequence
  Description of Artificial Sequence: Synthetic oligonucleotide
acctgagctcctggaccgcggc

SEQ ID NO: 14013 - DNA, 21 bp, Artificial Sequence
  Description of Artificial Sequence: Synthetic oligonucleotide
cctgagctcctggaccgcggc

SEQ ID NO: 14014 - DNA, 21 bp, Artificial Sequence
  Description of Artificial Sequence: Synthetic oligonucleotide
ctgagctcctggaccgcggcg

SEQ ID NO: 14015 - DNA, 22 bp, Artificial Sequence
  Description of Artificial Sequence: Synthetic oligonucleotide
tgagctcctggaccgcggcgga

SEQ ID NO: 14016 - DNA, 21 bp, Artificial Sequence
  Description of Artificial Sequence: Synthetic oligonucleotide
gagctcctggaccgcggcgga

SEQ ID NO: 14017 - DNA, 23 bp, Artificial Sequence
  Description of Artificial Sequence: Synthetic oligonucleotide
agctcctggaccgcggcggacat

SEQ ID NO: 14018 - DNA, 23 bp, Artificial Sequence
  Description of Artificial Sequence: Synthetic oligonucleotide
aagtgggaggcggcccgtgtggt

SEQ ID NO: 14019 - DNA, 22 bp, Artificial Sequence
  Description of Artificial Sequence: Synthetic oligonucleotide
agtgggaggcggcccgtgtggt

SEQ ID NO: 14020 - DNA, 21 bp, Artificial Sequence
  Description of Artificial Sequence: Synthetic oligonucleotide
gtgggaggcggcccgtgtggt

SEQ ID NO: 14021 - DNA, 21 bp, Artificial Sequence
  Description of Artificial Sequence: Synthetic oligonucleotide
tgggaggcggcccgtgtggtg

SEQ ID NO: 14022 - DNA, 20 bp, Artificial Sequence
  Description of Artificial Sequence: Synthetic oligonucleotide
gggaggcggcccgtgtggtg

SEQ ID NO: 14023 - DNA, 21 bp, Artificial Sequence
  Description of Artificial Sequence: Synthetic oligonucleotide
ggaggcggcccgtgtggtgga

SEQ ID NO: 14024 - DNA, 21 bp, Artificial Sequence
  Description of Artificial Sequence: Synthetic oligonucleotide
gaggcggcccgtgtggtggag

SEQ ID NO: 14025 - DNA, 22 bp, Artificial Sequence
  Description of Artificial Sequence: Synthetic oligonucleotide
aggcggcccgtgtggtggagca

SEQ ID NO: 14026 - DNA, 21 bp, Artificial Sequence
  Description of Artificial Sequence: Synthetic oligonucleotide
ggcggcccgtgtggtggagca

SEQ ID NO: 14027 - DNA, 23 bp, Artificial Sequence
  Description of Artificial Sequence: Synthetic oligonucleotide
gcggcccgtgtggtggagcagtt

SEQ ID NO: 14028 - DNA, 24 bp, Artificial Sequence
  Description of Artificial Sequence: Synthetic oligonucleotide
cggcccgtgtggtggagcagttga

SEQ ID NO: 14029 - DNA, 25 bp, Artificial Sequence
  Description of Artificial Sequence: Synthetic oligonucleotide
ggcccgtgtggtggagcagttgaga

SEQ ID NO: 14030 - DNA, 25 bp, Artificial Sequence
  Description of Artificial Sequence: Synthetic oligonucleotide
gcccgtgtggtggagcagttgagag

SEQ ID NO: 14031 - DNA, 25 bp, Artificial Sequence
  Description of Artificial Sequence: Synthetic oligonucleotide
cccgtgtggtggagcagttgagagc

SEQ ID NO: 14032 - DNA, 27 bp, Artificial Sequence
  Description of Artificial Sequence: Synthetic oligonucleotide
ccgtgtggtggagcagttgagagccta

SEQ ID NO: 14033 - DNA, 27 bp, Artificial Sequence
  Description of Artificial Sequence: Synthetic oligonucleotide
cgtgtggtggagcagttgagagcctac

SEQ ID NO: 14034 - DNA, 27 bp, Artificial Sequence
  Description of Artificial Sequence: Synthetic oligonucleotide
gtgtggtggagcagttgagagcctacc

SEQ ID NO: 14035 - DNA, 25 bp, Artificial Sequence
  Description of Artificial Sequence: Synthetic oligonucleotide
gggctccgcagatacctggagaacc

SEQ ID NO: 14036 - DNA, 25 bp, Artificial Sequence
  Description of Artificial Sequence: Synthetic oligonucleotide
ttcgtgcggttcgacagcgacgcct

SEQ ID NO: 14037 - DNA, 24 bp, Artificial Sequence
  Description of Artificial Sequence: Synthetic oligonucleotide
tcgtgcggttcgacagcgacgcct

SEQ ID NO: 14038 - DNA, 23 bp, Artificial Sequence
  Description of Artificial Sequence: Synthetic oligonucleotide
cgtgcggttcgacagcgacgcct

SEQ ID NO: 14039 - DNA, 23 bp, Artificial Sequence
  Description of Artificial Sequence: Synthetic oligonucleotide
gtgcggttcgacagcgacgcctc

SEQ ID NO: 14040 - DNA, 24 bp, Artificial Sequence
  Description of Artificial Sequence: Synthetic oligonucleotide
tgcggttcgacagcgacgcctcga

SEQ ID NO: 14041 - DNA, 23 bp, Artificial Sequence
  Description of Artificial Sequence: Synthetic oligonucleotide
gcggttcgacagcgacgcctcga

SEQ ID NO: 14042 - DNA, 23 bp, Artificial Sequence
  Description of Artificial Sequence: Synthetic oligonucleotide
cggttcgacagcgacgcctcgag

SEQ ID NO: 14043 - DNA, 23 bp, Artificial Sequence
  Description of Artificial Sequence: Synthetic oligonucleotide
ggttcgacagcgacgcctcgagc

SEQ ID NO: 14044 - DNA, 24 bp, Artificial Sequence
  Description of Artificial Sequence: Synthetic oligonucleotide
gttcgacagcgacgcctcgagcca

SEQ ID NO: 14045 - DNA, 25 bp, Artificial Sequence
  Description of Artificial Sequence: Synthetic oligonucleotide
ttcgacagcgacgcctcgagccaga

SEQ ID NO: 14046 - DNA, 24 bp, Artificial Sequence
  Description of Artificial Sequence: Synthetic oligonucleotide
tcgacagcgacgcctcgagccaga

SEQ ID NO: 14047 - DNA, 23 bp, Artificial Sequence
  Description of Artificial Sequence: Synthetic oligonucleotide
cgacagcgacgcctcgagccaga

SEQ ID NO: 14048 - DNA, 23 bp, Artificial Sequence
  Description of Artificial Sequence: Synthetic oligonucleotide
gacagcgacgcctcgagccagag

SEQ ID NO: 14049 - DNA, 25 bp, Artificial Sequence
  Description of Artificial Sequence: Synthetic oligonucleotide
acagcgacgcctcgagccagaggat

SEQ ID NO: 14050 - DNA, 24 bp, Artificial Sequence
  Description of Artificial Sequence: Synthetic oligonucleotide
cagcgacgcctcgagccagaggat

SEQ ID NO: 14051 - DNA, 24 bp, Artificial Sequence
  Description of Artificial Sequence: Synthetic oligonucleotide
agcgacgcctcgagccagaggatg

SEQ ID NO: 14052 - DNA, 23 bp, Artificial Sequence
  Description of Artificial Sequence: Synthetic oligonucleotide
gcgacgcctcgagccagaggatg

SEQ ID NO: 14053 - DNA, 24 bp, Artificial Sequence
  Description of Artificial Sequence: Synthetic oligonucleotide
cgacgcctcgagccagaggatgga

SEQ ID NO: 14054 - DNA, 24 bp, Artificial Sequence
  Description of Artificial Sequence: Synthetic oligonucleotide
gacgcctcgagccagaggatggag

SEQ ID NO: 14055 - DNA, 24 bp, Artificial Sequence
  Description of Artificial Sequence: Synthetic oligonucleotide
acgcctcgagccagaggatggagc

SEQ ID NO: 14056 - DNA, 23 bp, Artificial Sequence
  Description of Artificial Sequence: Synthetic oligonucleotide
cgcctcgagccagaggatggagc

SEQ ID NO: 14057 - DNA, 23 bp, Artificial Sequence
  Description of Artificial Sequence: Synthetic oligonucleotide
gcctcgagccagaggatggagcc

SEQ ID NO: 14058 - DNA, 23 bp, Artificial Sequence
  Description of Artificial Sequence: Synthetic oligonucleotide
cctcgagccagaggatggagccg

SEQ ID NO: 14059 - DNA, 23 bp, Artificial Sequence
  Description of Artificial Sequence: Synthetic oligonucleotide
ctcgagccagaggatggagccgc

SEQ ID NO: 14060 - DNA, 23 bp, Artificial Sequence
  Description of Artificial Sequence: Synthetic oligonucleotide
tcgagccagaggatggagccgcg

SEQ ID NO: 14061 - DNA, 24 bp, Artificial Sequence
  Description of Artificial Sequence: Synthetic oligonucleotide
tgggccctgggcttctaccctgca

SEQ ID NO: 14062 - DNA, 23 bp, Artificial Sequence
  Description of Artificial Sequence: Synthetic oligonucleotide
gggccctgggcttctaccctgca

SEQ ID NO: 14063 - DNA, 24 bp, Artificial Sequence
  Description of Artificial Sequence: Synthetic oligonucleotide
ggccctgggcttctaccctgcaga

SEQ ID NO: 14064 - DNA, 26 bp, Artificial Sequence
  Description of Artificial Sequence: Synthetic oligonucleotide
gccctgggcttctaccctgcagagat

SEQ ID NO: 14065 - DNA, 27 bp, Artificial Sequence
  Description of Artificial Sequence: Synthetic oligonucleotide
ccctgggcttctaccctgcagagatca

SEQ ID NO: 14066 - DNA, 27 bp, Artificial Sequence
  Description of Artificial Sequence: Synthetic oligonucleotide
cctgggcttctaccctgcagagatcac

SEQ ID NO: 14067 - DNA, 28 bp, Artificial Sequence
  Description of Artificial Sequence: Synthetic oligonucleotide
ctgggcttctaccctgcagagatcacac

SEQ ID NO: 14068 - DNA, 29 bp, Artificial Sequence
  Description of Artificial Sequence: Synthetic oligonucleotide
tgggcttctaccctgcagagatcacactg

SEQ ID NO: 14069 - DNA, 28 bp, Artificial Sequence
  Description of Artificial Sequence: Synthetic oligonucleotide
gggcttctaccctgcagagatcacactg

SEQ ID NO: 14070 - DNA, 29 bp, Artificial Sequence
  Description of Artificial Sequence: Synthetic oligonucleotide
ggcttctaccctgcagagatcacactgac

SEQ ID NO: 14071 - DNA, 26 bp, Artificial Sequence
  Description of Artificial Sequence: Synthetic oligonucleotide
gcttcctccgcgggtaccaccagtat

SEQ ID NO: 14072 - DNA, 26 bp, Artificial Sequence
  Description of Artificial Sequence: Synthetic oligonucleotide
cttcctccgcgggtaccaccagtatg

SEQ ID NO: 14073 - DNA, 26 bp, Artificial Sequence
  Description of Artificial Sequence: Synthetic oligonucleotide
ttcctccgcgggtaccaccagtatgc

SEQ ID NO: 14074 - DNA, 25 bp, Artificial Sequence
  Description of Artificial Sequence: Synthetic oligonucleotide
tcctccgcgggtaccaccagtatgc

SEQ ID NO: 14075 - DNA, 24 bp, Artificial Sequence
  Description of Artificial Sequence: Synthetic oligonucleotide
cctccgcgggtaccaccagtatgc

SEQ ID NO: 14076 - DNA, 26 bp, Artificial Sequence
  Description of Artificial Sequence: Synthetic oligonucleotide
ctccgcgggtaccaccagtatgccta

SEQ ID NO: 14077 - DNA, 26 bp, Artificial Sequence
  Description of Artificial Sequence: Synthetic oligonucleotide
tccgcgggtaccaccagtatgcctac

SEQ ID NO: 14078 - DNA, 25 bp, Artificial Sequence
  Description of Artificial Sequence: Synthetic oligonucleotide
ccgcgggtaccaccagtatgcctac

SEQ ID NO: 14079 - DNA, 26 bp, Artificial Sequence
  Description of Artificial Sequence: Synthetic oligonucleotide
cgcgggtaccaccagtatgcctacga

SEQ ID NO: 14080 - DNA, 26 bp, Artificial Sequence
  Description of Artificial Sequence: Synthetic oligonucleotide
gcgggtaccaccagtatgcctacgac

SEQ ID NO: 14081 - DNA, 26 bp, Artificial Sequence
  Description of Artificial Sequence: Synthetic oligonucleotide
cgggtaccaccagtatgcctacgacg

SEQ ID NO: 14082 - DNA, 26 bp, Artificial Sequence
  Description of Artificial Sequence: Synthetic oligonucleotide
gggtaccaccagtatgcctacgacgg

SEQ ID NO: 14083 - DNA, 27 bp, Artificial Sequence
  Description of Artificial Sequence: Synthetic oligonucleotide
ggtaccaccagtatgcctacgacggca

SEQ ID NO: 14084 - DNA, 28 bp, Artificial Sequence
  Description of Artificial Sequence: Synthetic oligonucleotide
gtaccaccagtatgcctacgacggcaag

SEQ ID NO: 14085 - DNA, 28 bp, Artificial Sequence
  Description of Artificial Sequence: Synthetic oligonucleotide
taccaccagtatgcctacgacggcaagg

SEQ ID NO: 14086 - DNA, 27 bp, Artificial Sequence
  Description of Artificial Sequence: Synthetic oligonucleotide
accaccagtatgcctacgacggcaagg

SEQ ID NO: 14087 - DNA, 27 bp, Artificial Sequence
  Description of Artificial Sequence: Synthetic oligonucleotide
ccaccagtatgcctacgacggcaagga

SEQ ID NO: 14088 - DNA, 30 bp, Artificial Sequence
  Description of Artificial Sequence: Synthetic oligonucleotide
caccagtatgcctacgacggcaaggattac

SEQ ID NO: 14089 - DNA, 32 bp, Artificial Sequence
  Description of Artificial Sequence: Synthetic oligonucleotide
accagtatgcctacgacggcaaggattacatc

SEQ ID NO: 14090 - DNA, 31 bp, Artificial Sequence
  Description of Artificial Sequence: Synthetic oligonucleotide
ccagtatgcctacgacggcaaggattacatc

SEQ ID NO: 14091 - DNA, 32 bp, Artificial Sequence
  Description of Artificial Sequence: Synthetic oligonucleotide
ggttctcacaccctccagatgatgtttggttg

SEQ ID NO: 14092 - DNA, 32 bp, Artificial Sequence
  Description of Artificial Sequence: Synthetic oligonucleotide
gttctcacaccctccagatgatgtttggttgc

SEQ ID NO: 14093 - DNA, 32 bp, Artificial Sequence
  Description of Artificial Sequence: Synthetic oligonucleotide
ttctcacaccctccagatgatgtttggttgcg

SEQ ID NO: 14094 - DNA, 31 bp, Artificial Sequence
  Description of Artificial Sequence: Synthetic oligonucleotide
tctcacaccctccagatgatgtttggttgcg

SEQ ID NO: 14095 - DNA, 30 bp, Artificial Sequence
  Description of Artificial Sequence: Synthetic oligonucleotide
ctcacaccctccagatgatgtttggttgcg

SEQ ID NO: 14096 - DNA, 31 bp, Artificial Sequence
  Description of Artificial Sequence: Synthetic oligonucleotide
tcacaccctccagatgatgtttggttgcgac

SEQ ID NO: 14097 - DNA, 30 bp, Artificial Sequence
  Description of Artificial Sequence: Synthetic oligonucleotide
cacaccctccagatgatgtttggttgcgac

SEQ ID NO: 14098 - DNA, 30 bp, Artificial Sequence
  Description of Artificial Sequence: Synthetic oligonucleotide
acaccctccagatgatgtttggttgcgacg

SEQ ID NO: 14099 - DNA, 29 bp, Artificial Sequence
  Description of Artificial Sequence: Synthetic oligonucleotide
caccctccagatgatgtttggttgcgacg

SEQ ID NO: 14100 - DNA, 30 bp, Artificial Sequence
  Description of Artificial Sequence: Synthetic oligonucleotide
accctccagatgatgtttggttgcgacgtg

SEQ ID NO: 14101 - DNA, 29 bp, Artificial Sequence
  Description of Artificial Sequence: Synthetic oligonucleotide
ccctccagatgatgtttggttgcgacgtg

SEQ ID NO: 14102 - DNA, 29 bp, Artificial Sequence
  Description of Artificial Sequence: Synthetic oligonucleotide
cctccagatgatgtttggttgcgacgtgg

SEQ ID NO: 14103 - DNA, 29 bp, Artificial Sequence
  Description of Artificial Sequence: Synthetic oligonucleotide
ctccagatgatgtttggttgcgacgtggg

SEQ ID NO: 14104 - DNA, 29 bp, Artificial Sequence
  Description of Artificial Sequence: Synthetic oligonucleotide
tccagatgatgtttggttgcgacgtgggg

SEQ ID NO: 14105 - DNA, 28 bp, Artificial Sequence
  Description of Artificial Sequence: Synthetic oligonucleotide
ccagatgatgtttggttgcgacgtgggg

SEQ ID NO: 14106 - DNA, 29 bp, Artificial Sequence
  Description of Artificial Sequence: Synthetic oligonucleotide
cagatgatgtttggttgcgacgtggggtc

SEQ ID NO: 14107 - DNA, 29 bp, Artificial Sequence
  Description of Artificial Sequence: Synthetic oligonucleotide
agatgatgtttggttgcgacgtggggtcg

SEQ ID NO: 14108 - DNA, 28 bp, Artificial Sequence
  Description of Artificial Sequence: Synthetic oligonucleotide
gatgatgtttggttgcgacgtggggtcg

SEQ ID NO: 14109 - DNA, 28 bp, Artificial Sequence
  Description of Artificial Sequence: Synthetic oligonucleotide
atgatgtttggttgcgacgtggggtcgg

SEQ ID NO: 14110 - DNA, 27 bp, Artificial Sequence
  Description of Artificial Sequence: Synthetic oligonucleotide
tgatgtttggttgcgacgtggggtcgg

SEQ ID NO: 14111 - DNA, 27 bp, Artificial Sequence
  Description of Artificial Sequence: Synthetic oligonucleotide
gatgtttggttgcgacgtggggtcgga

SEQ ID NO: 14112 - DNA, 27 bp, Artificial Sequence
  Description of Artificial Sequence: Synthetic oligonucleotide
atgtttggttgcgacgtggggtcggac

SEQ ID NO: 14113 - DNA, 26 bp, Artificial Sequence
  Description of Artificial Sequence: Synthetic oligonucleotide
tgtttggttgcgacgtggggtcggac

SEQ ID NO: 14114 - DNA, 25 bp, Artificial Sequence
  Description of Artificial Sequence: Synthetic oligonucleotide
gtttggttgcgacgtggggtcggac

SEQ ID NO: 14115 - DNA, 25 bp, Artificial Sequence
  Description of Artificial Sequence: Synthetic oligonucleotide
tttggttgcgacgtggggtcggacg

SEQ ID NO: 14116 - DNA, 24 bp, Artificial Sequence
  Description of Artificial Sequence: Synthetic oligonucleotide
ttggttgcgacgtggggtcggacg

SEQ ID NO: 14117 - DNA, 23 bp, Artificial Sequence
  Description of Artificial Sequence: Synthetic oligonucleotide
tggttgcgacgtggggtcggacg

SEQ ID NO: 14118 - DNA, 22 bp, Artificial Sequence
  Description of Artificial Sequence: Synthetic oligonucleotide
ggttgcgacgtggggtcggacg

SEQ ID NO: 14119 - DNA, 22 bp, Artificial Sequence
  Description of Artificial Sequence: Synthetic oligonucleotide
gttgcgacgtggggtcggacgg

SEQ ID NO: 14120 - DNA, 22 bp, Artificial Sequence
  Description of Artificial Sequence: Synthetic oligonucleotide
ttgcgacgtggggtcggacggg

SEQ ID NO: 14121 - DNA, 26 bp, Artificial Sequence
  Description of Artificial Sequence: Synthetic oligonucleotide
gtgaaggcccactcacagactgaccg

SEQ ID NO: 14122 - DNA, 26 bp, Artificial Sequence
  Description of Artificial Sequence: Synthetic oligonucleotide
tgaaggcccactcacagactgaccgc

SEQ ID NO: 14123 - DNA, 25 bp, Artificial Sequence
  Description of Artificial Sequence: Synthetic oligonucleotide
gaaggcccactcacagactgaccgc

SEQ ID NO: 14124 - DNA, 26 bp, Artificial Sequence
  Description of Artificial Sequence: Synthetic oligonucleotide
aaggcccactcacagactgaccgcga

SEQ ID NO: 14125 - DNA, 25 bp, Artificial Sequence
  Description of Artificial Sequence: Synthetic oligonucleotide
aggcccactcacagactgaccgcga

SEQ ID NO: 14126 - DNA, 24 bp, Artificial Sequence
  Description of Artificial Sequence: Synthetic oligonucleotide
ggcccactcacagactgaccgcga

SEQ ID NO: 14127 - DNA, 26 bp, Artificial Sequence
  Description of Artificial Sequence: Synthetic oligonucleotide
gcccactcacagactgaccgcgagaa

SEQ ID NO: 14128 - DNA, 26 bp, Artificial Sequence
  Description of Artificial Sequence: Synthetic oligonucleotide
cccactcacagactgaccgcgagaac

SEQ ID NO: 14129 - DNA, 27 bp, Artificial Sequence
  Description of Artificial Sequence: Synthetic oligonucleotide
ccactcacagactgaccgcgagaacct

SEQ ID NO: 14130 - DNA, 27 bp, Artificial Sequence
  Description of Artificial Sequence: Synthetic oligonucleotide
cactcacagactgaccgcgagaacctg

SEQ ID NO: 14131 - DNA, 27 bp, Artificial Sequence
  Description of Artificial Sequence: Synthetic oligonucleotide
actcacagactgaccgcgagaacctgc

SEQ ID NO: 14132 - DNA, 26 bp, Artificial Sequence
  Description of Artificial Sequence: Synthetic oligonucleotide
ctcacagactgaccgcgagaacctgc

SEQ ID NO: 14133 - DNA, 26 bp, Artificial Sequence
  Description of Artificial Sequence: Synthetic oligonucleotide
tcacagactgaccgcgagaacctgcg

SEQ ID NO: 14134 - DNA, 25 bp, Artificial Sequence
  Description of Artificial Sequence: Synthetic oligonucleotide
cacagactgaccgcgagaacctgcg

SEQ ID NO: 14135 - DNA, 27 bp, Artificial Sequence
  Description of Artificial Sequence: Synthetic oligonucleotide
acagactgaccgcgagaacctgcggat

SEQ ID NO: 14136 - DNA, 26 bp, Artificial Sequence
  Description of Artificial Sequence: Synthetic oligonucleotide
cagactgaccgcgagaacctgcggat

SEQ ID NO: 14137 - DNA, 26 bp, Artificial Sequence
  Description of Artificial Sequence: Synthetic oligonucleotide
agactgaccgcgagaacctgcggatc

SEQ ID NO: 14138 - DNA, 25 bp, Artificial Sequence
  Description of Artificial Sequence: Synthetic oligonucleotide
gactgaccgcgagaacctgcggatc

SEQ ID NO: 14139 - DNA, 25 bp, Artificial Sequence
  Description of Artificial Sequence: Synthetic oligonucleotide
actgaccgcgagaacctgcggatcg

SEQ ID NO: 14140 - DNA, 24 bp, Artificial Sequence
  Description of Artificial Sequence: Synthetic oligonucleotide
ctgaccgcgagaacctgcggatcg

SEQ ID NO: 14141 - DNA, 24 bp, Artificial Sequence
  Description of Artificial Sequence: Synthetic oligonucleotide
tgaccgcgagaacctgcggatcgc

SEQ ID NO: 14142 - DNA, 23 bp, Artificial Sequence
  Description of Artificial Sequence: Synthetic oligonucleotide
gaccgcgagaacctgcggatcgc

SEQ ID NO: 14143 - DNA, 23 bp, Artificial Sequence
  Description of Artificial Sequence: Synthetic oligonucleotide
accgcgagaacctgcggatcgcg

SEQ ID NO: 14144 - DNA, 22 bp, Artificial Sequence
  Description of Artificial Sequence: Synthetic oligonucleotide
ccgcgagaacctgcggatcgcg

SEQ ID NO: 14145 - DNA, 23 bp, Artificial Sequence
  Description of Artificial Sequence: Synthetic oligonucleotide
cgcgagaacctgcggatcgcgct

SEQ ID NO: 14146 - DNA, 23 bp, Artificial Sequence
  Description of Artificial Sequence: Synthetic oligonucleotide
gcgagaacctgcggatcgcgctc

SEQ ID NO: 14147 - DNA, 23 bp, Artificial Sequence
  Description of Artificial Sequence: Synthetic oligonucleotide
cgagaacctgcggatcgcgctcc

SEQ ID NO: 14148 - DNA, 23 bp, Artificial Sequence
  Description of Artificial Sequence: Synthetic oligonucleotide
aagcgcaagtgggaggcggccca

SEQ ID NO: 14149 - DNA, 22 bp, Artificial Sequence
  Description of Artificial Sequence: Synthetic oligonucleotide
agcgcaagtgggaggcggccca

SEQ ID NO: 14150 - DNA, 21 bp, Artificial Sequence
  Description of Artificial Sequence: Synthetic oligonucleotide
gcgcaagtgggaggcggccca

SEQ ID NO: 14151 - DNA, 21 bp, Artificial Sequence
  Description of Artificial Sequence: Synthetic oligonucleotide
cgcaagtgggaggcggcccac

SEQ ID NO: 14152 - DNA, 22 bp, Artificial Sequence
  Description of Artificial Sequence: Synthetic oligonucleotide
gcaagtgggaggcggcccacgt

SEQ ID NO: 14153 - DNA, 22 bp, Artificial Sequence
  Description of Artificial Sequence: Synthetic oligonucleotide
caagtgggaggcggcccacgtg

SEQ ID NO: 14154 - DNA, 22 bp, Artificial Sequence
  Description of Artificial Sequence: Synthetic oligonucleotide
aagtgggaggcggcccacgtgg

SEQ ID NO: 14155 - DNA, 21 bp, Artificial Sequence
  Description of Artificial Sequence: Synthetic oligonucleotide
agtgggaggcggcccacgtgg

SEQ ID NO: 14156 - DNA, 20 bp, Artificial Sequence
  Description of Artificial Sequence: Synthetic oligonucleotide
gtgggaggcggcccacgtgg

SEQ ID NO: 14157 - DNA, 20 bp, Artificial Sequence
  Description of Artificial Sequence: Synthetic oligonucleotide
tgggaggcggcccacgtggc

SEQ ID NO: 14158 - DNA, 20 bp, Artificial Sequence
  Description of Artificial Sequence: Synthetic oligonucleotide
gggaggcggcccacgtggct

SEQ ID NO: 14159 - DNA, 20 bp, Artificial Sequence
  Description of Artificial Sequence: Synthetic oligonucleotide
ggaggcggcccacgtggcgt

SEQ ID NO: 14160 - DNA, 20 bp, Artificial Sequence
  Description of Artificial Sequence: Synthetic oligonucleotide
gaggcggcccacgtggcgga

SEQ ID NO: 14161 - DNA, 20 bp, Artificial Sequence
  Description of Artificial Sequence: Synthetic oligonucleotide
aggcggcccacgtggcggag

SEQ ID NO: 14162 - DNA, 20 bp, Artificial Sequence
  Description of Artificial Sequence: Synthetic oligonucleotide
ggcggcccacgtggcggagt

SEQ ID NO: 14163 - DNA, 20 bp, Artificial Sequence
  Description of Artificial Sequence: Synthetic oligonucleotide
gcggcccacgtggcggagca

SEQ ID NO: 14164 - DNA, 20 bp, Artificial Sequence
  Description of Artificial Sequence: Synthetic oligonucleotide
cggcccacgtggcggagcag

SEQ ID NO: 14165 - DNA, 21 bp, Artificial Sequence
  Description of Artificial Sequence: Synthetic oligonucleotide
ggcccacgtggcggagcagca

SEQ ID NO: 14166 - DNA, 22 bp, Artificial Sequence
  Description of Artificial Sequence: Synthetic oligonucleotide
gcccacgtggcggagcagcaga

SEQ ID NO: 14167 - DNA, 23 bp, Artificial Sequence
  Description of Artificial Sequence: Synthetic oligonucleotide
cccacgtggcggagcagcagaga

SEQ ID NO: 14168 - DNA, 23 bp, Artificial Sequence
  Description of Artificial Sequence: Synthetic oligonucleotide
ccacgtggcggagcagcagagag

SEQ ID NO: 14169 - DNA, 23 bp, Artificial Sequence
  Description of Artificial Sequence: Synthetic oligonucleotide
cacgtggcggagcagcagagagc

SEQ ID NO: 14170 - DNA, 25 bp, Artificial Sequence
  Description of Artificial Sequence: Synthetic oligonucleotide
acgtggcggagcagcagagagccta

SEQ ID NO: 14171 - DNA, 24 bp, Artificial Sequence
  Description of Artificial Sequence: Synthetic oligonucleotide
cgtggcggagcagcagagagccta

SEQ ID NO: 14172 - DNA, 24 bp, Artificial Sequence
  Description of Artificial Sequence: Synthetic oligonucleotide
aagtgggaggcggcccatgtggca

SEQ ID NO: 14173 - DNA, 23 bp, Artificial Sequence
  Description of Artificial Sequence: Synthetic oligonucleotide
agtgggaggcggcccatgtggca

SEQ ID NO: 14174 - DNA, 22 bp, Artificial Sequence
  Description of Artificial Sequence: Synthetic oligonucleotide
gtgggaggcggcccatgtggca

SEQ ID NO: 14175 - DNA, 23 bp, Artificial Sequence
  Description of Artificial Sequence: Synthetic oligonucleotide
tgggaggcggcccatgtggcaga

SEQ ID NO: 14176 - DNA, 22 bp, Artificial Sequence
  Description of Artificial Sequence: Synthetic oligonucleotide
gggaggcggcccatgtggcaga

SEQ ID NO: 14177 - DNA, 22 bp, Artificial Sequence
  Description of Artificial Sequence: Synthetic oligonucleotide
ggaggcggcccatgtggcagag

SEQ ID NO: 14178 - DNA, 23 bp, Artificial Sequence
  Description of Artificial Sequence: Synthetic oligonucleotide
gaggcggcccatgtggcagagca

SEQ ID NO: 14179 - DNA, 23 bp, Artificial Sequence
  Description of Artificial Sequence: Synthetic oligonucleotide
aggcggcccatgtggcagagcag

SEQ ID NO: 14180 - DNA, 22 bp, Artificial Sequence
  Description of Artificial Sequence: Synthetic oligonucleotide
ggcggcccatgtggcagagcag

SEQ ID NO: 14181 - DNA, 23 bp, Artificial Sequence
  Description of Artificial Sequence: Synthetic oligonucleotide
gcggcccatgtggcagagcagca

SEQ ID NO: 14182 - DNA, 24 bp, Artificial Sequence
  Description of Artificial Sequence: Synthetic oligonucleotide
cggcccatgtggcagagcagcaga

SEQ ID NO: 14183 - DNA, 25 bp, Artificial Sequence
  Description of Artificial Sequence: Synthetic oligonucleotide
ggcccatgtggcagagcagcagaga

SEQ ID NO: 14184 - DNA, 25 bp, Artificial Sequence
  Description of Artificial Sequence: Synthetic oligonucleotide
gcccatgtggcagagcagcagagag

SEQ ID NO: 14185 - DNA, 25 bp, Artificial Sequence
  Description of Artificial Sequence: Synthetic oligonucleotide
cccatgtggcagagcagcagagagc

SEQ ID NO: 14186 - DNA, 27 bp, Artificial Sequence
  Description of Artificial Sequence: Synthetic oligonucleotide
ccatgtggcagagcagcagagagccta

SEQ ID NO: 14187 - DNA, 27 bp, Artificial Sequence
  Description of Artificial Sequence: Synthetic oligonucleotide
catgtggcagagcagcagagagcctac

SEQ ID NO: 14188 - DNA, 27 bp, Artificial Sequence
  Description of Artificial Sequence: Synthetic oligonucleotide
atgtggcagagcagcagagagcctacc

SEQ ID NO: 14189 - DNA, 27 bp, Artificial Sequence
  Description of Artificial Sequence: Synthetic oligonucleotide
tgtggcagagcagcagagagcctacct

SEQ ID NO: 14190 - DNA, 26 bp, Artificial Sequence
  Description of Artificial Sequence: Synthetic oligonucleotide
gtggcagagcagcagagagcctacct

SEQ ID NO: 14191 - DNA, 26 bp, Artificial Sequence
  Description of Artificial Sequence: Synthetic oligonucleotide
tggcagagcagcagagagcctacctg

SEQ ID NO: 14192 - DNA, 25 bp, Artificial Sequence
  Description of Artificial Sequence: Synthetic oligonucleotide
ggcagagcagcagagagcctacctg

SEQ ID NO: 14193 - DNA, 26 bp, Artificial Sequence
  Description of Artificial Sequence: Synthetic oligonucleotide
gcagagcagcagagagcctacctgga

SEQ ID NO: 14194 - DNA, 26 bp, Artificial Sequence
  Description of Artificial Sequence: Synthetic oligonucleotide
cagagcagcagagagcctacctggag

SEQ ID NO: 14195 - DNA, 26 bp, Artificial Sequence
  Description of Artificial Sequence: Synthetic oligonucleotide
agagcagcagagagcctacctggagg

SEQ ID NO: 14196 - DNA, 22 bp, Artificial Sequence
  Description of Artificial Sequence: Synthetic oligonucleotide
ctgcgacgtggggtcggacgga

SEQ ID NO: 14197 - DNA, 22 bp, Artificial Sequence
  Description of Artificial Sequence: Synthetic oligonucleotide
tgcgacgtggggtcggacggac

SEQ ID NO: 14198 - DNA, 21 bp, Artificial Sequence
  Description of Artificial Sequence: Synthetic oligonucleotide
gcgacgtggggtcggacggac

SEQ ID NO: 14199 - DNA, 21 bp, Artificial Sequence
  Description of Artificial Sequence: Synthetic oligonucleotide
cgacgtggggtcggacggacg

SEQ ID NO: 14200 - DNA, 23 bp, Artificial Sequence
  Description of Artificial Sequence: Synthetic oligonucleotide
gacgtggggtcggacggacgctt

SEQ ID NO: 14201 - DNA, 23 bp, Artificial Sequence
  Description of Artificial Sequence: Synthetic oligonucleotide
acgtggggtcggacggacgcttc

SEQ ID NO: 14202 - DNA, 22 bp, Artificial Sequence
  Description of Artificial Sequence: Synthetic oligonucleotide
cgtggggtcggacggacgcttc

SEQ ID NO: 14203 - DNA, 23 bp, Artificial Sequence
  Description of Artificial Sequence: Synthetic oligonucleotide
gtggggtcggacggacgcttcct

SEQ ID NO: 14204 - DNA, 23 bp, Artificial Sequence
  Description of Artificial Sequence: Synthetic oligonucleotide
tggggtcggacggacgcttcctc

SEQ ID NO: 14205 - DNA, 22 bp, Artificial Sequence
  Description of Artificial Sequence: Synthetic oligonucleotide
ggggtcggacggacgcttcctc

SEQ ID NO: 14206 - DNA, 22 bp, Artificial Sequence
  Description of Artificial Sequence: Synthetic oligonucleotide
gggtcggacggacgcttcctcc

SEQ ID NO: 14207 - DNA, 22 bp, Artificial Sequence
  Description of Artificial Sequence: Synthetic oligonucleotide
ggtcggacggacgcttcctccg

SEQ ID NO: 14208 - DNA, 22 bp, Artificial Sequence
  Description of Artificial Sequence: Synthetic oligonucleotide
gtcggacggacgcttcctccgc

SEQ ID NO: 14209 - DNA, 22 bp, Artificial Sequence
  Description of Artificial Sequence: Synthetic oligonucleotide
tcggacggacgcttcctccgcg

SEQ ID NO: 14210 - DNA, 21 bp, Artificial Sequence
  Description of Artificial Sequence: Synthetic oligonucleotide
cggacggacgcttcctccgcg

SEQ ID NO: 14211 - DNA, 21 bp, Artificial Sequence
  Description of Artificial Sequence: Synthetic oligonucleotide
ggacggacgcttcctccgcgg

SEQ ID NO: 14212 - DNA, 23 bp, Artificial Sequence
  Description of Artificial Sequence: Synthetic oligonucleotide
gacggacgcttcctccgcgggta

SEQ ID NO: 14213 - DNA, 23 bp, Artificial Sequence
  Description of Artificial Sequence: Synthetic oligonucleotide
acggacgcttcctccgcgggtac

SEQ ID NO: 14214 - DNA, 22 bp, Artificial Sequence
  Description of Artificial Sequence: Synthetic oligonucleotide
cggacgcttcctccgcgggtac

SEQ ID NO: 14215 - DNA, 23 bp, Artificial Sequence
  Description of Artificial Sequence: Synthetic oligonucleotide
ggacgcttcctccgcgggtacca

SEQ ID NO: 14216 - DNA, 23 bp, Artificial Sequence
  Description of Artificial Sequence: Synthetic oligonucleotide
gacgcttcctccgcgggtaccac

SEQ ID NO: 14217 - DNA, 24 bp, Artificial Sequence
  Description of Artificial Sequence: Synthetic oligonucleotide
acgcttcctccgcgggtaccacca

SEQ ID NO: 14218 - DNA, 28 bp, Artificial Sequence
  Description of Artificial Sequence: Synthetic oligonucleotide
gcccactcacagactgaccgagagaatc

SEQ ID NO: 14219 - DNA, 29 bp, Artificial Sequence
  Description of Artificial Sequence: Synthetic oligonucleotide
cccactcacagactgaccgagagaatctg

SEQ ID NO: 14220 - DNA, 29 bp, Artificial Sequence
  Description of Artificial Sequence: Synthetic oligonucleotide
ccactcacagactgaccgagagaatctgc

SEQ ID NO: 14221 - DNA, 29 bp, Artificial Sequence
  Description of Artificial Sequence: Synthetic oligonucleotide
cactcacagactgaccgagagaatctgcg

SEQ ID NO: 14222 - DNA, 29 bp, Artificial Sequence
  Description of Artificial Sequence: Synthetic oligonucleotide
actcacagactgaccgagagaatctgcgg

SEQ ID NO: 14223 - DNA, 28 bp, Artificial Sequence
  Description of Artificial Sequence: Synthetic oligonucleotide
ctcacagactgaccgagagaatctgcgg

SEQ ID NO: 14224 - DNA, 30 bp, Artificial Sequence
  Description of Artificial Sequence: Synthetic oligonucleotide
tcacagactgaccgagagaatctgcggatc

SEQ ID NO: 14225 - DNA, 29 bp, Artificial Sequence
  Description of Artificial Sequence: Synthetic oligonucleotide
cacagactgaccgagagaatctgcggatc

SEQ ID NO: 14226 - DNA, 29 bp, Artificial Sequence
  Description of Artificial Sequence: Synthetic oligonucleotide
acagactgaccgagagaatctgcggatcg

SEQ ID NO: 14227 - DNA, 28 bp, Artificial Sequence
  Description of Artificial Sequence: Synthetic oligonucleotide
cagactgaccgagagaatctgcggatcg

SEQ ID NO: 14228 - DNA, 28 bp, Artificial Sequence
  Description of Artificial Sequence: Synthetic oligonucleotide
agactgaccgagagaatctgcggatcgc

SEQ ID NO: 14229 - DNA, 27 bp, Artificial Sequence
  Description of Artificial Sequence: Synthetic oligonucleotide
gactgaccgagagaatctgcggatcgc

SEQ ID NO: 14230 - DNA, 27 bp, Artificial Sequence
  Description of Artificial Sequence: Synthetic oligonucleotide
actgaccgagagaatctgcggatcgcg

SEQ ID NO: 14231 - DNA, 26 bp, Artificial Sequence
  Description of Artificial Sequence: Synthetic oligonucleotide
ctgaccgagagaatctgcggatcgcg

SEQ ID NO: 14232 - DNA, 27 bp, Artificial Sequence
  Description of Artificial Sequence: Synthetic oligonucleotide
tgaccgagagaatctgcggatcgcgct

SEQ ID NO: 14233 - DNA, 26 bp, Artificial Sequence
  Description of Artificial Sequence: Synthetic oligonucleotide
gaccgagagaatctgcggatcgcgct

SEQ ID NO: 14234 - DNA, 26 bp, Artificial Sequence
  Description of Artificial Sequence: Synthetic oligonucleotide
accgagagaatctgcggatcgcgctc

SEQ ID NO: 14235 - DNA, 25 bp, Artificial Sequence
  Description of Artificial Sequence: Synthetic oligonucleotide
ccgagagaatctgcggatcgcgctc

SEQ ID NO: 14236 - DNA, 25 bp, Artificial Sequence
  Description of Artificial Sequence: Synthetic oligonucleotide
cgagagaatctgcggatcgcgctcc

SEQ ID NO: 14237 - DNA, 25 bp, Artificial Sequence
  Description of Artificial Sequence: Synthetic oligonucleotide
gagagaatctgcggatcgcgctccg

SEQ ID NO: 14238 - DNA, 27 bp, Artificial Sequence
  Description of Artificial Sequence: Synthetic oligonucleotide
agagaatctgcggatcgcgctccgcta

SEQ ID NO: 14239 - DNA, 26 bp, Artificial Sequence
  Description of Artificial Sequence: Synthetic oligonucleotide
gagaatctgcggatcgcgctccgcta

SEQ ID NO: 14240 - DNA, 27 bp, Artificial Sequence
  Description of Artificial Sequence: Synthetic oligonucleotide
agaatctgcggatcgcgctccgctact

SEQ ID NO: 14241 - DNA, 27 bp, Artificial Sequence
  Description of Artificial Sequence: Synthetic oligonucleotide
gaatctgcggatcgcgctccgctacta

SEQ ID NO: 14242 - DNA, 27 bp, Artificial Sequence
  Description of Artificial Sequence: Synthetic oligonucleotide
aatctgcggatcgcgctccgctactac

SEQ ID NO: 14243 - DNA, 27 bp, Artificial Sequence
  Description of Artificial Sequence: Synthetic oligonucleotide
atctgcggatcgcgctccgctactaca

SEQ ID NO: 14244 - DNA, 27 bp, Artificial Sequence
  Description of Artificial Sequence: Synthetic oligonucleotide
tctgcggatcgcgctccgctactacaa

SEQ ID NO: 14245 - DNA, 28 bp, Artificial Sequence
  Description of Artificial Sequence: Synthetic oligonucleotide
gacccccccaagacacatatgacccatc

SEQ ID NO: 14246 - DNA, 29 bp, Artificial Sequence
  Description of Artificial Sequence: Synthetic oligonucleotide
acccccccaagacacatatgacccatcac

SEQ ID NO: 14247 - DNA, 28 bp, Artificial Sequence
  Description of Artificial Sequence: Synthetic oligonucleotide
cccccccaagacacatatgacccatcac

SEQ ID NO: 14248 - DNA, 28 bp, Artificial Sequence
  Description of Artificial Sequence: Synthetic oligonucleotide
ccccccaagacacatatgacccatcacc

SEQ ID NO: 14249 - DNA, 28 bp, Artificial Sequence
  Description of Artificial Sequence: Synthetic oligonucleotide
cccccaagacacatatgacccatcaccc

SEQ ID NO: 14250 - DNA, 28 bp, Artificial Sequence
  Description of Artificial Sequence: Synthetic oligonucleotide
ccccaagacacatatgacccatcacccc

SEQ ID NO: 14251 - DNA, 30 bp, Artificial Sequence
  Description of Artificial Sequence: Synthetic oligonucleotide
cccaagacacatatgacccatcaccccatc

SEQ ID NO: 14252 - DNA, 31 bp, Artificial Sequence
  Description of Artificial Sequence: Synthetic oligonucleotide
ccaagacacatatgacccatcaccccatctc

SEQ ID NO: 14253 - DNA, 32 bp, Artificial Sequence
  Description of Artificial Sequence: Synthetic oligonucleotide
caagacacatatgacccatcaccccatctctg

SEQ ID NO: 14254 - DNA, 33 bp, Artificial Sequence
  Description of Artificial Sequence: Synthetic oligonucleotide
aagacacatatgacccatcaccccatctctgac

SEQ ID NO: 14255 - DNA, 32 bp, Artificial Sequence
  Description of Artificial Sequence: Synthetic oligonucleotide
agacacatatgacccatcaccccatctctgac

SEQ ID NO: 14256 - DNA, 31 bp, Artificial Sequence
  Description of Artificial Sequence: Synthetic oligonucleotide
gacacatatgacccatcaccccatctctgac

SEQ ID NO: 14257 - DNA, 31 bp, Artificial Sequence
  Description of Artificial Sequence: Synthetic oligonucleotide
acacatatgacccatcaccccatctctgacc

SEQ ID NO: 14258 - DNA, 30 bp, Artificial Sequence
  Description of Artificial Sequence: Synthetic oligonucleotide
cacatatgacccatcaccccatctctgacc

SEQ ID NO: 14259 - DNA, 32 bp, Artificial Sequence
  Description of Artificial Sequence: Synthetic oligonucleotide
acatatgacccatcaccccatctctgaccatg

SEQ ID NO: 14260 - DNA, 31 bp, Artificial Sequence
  Description of Artificial Sequence: Synthetic oligonucleotide
catatgacccatcaccccatctctgaccatg

SEQ ID NO: 14261 - DNA, 32 bp, Artificial Sequence
  Description of Artificial Sequence: Synthetic oligonucleotide
atatgacccatcaccccatctctgaccatgag

SEQ ID NO: 14262 - DNA, 31 bp, Artificial Sequence
  Description of Artificial Sequence: Synthetic oligonucleotide
tatgacccatcaccccatctctgaccatgag

SEQ ID NO: 14263 - DNA, 30 bp, Artificial Sequence
  Description of Artificial Sequence: Synthetic oligonucleotide
atgacccatcaccccatctctgaccatgag

SEQ ID NO: 14264 - DNA, 29 bp, Artificial Sequence
  Description of Artificial Sequence: Synthetic oligonucleotide
tgacccatcaccccatctctgaccatgag

SEQ ID NO: 14265 - DNA, 28 bp, Artificial Sequence
  Description of Artificial Sequence: Synthetic oligonucleotide
gacccatcaccccatctctgaccatgag

SEQ ID NO: 14266 - DNA, 28 bp, Artificial Sequence
  Description of Artificial Sequence: Synthetic oligonucleotide
acccatcaccccatctctgaccatgagg

SEQ ID NO: 14267 - DNA, 27 bp, Artificial Sequence
  Description of Artificial Sequence: Synthetic oligonucleotide
cccatcaccccatctctgaccatgagg

SEQ ID NO: 14268 - DNA, 27 bp, Artificial Sequence
  Description of Artificial Sequence: Synthetic oligonucleotide
ccatcaccccatctctgaccatgaggc

SEQ ID NO: 14269 - DNA, 27 bp, Artificial Sequence
  Description of Artificial Sequence: Synthetic oligonucleotide
catcaccccatctctgaccatgaggcc

SEQ ID NO: 14270 - DNA, 28 bp, Artificial Sequence
  Description of Artificial Sequence: Synthetic oligonucleotide
atcaccccatctctgaccatgaggccac

SEQ ID NO: 14271 - DNA, 27 bp, Artificial Sequence
  Description of Artificial Sequence: Synthetic oligonucleotide
tcaccccatctctgaccatgaggccac

SEQ ID NO: 14272 - DNA, 26 bp, Artificial Sequence
  Description of Artificial Sequence: Synthetic oligonucleotide
agcaggaggggccggagtattgggat

SEQ ID NO: 14273 - DNA, 25 bp, Artificial Sequence
  Description of Artificial Sequence: Synthetic oligonucleotide
gcaggaggggccggagtattgggat

SEQ ID NO: 14274 - DNA, 26 bp, Artificial Sequence
  Description of Artificial Sequence: Synthetic oligonucleotide
caggaggggccggagtattgggatga

SEQ ID NO: 14275 - DNA, 26 bp, Artificial Sequence
  Description of Artificial Sequence: Synthetic oligonucleotide
aggaggggccggagtattgggatgag

SEQ ID NO: 14276 - DNA, 25 bp, Artificial Sequence
  Description of Artificial Sequence: Synthetic oligonucleotide
ggaggggccggagtattgggatgag

SEQ ID NO: 14277 - DNA, 26 bp, Artificial Sequence
  Description of Artificial Sequence: Synthetic oligonucleotide
gaggggccggagtattgggatgagga

SEQ ID NO: 14278 - DNA, 27 bp, Artificial Sequence
  Description of Artificial Sequence: Synthetic oligonucleotide
aggggccggagtattgggatgaggaga

SEQ ID NO: 14279 - DNA, 26 bp, Artificial Sequence
  Description of Artificial Sequence: Synthetic oligonucleotide
ggggccggagtattgggatgaggaga

SEQ ID NO: 14280 - DNA, 27 bp, Artificial Sequence
  Description of Artificial Sequence: Synthetic oligonucleotide
gggccggagtattgggatgaggagaca

SEQ ID NO: 14281 - DNA, 27 bp, Artificial Sequence
  Description of Artificial Sequence: Synthetic oligonucleotide
ggccggagtattgggatgaggagacag

SEQ ID NO: 14282 - DNA, 27 bp, Artificial Sequence
  Description of Artificial Sequence: Synthetic oligonucleotide
gccggagtattgggatgaggagacagg

SEQ ID NO: 14283 - DNA, 27 bp, Artificial Sequence
  Description of Artificial Sequence: Synthetic oligonucleotide
ccggagtattgggatgaggagacaggg

SEQ ID NO: 14284 - DNA, 30 bp, Artificial Sequence
  Description of Artificial Sequence: Synthetic oligonucleotide
cggagtattgggatgaggagacagggaaag

SEQ ID NO: 14285 - DNA, 31 bp, Artificial Sequence
  Description of Artificial Sequence: Synthetic oligonucleotide
ggagtattgggatgaggagacagggaaagtg

SEQ ID NO: 14286 - DNA, 33 bp, Artificial Sequence
  Description of Artificial Sequence: Synthetic oligonucleotide
gagtattgggatgaggagacagggaaagtgaag

SEQ ID NO: 14287 - DNA, 33 bp, Artificial Sequence
  Description of Artificial Sequence: Synthetic oligonucleotide
agtattgggatgaggagacagggaaagtgaagg

SEQ ID NO: 14288 - DNA, 32 bp, Artificial Sequence
  Description of Artificial Sequence: Synthetic oligonucleotide
gtattgggatgaggagacagggaaagtgaagg

SEQ ID NO: 14289 - DNA, 32 bp, Artificial Sequence
  Description of Artificial Sequence: Synthetic oligonucleotide
tattgggatgaggagacagggaaagtgaaggc

SEQ ID NO: 14290 - DNA, 31 bp, Artificial Sequence
  Description of Artificial Sequence: Synthetic oligonucleotide
attgggatgaggagacagggaaagtgaaggc

SEQ ID NO: 14291 - DNA, 30 bp, Artificial Sequence
  Description of Artificial Sequence: Synthetic oligonucleotide
ttgggatgaggagacagggaaagtgaaggc

SEQ ID NO: 14292 - DNA, 29 bp, Artificial Sequence
  Description of Artificial Sequence: Synthetic oligonucleotide
tgggatgaggagacagggaaagtgaaggc

SEQ ID NO: 14293 - DNA, 28 bp, Artificial Sequence
  Description of Artificial Sequence: Synthetic oligonucleotide
gggatgaggagacagggaaagtgaaggc

SEQ ID NO: 14294 - DNA, 28 bp, Artificial Sequence
  Description of Artificial Sequence: Synthetic oligonucleotide
ggatgaggagacagggaaagtgaaggcc

SEQ ID NO: 14295 - DNA, 28 bp, Artificial Sequence
  Description of Artificial Sequence: Synthetic oligonucleotide
gatgaggagacagggaaagtgaaggccc

SEQ ID NO: 14296 - DNA, 29 bp, Artificial Sequence
  Description of Artificial Sequence: Synthetic oligonucleotide
atgaggagacagggaaagtgaaggcccac

SEQ ID NO: 14297 - DNA, 28 bp, Artificial Sequence
  Description of Artificial Sequence: Synthetic oligonucleotide
tgaggagacagggaaagtgaaggcccac

SEQ ID NO: 14298 - DNA, 23 bp, Artificial Sequence
  Description of Artificial Sequence: Synthetic oligonucleotide
gcccatgtggcggagcagcagag

SEQ ID NO: 14299 - DNA, 23 bp, Artificial Sequence
  Description of Artificial Sequence: Synthetic oligonucleotide
cccatgtggcggagcagcagagg

SEQ ID NO: 14300 - DNA, 23 bp, Artificial Sequence
  Description of Artificial Sequence: Synthetic oligonucleotide
ccatgtggcggagcagcagaggg

SEQ ID NO: 14301 - DNA, 23 bp, Artificial Sequence
  Description of Artificial Sequence: Synthetic oligonucleotide
catgtggcggagcagcagagggc

SEQ ID NO: 14302 - DNA, 25 bp, Artificial Sequence
  Description of Artificial Sequence: Synthetic oligonucleotide
atgtggcggagcagcagagggccta

SEQ ID NO: 14303 - DNA, 24 bp, Artificial Sequence
  Description of Artificial Sequence: Synthetic oligonucleotide
tgtggcggagcagcagagggccta

SEQ ID NO: 14304 - DNA, 23 bp, Artificial Sequence
  Description of Artificial Sequence: Synthetic oligonucleotide
gtggcggagcagcagagggccta

SEQ ID NO: 14305 - DNA, 23 bp, Artificial Sequence
  Description of Artificial Sequence: Synthetic oligonucleotide
tggcggagcagcagagggcctac

SEQ ID NO: 14306 - DNA, 22 bp, Artificial Sequence
  Description of Artificial Sequence: Synthetic oligonucleotide
ggcggagcagcagagggcctac

SEQ ID NO: 14307 - DNA, 23 bp, Artificial Sequence
  Description of Artificial Sequence: Synthetic oligonucleotide
gcggagcagcagagggcctacct

SEQ ID NO: 14308 - DNA, 23 bp, Artificial Sequence
  Description of Artificial Sequence: Synthetic oligonucleotide
cggagcagcagagggcctacctg

SEQ ID NO: 14309 - DNA, 24 bp, Artificial Sequence
  Description of Artificial Sequence: Synthetic oligonucleotide
ggagcagcagagggcctacctgga

SEQ ID NO: 14310 - DNA, 24 bp, Artificial Sequence
  Description of Artificial Sequence: Synthetic oligonucleotide
gagcagcagagggcctacctggag

SEQ ID NO: 14311 - DNA, 24 bp, Artificial Sequence
  Description of Artificial Sequence: Synthetic oligonucleotide
agcagcagagggcctacctggagg

SEQ ID NO: 14312 - DNA, 23 bp, Artificial Sequence
  Description of Artificial Sequence: Synthetic oligonucleotide
gcagcagagggcctacctggagg

SEQ ID NO: 14313 - DNA, 23 bp, Artificial Sequence
  Description of Artificial Sequence: Synthetic oligonucleotide
cagcagagggcctacctggaggg

SEQ ID NO: 14314 - DNA, 24 bp, Artificial Sequence
  Description of Artificial Sequence: Synthetic oligonucleotide
agcagagggcctacctggagggca

SEQ ID NO: 14315 - DNA, 23 bp, Artificial Sequence
  Description of Artificial Sequence: Synthetic oligonucleotide
gcagagggcctacctggagggca

SEQ ID NO: 14316 - DNA, 23 bp, Artificial Sequence
  Description of Artificial Sequence: Synthetic oligonucleotide
cagagggcctacctggagggcac

SEQ ID NO: 14317 - DNA, 24 bp, Artificial Sequence
  Description of Artificial Sequence: Synthetic oligonucleotide
agagggcctacctggagggcacgt

SEQ ID NO: 14318 - DNA, 23 bp, Artificial Sequence
  Description of Artificial Sequence: Synthetic oligonucleotide
gagggcctacctggagggcacgt

SEQ ID NO: 14319 - DNA, 23 bp, Artificial Sequence
  Description of Artificial Sequence: Synthetic oligonucleotide
agggcctacctggagggcacgtg

SEQ ID NO: 14320 - DNA, 22 bp, Artificial Sequence
  Description of Artificial Sequence: Synthetic oligonucleotide
gggcctacctggagggcacgtg

SEQ ID NO: 14321 - DNA, 22 bp, Artificial Sequence
  Description of Artificial Sequence: Synthetic oligonucleotide
ggcctacctggagggcacgtgc

SEQ ID NO: 14322 - DNA, 25 bp, Artificial Sequence
  Description of Artificial Sequence: Synthetic oligonucleotide
ggccggagtattgggacgaggagac

SEQ ID NO: 14323 - DNA, 25 bp, Artificial Sequence
  Description of Artificial Sequence: Synthetic oligonucleotide
gccggagtattgggacgaggagacg

SEQ ID NO: 14324 - DNA, 25 bp, Artificial Sequence
  Description of Artificial Sequence: Synthetic oligonucleotide
ccggagtattgggacgaggagacgg

SEQ ID NO: 14325 - DNA, 25 bp, Artificial Sequence
  Description of Artificial Sequence: Synthetic oligonucleotide
cggagtattgggacgaggagacggg

SEQ ID NO: 14326 - DNA, 27 bp, Artificial Sequence
  Description of Artificial Sequence: Synthetic oligonucleotide
ggagtattgggacgaggagacggggaa

SEQ ID NO: 14327 - DNA, 28 bp, Artificial Sequence
  Description of Artificial Sequence: Synthetic oligonucleotide
gagtattgggacgaggagacggggaaag

SEQ ID NO: 14328 - DNA, 29 bp, Artificial Sequence
  Description of Artificial Sequence: Synthetic oligonucleotide
agtattgggacgaggagacggggaaagtg

SEQ ID NO: 14329 - DNA, 28 bp, Artificial Sequence
  Description of Artificial Sequence: Synthetic oligonucleotide
gtattgggacgaggagacggggaaagtg

SEQ ID NO: 14330 - DNA, 30 bp, Artificial Sequence
  Description of Artificial Sequence: Synthetic oligonucleotide
tattgggacgaggagacggggaaagtgaag

SEQ ID NO: 14331 - DNA, 29 bp, Artificial Sequence
  Description of Artificial Sequence: Synthetic oligonucleotide
attgggacgaggagacggggaaagtgaag

SEQ ID NO: 14332 - DNA, 28 bp, Artificial Sequence
  Description of Artificial Sequence: Synthetic oligonucleotide
ttgggacgaggagacggggaaagtgaag

SEQ ID NO: 14333 - DNA, 27 bp, Artificial Sequence
  Description of Artificial Sequence: Synthetic oligonucleotide
tgggacgaggagacggggaaagtgaag

SEQ ID NO: 14334 - DNA, 26 bp, Artificial Sequence
  Description of Artificial Sequence: Synthetic oligonucleotide
gggacgaggagacggggaaagtgaag

SEQ ID NO: 14335 - DNA, 26 bp, Artificial Sequence
  Description of Artificial Sequence: Synthetic oligonucleotide
ggacgaggagacggggaaagtgaagg

SEQ ID NO: 14336 - DNA, 26 bp, Artificial Sequence
  Description of Artificial Sequence: Synthetic oligonucleotide
gacgaggagacggggaaagtgaaggc

SEQ ID NO: 14337 - DNA, 26 bp, Artificial Sequence
  Description of Artificial Sequence: Synthetic oligonucleotide
acgaggagacggggaaagtgaaggcc

SEQ ID NO: 14338 - DNA, 25 bp, Artificial Sequence
  Description of Artificial Sequence: Synthetic oligonucleotide
cgaggagacggggaaagtgaaggcc

SEQ ID NO: 14339 - DNA, 26 bp, Artificial Sequence
  Description of Artificial Sequence: Synthetic oligonucleotide
gaggagacggggaaagtgaaggccca

SEQ ID NO: 14340 - DNA, 27 bp, Artificial Sequence
  Description of Artificial Sequence: Synthetic oligonucleotide
aggagacggggaaagtgaaggcccact

SEQ ID NO: 14341 - DNA, 26 bp, Artificial Sequence
  Description of Artificial Sequence: Synthetic oligonucleotide
ggagacggggaaagtgaaggcccact

SEQ ID NO: 14342 - DNA, 27 bp, Artificial Sequence
  Description of Artificial Sequence: Synthetic oligonucleotide
gagacggggaaagtgaaggcccactca

SEQ ID NO: 14343 - DNA, 27 bp, Artificial Sequence
  Description of Artificial Sequence: Synthetic oligonucleotide
agacggggaaagtgaaggcccactcac

SEQ ID NO: 14344 - DNA, 27 bp, Artificial Sequence
  Description of Artificial Sequence: Synthetic oligonucleotide
gacggggaaagtgaaggcccactcaca

SEQ ID NO: 14345 - DNA, 27 bp, Artificial Sequence
  Description of Artificial Sequence: Synthetic oligonucleotide
acggggaaagtgaaggcccactcacag

SEQ ID NO: 14346 - DNA, 27 bp, Artificial Sequence
  Description of Artificial Sequence: Synthetic oligonucleotide
cggggaaagtgaaggcccactcacaga

SEQ ID NO: 14347 - DNA, 27 bp, Artificial Sequence
  Description of Artificial Sequence: Synthetic oligonucleotide
ggggaaagtgaaggcccactcacagac

SEQ ID NO: 14348 - DNA, 24 bp, Artificial Sequence
  Description of Artificial Sequence: Synthetic oligonucleotide
ggaaggagacgctgcagcgcactg

SEQ ID NO: 14349 - DNA, 23 bp, Artificial Sequence
  Description of Artificial Sequence: Synthetic oligonucleotide
cgtggatagagcaggaggggccc

SEQ ID NO: 14350 - DNA, 24 bp, Artificial Sequence
  Description of Artificial Sequence: Synthetic oligonucleotide
gtggatagagcaggaggggcccga

SEQ ID NO: 14351 - DNA, 27 bp, Artificial Sequence
  Description of Artificial Sequence: Synthetic oligonucleotide
tggatagagcaggaggggcccgagtat

SEQ ID NO: 14352 - DNA, 27 bp, Artificial Sequence
  Description of Artificial Sequence: Synthetic oligonucleotide
ggatagagcaggaggggcccgagtatt

SEQ ID NO: 14353 - DNA, 27 bp, Artificial Sequence
  Description of Artificial Sequence: Synthetic oligonucleotide
gatagagcaggaggggcccgagtattg

SEQ ID NO: 14354 - DNA, 27 bp, Artificial Sequence
  Description of Artificial Sequence: Synthetic oligonucleotide
atagagcaggaggggcccgagtattgg

SEQ ID NO: 14355 - DNA, 26 bp, Artificial Sequence
  Description of Artificial Sequence: Synthetic oligonucleotide
tagagcaggaggggcccgagtattgg

SEQ ID NO: 14356 - DNA, 25 bp, Artificial Sequence
  Description of Artificial Sequence: Synthetic oligonucleotide
agagcaggaggggcccgagtattgg

SEQ ID NO: 14357 - DNA, 24 bp, Artificial Sequence
  Description of Artificial Sequence: Synthetic oligonucleotide
gagcaggaggggcccgagtattgg

SEQ ID NO: 14358 - DNA, 25 bp, Artificial Sequence
  Description of Artificial Sequence: Synthetic oligonucleotide
agcaggaggggcccgagtattggga

SEQ ID NO: 14359 - DNA, 24 bp, Artificial Sequence
  Description of Artificial Sequence: Synthetic oligonucleotide
gcaggaggggcccgagtattggga

SEQ ID NO: 14360 - DNA, 24 bp, Artificial Sequence
  Description of Artificial Sequence: Synthetic oligonucleotide
caggaggggcccgagtattgggac

SEQ ID NO: 14361 - DNA, 25 bp, Artificial Sequence
  Description of Artificial Sequence: Synthetic oligonucleotide
aggaggggcccgagtattgggacga

SEQ ID NO: 14362 - DNA, 24 bp, Artificial Sequence
  Description of Artificial Sequence: Synthetic oligonucleotide
ggaggggcccgagtattgggacga

SEQ ID NO: 14363 - DNA, 24 bp, Artificial Sequence
  Description of Artificial Sequence: Synthetic oligonucleotide
gaggggcccgagtattgggacgag

SEQ ID NO: 14364 - DNA, 25 bp, Artificial Sequence
  Description of Artificial Sequence: Synthetic oligonucleotide
aggggcccgagtattgggacgagga

SEQ ID NO: 14365 - DNA, 24 bp, Artificial Sequence
  Description of Artificial Sequence: Synthetic oligonucleotide
ggggcccgagtattgggacgagga

SEQ ID NO: 14366 - DNA, 25 bp, Artificial Sequence
  Description of Artificial Sequence: Synthetic oligonucleotide
gggcccgagtattgggacgaggaga

SEQ ID NO: 14367 - DNA, 26 bp, Artificial Sequence
  Description of Artificial Sequence: Synthetic oligonucleotide
ggcccgagtattgggacgaggagaca

SEQ ID NO: 14368 - DNA, 26 bp, Artificial Sequence
  Description of Artificial Sequence: Synthetic oligonucleotide
gcccgagtattgggacgaggagacag

SEQ ID NO: 14369 - DNA, 26 bp, Artificial Sequence
  Description of Artificial Sequence: Synthetic oligonucleotide
cccgagtattgggacgaggagacagg

SEQ ID NO: 14370 - DNA, 27 bp, Artificial Sequence
  Description of Artificial Sequence: Synthetic oligonucleotide
ccgagtattgggacgaggagacaggga

SEQ ID NO: 14371 - DNA, 29 bp, Artificial Sequence
  Description of Artificial Sequence: Synthetic oligonucleotide
cgagtattgggacgaggagacagggaaag

SEQ ID NO: 14372 - DNA, 22 bp, Artificial Sequence
  Description of Artificial Sequence: Synthetic oligonucleotide
gacagcgacgccgccagccaga

SEQ ID NO: 14373 - DNA, 22 bp, Artificial Sequence
  Description of Artificial Sequence: Synthetic oligonucleotide
acagcgacgccgccagccagag

SEQ ID NO: 14374 - DNA, 21 bp, Artificial Sequence
  Description of Artificial Sequence: Synthetic oligonucleotide
cagcgacgccgccagccagag

SEQ ID NO: 14375 - DNA, 23 bp, Artificial Sequence
  Description of Artificial Sequence: Synthetic oligonucleotide
agcgacgccgccagccagaggat

SEQ ID NO: 14376 - DNA, 22 bp, Artificial Sequence
  Description of Artificial Sequence: Synthetic oligonucleotide
gcgacgccgccagccagaggat

SEQ ID NO: 14377 - DNA, 22 bp, Artificial Sequence
  Description of Artificial Sequence: Synthetic oligonucleotide
cgacgccgccagccagaggatg

SEQ ID NO: 14378 - DNA, 23 bp, Artificial Sequence
  Description of Artificial Sequence: Synthetic oligonucleotide
gacgccgccagccagaggatgga

SEQ ID NO: 14379 - DNA, 23 bp, Artificial Sequence
  Description of Artificial Sequence: Synthetic oligonucleotide
acgccgccagccagaggatggag

SEQ ID NO: 14380 - DNA, 22 bp, Artificial Sequence
  Description of Artificial Sequence: Synthetic oligonucleotide
cgccgccagccagaggatggag

SEQ ID NO: 14381 - DNA, 22 bp, Artificial Sequence
  Description of Artificial Sequence: Synthetic oligonucleotide
gccgccagccagaggatggagc

SEQ ID NO: 14382 - DNA, 22 bp, Artificial Sequence
  Description of Artificial Sequence: Synthetic oligonucleotide
ccgccagccagaggatggagcc

SEQ ID NO: 14383 - DNA, 22 bp, Artificial Sequence
  Description of Artificial Sequence: Synthetic oligonucleotide
cgccagccagaggatggagccg

SEQ ID NO: 14384 - DNA, 22 bp, Artificial Sequence
  Description of Artificial Sequence: Synthetic oligonucleotide
gccagccagaggatggagccgc

SEQ ID NO: 14385 - DNA, 22 bp, Artificial Sequence
  Description of Artificial Sequence: Synthetic oligonucleotide
ccagccagaggatggagccgcg

SEQ ID NO: 14386 - DNA, 22 bp, Artificial Sequence
  Description of Artificial Sequence: Synthetic oligonucleotide
cagccagaggatggagccgcgg

SEQ ID NO: 14387 - DNA, 25 bp, Artificial Sequence
  Description of Artificial Sequence: Synthetic oligonucleotide
gcggcggacatggcggctcagataa

SEQ ID NO: 14388 - DNA, 25 bp, Artificial Sequence
  Description of Artificial Sequence: Synthetic oligonucleotide
cggcggacatggcggctcagataac

SEQ ID NO: 14389 - DNA, 27 bp, Artificial Sequence
  Description of Artificial Sequence: Synthetic oligonucleotide
ggcggacatggcggctcagataaccaa

SEQ ID NO: 14390 - DNA, 27 bp, Artificial Sequence
  Description of Artificial Sequence: Synthetic oligonucleotide
gcggacatggcggctcagataaccaag

SEQ ID NO: 14391 - DNA, 27 bp, Artificial Sequence
  Description of Artificial Sequence: Synthetic oligonucleotide
cggacatggcggctcagataaccaagc

SEQ ID NO: 14392 - DNA, 27 bp, Artificial Sequence
  Description of Artificial Sequence: Synthetic oligonucleotide
ggacatggcggctcagataaccaagcg

SEQ ID NO: 14393 - DNA, 27 bp, Artificial Sequence
  Description of Artificial Sequence: Synthetic oligonucleotide
gacatggcggctcagataaccaagcgc

SEQ ID NO: 14394 - DNA, 29 bp, Artificial Sequence
  Description of Artificial Sequence: Synthetic oligonucleotide
acatggcggctcagataaccaagcgcaag

SEQ ID NO: 14395 - DNA, 28 bp, Artificial Sequence
  Description of Artificial Sequence: Synthetic oligonucleotide
catggcggctcagataaccaagcgcaag

SEQ ID NO: 14396 - DNA, 29 bp, Artificial Sequence
  Description of Artificial Sequence: Synthetic oligonucleotide
atggcggctcagataaccaagcgcaagtg

SEQ ID NO: 14397 - DNA, 28 bp, Artificial Sequence
  Description of Artificial Sequence: Synthetic oligonucleotide
tggcggctcagataaccaagcgcaagtg

SEQ ID NO: 14398 - DNA, 27 bp, Artificial Sequence
  Description of Artificial Sequence: Synthetic oligonucleotide
ggcggctcagataaccaagcgcaagtg

SEQ ID NO: 14399 - DNA, 27 bp, Artificial Sequence
  Description of Artificial Sequence: Synthetic oligonucleotide
gcggctcagataaccaagcgcaagtgg

SEQ ID NO: 14400 - DNA, 27 bp, Artificial Sequence
  Description of Artificial Sequence: Synthetic oligonucleotide
cggctcagataaccaagcgcaagtggg

SEQ ID NO: 14401 - DNA, 28 bp, Artificial Sequence
  Description of Artificial Sequence: Synthetic oligonucleotide
ggctcagataaccaagcgcaagtgggag

SEQ ID NO: 14402 - DNA, 28 bp, Artificial Sequence
  Description of Artificial Sequence: Synthetic oligonucleotide
gctcagataaccaagcgcaagtgggagg

SEQ ID NO: 14403 - DNA, 28 bp, Artificial Sequence
  Description of Artificial Sequence: Synthetic oligonucleotide
ctcagataaccaagcgcaagtgggaggc

SEQ ID NO: 14404 - DNA, 28 bp, Artificial Sequence
  Description of Artificial Sequence: Synthetic oligonucleotide
tcagataaccaagcgcaagtgggaggcg

SEQ ID NO: 14405 - DNA, 27 bp, Artificial Sequence
  Description of Artificial Sequence: Synthetic oligonucleotide
cagataaccaagcgcaagtgggaggcg

SEQ ID NO: 14406 - DNA, 27 bp, Artificial Sequence
  Description of Artificial Sequence: Synthetic oligonucleotide
agataaccaagcgcaagtgggaggcgg

SEQ ID NO: 14407 - DNA, 26 bp, Artificial Sequence
  Description of Artificial Sequence: Synthetic oligonucleotide
gataaccaagcgcaagtgggaggcgg

SEQ ID NO: 14408 - DNA, 26 bp, Artificial Sequence
  Description of Artificial Sequence: Synthetic oligonucleotide
ataaccaagcgcaagtgggaggcggc

SEQ ID NO: 14409 - DNA, 25 bp, Artificial Sequence
  Description of Artificial Sequence: Synthetic oligonucleotide
taaccaagcgcaagtgggaggcggc

SEQ ID NO: 14410 - DNA, 24 bp, Artificial Sequence
  Description of Artificial Sequence: Synthetic oligonucleotide
aaccaagcgcaagtgggaggcggc

SEQ ID NO: 14411 - DNA, 26 bp, Artificial Sequence
  Description of Artificial Sequence: Synthetic oligonucleotide
agttcgtgcggttcgacagcgacgct

SEQ ID NO: 14412 - DNA, 25 bp, Artificial Sequence
  Description of Artificial Sequence: Synthetic oligonucleotide
gttcgtgcggttcgacagcgacgct

SEQ ID NO: 14413 - DNA, 25 bp, Artificial Sequence
  Description of Artificial Sequence: Synthetic oligonucleotide
ttcgtgcggttcgacagcgacgctg

SEQ ID NO: 14414 - DNA, 24 bp, Artificial Sequence
  Description of Artificial Sequence: Synthetic oligonucleotide
tcgtgcggttcgacagcgacgctg

SEQ ID NO: 14415 - DNA, 23 bp, Artificial Sequence
  Description of Artificial Sequence: Synthetic oligonucleotide
cgtgcggttcgacagcgacgctg

SEQ ID NO: 14416 - DNA, 23 bp, Artificial Sequence
  Description of Artificial Sequence: Synthetic oligonucleotide
gtgcggttcgacagcgacgctgc

SEQ ID NO: 14417 - DNA, 24 bp, Artificial Sequence
  Description of Artificial Sequence: Synthetic oligonucleotide
tgcggttcgacagcgacgctgcga

SEQ ID NO: 14418 - DNA, 23 bp, Artificial Sequence
  Description of Artificial Sequence: Synthetic oligonucleotide
gcggttcgacagcgacgctgcga

SEQ ID NO: 14419 - DNA, 23 bp, Artificial Sequence
  Description of Artificial Sequence: Synthetic oligonucleotide
cggttcgacagcgacgctgcgag

SEQ ID NO: 14420 - DNA, 23 bp, Artificial Sequence
  Description of Artificial Sequence: Synthetic oligonucleotide
ggttcgacagcgacgctgcgagc

SEQ ID NO: 14421 - DNA, 24 bp, Artificial Sequence
  Description of Artificial Sequence: Synthetic oligonucleotide
gttcgacagcgacgctgcgagcca

SEQ ID NO: 14422 - DNA, 25 bp, Artificial Sequence
  Description of Artificial Sequence: Synthetic oligonucleotide
ttcgacagcgacgctgcgagccaga

SEQ ID NO: 14423 - DNA, 24 bp, Artificial Sequence
  Description of Artificial Sequence: Synthetic oligonucleotide
tcgacagcgacgctgcgagccaga

SEQ ID NO: 14424 - DNA, 23 bp, Artificial Sequence
  Description of Artificial Sequence: Synthetic oligonucleotide
cgacagcgacgctgcgagccaga

SEQ ID NO: 14425 - DNA, 23 bp, Artificial Sequence
  Description of Artificial Sequence: Synthetic oligonucleotide
gacagcgacgctgcgagccagag

SEQ ID NO: 14426 - DNA, 25 bp, Artificial Sequence
  Description of Artificial Sequence: Synthetic oligonucleotide
acagcgacgctgcgagccagaggat

SEQ ID NO: 14427 - DNA, 24 bp, Artificial Sequence
  Description of Artificial Sequence: Synthetic oligonucleotide
cagcgacgctgcgagccagaggat

SEQ ID NO: 14428 - DNA, 24 bp, Artificial Sequence
  Description of Artificial Sequence: Synthetic oligonucleotide
agcgacgctgcgagccagaggatg

SEQ ID NO: 14429 - DNA, 23 bp, Artificial Sequence
  Description of Artificial Sequence: Synthetic oligonucleotide
gcgacgctgcgagccagaggatg

SEQ ID NO: 14430 - DNA, 24 bp, Artificial Sequence
  Description of Artificial Sequence: Synthetic oligonucleotide
cgacgctgcgagccagaggatgga

SEQ ID NO: 14431 - DNA, 24 bp, Artificial Sequence
  Description of Artificial Sequence: Synthetic oligonucleotide
gacgctgcgagccagaggatggag

SEQ ID NO: 14432 - DNA, 24 bp, Artificial Sequence
  Description of Artificial Sequence: Synthetic oligonucleotide
acgctgcgagccagaggatggagc

SEQ ID NO: 14433 - DNA, 23 bp, Artificial Sequence
  Description of Artificial Sequence: Synthetic oligonucleotide
cgctgcgagccagaggatggagc

SEQ ID NO: 14434 - DNA, 23 bp, Artificial Sequence
  Description of Artificial Sequence: Synthetic oligonucleotide
gctgcgagccagaggatggagcc

SEQ ID NO: 14435 - DNA, 23 bp, Artificial Sequence
  Description of Artificial Sequence: Synthetic oligonucleotide
ctgcgagccagaggatggagccg

SEQ ID NO: 14436 - DNA, 23 bp, Artificial Sequence
  Description of Artificial Sequence: Synthetic oligonucleotide
tgcgagccagaggatggagccgc

SEQ ID NO: 14437 - DNA, 29 bp, Artificial Sequence
  Description of Artificial Sequence: Synthetic oligonucleotide
gaggagacagggaaagtgaaggcccattc

SEQ ID NO: 14438 - DNA, 30 bp, Artificial Sequence
  Description of Artificial Sequence: Synthetic oligonucleotide
aggagacagggaaagtgaaggcccattcac

SEQ ID NO: 14439 - DNA, 29 bp, Artificial Sequence
  Description of Artificial Sequence: Synthetic oligonucleotide
ggagacagggaaagtgaaggcccattcac

SEQ ID NO: 14440 - DNA, 30 bp, Artificial Sequence
  Description of Artificial Sequence: Synthetic oligonucleotide
gagacagggaaagtgaaggcccattcacag

SEQ ID NO: 14441 - DNA, 31 bp, Artificial Sequence
  Description of Artificial Sequence: Synthetic oligonucleotide
agacagggaaagtgaaggcccattcacagac

SEQ ID NO: 14442 - DNA, 30 bp, Artificial Sequence
  Description of Artificial Sequence: Synthetic oligonucleotide
gacagggaaagtgaaggcccattcacagac

SEQ ID NO: 14443 - DNA, 31 bp, Artificial Sequence
  Description of Artificial Sequence: Synthetic oligonucleotide
acagggaaagtgaaggcccattcacagactg

SEQ ID NO: 14444 - DNA, 30 bp, Artificial Sequence
  Description of Artificial Sequence: Synthetic oligonucleotide
cagggaaagtgaaggcccattcacagactg

SEQ ID NO: 14445 - DNA, 31 bp, Artificial Sequence
  Description of Artificial Sequence: Synthetic oligonucleotide
agggaaagtgaaggcccattcacagactgac

SEQ ID NO: 14446 - DNA, 30 bp, Artificial Sequence
  Description of Artificial Sequence: Synthetic oligonucleotide
gggaaagtgaaggcccattcacagactgac

SEQ ID NO: 14447 - DNA, 30 bp, Artificial Sequence
  Description of Artificial Sequence: Synthetic oligonucleotide
ggaaagtgaaggcccattcacagactgacc

SEQ ID NO: 14448 - DNA, 30 bp, Artificial Sequence
  Description of Artificial Sequence: Synthetic oligonucleotide
gaaagtgaaggcccattcacagactgaccg

SEQ ID NO: 14449 - DNA, 31 bp, Artificial Sequence
  Description of Artificial Sequence: Synthetic oligonucleotide
aaagtgaaggcccattcacagactgaccgag

SEQ ID NO: 14450 - DNA, 30 bp, Artificial Sequence
  Description of Artificial Sequence: Synthetic oligonucleotide
aagtgaaggcccattcacagactgaccgag

SEQ ID NO: 14451 - DNA, 29 bp, Artificial Sequence
  Description of Artificial Sequence: Synthetic oligonucleotide
agtgaaggcccattcacagactgaccgag

SEQ ID NO: 14452 - DNA, 28 bp, Artificial Sequence
  Description of Artificial Sequence: Synthetic oligonucleotide
gtgaaggcccattcacagactgaccgag

SEQ ID NO: 14453 - DNA, 29 bp, Artificial Sequence
  Description of Artificial Sequence: Synthetic oligonucleotide
tgaaggcccattcacagactgaccgagag

SEQ ID NO: 14454 - DNA, 28 bp, Artificial Sequence
  Description of Artificial Sequence: Synthetic oligonucleotide
gaaggcccattcacagactgaccgagag

SEQ ID NO: 14455 - DNA, 30 bp, Artificial Sequence
  Description of Artificial Sequence: Synthetic oligonucleotide
aaggcccattcacagactgaccgagagaac

SEQ ID NO: 14456 - DNA, 29 bp, Artificial Sequence
  Description of Artificial Sequence: Synthetic oligonucleotide
aggcccattcacagactgaccgagagaac

SEQ ID NO: 14457 - DNA, 28 bp, Artificial Sequence
  Description of Artificial Sequence: Synthetic oligonucleotide
ggcccattcacagactgaccgagagaac

SEQ ID NO: 14458 - DNA, 28 bp, Artificial Sequence
  Description of Artificial Sequence: Synthetic oligonucleotide
gcccattcacagactgaccgagagaacc

SEQ ID NO: 14459 - DNA, 29 bp, Artificial Sequence
  Description of Artificial Sequence: Synthetic oligonucleotide
cccattcacagactgaccgagagaacctg

SEQ ID NO: 14460 - DNA, 29 bp, Artificial Sequence
  Description of Artificial Sequence: Synthetic oligonucleotide
ccattcacagactgaccgagagaacctgc

SEQ ID NO: 14461 - DNA, 29 bp, Artificial Sequence
  Description of Artificial Sequence: Synthetic oligonucleotide
cattcacagactgaccgagagaacctgcg

SEQ ID NO: 14462 - DNA, 29 bp, Artificial Sequence
  Description of Artificial Sequence: Synthetic oligonucleotide
attcacagactgaccgagagaacctgcgg

SEQ ID NO: 14463 - DNA, 28 bp, Artificial Sequence
  Description of Artificial Sequence: Synthetic oligonucleotide
ttcacagactgaccgagagaacctgcgg

SEQ ID NO: 14464 - DNA, 27 bp, Artificial Sequence
  Description of Artificial Sequence: Synthetic oligonucleotide
agcagagagcctacctggagggcacat

SEQ ID NO: 14465 - DNA, 26 bp, Artificial Sequence
  Description of Artificial Sequence: Synthetic oligonucleotide
gcagagagcctacctggagggcacat

SEQ ID NO: 14466 - DNA, 26 bp, Artificial Sequence
  Description of Artificial Sequence: Synthetic oligonucleotide
cagagagcctacctggagggcacatg

SEQ ID NO: 14467 - DNA, 26 bp, Artificial Sequence
  Description of Artificial Sequence: Synthetic oligonucleotide
agagagcctacctggagggcacatgc

SEQ ID NO: 14468 - DNA, 25 bp, Artificial Sequence
  Description of Artificial Sequence: Synthetic oligonucleotide
gagagcctacctggagggcacatgc

SEQ ID NO: 14469 - DNA, 26 bp, Artificial Sequence
  Description of Artificial Sequence: Synthetic oligonucleotide
agagcctacctggagggcacatgcgt

SEQ ID NO: 14470 - DNA, 25 bp, Artificial Sequence
  Description of Artificial Sequence: Synthetic oligonucleotide
gagcctacctggagggcacatgcgt

SEQ ID NO: 14471 - DNA, 25 bp, Artificial Sequence
  Description of Artificial Sequence: Synthetic oligonucleotide
agcctacctggagggcacatgcgtg

SEQ ID NO: 14472 - DNA, 24 bp, Artificial Sequence
  Description of Artificial Sequence: Synthetic oligonucleotide
gcctacctggagggcacatgcgtg

SEQ ID NO: 14473 - DNA, 25 bp, Artificial Sequence
  Description of Artificial Sequence: Synthetic oligonucleotide
cctacctggagggcacatgcgtgga

SEQ ID NO: 14474 - DNA, 25 bp, Artificial Sequence
  Description of Artificial Sequence: Synthetic oligonucleotide
ctacctggagggcacatgcgtggac

SEQ ID NO: 14475 - DNA, 25 bp, Artificial Sequence
  Description of Artificial Sequence: Synthetic oligonucleotide
tacctggagggcacatgcgtggacg

SEQ ID NO: 14476 - DNA, 24 bp, Artificial Sequence
  Description of Artificial Sequence: Synthetic oligonucleotide
acctggagggcacatgcgtggacg

SEQ ID NO: 14477 - DNA, 23 bp, Artificial Sequence
  Description of Artificial Sequence: Synthetic oligonucleotide
cctggagggcacatgcgtggacg

SEQ ID NO: 14478 - DNA, 23 bp, Artificial Sequence
  Description of Artificial Sequence: Synthetic oligonucleotide
ctggagggcacatgcgtggacgg

SEQ ID NO: 14479 - DNA, 23 bp, Artificial Sequence
  Description of Artificial Sequence: Synthetic oligonucleotide
tggagggcacatgcgtggacggg

SEQ ID NO: 14480 - DNA, 22 bp, Artificial Sequence
  Description of Artificial Sequence: Synthetic oligonucleotide
ggagggcacatgcgtggacggg

SEQ ID NO: 14481 - DNA, 23 bp, Artificial Sequence
  Description of Artificial Sequence: Synthetic oligonucleotide
gagggcacatgcgtggacgggct

SEQ ID NO: 14482 - DNA, 23 bp, Artificial Sequence
  Description of Artificial Sequence: Synthetic oligonucleotide
agggcacatgcgtggacgggctc

SEQ ID NO: 14483 - DNA, 22 bp, Artificial Sequence
  Description of Artificial Sequence: Synthetic oligonucleotide
gggcacatgcgtggacgggctc

SEQ ID NO: 14484 - DNA, 22 bp, Artificial Sequence
  Description of Artificial Sequence: Synthetic oligonucleotide
ggcacatgcgtggacgggctcc

SEQ ID NO: 14485 - DNA, 22 bp, Artificial Sequence
  Description of Artificial Sequence: Synthetic oligonucleotide
gcacatgcgtggacgggctccg

SEQ ID NO: 14486 - DNA, 23 bp, Artificial Sequence
  Description of Artificial Sequence: Synthetic oligonucleotide
cacatgcgtggacgggctccgca

SEQ ID NO: 14487 - DNA, 26 bp, Artificial Sequence
  Description of Artificial Sequence: Synthetic oligonucleotide
acatgcgtggacgggctccgcagata

SEQ ID NO: 14488 - DNA, 25 bp, Artificial Sequence
  Description of Artificial Sequence: Synthetic oligonucleotide
catgcgtggacgggctccgcagata

SEQ ID NO: 14489 - DNA, 25 bp, Artificial Sequence
  Description of Artificial Sequence: Synthetic oligonucleotide
atgcgtggacgggctccgcagatac

SEQ ID NO: 14490 - DNA, 24 bp, Artificial Sequence
  Description of Artificial Sequence: Synthetic oligonucleotide
agcgccgtggatagagcaggaggg

SEQ ID NO: 14491 - DNA, 23 bp, Artificial Sequence
  Description of Artificial Sequence: Synthetic oligonucleotide
tcttggaccgccgcggacatggc

SEQ ID NO: 14492 - DNA, 22 bp, Artificial Sequence
  Description of Artificial Sequence: Synthetic oligonucleotide
cttggaccgccgcggacatggc

SEQ ID NO: 14493 - DNA, 22 bp, Artificial Sequence
  Description of Artificial Sequence: Synthetic oligonucleotide
ttggaccgccgcggacatggcg

SEQ ID NO: 14494 - DNA, 21 bp, Artificial Sequence
  Description of Artificial Sequence: Synthetic oligonucleotide
tggaccgccgcggacatggcg

SEQ ID NO: 14495 - DNA, 20 bp, Artificial Sequence
  Description of Artificial Sequence: Synthetic oligonucleotide
ggaccgccgcggacatggcg

SEQ ID NO: 14496 - DNA, 20 bp, Artificial Sequence
  Description of Artificial Sequence: Synthetic oligonucleotide
gaccgccgcggacatggcgg

SEQ ID NO: 14497 - DNA, 21 bp, Artificial Sequence
  Description of Artificial Sequence: Synthetic oligonucleotide
accgccgcggacatggcggct

SEQ ID NO: 14498 - DNA, 20 bp, Artificial Sequence
  Description of Artificial Sequence: Synthetic oligonucleotide
ccgccgcggacatggcggct

SEQ ID NO: 14499 - DNA, 21 bp, Artificial Sequence
  Description of Artificial Sequence: Synthetic oligonucleotide
cgccgcggacatggcggctca

SEQ ID NO: 14500 - DNA, 23 bp, Artificial Sequence
  Description of Artificial Sequence: Synthetic oligonucleotide
gccgcggacatggcggctcagat

SEQ ID NO: 14501 - DNA, 24 bp, Artificial Sequence
  Description of Artificial Sequence: Synthetic oligonucleotide
ccgcggacatggcggctcagatca

SEQ ID NO: 14502 - DNA, 24 bp, Artificial Sequence
  Description of Artificial Sequence: Synthetic oligonucleotide
cgcggacatggcggctcagatcac

SEQ ID NO: 14503 - DNA, 28 bp, Artificial Sequence
  Description of Artificial Sequence: Synthetic oligonucleotide
ggagtattgggacgaggagacagggaag

SEQ ID NO: 14504 - DNA, 28 bp, Artificial Sequence
  Description of Artificial Sequence: Synthetic oligonucleotide
gagtattgggacgaggagacagggaagg

SEQ ID NO: 14505 - DNA, 29 bp, Artificial Sequence
  Description of Artificial Sequence: Synthetic oligonucleotide
agtattgggacgaggagacagggaaggtg

SEQ ID NO: 14506 - DNA, 28 bp, Artificial Sequence
  Description of Artificial Sequence: Synthetic oligonucleotide
gtattgggacgaggagacagggaaggtg

SEQ ID NO: 14507 - DNA, 30 bp, Artificial Sequence
  Description of Artificial Sequence: Synthetic oligonucleotide
tattgggacgaggagacagggaaggtgaag

SEQ ID NO: 14508 - DNA, 29 bp, Artificial Sequence
  Description of Artificial Sequence: Synthetic oligonucleotide
attgggacgaggagacagggaaggtgaag

SEQ ID NO: 14509 - DNA, 28 bp, Artificial Sequence
  Description of Artificial Sequence: Synthetic oligonucleotide
ttgggacgaggagacagggaaggtgaag

SEQ ID NO: 14510 - DNA, 27 bp, Artificial Sequence
  Description of Artificial Sequence: Synthetic oligonucleotide
tgggacgaggagacagggaaggtgaag

SEQ ID NO: 14511 - DNA, 26 bp, Artificial Sequence
  Description of Artificial Sequence: Synthetic oligonucleotide
gggacgaggagacagggaaggtgaag

SEQ ID NO: 14512 - DNA, 26 bp, Artificial Sequence
  Description of Artificial Sequence: Synthetic oligonucleotide
ggacgaggagacagggaaggtgaagg

SEQ ID NO: 14513 - DNA, 26 bp, Artificial Sequence
  Description of Artificial Sequence: Synthetic oligonucleotide
gacgaggagacagggaaggtgaaggc

SEQ ID NO: 14514 - DNA, 26 bp, Artificial Sequence
  Description of Artificial Sequence: Synthetic oligonucleotide
acgaggagacagggaaggtgaaggcc

SEQ ID NO: 14515 - DNA, 25 bp, Artificial Sequence
  Description of Artificial Sequence: Synthetic oligonucleotide
cgaggagacagggaaggtgaaggcc

SEQ ID NO: 14516 - DNA, 26 bp, Artificial Sequence
  Description of Artificial Sequence: Synthetic oligonucleotide
gaggagacagggaaggtgaaggccca

SEQ ID NO: 14517 - DNA, 27 bp, Artificial Sequence
  Description of Artificial Sequence: Synthetic oligonucleotide
aggagacagggaaggtgaaggcccact

SEQ ID NO: 14518 - DNA, 26 bp, Artificial Sequence
  Description of Artificial Sequence: Synthetic oligonucleotide
ggagacagggaaggtgaaggcccact

SEQ ID NO: 14519 - DNA, 27 bp, Artificial Sequence
  Description of Artificial Sequence: Synthetic oligonucleotide
gagacagggaaggtgaaggcccactca

SEQ ID NO: 14520 - DNA, 27 bp, Artificial Sequence
  Description of Artificial Sequence: Synthetic oligonucleotide
agacagggaaggtgaaggcccactcac

SEQ ID NO: 14521 - DNA, 27 bp, Artificial Sequence
  Description of Artificial Sequence: Synthetic oligonucleotide
gacagggaaggtgaaggcccactcaca

SEQ ID NO: 14522 - DNA, 27 bp, Artificial Sequence
  Description of Artificial Sequence: Synthetic oligonucleotide
acagggaaggtgaaggcccactcacag

SEQ ID NO: 14523 - DNA, 27 bp, Artificial Sequence
  Description of Artificial Sequence: Synthetic oligonucleotide
cagggaaggtgaaggcccactcacaga

SEQ ID NO: 14524 - DNA, 27 bp, Artificial Sequence
  Description of Artificial Sequence: Synthetic oligonucleotide
agggaaggtgaaggcccactcacagac

SEQ ID NO: 14525 - DNA, 27 bp, Artificial Sequence
  Description of Artificial Sequence: Synthetic oligonucleotide
gggaaggtgaaggcccactcacagact

SEQ ID NO: 14526 - DNA, 27 bp, Artificial Sequence
  Description of Artificial Sequence: Synthetic oligonucleotide
ggaaggtgaaggcccactcacagactg

SEQ ID NO: 14527 - DNA, 28 bp, Artificial Sequence
  Description of Artificial Sequence: Synthetic oligonucleotide
gaaggtgaaggcccactcacagactgac

SEQ ID NO: 14528 - DNA, 28 bp, Artificial Sequence
  Description of Artificial Sequence: Synthetic oligonucleotide
aaggtgaaggcccactcacagactgacc

SEQ ID NO: 14529 - DNA, 27 bp, Artificial Sequence
  Description of Artificial Sequence: Synthetic oligonucleotide
aggtgaaggcccactcacagactgacc

SEQ ID NO: 14530 - DNA, 26 bp, Artificial Sequence
  Description of Artificial Sequence: Synthetic oligonucleotide
ggtgaaggcccactcacagactgacc

SEQ ID NO: 14531 - DNA, 24 bp, Artificial Sequence
  Description of Artificial Sequence: Synthetic oligonucleotide
gacgccgcgagccagaggatggaa

SEQ ID NO: 14532 - DNA, 24 bp, Artificial Sequence
  Description of Artificial Sequence: Synthetic oligonucleotide
acgccgcgagccagaggatggaac

SEQ ID NO: 14533 - DNA, 23 bp, Artificial Sequence
  Description of Artificial Sequence: Synthetic oligonucleotide
cgccgcgagccagaggatggaac

SEQ ID NO: 14534 - DNA, 23 bp, Artificial Sequence
  Description of Artificial Sequence: Synthetic oligonucleotide
gccgcgagccagaggatggaacc

SEQ ID NO: 14535 - DNA, 23 bp, Artificial Sequence
  Description of Artificial Sequence: Synthetic oligonucleotide
ccgcgagccagaggatggaaccg

SEQ ID NO: 14536 - DNA, 23 bp, Artificial Sequence
  Description of Artificial Sequence: Synthetic oligonucleotide
cgcgagccagaggatggaaccgc

SEQ ID NO: 14537 - DNA, 23 bp, Artificial Sequence
  Description of Artificial Sequence: Synthetic oligonucleotide
gcgagccagaggatggaaccgcg

SEQ ID NO: 14538 - DNA, 23 bp, Artificial Sequence
  Description of Artificial Sequence: Synthetic oligonucleotide
cgagccagaggatggaaccgcgg

SEQ ID NO: 14539 - DNA, 23 bp, Artificial Sequence
  Description of Artificial Sequence: Synthetic oligonucleotide
gagccagaggatggaaccgcggg

SEQ ID NO: 14540 - DNA, 23 bp, Artificial Sequence
  Description of Artificial Sequence: Synthetic oligonucleotide
agccagaggatggaaccgcgggc

SEQ ID NO: 14541 - DNA, 22 bp, Artificial Sequence
  Description of Artificial Sequence: Synthetic oligonucleotide
gccagaggatggaaccgcgggc

SEQ ID NO: 14542 - DNA, 22 bp, Artificial Sequence
  Description of Artificial Sequence: Synthetic oligonucleotide
ccagaggatggaaccgcgggcg

SEQ ID NO: 14543 - DNA, 22 bp, Artificial Sequence
  Description of Artificial Sequence: Synthetic oligonucleotide
cagaggatggaaccgcgggcgc

SEQ ID NO: 14544 - DNA, 22 bp, Artificial Sequence
  Description of Artificial Sequence: Synthetic oligonucleotide
agaggatggaaccgcgggcgcc

SEQ ID NO: 14545 - DNA, 21 bp, Artificial Sequence
  Description of Artificial Sequence: Synthetic oligonucleotide
gaggatggaaccgcgggcgcc

SEQ ID NO: 14546 - DNA, 22 bp, Artificial Sequence
  Description of Artificial Sequence: Synthetic oligonucleotide
aggatggaaccgcgggcgccgt

SEQ ID NO: 14547 - DNA, 21 bp, Artificial Sequence
  Description of Artificial Sequence: Synthetic oligonucleotide
ggatggaaccgcgggcgccgt

SEQ ID NO: 14548 - DNA, 21 bp, Artificial Sequence
  Description of Artificial Sequence: Synthetic oligonucleotide
gatggaaccgcgggcgccgtg

SEQ ID NO: 14549 - DNA, 24 bp, Artificial Sequence
  Description of Artificial Sequence: Synthetic oligonucleotide
atggaaccgcgggcgccgtggata

SEQ ID NO: 14550 - DNA, 23 bp, Artificial Sequence
  Description of Artificial Sequence: Synthetic oligonucleotide
tggaaccgcgggcgccgtggata

SEQ ID NO: 14551 - DNA, 22 bp, Artificial Sequence
  Description of Artificial Sequence: Synthetic oligonucleotide
ggaaccgcgggcgccgtggata

SEQ ID NO: 14552 - DNA, 23 bp, Artificial Sequence
  Description of Artificial Sequence: Synthetic oligonucleotide
gaaccgcgggcgccgtggataga

SEQ ID NO: 14553 - DNA, 23 bp, Artificial Sequence
  Description of Artificial Sequence: Synthetic oligonucleotide
aaccgcgggcgccgtggatagag

SEQ ID NO: 14554 - DNA, 22 bp, Artificial Sequence
  Description of Artificial Sequence: Synthetic oligonucleotide
accgcgggcgccgtggatagag

SEQ ID NO: 14555 - DNA, 29 bp, Artificial Sequence
  Description of Artificial Sequence: Synthetic oligonucleotide
cagatgatgtttggctgcgacgtgggatc

SEQ ID NO: 14556 - DNA, 29 bp, Artificial Sequence
  Description of Artificial Sequence: Synthetic oligonucleotide
agatgatgtttggctgcgacgtgggatcg

SEQ ID NO: 14557 - DNA, 28 bp, Artificial Sequence
  Description of Artificial Sequence: Synthetic oligonucleotide
gatgatgtttggctgcgacgtgggatcg

SEQ ID NO: 14558 - DNA, 28 bp, Artificial Sequence
  Description of Artificial Sequence: Synthetic oligonucleotide
atgatgtttggctgcgacgtgggatcgg

SEQ ID NO: 14559 - DNA, 27 bp, Artificial Sequence
  Description of Artificial Sequence: Synthetic oligonucleotide
tgatgtttggctgcgacgtgggatcgg

SEQ ID NO: 14560 - DNA, 27 bp, Artificial Sequence
  Description of Artificial Sequence: Synthetic oligonucleotide
gatgtttggctgcgacgtgggatcgga

SEQ ID NO: 14561 - DNA, 27 bp, Artificial Sequence
  Description of Artificial Sequence: Synthetic oligonucleotide
atgtttggctgcgacgtgggatcggac

SEQ ID NO: 14562 - DNA, 26 bp, Artificial Sequence
  Description of Artificial Sequence: Synthetic oligonucleotide
tgtttggctgcgacgtgggatcggac

SEQ ID NO: 14563 - DNA, 25 bp, Artificial Sequence
  Description of Artificial Sequence: Synthetic oligonucleotide
gtttggctgcgacgtgggatcggac

SEQ ID NO: 14564 - DNA, 25 bp, Artificial Sequence
  Description of Artificial Sequence: Synthetic oligonucleotide
tttggctgcgacgtgggatcggacg

SEQ ID NO: 14565 - DNA, 24 bp, Artificial Sequence
  Description of Artificial Sequence: Synthetic oligonucleotide
ttggctgcgacgtgggatcggacg

SEQ ID NO: 14566 - DNA, 23 bp, Artificial Sequence
  Description of Artificial Sequence: Synthetic oligonucleotide
tggctgcgacgtgggatcggacg

SEQ ID NO: 14567 - DNA, 22 bp, Artificial Sequence
  Description of Artificial Sequence: Synthetic oligonucleotide
ggctgcgacgtgggatcggacg

SEQ ID NO: 14568 - DNA, 22 bp, Artificial Sequence
  Description of Artificial Sequence: Synthetic oligonucleotide
gctgcgacgtgggatcggacgg

SEQ ID NO: 14569 - DNA, 22 bp, Artificial Sequence
  Description of Artificial Sequence: Synthetic oligonucleotide
ctgcgacgtgggatcggacggg

SEQ ID NO: 14570 - DNA, 22 bp, Artificial Sequence
  Description of Artificial Sequence: Synthetic oligonucleotide
tgcgacgtgggatcggacgggc

SEQ ID NO: 14571 - DNA, 21 bp, Artificial Sequence
  Description of Artificial Sequence: Synthetic oligonucleotide
gcgacgtgggatcggacgggc

SEQ ID NO: 14572 - DNA, 21 bp, Artificial Sequence
  Description of Artificial Sequence: Synthetic oligonucleotide
cgacgtgggatcggacgggcg

SEQ ID NO: 14573 - DNA, 23 bp, Artificial Sequence
  Description of Artificial Sequence: Synthetic oligonucleotide
gacgtgggatcggacgggcgctt

SEQ ID NO: 14574 - DNA, 23 bp, Artificial Sequence
  Description of Artificial Sequence: Synthetic oligonucleotide
acgtgggatcggacgggcgcttc

SEQ ID NO: 14575 - DNA, 22 bp, Artificial Sequence
  Description of Artificial Sequence: Synthetic oligonucleotide
cgtgggatcggacgggcgcttc

SEQ ID NO: 14576 - DNA, 23 bp, Artificial Sequence
  Description of Artificial Sequence: Synthetic oligonucleotide
gtgggatcggacgggcgcttcct

SEQ ID NO: 14577 - DNA, 23 bp, Artificial Sequence
  Description of Artificial Sequence: Synthetic oligonucleotide
tgggatcggacgggcgcttcctc

SEQ ID NO: 14578 - DNA, 22 bp, Artificial Sequence
  Description of Artificial Sequence: Synthetic oligonucleotide
gggatcggacgggcgcttcctc

SEQ ID NO: 14579 - DNA, 22 bp, Artificial Sequence
  Description of Artificial Sequence: Synthetic oligonucleotide
ggatcggacgggcgcttcctcc

SEQ ID NO: 14580 - DNA, 22 bp, Artificial Sequence
  Description of Artificial Sequence: Synthetic oligonucleotide
gatcggacgggcgcttcctccg

SEQ ID NO: 14581 - DNA, 22 bp, Artificial Sequence
  Description of Artificial Sequence: Synthetic oligonucleotide
atcggacgggcgcttcctccgc

SEQ ID NO: 14582 - DNA, 28 bp, Artificial Sequence
  Description of Artificial Sequence: Synthetic oligonucleotide
ctgaaagaggacctgcgctcttggactg

SEQ ID NO: 14583 - DNA, 28 bp, Artificial Sequence
  Description of Artificial Sequence: Synthetic oligonucleotide
tgaaagaggacctgcgctcttggactgc

SEQ ID NO: 14584 - DNA, 27 bp, Artificial Sequence
  Description of Artificial Sequence: Synthetic oligonucleotide
gaaagaggacctgcgctcttggactgc

SEQ ID NO: 14585 - DNA, 27 bp, Artificial Sequence
  Description of Artificial Sequence: Synthetic oligonucleotide
aaagaggacctgcgctcttggactgcg

SEQ ID NO: 14586 - DNA, 26 bp, Artificial Sequence
  Description of Artificial Sequence: Synthetic oligonucleotide
aagaggacctgcgctcttggactgcg

SEQ ID NO: 14587 - DNA, 25 bp, Artificial Sequence
  Description of Artificial Sequence: Synthetic oligonucleotide
agaggacctgcgctcttggactgcg

SEQ ID NO: 14588 - DNA, 24 bp, Artificial Sequence
  Description of Artificial Sequence: Synthetic oligonucleotide
gaggacctgcgctcttggactgcg

SEQ ID NO: 14589 - DNA, 24 bp, Artificial Sequence
  Description of Artificial Sequence: Synthetic oligonucleotide
aggacctgcgctcttggactgcgg

SEQ ID NO: 14590 - DNA, 23 bp, Artificial Sequence
  Description of Artificial Sequence: Synthetic oligonucleotide
ggacctgcgctcttggactgcgg

SEQ ID NO: 14591 - DNA, 23 bp, Artificial Sequence
  Description of Artificial Sequence: Synthetic oligonucleotide
gacctgcgctcttggactgcggc

SEQ ID NO: 14592 - DNA, 23 bp, Artificial Sequence
  Description of Artificial Sequence: Synthetic oligonucleotide
acctgcgctcttggactgcggcg

SEQ ID NO: 14593 - DNA, 22 bp, Artificial Sequence
  Description of Artificial Sequence: Synthetic oligonucleotide
cctgcgctcttggactgcggcg

SEQ ID NO: 14594 - DNA, 23 bp, Artificial Sequence
  Description of Artificial Sequence: Synthetic oligonucleotide
ctgcgctcttggactgcggcgga

SEQ ID NO: 14595 - DNA, 25 bp, Artificial Sequence
  Description of Artificial Sequence: Synthetic oligonucleotide
tgcgctcttggactgcggcggacat

SEQ ID NO: 14596 - DNA, 24 bp, Artificial Sequence
  Description of Artificial Sequence: Synthetic oligonucleotide
gcgctcttggactgcggcggacat

SEQ ID NO: 14597 - DNA, 24 bp, Artificial Sequence
  Description of Artificial Sequence: Synthetic oligonucleotide
cgctcttggactgcggcggacatg

SEQ ID NO: 14598 - DNA, 24 bp, Artificial Sequence
  Description of Artificial Sequence: Synthetic oligonucleotide
gctcttggactgcggcggacatgg

SEQ ID NO: 14599 - DNA, 24 bp, Artificial Sequence
  Description of Artificial Sequence: Synthetic oligonucleotide
ctcttggactgcggcggacatggc

SEQ ID NO: 14600 - DNA, 24 bp, Artificial Sequence
  Description of Artificial Sequence: Synthetic oligonucleotide
tcttggactgcggcggacatggcg

SEQ ID NO: 14601 - DNA, 23 bp, Artificial Sequence
  Description of Artificial Sequence: Synthetic oligonucleotide
cttggactgcggcggacatggcg

SEQ ID NO: 14602 - DNA, 23 bp, Artificial Sequence
  Description of Artificial Sequence: Synthetic oligonucleotide
ttggactgcggcggacatggcgg

SEQ ID NO: 14603 - DNA, 22 bp, Artificial Sequence
  Description of Artificial Sequence: Synthetic oligonucleotide
tggactgcggcggacatggcgg

SEQ ID NO: 14604 - DNA, 21 bp, Artificial Sequence
  Description of Artificial Sequence: Synthetic oligonucleotide
ggactgcggcggacatggcgg

SEQ ID NO: 14605 - DNA, 22 bp, Artificial Sequence
  Description of Artificial Sequence: Synthetic oligonucleotide
gactgcggcggacatggcggct

SEQ ID NO: 14606 - DNA, 23 bp, Artificial Sequence
  Description of Artificial Sequence: Synthetic oligonucleotide
actgcggcggacatggcggctca

SEQ ID NO: 14607 - DNA, 22 bp, Artificial Sequence
  Description of Artificial Sequence: Synthetic oligonucleotide
ctgcggcggacatggcggctca

SEQ ID NO: 14608 - DNA, 24 bp, Artificial Sequence
  Description of Artificial Sequence: Synthetic oligonucleotide
tgcggcggacatggcggctcagat

SEQ ID NO: 14609 - DNA, 27 bp, Artificial Sequence
  Description of Artificial Sequence: Synthetic oligonucleotide
acccaggacacggagcttgtggagact

SEQ ID NO: 14610 - DNA, 27 bp, Artificial Sequence
  Description of Artificial Sequence: Synthetic oligonucleotide
cccaggacacggagcttgtggagacta

SEQ ID NO: 14611 - DNA, 27 bp, Artificial Sequence
  Description of Artificial Sequence: Synthetic oligonucleotide
ccaggacacggagcttgtggagactag

SEQ ID NO: 14612 - DNA, 27 bp, Artificial Sequence
  Description of Artificial Sequence: Synthetic oligonucleotide
caggacacggagcttgtggagactagg

SEQ ID NO: 14613 - DNA, 27 bp, Artificial Sequence
  Description of Artificial Sequence: Synthetic oligonucleotide
aggacacggagcttgtggagactaggc

SEQ ID NO: 14614 - DNA, 26 bp, Artificial Sequence
  Description of Artificial Sequence: Synthetic oligonucleotide
ggacacggagcttgtggagactaggc

SEQ ID NO: 14615 - DNA, 27 bp, Artificial Sequence
  Description of Artificial Sequence: Synthetic oligonucleotide
gacacggagcttgtggagactaggcct

SEQ ID NO: 14616 - DNA, 27 bp, Artificial Sequence
  Description of Artificial Sequence: Synthetic oligonucleotide
acacggagcttgtggagactaggcctg

SEQ ID NO: 14617 - DNA, 26 bp, Artificial Sequence
  Description of Artificial Sequence: Synthetic oligonucleotide
cacggagcttgtggagactaggcctg

SEQ ID NO: 14618 - DNA, 27 bp, Artificial Sequence
  Description of Artificial Sequence: Synthetic oligonucleotide
acggagcttgtggagactaggcctgca

SEQ ID NO: 14619 - DNA, 26 bp, Artificial Sequence
  Description of Artificial Sequence: Synthetic oligonucleotide
cggagcttgtggagactaggcctgca

SEQ ID NO: 14620 - DNA, 26 bp, Artificial Sequence
  Description of Artificial Sequence: Synthetic oligonucleotide
ggagcttgtggagactaggcctgcag

SEQ ID NO: 14621 - DNA, 26 bp, Artificial Sequence
  Description of Artificial Sequence: Synthetic oligonucleotide
gagcttgtggagactaggcctgcagg

SEQ ID NO: 14622 - DNA, 26 bp, Artificial Sequence
  Description of Artificial Sequence: Synthetic oligonucleotide
agcttgtggagactaggcctgcaggg

SEQ ID NO: 14623 - DNA, 25 bp, Artificial Sequence
  Description of Artificial Sequence: Synthetic oligonucleotide
gcttgtggagactaggcctgcaggg

SEQ ID NO: 14624 - DNA, 27 bp, Artificial Sequence
  Description of Artificial Sequence: Synthetic oligonucleotide
cttgtggagactaggcctgcaggggat

SEQ ID NO: 14625 - DNA, 27 bp, Artificial Sequence
  Description of Artificial Sequence: Synthetic oligonucleotide
ttgtggagactaggcctgcaggggatg

SEQ ID NO: 14626 - DNA, 26 bp, Artificial Sequence
  Description of Artificial Sequence: Synthetic oligonucleotide
tgtggagactaggcctgcaggggatg

SEQ ID NO: 14627 - DNA, 25 bp, Artificial Sequence
  Description of Artificial Sequence: Synthetic oligonucleotide
gtggagactaggcctgcaggggatg

SEQ ID NO: 14628 - DNA, 27 bp, Artificial Sequence
  Description of Artificial Sequence: Synthetic oligonucleotide
tggagactaggcctgcaggggatggaa

SEQ ID NO: 14629 - DNA, 26 bp, Artificial Sequence
  Description of Artificial Sequence: Synthetic oligonucleotide
ggagactaggcctgcaggggatggaa

SEQ ID NO: 14630 - DNA, 26 bp, Artificial Sequence
  Description of Artificial Sequence: Synthetic oligonucleotide
gagactaggcctgcaggggatggaac

SEQ ID NO: 14631 - DNA, 27 bp, Artificial Sequence
  Description of Artificial Sequence: Synthetic oligonucleotide
agactaggcctgcaggggatggaacct

SEQ ID NO: 14632 - DNA, 27 bp, Artificial Sequence
  Description of Artificial Sequence: Synthetic oligonucleotide
gactaggcctgcaggggatggaacctt

SEQ ID NO: 14633 - DNA, 27 bp, Artificial Sequence
  Description of Artificial Sequence: Synthetic oligonucleotide
actaggcctgcaggggatggaaccttc

SEQ ID NO: 14634 - DNA, 26 bp, Artificial Sequence
  Description of Artificial Sequence: Synthetic oligonucleotide
ctaggcctgcaggggatggaaccttc

SEQ ID NO: 14635 - DNA, 27 bp, Artificial Sequence
  Description of Artificial Sequence: Synthetic oligonucleotide
taggcctgcaggggatggaaccttcca

SEQ ID NO: 14636 - DNA, 24 bp, Artificial Sequence
  Description of Artificial Sequence: Synthetic oligonucleotide
ccgtggatagagcaggaggggcca

SEQ ID NO: 14637 - DNA, 25 bp, Artificial Sequence
  Description of Artificial Sequence: Synthetic oligonucleotide
cgtggatagagcaggaggggccaga

SEQ ID NO: 14638 - DNA, 27 bp, Artificial Sequence
  Description of Artificial Sequence: Synthetic oligonucleotide
gtggatagagcaggaggggccagagta

SEQ ID NO: 14639 - DNA, 29 bp, Artificial Sequence
  Description of Artificial Sequence: Synthetic oligonucleotide
tggatagagcaggaggggccagagtattg

SEQ ID NO: 14640 - DNA, 28 bp, Artificial Sequence
  Description of Artificial Sequence: Synthetic oligonucleotide
ggatagagcaggaggggccagagtattg

SEQ ID NO: 14641 - DNA, 28 bp, Artificial Sequence
  Description of Artificial Sequence: Synthetic oligonucleotide
gatagagcaggaggggccagagtattgg

SEQ ID NO: 14642 - DNA, 28 bp, Artificial Sequence
  Description of Artificial Sequence: Synthetic oligonucleotide
atagagcaggaggggccagagtattggg

SEQ ID NO: 14643 - DNA, 27 bp, Artificial Sequence
  Description of Artificial Sequence: Synthetic oligonucleotide
tagagcaggaggggccagagtattggg

SEQ ID NO: 14644 - DNA, 27 bp, Artificial Sequence
  Description of Artificial Sequence: Synthetic oligonucleotide
agagcaggaggggccagagtattggga

SEQ ID NO: 14645 - DNA, 26 bp, Artificial Sequence
  Description of Artificial Sequence: Synthetic oligonucleotide
gagcaggaggggccagagtattggga

SEQ ID NO: 14646 - DNA, 26 bp, Artificial Sequence
  Description of Artificial Sequence: Synthetic oligonucleotide
agcaggaggggccagagtattgggac

SEQ ID NO: 14647 - DNA, 25 bp, Artificial Sequence
  Description of Artificial Sequence: Synthetic oligonucleotide
gcaggaggggccagagtattgggac

SEQ ID NO: 14648 - DNA, 26 bp, Artificial Sequence
  Description of Artificial Sequence: Synthetic oligonucleotide
caggaggggccagagtattgggacga

SEQ ID NO: 14649 - DNA, 26 bp, Artificial Sequence
  Description of Artificial Sequence: Synthetic oligonucleotide
aggaggggccagagtattgggacgag

SEQ ID NO: 14650 - DNA, 25 bp, Artificial Sequence
  Description of Artificial Sequence: Synthetic oligonucleotide
ggaggggccagagtattgggacgag

SEQ ID NO: 14651 - DNA, 26 bp, Artificial Sequence
  Description of Artificial Sequence: Synthetic oligonucleotide
gaggggccagagtattgggacgagga

SEQ ID NO: 14652 - DNA, 27 bp, Artificial Sequence
  Description of Artificial Sequence: Synthetic oligonucleotide
aggggccagagtattgggacgaggaga

SEQ ID NO: 14653 - DNA, 26 bp, Artificial Sequence
  Description of Artificial Sequence: Synthetic oligonucleotide
ggggccagagtattgggacgaggaga

SEQ ID NO: 14654 - DNA, 27 bp, Artificial Sequence
  Description of Artificial Sequence: Synthetic oligonucleotide
gggccagagtattgggacgaggagaca

SEQ ID NO: 14655 - DNA, 27 bp, Artificial Sequence
  Description of Artificial Sequence: Synthetic oligonucleotide
ggccagagtattgggacgaggagacag

SEQ ID NO: 14656 - DNA, 27 bp, Artificial Sequence
  Description of Artificial Sequence: Synthetic oligonucleotide
gccagagtattgggacgaggagacagg

SEQ ID NO: 14657 - DNA, 27 bp, Artificial Sequence
  Description of Artificial Sequence: Synthetic oligonucleotide
ccagagtattgggacgaggagacaggg

SEQ ID NO: 14658 - DNA, 30 bp, Artificial Sequence
  Description of Artificial Sequence: Synthetic oligonucleotide
cagagtattgggacgaggagacagggaaag

SEQ ID NO: 14659 - DNA, 31 bp, Artificial Sequence
  Description of Artificial Sequence: Synthetic oligonucleotide
agagtattgggacgaggagacagggaaagtg

SEQ ID NO: 14660 - DNA, 27 bp, Artificial Sequence
  Description of Artificial Sequence: Synthetic oligonucleotide
aacctgcggatcgcgctccgctactat

SEQ ID NO: 14661 - DNA, 27 bp, Artificial Sequence
  Description of Artificial Sequence: Synthetic oligonucleotide
acctgcggatcgcgctccgctactata

SEQ ID NO: 14662 - DNA, 27 bp, Artificial Sequence
  Description of Artificial Sequence: Synthetic oligonucleotide
cctgcggatcgcgctccgctactataa

SEQ ID NO: 14663 - DNA, 27 bp, Artificial Sequence
  Description of Artificial Sequence: Synthetic oligonucleotide
ctgcggatcgcgctccgctactataac

SEQ ID NO: 14664 - DNA, 27 bp, Artificial Sequence
  Description of Artificial Sequence: Synthetic oligonucleotide
tgcggatcgcgctccgctactataacc

SEQ ID NO: 14665 - DNA, 27 bp, Artificial Sequence
  Description of Artificial Sequence: Synthetic oligonucleotide
gcggatcgcgctccgctactataacca

SEQ ID NO: 14666 - DNA, 27 bp, Artificial Sequence
  Description of Artificial Sequence: Synthetic oligonucleotide
cggatcgcgctccgctactataaccag

SEQ ID NO: 14667 - DNA, 28 bp, Artificial Sequence
  Description of Artificial Sequence: Synthetic oligonucleotide
ggatcgcgctccgctactataaccagag

SEQ ID NO: 14668 - DNA, 28 bp, Artificial Sequence
  Description of Artificial Sequence: Synthetic oligonucleotide
gatcgcgctccgctactataaccagagc

SEQ ID NO: 14669 - DNA, 28 bp, Artificial Sequence
  Description of Artificial Sequence: Synthetic oligonucleotide
atcgcgctccgctactataaccagagcg

SEQ ID NO: 14670 - DNA, 27 bp, Artificial Sequence
  Description of Artificial Sequence: Synthetic oligonucleotide
tcgcgctccgctactataaccagagcg

SEQ ID NO: 14671 - DNA, 27 bp, Artificial Sequence
  Description of Artificial Sequence: Synthetic oligonucleotide
cgcgctccgctactataaccagagcga

SEQ ID NO: 14672 - DNA, 27 bp, Artificial Sequence
  Description of Artificial Sequence: Synthetic oligonucleotide
gcgctccgctactataaccagagcgag

SEQ ID NO: 14673 - DNA, 27 bp, Artificial Sequence
  Description of Artificial Sequence: Synthetic oligonucleotide
cgctccgctactataaccagagcgagg

SEQ ID NO: 14674 - DNA, 27 bp, Artificial Sequence
  Description of Artificial Sequence: Synthetic oligonucleotide
gctccgctactataaccagagcgaggc

SEQ ID NO: 14675 - DNA, 27 bp, Artificial Sequence
  Description of Artificial Sequence: Synthetic oligonucleotide
ctccgctactataaccagagcgaggcc

SEQ ID NO: 14676 - DNA, 27 bp, Artificial Sequence
  Description of Artificial Sequence: Synthetic oligonucleotide
tccgctactataaccagagcgaggccg

SEQ ID NO: 14677 - DNA, 26 bp, Artificial Sequence
  Description of Artificial Sequence: Synthetic oligonucleotide
ccgctactataaccagagcgaggccg

SEQ ID NO: 14678 - DNA, 27 bp, Artificial Sequence
  Description of Artificial Sequence: Synthetic oligonucleotide
cgctactataaccagagcgaggccggt

SEQ ID NO: 14679 - DNA, 28 bp, Artificial Sequence
  Description of Artificial Sequence: Synthetic oligonucleotide
gctactataaccagagcgaggccggttc

SEQ ID NO: 14680 - DNA, 29 bp, Artificial Sequence
  Description of Artificial Sequence: Synthetic oligonucleotide
ctactataaccagagcgaggccggttctc

SEQ ID NO: 14681 - DNA, 30 bp, Artificial Sequence
  Description of Artificial Sequence: Synthetic oligonucleotide
tactataaccagagcgaggccggttctcac

SEQ ID NO: 14682 - DNA, 29 bp, Artificial Sequence
  Description of Artificial Sequence: Synthetic oligonucleotide
actataaccagagcgaggccggttctcac

SEQ ID NO: 14683 - DNA, 28 bp, Artificial Sequence
  Description of Artificial Sequence: Synthetic oligonucleotide
ctataaccagagcgaggccggttctcac

SEQ ID NO: 14684 - DNA, 29 bp, Artificial Sequence
  Description of Artificial Sequence: Synthetic oligonucleotide
tataaccagagcgaggccggttctcacac

SEQ ID NO: 14685 - DNA, 28 bp, Artificial Sequence
  Description of Artificial Sequence: Synthetic oligonucleotide
ataaccagagcgaggccggttctcacac

SEQ ID NO: 14686 - DNA, 27 bp, Artificial Sequence
  Description of Artificial Sequence: Synthetic oligonucleotide
taaccagagcgaggccggttctcacac

SEQ ID NO: 14687 - DNA, 29 bp, Artificial Sequence
  Description of Artificial Sequence: Synthetic oligonucleotide
cgcagatacctggagaacgggaaggaaac

SEQ ID NO: 14688 - DNA, 29 bp, Artificial Sequence
  Description of Artificial Sequence: Synthetic oligonucleotide
gcagatacctggagaacgggaaggaaacg

SEQ ID NO: 14689 - DNA, 29 bp, Artificial Sequence
  Description of Artificial Sequence: Synthetic oligonucleotide
cagatacctggagaacgggaaggaaacgc

SEQ ID NO: 14690 - DNA, 30 bp, Artificial Sequence
  Description of Artificial Sequence: Synthetic oligonucleotide
agatacctggagaacgggaaggaaacgctg

SEQ ID NO: 14691 - DNA, 29 bp, Artificial Sequence
  Description of Artificial Sequence: Synthetic oligonucleotide
gatacctggagaacgggaaggaaacgctg

SEQ ID NO: 14692 - DNA, 29 bp, Artificial Sequence
  Description of Artificial Sequence: Synthetic oligonucleotide
atacctggagaacgggaaggaaacgctgc

SEQ ID NO: 14693 - DNA, 28 bp, Artificial Sequence
  Description of Artificial Sequence: Synthetic oligonucleotide
tacctggagaacgggaaggaaacgctgc

SEQ ID NO: 14694 - DNA, 27 bp, Artificial Sequence
  Description of Artificial Sequence: Synthetic oligonucleotide
acctggagaacgggaaggaaacgctgc

SEQ ID NO: 14695 - DNA, 27 bp, Artificial Sequence
  Description of Artificial Sequence: Synthetic oligonucleotide
cctggagaacgggaaggaaacgctgca

SEQ ID NO: 14696 - DNA, 27 bp, Artificial Sequence
  Description of Artificial Sequence: Synthetic oligonucleotide
ctggagaacgggaaggaaacgctgcag

SEQ ID NO: 14697 - DNA, 27 bp, Artificial Sequence
  Description of Artificial Sequence: Synthetic oligonucleotide
tggagaacgggaaggaaacgctgcagc

SEQ ID NO: 14698 - DNA, 26 bp, Artificial Sequence
  Description of Artificial Sequence: Synthetic oligonucleotide
ggagaacgggaaggaaacgctgcagc

SEQ ID NO: 14699 - DNA, 26 bp, Artificial Sequence
  Description of Artificial Sequence: Synthetic oligonucleotide
gagaacgggaaggaaacgctgcagcg

SEQ ID NO: 14700 - DNA, 27 bp, Artificial Sequence
  Description of Artificial Sequence: Synthetic oligonucleotide
agaacgggaaggaaacgctgcagcgca

SEQ ID NO: 14701 - DNA, 26 bp, Artificial Sequence
  Description of Artificial Sequence: Synthetic oligonucleotide
gaacgggaaggaaacgctgcagcgca

SEQ ID NO: 14702 - DNA, 26 bp, Artificial Sequence
  Description of Artificial Sequence: Synthetic oligonucleotide
aacgggaaggaaacgctgcagcgcac

SEQ ID NO: 14703 - DNA, 25 bp, Artificial Sequence
  Description of Artificial Sequence: Synthetic oligonucleotide
acgggaaggaaacgctgcagcgcac

SEQ ID NO: 14704 - DNA, 24 bp, Artificial Sequence
  Description of Artificial Sequence: Synthetic oligonucleotide
cgggaaggaaacgctgcagcgcac

SEQ ID NO: 14705 - DNA, 24 bp, Artificial Sequence
  Description of Artificial Sequence: Synthetic oligonucleotide
gggaaggaaacgctgcagcgcacg

SEQ ID NO: 14706 - DNA, 25 bp, Artificial Sequence
  Description of Artificial Sequence: Synthetic oligonucleotide
ggaaggaaacgctgcagcgcacgga

SEQ ID NO: 14707 - DNA, 25 bp, Artificial Sequence
  Description of Artificial Sequence: Synthetic oligonucleotide
gaaggaaacgctgcagcgcacggac

SEQ ID NO: 14708 - DNA, 25 bp, Artificial Sequence
  Description of Artificial Sequence: Synthetic oligonucleotide
aaggaaacgctgcagcgcacggacc

SEQ ID NO: 14709 - DNA, 24 bp, Artificial Sequence
  Description of Artificial Sequence: Synthetic oligonucleotide
aggaaacgctgcagcgcacggacc

SEQ ID NO: 14710 - DNA, 23 bp, Artificial Sequence
  Description of Artificial Sequence: Synthetic oligonucleotide
ggaaacgctgcagcgcacggacc

SEQ ID NO: 14711 - DNA, 23 bp, Artificial Sequence
  Description of Artificial Sequence: Synthetic oligonucleotide
gaaacgctgcagcgcacggaccc

SEQ ID NO: 14712 - DNA, 23 bp, Artificial Sequence
  Description of Artificial Sequence: Synthetic oligonucleotide
aaacgctgcagcgcacggacccc

SEQ ID NO: 14713 - DNA, 22 bp, Artificial Sequence
  Description of Artificial Sequence: Synthetic oligonucleotide
aacgctgcagcgcacggacccc

SEQ ID NO: 14714 - DNA, 24 bp, Artificial Sequence
  Description of Artificial Sequence: Synthetic oligonucleotide
ctcttggaccgcagcggacatggc

SEQ ID NO: 14715 - DNA, 24 bp, Artificial Sequence
  Description of Artificial Sequence: Synthetic oligonucleotide
tcttggaccgcagcggacatggcg

SEQ ID NO: 14716 - DNA, 23 bp, Artificial Sequence
  Description of Artificial Sequence: Synthetic oligonucleotide
cttggaccgcagcggacatggcg

SEQ ID NO: 14717 - DNA, 23 bp, Artificial Sequence
  Description of Artificial Sequence: Synthetic oligonucleotide
ttggaccgcagcggacatggcgg

SEQ ID NO: 14718 - DNA, 22 bp, Artificial Sequence
  Description of Artificial Sequence: Synthetic oligonucleotide
tggaccgcagcggacatggcgg

SEQ ID NO: 14719 - DNA, 21 bp, Artificial Sequence
  Description of Artificial Sequence: Synthetic oligonucleotide
ggaccgcagcggacatggcgg

SEQ ID NO: 14720 - DNA, 22 bp, Artificial Sequence
  Description of Artificial Sequence: Synthetic oligonucleotide
gaccgcagcggacatggcggct

SEQ ID NO: 14721 - DNA, 23 bp, Artificial Sequence
  Description of Artificial Sequence: Synthetic oligonucleotide
accgcagcggacatggcggctca

SEQ ID NO: 14722 - DNA, 22 bp, Artificial Sequence
  Description of Artificial Sequence: Synthetic oligonucleotide
ccgcagcggacatggcggctca

SEQ ID NO: 14723 - DNA, 24 bp, Artificial Sequence
  Description of Artificial Sequence: Synthetic oligonucleotide
cgcagcggacatggcggctcagat

SEQ ID NO: 14724 - DNA, 25 bp, Artificial Sequence
  Description of Artificial Sequence: Synthetic oligonucleotide
gcagcggacatggcggctcagatca

SEQ ID NO: 14725 - DNA, 25 bp, Artificial Sequence
  Description of Artificial Sequence: Synthetic oligonucleotide
cagcggacatggcggctcagatcac

SEQ ID NO: 14726 - DNA, 27 bp, Artificial Sequence
  Description of Artificial Sequence: Synthetic oligonucleotide
agcggacatggcggctcagatcaccaa

SEQ ID NO: 14727 - DNA, 31 bp, Artificial Sequence
  Description of Artificial Sequence: Synthetic oligonucleotide
cagtacgcctacgacggcaaggattacatag

SEQ ID NO: 14728 - DNA, 31 bp, Artificial Sequence
  Description of Artificial Sequence: Synthetic oligonucleotide
agtacgcctacgacggcaaggattacatagc

SEQ ID NO: 14729 - DNA, 30 bp, Artificial Sequence
  Description of Artificial Sequence: Synthetic oligonucleotide
gtacgcctacgacggcaaggattacatagc

SEQ ID NO: 14730 - DNA, 30 bp, Artificial Sequence
  Description of Artificial Sequence: Synthetic oligonucleotide
tacgcctacgacggcaaggattacatagcc

SEQ ID NO: 14731 - DNA, 29 bp, Artificial Sequence
  Description of Artificial Sequence: Synthetic oligonucleotide
acgcctacgacggcaaggattacatagcc

SEQ ID NO: 14732 - DNA, 28 bp, Artificial Sequence
  Description of Artificial Sequence: Synthetic oligonucleotide
cgcctacgacggcaaggattacatagcc

SEQ ID NO: 14733 - DNA, 28 bp, Artificial Sequence
  Description of Artificial Sequence: Synthetic oligonucleotide
gcctacgacggcaaggattacatagccc

SEQ ID NO: 14734 - DNA, 29 bp, Artificial Sequence
  Description of Artificial Sequence: Synthetic oligonucleotide
cctacgacggcaaggattacatagccctg

SEQ ID NO: 14735 - DNA, 32 bp, Artificial Sequence
  Description of Artificial Sequence: Synthetic oligonucleotide
ctacgacggcaaggattacatagccctgaaag

SEQ ID NO: 14736 - DNA, 33 bp, Artificial Sequence
  Description of Artificial Sequence: Synthetic oligonucleotide
tacgacggcaaggattacatagccctgaaagag

SEQ ID NO: 14737 - DNA, 32 bp, Artificial Sequence
  Description of Artificial Sequence: Synthetic oligonucleotide
acgacggcaaggattacatagccctgaaagag

SEQ ID NO: 14738 - DNA, 31 bp, Artificial Sequence
  Description of Artificial Sequence: Synthetic oligonucleotide
cgacggcaaggattacatagccctgaaagag

SEQ ID NO: 14739 - DNA, 31 bp, Artificial Sequence
  Description of Artificial Sequence: Synthetic oligonucleotide
gacggcaaggattacatagccctgaaagagg

SEQ ID NO: 14740 - DNA, 32 bp, Artificial Sequence
  Description of Artificial Sequence: Synthetic oligonucleotide
acggcaaggattacatagccctgaaagaggac

SEQ ID NO: 14741 - DNA, 31 bp, Artificial Sequence
  Description of Artificial Sequence: Synthetic oligonucleotide
cggcaaggattacatagccctgaaagaggac

SEQ ID NO: 14742 - DNA, 31 bp, Artificial Sequence
  Description of Artificial Sequence: Synthetic oligonucleotide
ggcaaggattacatagccctgaaagaggacc

SEQ ID NO: 14743 - DNA, 32 bp, Artificial Sequence
  Description of Artificial Sequence: Synthetic oligonucleotide
gcaaggattacatagccctgaaagaggacctg

SEQ ID NO: 14744 - DNA, 32 bp, Artificial Sequence
  Description of Artificial Sequence: Synthetic oligonucleotide
caaggattacatagccctgaaagaggacctgc

SEQ ID NO: 14745 - DNA, 32 bp, Artificial Sequence
  Description of Artificial Sequence: Synthetic oligonucleotide
aaggattacatagccctgaaagaggacctgcg

SEQ ID NO: 14746 - DNA, 31 bp, Artificial Sequence
  Description of Artificial Sequence: Synthetic oligonucleotide
aggattacatagccctgaaagaggacctgcg

SEQ ID NO: 14747 - DNA, 30 bp, Artificial Sequence
  Description of Artificial Sequence: Synthetic oligonucleotide
ggattacatagccctgaaagaggacctgcg

SEQ ID NO: 14748 - DNA, 30 bp, Artificial Sequence
  Description of Artificial Sequence: Synthetic oligonucleotide
gattacatagccctgaaagaggacctgcgc

SEQ ID NO: 14749 - DNA, 31 bp, Artificial Sequence
  Description of Artificial Sequence: Synthetic oligonucleotide
attacatagccctgaaagaggacctgcgctc

SEQ ID NO: 14750 - DNA, 30 bp, Artificial Sequence
  Description of Artificial Sequence: Synthetic oligonucleotide
ttacatagccctgaaagaggacctgcgctc

SEQ ID NO: 14751 - DNA, 29 bp, Artificial Sequence
  Description of Artificial Sequence: Synthetic oligonucleotide
tacatagccctgaaagaggacctgcgctc

SEQ ID NO: 14752 - DNA, 28 bp, Artificial Sequence
  Description of Artificial Sequence: Synthetic oligonucleotide
acatagccctgaaagaggacctgcgctc

SEQ ID NO: 14753 - DNA, 27 bp, Artificial Sequence
  Description of Artificial Sequence: Synthetic oligonucleotide
catagccctgaaagaggacctgcgctc

SEQ ID NO: 14754 - DNA, 29 bp, Artificial Sequence
  Description of Artificial Sequence: Synthetic oligonucleotide
atagccctgaaagaggacctgcgctcttg

SEQ ID NO: 14755 - DNA, 28 bp, Artificial Sequence
  Description of Artificial Sequence: Synthetic oligonucleotide
tagccctgaaagaggacctgcgctcttg

SEQ ID NO: 14756 - DNA, 27 bp, Artificial Sequence
  Description of Artificial Sequence: Synthetic oligonucleotide
agccctgaaagaggacctgcgctcttg

SEQ ID NO: 14757 - DNA, 25 bp, Artificial Sequence
  Description of Artificial Sequence: Synthetic oligonucleotide
acccagacctgggcaggctcccaat

SEQ ID NO: 14758 - DNA, 24 bp, Artificial Sequence
  Description of Artificial Sequence: Synthetic oligonucleotide
cccagacctgggcaggctcccaat

SEQ ID NO: 14759 - DNA, 24 bp, Artificial Sequence
  Description of Artificial Sequence: Synthetic oligonucleotide
ccagacctgggcaggctcccaatc

SEQ ID NO: 14760 - DNA, 26 bp, Artificial Sequence
  Description of Artificial Sequence: Synthetic oligonucleotide
cagacctgggcaggctcccaatccat

SEQ ID NO: 14761 - DNA, 27 bp, Artificial Sequence
  Description of Artificial Sequence: Synthetic oligonucleotide
agacctgggcaggctcccaatccatga

SEQ ID NO: 14762 - DNA, 26 bp, Artificial Sequence
  Description of Artificial Sequence: Synthetic oligonucleotide
gacctgggcaggctcccaatccatga

SEQ ID NO: 14763 - DNA, 26 bp, Artificial Sequence
  Description of Artificial Sequence: Synthetic oligonucleotide
acctgggcaggctcccaatccatgag

SEQ ID NO: 14764 - DNA, 25 bp, Artificial Sequence
  Description of Artificial Sequence: Synthetic oligonucleotide
cctgggcaggctcccaatccatgag

SEQ ID NO: 14765 - DNA, 27 bp, Artificial Sequence
  Description of Artificial Sequence: Synthetic oligonucleotide
ctgggcaggctcccaatccatgaggta

SEQ ID NO: 14766 - DNA, 30 bp, Artificial Sequence
  Description of Artificial Sequence: Synthetic oligonucleotide
tgggcaggctcccaatccatgaggtatttc

SEQ ID NO: 14767 - DNA, 29 bp, Artificial Sequence
  Description of Artificial Sequence: Synthetic oligonucleotide
gggcaggctcccaatccatgaggtatttc

SEQ ID NO: 14768 - DNA, 30 bp, Artificial Sequence
  Description of Artificial Sequence: Synthetic oligonucleotide
ggcaggctcccaatccatgaggtatttctc

SEQ ID NO: 14769 - DNA, 30 bp, Artificial Sequence
  Description of Artificial Sequence: Synthetic oligonucleotide
gcaggctcccaatccatgaggtatttctcc

SEQ ID NO: 14770 - DNA, 31 bp, Artificial Sequence
  Description of Artificial Sequence: Synthetic oligonucleotide
caggctcccaatccatgaggtatttctccac

SEQ ID NO: 14771 - DNA, 33 bp, Artificial Sequence
  Description of Artificial Sequence: Synthetic oligonucleotide
aggctcccaatccatgaggtatttctccacatc

SEQ ID NO: 14772 - DNA, 32 bp, Artificial Sequence
  Description of Artificial Sequence: Synthetic oligonucleotide
ggctcccaatccatgaggtatttctccacatc

SEQ ID NO: 14773 - DNA, 32 bp, Artificial Sequence
  Description of Artificial Sequence: Synthetic oligonucleotide
gctcccaatccatgaggtatttctccacatcc

SEQ ID NO: 14774 - DNA, 32 bp, Artificial Sequence
  Description of Artificial Sequence: Synthetic oligonucleotide
ctcccaatccatgaggtatttctccacatccg

SEQ ID NO: 14775 - DNA, 33 bp, Artificial Sequence
  Description of Artificial Sequence: Synthetic oligonucleotide
tcccaatccatgaggtatttctccacatccgtg

SEQ ID NO: 14776 - DNA, 32 bp, Artificial Sequence
  Description of Artificial Sequence: Synthetic oligonucleotide
cccaatccatgaggtatttctccacatccgtg

SEQ ID NO: 14777 - DNA, 33 bp, Artificial Sequence
  Description of Artificial Sequence: Synthetic oligonucleotide
ccaatccatgaggtatttctccacatccgtgtc

SEQ ID NO: 14778 - DNA, 33 bp, Artificial Sequence
  Description of Artificial Sequence: Synthetic oligonucleotide
caatccatgaggtatttctccacatccgtgtcc

SEQ ID NO: 14779 - DNA, 33 bp, Artificial Sequence
  Description of Artificial Sequence: Synthetic oligonucleotide
aatccatgaggtatttctccacatccgtgtccc

SEQ ID NO: 14780 - DNA, 32 bp, Artificial Sequence
  Description of Artificial Sequence: Synthetic oligonucleotide
atccatgaggtatttctccacatccgtgtccc

SEQ ID NO: 14781 - DNA, 24 bp, Artificial Sequence
  Description of Artificial Sequence: Synthetic oligonucleotide
ctggcagcgggatggggaggacta

SEQ ID NO: 14782 - DNA, 25 bp, Artificial Sequence
  Description of Artificial Sequence: Synthetic oligonucleotide
tggcagcgggatggggaggactaga

SEQ ID NO: 14783 - DNA, 24 bp, Artificial Sequence
  Description of Artificial Sequence: Synthetic oligonucleotide
ggcagcgggatggggaggactaga

SEQ ID NO: 14784 - DNA, 24 bp, Artificial Sequence
  Description of Artificial Sequence: Synthetic oligonucleotide
gcagcgggatggggaggactagac

SEQ ID NO: 14785 - DNA, 24 bp, Artificial Sequence
  Description of Artificial Sequence: Synthetic oligonucleotide
cagcgggatggggaggactagacc

SEQ ID NO: 14786 - DNA, 25 bp, Artificial Sequence
  Description of Artificial Sequence: Synthetic oligonucleotide
agcgggatggggaggactagaccca

SEQ ID NO: 14787 - DNA, 24 bp, Artificial Sequence
  Description of Artificial Sequence: Synthetic oligonucleotide
gcgggatggggaggactagaccca

SEQ ID NO: 14788 - DNA, 24 bp, Artificial Sequence
  Description of Artificial Sequence: Synthetic oligonucleotide
cgggatggggaggactagacccag

SEQ ID NO: 14789 - DNA, 25 bp, Artificial Sequence
  Description of Artificial Sequence: Synthetic oligonucleotide
gggatggggaggactagacccagga

SEQ ID NO: 14790 - DNA, 26 bp, Artificial Sequence
  Description of Artificial Sequence: Synthetic oligonucleotide
ggatggggaggactagacccaggaca

SEQ ID NO: 14791 - DNA, 26 bp, Artificial Sequence
  Description of Artificial Sequence: Synthetic oligonucleotide
gatggggaggactagacccaggacac

SEQ ID NO: 14792 - DNA, 26 bp, Artificial Sequence
  Description of Artificial Sequence: Synthetic oligonucleotide
atggggaggactagacccaggacacg

SEQ ID NO: 14793 - DNA, 25 bp, Artificial Sequence
  Description of Artificial Sequence: Synthetic oligonucleotide
tggggaggactagacccaggacacg

SEQ ID NO: 14794 - DNA, 24 bp, Artificial Sequence
  Description of Artificial Sequence: Synthetic oligonucleotide
ggggaggactagacccaggacacg

SEQ ID NO: 14795 - DNA, 25 bp, Artificial Sequence
  Description of Artificial Sequence: Synthetic oligonucleotide
gggaggactagacccaggacacgga

SEQ ID NO: 14796 - DNA, 25 bp, Artificial Sequence
  Description of Artificial Sequence: Synthetic oligonucleotide
ggaggactagacccaggacacggag

SEQ ID NO: 14797 - DNA, 27 bp, Artificial Sequence
  Description of Artificial Sequence: Synthetic oligonucleotide
gaggactagacccaggacacggagctt

SEQ ID NO: 14798 - DNA, 27 bp, Artificial Sequence
  Description of Artificial Sequence: Synthetic oligonucleotide
aggactagacccaggacacggagcttg

SEQ ID NO: 14799 - DNA, 27 bp, Artificial Sequence
  Description of Artificial Sequence: Synthetic oligonucleotide
ggactagacccaggacacggagcttgt

SEQ ID NO: 14800 - DNA, 27 bp, Artificial Sequence
  Description of Artificial Sequence: Synthetic oligonucleotide
gactagacccaggacacggagcttgtg

SEQ ID NO: 14801 - DNA, 27 bp, Artificial Sequence
  Description of Artificial Sequence: Synthetic oligonucleotide
actagacccaggacacggagcttgtgg

SEQ ID NO: 14802 - DNA, 27 bp, Artificial Sequence
  Description of Artificial Sequence: Synthetic oligonucleotide
ctagacccaggacacggagcttgtgga

SEQ ID NO: 14803 - DNA, 27 bp, Artificial Sequence
  Description of Artificial Sequence: Synthetic oligonucleotide
tagacccaggacacggagcttgtggag

SEQ ID NO: 14804 - DNA, 25 bp, Artificial Sequence
  Description of Artificial Sequence: Synthetic oligonucleotide
gagagaacctgcggatcgcgctcct

SEQ ID NO: 14805 - DNA, 27 bp, Artificial Sequence
  Description of Artificial Sequence: Synthetic oligonucleotide
agagaacctgcggatcgcgctcctcta

SEQ ID NO: 14806 - DNA, 26 bp, Artificial Sequence
  Description of Artificial Sequence: Synthetic oligonucleotide
gagaacctgcggatcgcgctcctcta

SEQ ID NO: 14807 - DNA, 27 bp, Artificial Sequence
  Description of Artificial Sequence: Synthetic oligonucleotide
agaacctgcggatcgcgctcctctact

SEQ ID NO: 14808 - DNA, 27 bp, Artificial Sequence
  Description of Artificial Sequence: Synthetic oligonucleotide
gaacctgcggatcgcgctcctctacta

SEQ ID NO: 14809 - DNA, 27 bp, Artificial Sequence
  Description of Artificial Sequence: Synthetic oligonucleotide
aacctgcggatcgcgctcctctactac

SEQ ID NO: 14810 - DNA, 27 bp, Artificial Sequence
  Description of Artificial Sequence: Synthetic oligonucleotide
acctgcggatcgcgctcctctactaca

SEQ ID NO: 14811 - DNA, 27 bp, Artificial Sequence
  Description of Artificial Sequence: Synthetic oligonucleotide
cctgcggatcgcgctcctctactacaa

SEQ ID NO: 14812 - DNA, 27 bp, Artificial Sequence
  Description of Artificial Sequence: Synthetic oligonucleotide
ctgcggatcgcgctcctctactacaac

SEQ ID NO: 14813 - DNA, 27 bp, Artificial Sequence
  Description of Artificial Sequence: Synthetic oligonucleotide
tgcggatcgcgctcctctactacaacc

SEQ ID NO: 14814 - DNA, 27 bp, Artificial Sequence
  Description of Artificial Sequence: Synthetic oligonucleotide
gcggatcgcgctcctctactacaacca

SEQ ID NO: 14815 - DNA, 27 bp, Artificial Sequence
  Description of Artificial Sequence: Synthetic oligonucleotide
cggatcgcgctcctctactacaaccag

SEQ ID NO: 14816 - DNA, 28 bp, Artificial Sequence
  Description of Artificial Sequence: Synthetic oligonucleotide
ggatcgcgctcctctactacaaccagag

SEQ ID NO: 14817 - DNA, 28 bp, Artificial Sequence
  Description of Artificial Sequence: Synthetic oligonucleotide
gatcgcgctcctctactacaaccagagc

SEQ ID NO: 14818 - DNA, 28 bp, Artificial Sequence
  Description of Artificial Sequence: Synthetic oligonucleotide
atcgcgctcctctactacaaccagagcg

SEQ ID NO: 14819 - DNA, 27 bp, Artificial Sequence
  Description of Artificial Sequence: Synthetic oligonucleotide
tcgcgctcctctactacaaccagagcg

SEQ ID NO: 14820 - DNA, 27 bp, Artificial Sequence
  Description of Artificial Sequence: Synthetic oligonucleotide
cgcgctcctctactacaaccagagcga

SEQ ID NO: 14821 - DNA, 27 bp, Artificial Sequence
  Description of Artificial Sequence: Synthetic oligonucleotide
gcgctcctctactacaaccagagcgag

SEQ ID NO: 14822 - DNA, 27 bp, Artificial Sequence
  Description of Artificial Sequence: Synthetic oligonucleotide
cgctcctctactacaaccagagcgagg

SEQ ID NO: 14823 - DNA, 27 bp, Artificial Sequence
  Description of Artificial Sequence: Synthetic oligonucleotide
gctcctctactacaaccagagcgaggc

SEQ ID NO: 14824 - DNA, 27 bp, Artificial Sequence
  Description of Artificial Sequence: Synthetic oligonucleotide
ctcctctactacaaccagagcgaggcc

SEQ ID NO: 14825 - DNA, 27 bp, Artificial Sequence
  Description of Artificial Sequence: Synthetic oligonucleotide
tcctctactacaaccagagcgaggccg

SEQ ID NO: 14826 - DNA, 26 bp, Artificial Sequence
  Description of Artificial Sequence: Synthetic oligonucleotide
cctctactacaaccagagcgaggccg

SEQ ID NO: 14827 - DNA, 27 bp, Artificial Sequence
  Description of Artificial Sequence: Synthetic oligonucleotide
ctctactacaaccagagcgaggccggt

SEQ ID NO: 14828 - DNA, 28 bp, Artificial Sequence
  Description of Artificial Sequence: Synthetic oligonucleotide
tctactacaaccagagcgaggccggttc

SEQ ID NO: 14829 - DNA, 27 bp, Artificial Sequence
  Description of Artificial Sequence: Synthetic oligonucleotide
ggatcgcgctccgctactacaaccaca

SEQ ID NO: 14830 - DNA, 27 bp, Artificial Sequence
  Description of Artificial Sequence: Synthetic oligonucleotide
gatcgcgctccgctactacaaccacag

SEQ ID NO: 14831 - DNA, 27 bp, Artificial Sequence
  Description of Artificial Sequence: Synthetic oligonucleotide
atcgcgctccgctactacaaccacagc

SEQ ID NO: 14832 - DNA, 26 bp, Artificial Sequence
  Description of Artificial Sequence: Synthetic oligonucleotide
tcgcgctccgctactacaaccacagc

SEQ ID NO: 14833 - DNA, 25 bp, Artificial Sequence
  Description of Artificial Sequence: Synthetic oligonucleotide
cgcgctccgctactacaaccacagc

SEQ ID NO: 14834 - DNA, 26 bp, Artificial Sequence
  Description of Artificial Sequence: Synthetic oligonucleotide
gcgctccgctactacaaccacagcga

SEQ ID NO: 14835 - DNA, 26 bp, Artificial Sequence
  Description of Artificial Sequence: Synthetic oligonucleotide
cgctccgctactacaaccacagcgag

SEQ ID NO: 14836 - DNA, 26 bp, Artificial Sequence
  Description of Artificial Sequence: Synthetic oligonucleotide
gctccgctactacaaccacagcgagg

SEQ ID NO: 14837 - DNA, 26 bp, Artificial Sequence
  Description of Artificial Sequence: Synthetic oligonucleotide
ctccgctactacaaccacagcgaggc

SEQ ID NO: 14838 - DNA, 26 bp, Artificial Sequence
  Description of Artificial Sequence: Synthetic oligonucleotide
tccgctactacaaccacagcgaggcc

SEQ ID NO: 14839 - DNA, 25 bp, Artificial Sequence
  Description of Artificial Sequence: Synthetic oligonucleotide
ccgctactacaaccacagcgaggcc

SEQ ID NO: 14840 - DNA, 25 bp, Artificial Sequence
  Description of Artificial Sequence: Synthetic oligonucleotide
cgctactacaaccacagcgaggccg

SEQ ID NO: 14841 - DNA, 24 bp, Artificial Sequence
  Description of Artificial Sequence: Synthetic oligonucleotide
cacagcgaggccggttctcacacc

SEQ ID NO: 14842 - DNA, 25 bp, Artificial Sequence
  Description of Artificial Sequence: Synthetic oligonucleotide
acagcgaggccggttctcacaccct

SEQ ID NO: 14843 - DNA, 24 bp, Artificial Sequence
  Description of Artificial Sequence: Synthetic oligonucleotide
cagcgaggccggttctcacaccct

SEQ ID NO: 14844 - DNA, 26 bp, Artificial Sequence
  Description of Artificial Sequence: Synthetic oligonucleotide
aacgggaaggagacgctgcagcgcat

SEQ ID NO: 14845 - DNA, 25 bp, Artificial Sequence
  Description of Artificial Sequence: Synthetic oligonucleotide
acgggaaggagacgctgcagcgcat

SEQ ID NO: 14846 - DNA, 24 bp, Artificial Sequence
  Description of Artificial Sequence: Synthetic oligonucleotide
cgggaaggagacgctgcagcgcat

SEQ ID NO: 14847 - DNA, 24 bp, Artificial Sequence
  Description of Artificial Sequence: Synthetic oligonucleotide
gggaaggagacgctgcagcgcatg

SEQ ID NO: 14848 - DNA, 24 bp, Artificial Sequence
  Description of Artificial Sequence: Synthetic oligonucleotide
ggaaggagacgctgcagcgcatgg

SEQ ID NO: 14849 - DNA, 23 bp, Artificial Sequence
  Description of Artificial Sequence: Synthetic oligonucleotide
ctccgcgggtaccaccagtacgg

SEQ ID NO: 14850 - DNA, 25 bp, Artificial Sequence
  Description of Artificial Sequence: Synthetic oligonucleotide
tccgcgggtaccaccagtacggcta

SEQ ID NO: 14851 - DNA, 24 bp, Artificial Sequence
  Description of Artificial Sequence: Synthetic oligonucleotide
ccgcgggtaccaccagtacggcta

SEQ ID NO: 14852 - DNA, 24 bp, Artificial Sequence
  Description of Artificial Sequence: Synthetic oligonucleotide
cgcgggtaccaccagtacggctac

SEQ ID NO: 14853 - DNA, 25 bp, Artificial Sequence
  Description of Artificial Sequence: Synthetic oligonucleotide
gcgggtaccaccagtacggctacga

SEQ ID NO: 14854 - DNA, 25 bp, Artificial Sequence
  Description of Artificial Sequence: Synthetic oligonucleotide
cgggtaccaccagtacggctacgac

SEQ ID NO: 14855 - DNA, 25 bp, Artificial Sequence
  Description of Artificial Sequence: Synthetic oligonucleotide
gggtaccaccagtacggctacgacg

SEQ ID NO: 14856 - DNA, 25 bp, Artificial Sequence
  Description of Artificial Sequence: Synthetic oligonucleotide
ggtaccaccagtacggctacgacgg

SEQ ID NO: 14857 - DNA, 27 bp, Artificial Sequence
  Description of Artificial Sequence: Synthetic oligonucleotide
gtaccaccagtacggctacgacggcaa

SEQ ID NO: 14858 - DNA, 27 bp, Artificial Sequence
  Description of Artificial Sequence: Synthetic oligonucleotide
taccaccagtacggctacgacggcaag

SEQ ID NO: 14859 - DNA, 26 bp, Artificial Sequence
  Description of Artificial Sequence: Synthetic oligonucleotide
accaccagtacggctacgacggcaag

SEQ ID NO: 14860 - DNA, 25 bp, Artificial Sequence
  Description of Artificial Sequence: Synthetic oligonucleotide
ccaccagtacggctacgacggcaag

SEQ ID NO: 14861 - DNA, 27 bp, Artificial Sequence
  Description of Artificial Sequence: Synthetic oligonucleotide
caccagtacggctacgacggcaaggat

SEQ ID NO: 14862 - DNA, 29 bp, Artificial Sequence
  Description of Artificial Sequence: Synthetic oligonucleotide
accagtacggctacgacggcaaggattac

SEQ ID NO: 14863 - DNA, 28 bp, Artificial Sequence
  Description of Artificial Sequence: Synthetic oligonucleotide
ccagtacggctacgacggcaaggattac

SEQ ID NO: 14864 - DNA, 30 bp, Artificial Sequence
  Description of Artificial Sequence: Synthetic oligonucleotide
cagtacggctacgacggcaaggattacatc

SEQ ID NO: 14865 - DNA, 30 bp, Artificial Sequence
  Description of Artificial Sequence: Synthetic oligonucleotide
agtacggctacgacggcaaggattacatcg

SEQ ID NO: 14866 - DNA, 29 bp, Artificial Sequence
  Description of Artificial Sequence: Synthetic oligonucleotide
gtacggctacgacggcaaggattacatcg

SEQ ID NO: 14867 - DNA, 29 bp, Artificial Sequence
  Description of Artificial Sequence: Synthetic oligonucleotide
tacggctacgacggcaaggattacatcgc

SEQ ID NO: 14868 - DNA, 28 bp, Artificial Sequence
  Description of Artificial Sequence: Synthetic oligonucleotide
acggctacgacggcaaggattacatcgc

SEQ ID NO: 14869 - DNA, 27 bp, Artificial Sequence
  Description of Artificial Sequence: Synthetic oligonucleotide
cggctacgacggcaaggattacatcgc

SEQ ID NO: 14870 - DNA, 27 bp, Artificial Sequence
  Description of Artificial Sequence: Synthetic oligonucleotide
ggctacgacggcaaggattacatcgcc

SEQ ID NO: 14871 - DNA, 27 bp, Artificial Sequence
  Description of Artificial Sequence: Synthetic oligonucleotide
gctacgacggcaaggattacatcgccc

SEQ ID NO: 14872 - DNA, 24 bp, Artificial Sequence
  Description of Artificial Sequence: Synthetic oligonucleotide
cgaggccggttctcacaccctcga

SEQ ID NO: 14873 - DNA, 26 bp, Artificial Sequence
  Description of Artificial Sequence: Synthetic oligonucleotide
gaggccggttctcacaccctcgagat

SEQ ID NO: 14874 - DNA, 27 bp, Artificial Sequence
  Description of Artificial Sequence: Synthetic oligonucleotide
aggccggttctcacaccctcgagatga

SEQ ID NO: 14875 - DNA, 27 bp, Artificial Sequence
  Description of Artificial Sequence: Synthetic oligonucleotide
ggccggttctcacaccctcgagatgat

SEQ ID NO: 14876 - DNA, 27 bp, Artificial Sequence
  Description of Artificial Sequence: Synthetic oligonucleotide
gccggttctcacaccctcgagatgatg

SEQ ID NO: 14877 - DNA, 30 bp, Artificial Sequence
  Description of Artificial Sequence: Synthetic oligonucleotide
ccggttctcacaccctcgagatgatgtttg

SEQ ID NO: 14878 - DNA, 30 bp, Artificial Sequence
  Description of Artificial Sequence: Synthetic oligonucleotide
cggttctcacaccctcgagatgatgtttgg

SEQ ID NO: 14879 - DNA, 30 bp, Artificial Sequence
  Description of Artificial Sequence: Synthetic oligonucleotide
ggttctcacaccctcgagatgatgtttggc

SEQ ID NO: 14880 - DNA, 31 bp, Artificial Sequence
  Description of Artificial Sequence: Synthetic oligonucleotide
gttctcacaccctcgagatgatgtttggctg

SEQ ID NO: 14881 - DNA, 31 bp, Artificial Sequence
  Description of Artificial Sequence: Synthetic oligonucleotide
ttctcacaccctcgagatgatgtttggctgc

SEQ ID NO: 14882 - DNA, 30 bp, Artificial Sequence
  Description of Artificial Sequence: Synthetic oligonucleotide
tctcacaccctcgagatgatgtttggctgc

SEQ ID NO: 14883 - DNA, 29 bp, Artificial Sequence
  Description of Artificial Sequence: Synthetic oligonucleotide
ctcacaccctcgagatgatgtttggctgc

SEQ ID NO: 14884 - DNA, 29 bp, Artificial Sequence
  Description of Artificial Sequence: Synthetic oligonucleotide
tcacaccctcgagatgatgtttggctgcg

SEQ ID NO: 14885 - DNA, 28 bp, Artificial Sequence
  Description of Artificial Sequence: Synthetic oligonucleotide
cacaccctcgagatgatgtttggctgcg

SEQ ID NO: 14886 - DNA, 29 bp, Artificial Sequence
  Description of Artificial Sequence: Synthetic oligonucleotide
acaccctcgagatgatgtttggctgcgac

SEQ ID NO: 14887 - DNA, 28 bp, Artificial Sequence
  Description of Artificial Sequence: Synthetic oligonucleotide
caccctcgagatgatgtttggctgcgac

SEQ ID NO: 14888 - DNA, 28 bp, Artificial Sequence
  Description of Artificial Sequence: Synthetic oligonucleotide
accctcgagatgatgtttggctgcgacg

SEQ ID NO: 14889 - DNA, 27 bp, Artificial Sequence
  Description of Artificial Sequence: Synthetic oligonucleotide
ccctcgagatgatgtttggctgcgacg

SEQ ID NO: 14890 - DNA, 28 bp, Artificial Sequence
  Description of Artificial Sequence: Synthetic oligonucleotide
cctcgagatgatgtttggctgcgacgtg

SEQ ID NO: 14891 - DNA, 28 bp, Artificial Sequence
  Description of Artificial Sequence: Synthetic oligonucleotide
ctcgagatgatgtttggctgcgacgtgg

SEQ ID NO: 14892 - DNA, 28 bp, Artificial Sequence
  Description of Artificial Sequence: Synthetic oligonucleotide
tcgagatgatgtttggctgcgacgtggg

SEQ ID NO: 14893 - DNA, 27 bp, Artificial Sequence
  Description of Artificial Sequence: Synthetic oligonucleotide
cgagatgatgtttggctgcgacgtggg

SEQ ID NO: 14894 - DNA, 27 bp, Artificial Sequence
  Description of Artificial Sequence: Synthetic oligonucleotide
gagatgatgtttggctgcgacgtgggg

SEQ ID NO: 14895 - DNA, 23 bp, Artificial Sequence
  Description of Artificial Sequence: Synthetic oligonucleotide
gggcgcttcctccgcgggtatga

SEQ ID NO: 14896 - DNA, 24 bp, Artificial Sequence
  Description of Artificial Sequence: Synthetic oligonucleotide
cgcttcctccgcgggtatgaccag

SEQ ID NO: 14897 - DNA, 25 bp, Artificial Sequence
  Description of Artificial Sequence: Synthetic oligonucleotide
gcttcctccgcgggtatgaccagga

SEQ ID NO: 14898 - DNA, 25 bp, Artificial Sequence
  Description of Artificial Sequence: Synthetic oligonucleotide
cttcctccgcgggtatgaccaggac

SEQ ID NO: 14899 - DNA, 25 bp, Artificial Sequence
  Description of Artificial Sequence: Synthetic oligonucleotide
ttcctccgcgggtatgaccaggacg

SEQ ID NO: 14900 - DNA, 24 bp, Artificial Sequence
  Description of Artificial Sequence: Synthetic oligonucleotide
tcctccgcgggtatgaccaggacg

SEQ ID NO: 14901 - DNA, 23 bp, Artificial Sequence
  Description of Artificial Sequence: Synthetic oligonucleotide
cctccgcgggtatgaccaggacg

SEQ ID NO: 14902 - DNA, 23 bp, Artificial Sequence
  Description of Artificial Sequence: Synthetic oligonucleotide
ctccgcgggtatgaccaggacgc

SEQ ID NO: 14903 - DNA, 25 bp, Artificial Sequence
  Description of Artificial Sequence: Synthetic oligonucleotide
tccgcgggtatgaccaggacgccta

SEQ ID NO: 14904 - DNA, 24 bp, Artificial Sequence
  Description of Artificial Sequence: Synthetic oligonucleotide
ccgcgggtatgaccaggacgccta

SEQ ID NO: 14905 - DNA, 24 bp, Artificial Sequence
  Description of Artificial Sequence: Synthetic oligonucleotide
cgcgggtatgaccaggacgcctac

SEQ ID NO: 14906 - DNA, 25 bp, Artificial Sequence
  Description of Artificial Sequence: Synthetic oligonucleotide
gcgggtatgaccaggacgcctacga

SEQ ID NO: 14907 - DNA, 25 bp, Artificial Sequence
  Description of Artificial Sequence: Synthetic oligonucleotide
cgggtatgaccaggacgcctacgac

SEQ ID NO: 14908 - DNA, 25 bp, Artificial Sequence
  Description of Artificial Sequence: Synthetic oligonucleotide
gggtatgaccaggacgcctacgacg

SEQ ID NO: 14909 - DNA, 25 bp, Artificial Sequence
  Description of Artificial Sequence: Synthetic oligonucleotide
ggtatgaccaggacgcctacgacgg

SEQ ID NO: 14910 - DNA, 27 bp, Artificial Sequence
  Description of Artificial Sequence: Synthetic oligonucleotide
gtatgaccaggacgcctacgacggcaa

SEQ ID NO: 14911 - DNA, 27 bp, Artificial Sequence
  Description of Artificial Sequence: Synthetic oligonucleotide
tatgaccaggacgcctacgacggcaag

SEQ ID NO: 14912 - DNA, 26 bp, Artificial Sequence
  Description of Artificial Sequence: Synthetic oligonucleotide
atgaccaggacgcctacgacggcaag

SEQ ID NO: 14913 - DNA, 25 bp, Artificial Sequence
  Description of Artificial Sequence: Synthetic oligonucleotide
tgaccaggacgcctacgacggcaag

SEQ ID NO: 14914 - DNA, 24 bp, Artificial Sequence
  Description of Artificial Sequence: Synthetic oligonucleotide
gaccaggacgcctacgacggcaag

SEQ ID NO: 14915 - DNA, 27 bp, Artificial Sequence
  Description of Artificial Sequence: Synthetic oligonucleotide
accaggacgcctacgacggcaaggatt

SEQ ID NO: 14916 - DNA, 27 bp, Artificial Sequence
  Description of Artificial Sequence: Synthetic oligonucleotide
ccaggacgcctacgacggcaaggatta

SEQ ID NO: 14917 - DNA, 23 bp, Artificial Sequence
  Description of Artificial Sequence: Synthetic oligonucleotide
ggcccatgtggcggagcagcaca

SEQ ID NO: 14918 - DNA, 24 bp, Artificial Sequence
  Description of Artificial Sequence: Synthetic oligonucleotide
gcccatgtggcggagcagcacaga

SEQ ID NO: 14919 - DNA, 24 bp, Artificial Sequence
  Description of Artificial Sequence: Synthetic oligonucleotide
cccatgtggcggagcagcacagag

SEQ ID NO: 14920 - DNA, 24 bp, Artificial Sequence
  Description of Artificial Sequence: Synthetic oligonucleotide
ccatgtggcggagcagcacagagc

SEQ ID NO: 14921 - DNA, 26 bp, Artificial Sequence
  Description of Artificial Sequence: Synthetic oligonucleotide
catgtggcggagcagcacagagccta

SEQ ID NO: 14922 - DNA, 26 bp, Artificial Sequence
  Description of Artificial Sequence: Synthetic oligonucleotide
atgtggcggagcagcacagagcctac

SEQ ID NO: 14923 - DNA, 25 bp, Artificial Sequence
  Description of Artificial Sequence: Synthetic oligonucleotide
tgtggcggagcagcacagagcctac

SEQ ID NO: 14924 - DNA, 24 bp, Artificial Sequence
  Description of Artificial Sequence: Synthetic oligonucleotide
gtggcggagcagcacagagcctac

SEQ ID NO: 14925 - DNA, 25 bp, Artificial Sequence
  Description of Artificial Sequence: Synthetic oligonucleotide
tggcggagcagcacagagcctacct

SEQ ID NO: 14926 - DNA, 24 bp, Artificial Sequence
  Description of Artificial Sequence: Synthetic oligonucleotide
ggcggagcagcacagagcctacct

SEQ ID NO: 14927 - DNA, 24 bp, Artificial Sequence
  Description of Artificial Sequence: Synthetic oligonucleotide
gcggagcagcacagagcctacctg

SEQ ID NO: 14928 - DNA, 25 bp, Artificial Sequence
  Description of Artificial Sequence: Synthetic oligonucleotide
cggagcagcacagagcctacctgga

SEQ ID NO: 14929 - DNA, 25 bp, Artificial Sequence
  Description of Artificial Sequence: Synthetic oligonucleotide
ggagcagcacagagcctacctggag

SEQ ID NO: 14930 - DNA, 25 bp, Artificial Sequence
  Description of Artificial Sequence: Synthetic oligonucleotide
gagcagcacagagcctacctggagg

SEQ ID NO: 14931 - DNA, 25 bp, Artificial Sequence
  Description of Artificial Sequence: Synthetic oligonucleotide
agcagcacagagcctacctggaggg

SEQ ID NO: 14932 - DNA, 24 bp, Artificial Sequence
  Description of Artificial Sequence: Synthetic oligonucleotide
gcagcacagagcctacctggaggg

SEQ ID NO: 14933 - DNA, 25 bp, Artificial Sequence
  Description of Artificial Sequence: Synthetic oligonucleotide
cagcacagagcctacctggagggca

SEQ ID NO: 14934 - DNA, 25 bp, Artificial Sequence
  Description of Artificial Sequence: Synthetic oligonucleotide
agcacagagcctacctggagggcac

SEQ ID NO: 14935 - DNA, 24 bp, Artificial Sequence
  Description of Artificial Sequence: Synthetic oligonucleotide
gcacagagcctacctggagggcac

SEQ ID NO: 14936 - DNA, 25 bp, Artificial Sequence
  Description of Artificial Sequence: Synthetic oligonucleotide
cacagagcctacctggagggcacgt

SEQ ID NO: 14937 - DNA, 25 bp, Artificial Sequence
  Description of Artificial Sequence: Synthetic oligonucleotide
acagagcctacctggagggcacgtg

SEQ ID NO: 14938 - DNA, 24 bp, Artificial Sequence
  Description of Artificial Sequence: Synthetic oligonucleotide
cagagcctacctggagggcacgtg

SEQ ID NO: 14939 - DNA, 27 bp, Artificial Sequence
  Description of Artificial Sequence: Synthetic oligonucleotide
aggagacagggaaagtgaaggcccagg

SEQ ID NO: 14940 - DNA, 26 bp, Artificial Sequence
  Description of Artificial Sequence: Synthetic oligonucleotide
ggagacagggaaagtgaaggcccagg

SEQ ID NO: 14941 - DNA, 27 bp, Artificial Sequence
  Description of Artificial Sequence: Synthetic oligonucleotide
gagacagggaaagtgaaggcccaggca

SEQ ID NO: 14942 - DNA, 27 bp, Artificial Sequence
  Description of Artificial Sequence: Synthetic oligonucleotide
agacagggaaagtgaaggcccaggcac

SEQ ID NO: 14943 - DNA, 27 bp, Artificial Sequence
  Description of Artificial Sequence: Synthetic oligonucleotide
gacagggaaagtgaaggcccaggcaca

SEQ ID NO: 14944 - DNA, 27 bp, Artificial Sequence
  Description of Artificial Sequence: Synthetic oligonucleotide
acagggaaagtgaaggcccaggcacag

SEQ ID NO: 14945 - DNA, 27 bp, Artificial Sequence
  Description of Artificial Sequence: Synthetic oligonucleotide
cagggaaagtgaaggcccaggcacaga

SEQ ID NO: 14946 - DNA, 27 bp, Artificial Sequence
  Description of Artificial Sequence: Synthetic oligonucleotide
agggaaagtgaaggcccaggcacagac

SEQ ID NO: 14947 - DNA, 27 bp, Artificial Sequence
  Description of Artificial Sequence: Synthetic oligonucleotide
gggaaagtgaaggcccaggcacagact

SEQ ID NO: 14948 - DNA, 27 bp, Artificial Sequence
  Description of Artificial Sequence: Synthetic oligonucleotide
ggaaagtgaaggcccaggcacagactg

SEQ ID NO: 14949 - DNA, 28 bp, Artificial Sequence
  Description of Artificial Sequence: Synthetic oligonucleotide
gaaagtgaaggcccaggcacagactgac

SEQ ID NO: 14950 - DNA, 28 bp, Artificial Sequence
  Description of Artificial Sequence: Synthetic oligonucleotide
aaagtgaaggcccaggcacagactgacc

SEQ ID NO: 14951 - DNA, 27 bp, Artificial Sequence
  Description of Artificial Sequence: Synthetic oligonucleotide
aagtgaaggcccaggcacagactgacc

SEQ ID NO: 14952 - DNA, 26 bp, Artificial Sequence
  Description of Artificial Sequence: Synthetic oligonucleotide
agtgaaggcccaggcacagactgacc

SEQ ID NO: 14953 - DNA, 25 bp, Artificial Sequence
  Description of Artificial Sequence: Synthetic oligonucleotide
gtgaaggcccaggcacagactgacc

SEQ ID NO: 14954 - DNA, 26 bp, Artificial Sequence
  Description of Artificial Sequence: Synthetic oligonucleotide
tgaaggcccaggcacagactgaccga

SEQ ID NO: 14955 - DNA, 25 bp, Artificial Sequence
  Description of Artificial Sequence: Synthetic oligonucleotide
gaaggcccaggcacagactgaccga

SEQ ID NO: 14956 - DNA, 26 bp, Artificial Sequence
  Description of Artificial Sequence: Synthetic oligonucleotide
aaggcccaggcacagactgaccgaga

SEQ ID NO: 14957 - DNA, 25 bp, Artificial Sequence
  Description of Artificial Sequence: Synthetic oligonucleotide
aggcccaggcacagactgaccgaga

SEQ ID NO: 14958 - DNA, 24 bp, Artificial Sequence
  Description of Artificial Sequence: Synthetic oligonucleotide
ggcccaggcacagactgaccgaga

SEQ ID NO: 14959 - DNA, 26 bp, Artificial Sequence
  Description of Artificial Sequence: Synthetic oligonucleotide
gcccaggcacagactgaccgagagaa

SEQ ID NO: 14960 - DNA, 26 bp, Artificial Sequence
  Description of Artificial Sequence: Synthetic oligonucleotide
cccaggcacagactgaccgagagaac

SEQ ID NO: 14961 - DNA, 27 bp, Artificial Sequence
  Description of Artificial Sequence: Synthetic oligonucleotide
ccaggcacagactgaccgagagaacct

SEQ ID NO: 14962 - DNA, 27 bp, Artificial Sequence
  Description of Artificial Sequence: Synthetic oligonucleotide
caggcacagactgaccgagagaacctg

SEQ ID NO: 14963 - DNA, 27 bp, Artificial Sequence
  Description of Artificial Sequence: Synthetic oligonucleotide
aggcacagactgaccgagagaacctgc

SEQ ID NO: 14964 - DNA, 26 bp, Artificial Sequence
  Description of Artificial Sequence: Synthetic oligonucleotide
ggcacagactgaccgagagaacctgc

SEQ ID NO: 14965 - DNA, 26 bp, Artificial Sequence
  Description of Artificial Sequence: Synthetic oligonucleotide
gcacagactgaccgagagaacctgcg

SEQ ID NO: 14966 - DNA, 26 bp, Artificial Sequence
  Description of Artificial Sequence: Synthetic oligonucleotide
cagagcgaggacggttctcacaccct

SEQ ID NO: 14967 - DNA, 26 bp, Artificial Sequence
  Description of Artificial Sequence: Synthetic oligonucleotide
agagcgaggacggttctcacaccctc

SEQ ID NO: 14968 - DNA, 25 bp, Artificial Sequence
  Description of Artificial Sequence: Synthetic oligonucleotide
gagcgaggacggttctcacaccctc

SEQ ID NO: 14969 - DNA, 26 bp, Artificial Sequence
  Description of Artificial Sequence: Synthetic oligonucleotide
agcgaggacggttctcacaccctcca

SEQ ID NO: 14970 - DNA, 25 bp, Artificial Sequence
  Description of Artificial Sequence: Synthetic oligonucleotide
gcgaggacggttctcacaccctcca

SEQ ID NO: 14971 - DNA, 27 bp, Artificial Sequence
  Description of Artificial Sequence: Synthetic oligonucleotide
cgaggacggttctcacaccctccagat

SEQ ID NO: 14972 - DNA, 27 bp, Artificial Sequence
  Description of Artificial Sequence: Synthetic oligonucleotide
gaggacggttctcacaccctccagatg

SEQ ID NO: 14973 - DNA, 29 bp, Artificial Sequence
  Description of Artificial Sequence: Synthetic oligonucleotide
aggacggttctcacaccctccagatgatg

SEQ ID NO: 14974 - DNA, 28 bp, Artificial Sequence
  Description of Artificial Sequence: Synthetic oligonucleotide
ggacggttctcacaccctccagatgatg

SEQ ID NO: 14975 - DNA, 31 bp, Artificial Sequence
  Description of Artificial Sequence: Synthetic oligonucleotide
gacggttctcacaccctccagatgatgtttg

SEQ ID NO: 14976 - DNA, 31 bp, Artificial Sequence
  Description of Artificial Sequence: Synthetic oligonucleotide
acggttctcacaccctccagatgatgtttgg

SEQ ID NO: 14977 - DNA, 27 bp, Artificial Sequence
  Description of Artificial Sequence: Synthetic oligonucleotide
cctacgacggcaaggattacatcgccg

SEQ ID NO: 14978 - DNA, 28 bp, Artificial Sequence
  Description of Artificial Sequence: Synthetic oligonucleotide
ctacgacggcaaggattacatcgccgtg

SEQ ID NO: 14979 - DNA, 31 bp, Artificial Sequence
  Description of Artificial Sequence: Synthetic oligonucleotide
tacgacggcaaggattacatcgccgtgaaag

SEQ ID NO: 14980 - DNA, 30 bp, Artificial Sequence
  Description of Artificial Sequence: Synthetic oligonucleotide
acgacggcaaggattacatcgccgtgaaag

SEQ ID NO: 14981 - DNA, 29 bp, Artificial Sequence
  Description of Artificial Sequence: Synthetic oligonucleotide
cgacggcaaggattacatcgccgtgaaag

SEQ ID NO: 14982 - DNA, 30 bp, Artificial Sequence
  Description of Artificial Sequence: Synthetic oligonucleotide
gacggcaaggattacatcgccgtgaaagag

SEQ ID NO: 14983 - DNA, 30 bp, Artificial Sequence
  Description of Artificial Sequence: Synthetic oligonucleotide
acggcaaggattacatcgccgtgaaagagg

SEQ ID NO: 14984 - DNA, 29 bp, Artificial Sequence
  Description of Artificial Sequence: Synthetic oligonucleotide
cggcaaggattacatcgccgtgaaagagg

SEQ ID NO: 14985 - DNA, 30 bp, Artificial Sequence
  Description of Artificial Sequence: Synthetic oligonucleotide
ggcaaggattacatcgccgtgaaagaggac

SEQ ID NO: 14986 - DNA, 30 bp, Artificial Sequence
  Description of Artificial Sequence: Synthetic oligonucleotide
gcaaggattacatcgccgtgaaagaggacc

SEQ ID NO: 14987 - DNA, 31 bp, Artificial Sequence
  Description of Artificial Sequence: Synthetic oligonucleotide
caaggattacatcgccgtgaaagaggacctg

SEQ ID NO: 14988 - DNA, 31 bp, Artificial Sequence
  Description of Artificial Sequence: Synthetic oligonucleotide
aaggattacatcgccgtgaaagaggacctgc

SEQ ID NO: 14989 - DNA, 30 bp, Artificial Sequence
  Description of Artificial Sequence: Synthetic oligonucleotide
aggattacatcgccgtgaaagaggacctgc

SEQ ID NO: 14990 - DNA, 29 bp, Artificial Sequence
  Description of Artificial Sequence: Synthetic oligonucleotide
ggattacatcgccgtgaaagaggacctgc

SEQ ID NO: 14991 - DNA, 29 bp, Artificial Sequence
  Description of Artificial Sequence: Synthetic oligonucleotide
gattacatcgccgtgaaagaggacctgcg

SEQ ID NO: 14992 - DNA, 29 bp, Artificial Sequence
  Description of Artificial Sequence: Synthetic oligonucleotide
attacatcgccgtgaaagaggacctgcgc

SEQ ID NO: 14993 - DNA, 28 bp, Artificial Sequence
  Description of Artificial Sequence: Synthetic oligonucleotide
ttacatcgccgtgaaagaggacctgcgc

SEQ ID NO: 14994 - DNA, 27 bp, Artificial Sequence
  Description of Artificial Sequence: Synthetic oligonucleotide
tacatcgccgtgaaagaggacctgcgc

SEQ ID NO: 14995 - DNA, 27 bp, Artificial Sequence
  Description of Artificial Sequence: Synthetic oligonucleotide
acatcgccgtgaaagaggacctgcgct

SEQ ID NO: 14996 - DNA, 26 bp, Artificial Sequence
  Description of Artificial Sequence: Synthetic oligonucleotide
catcgccgtgaaagaggacctgcgct

SEQ ID NO: 14997 - DNA, 27 bp, Artificial Sequence
  Description of Artificial Sequence: Synthetic oligonucleotide
atcgccgtgaaagaggacctgcgctct

SEQ ID NO: 14998 - DNA, 27 bp, Artificial Sequence
  Description of Artificial Sequence: Synthetic oligonucleotide
tcgccgtgaaagaggacctgcgctctt

SEQ ID NO: 14999 - DNA, 26 bp, Artificial Sequence
  Description of Artificial Sequence: Synthetic oligonucleotide
cgccgtgaaagaggacctgcgctctt

SEQ ID NO: 15000 - DNA, 26 bp, Artificial Sequence
  Description of Artificial Sequence: Synthetic oligonucleotide
gccgtgaaagaggacctgcgctcttg

SEQ ID NO: 15001 - DNA, 27 bp, Artificial Sequence
  Description of Artificial Sequence: Synthetic oligonucleotide
ccgtgaaagaggacctgcgctcttgga

SEQ ID NO: 15002 - DNA, 27 bp, Artificial Sequence
  Description of Artificial Sequence: Synthetic oligonucleotide
cgtgaaagaggacctgcgctcttggac

SEQ ID NO: 15003 - DNA, 27 bp, Artificial Sequence
  Description of Artificial Sequence: Synthetic oligonucleotide
gtgaaagaggacctgcgctcttggacc

SEQ ID NO: 15004 - DNA, 26 bp, Artificial Sequence
  Description of Artificial Sequence: Synthetic oligonucleotide
gcagttcgtgcggttcgacagcgaca

SEQ ID NO: 15005 - DNA, 26 bp, Artificial Sequence
  Description of Artificial Sequence: Synthetic oligonucleotide
cagttcgtgcggttcgacagcgacac

SEQ ID NO: 15006 - DNA, 26 bp, Artificial Sequence
  Description of Artificial Sequence: Synthetic oligonucleotide
agttcgtgcggttcgacagcgacacc

SEQ ID NO: 15007 - DNA, 25 bp, Artificial Sequence
  Description of Artificial Sequence: Synthetic oligonucleotide
gttcgtgcggttcgacagcgacacc

SEQ ID NO: 15008 - DNA, 25 bp, Artificial Sequence
  Description of Artificial Sequence: Synthetic oligonucleotide
ttcgtgcggttcgacagcgacaccg

SEQ ID NO: 15009 - DNA, 24 bp, Artificial Sequence
  Description of Artificial Sequence: Synthetic oligonucleotide
tcgtgcggttcgacagcgacaccg

SEQ ID NO: 15010 - DNA, 23 bp, Artificial Sequence
  Description of Artificial Sequence: Synthetic oligonucleotide
cgtgcggttcgacagcgacaccg

SEQ ID NO: 15011 - DNA, 23 bp, Artificial Sequence
  Description of Artificial Sequence: Synthetic oligonucleotide
gtgcggttcgacagcgacaccgc

SEQ ID NO: 15012 - DNA, 24 bp, Artificial Sequence
  Description of Artificial Sequence: Synthetic oligonucleotide
tgcggttcgacagcgacaccgcga

SEQ ID NO: 15013 - DNA, 23 bp, Artificial Sequence
  Description of Artificial Sequence: Synthetic oligonucleotide
gcggttcgacagcgacaccgcga

SEQ ID NO: 15014 - DNA, 23 bp, Artificial Sequence
  Description of Artificial Sequence: Synthetic oligonucleotide
cggttcgacagcgacaccgcgag

SEQ ID NO: 15015 - DNA, 23 bp, Artificial Sequence
  Description of Artificial Sequence: Synthetic oligonucleotide
ggttcgacagcgacaccgcgagc

SEQ ID NO: 15016 - DNA, 24 bp, Artificial Sequence
  Description of Artificial Sequence: Synthetic oligonucleotide
gttcgacagcgacaccgcgagcca

SEQ ID NO: 15017 - DNA, 25 bp, Artificial Sequence
  Description of Artificial Sequence: Synthetic oligonucleotide
ttcgacagcgacaccgcgagccaga

SEQ ID NO: 15018 - DNA, 24 bp, Artificial Sequence
  Description of Artificial Sequence: Synthetic oligonucleotide
tcgacagcgacaccgcgagccaga

SEQ ID NO: 15019 - DNA, 23 bp, Artificial Sequence
  Description of Artificial Sequence: Synthetic oligonucleotide
cgacagcgacaccgcgagccaga

SEQ ID NO: 15020 - DNA, 23 bp, Artificial Sequence
  Description of Artificial Sequence: Synthetic oligonucleotide
gacagcgacaccgcgagccagag

SEQ ID NO: 15021 - DNA, 25 bp, Artificial Sequence
  Description of Artificial Sequence: Synthetic oligonucleotide
acagcgacaccgcgagccagaggat

SEQ ID NO: 15022 - DNA, 24 bp, Artificial Sequence
  Description of Artificial Sequence: Synthetic oligonucleotide
cagcgacaccgcgagccagaggat

SEQ ID NO: 15023 - DNA, 24 bp, Artificial Sequence
  Description of Artificial Sequence: Synthetic oligonucleotide
agcgacaccgcgagccagaggatg

SEQ ID NO: 15024 - DNA, 23 bp, Artificial Sequence
  Description of Artificial Sequence: Synthetic oligonucleotide
gcgacaccgcgagccagaggatg

SEQ ID NO: 15025 - DNA, 24 bp, Artificial Sequence
  Description of Artificial Sequence: Synthetic oligonucleotide
cgacaccgcgagccagaggatgga

SEQ ID NO: 15026 - DNA, 24 bp, Artificial Sequence
  Description of Artificial Sequence: Synthetic oligonucleotide
gacaccgcgagccagaggatggag

SEQ ID NO: 15027 - DNA, 24 bp, Artificial Sequence
  Description of Artificial Sequence: Synthetic oligonucleotide
acaccgcgagccagaggatggagc

SEQ ID NO: 15028 - DNA, 23 bp, Artificial Sequence
  Description of Artificial Sequence: Synthetic oligonucleotide
caccgcgagccagaggatggagc

SEQ ID NO: 15029 - DNA, 23 bp, Artificial Sequence
  Description of Artificial Sequence: Synthetic oligonucleotide
accgcgagccagaggatggagcc

SEQ ID NO: 15030 - DNA, 32 bp, Artificial Sequence
  Description of Artificial Sequence: Synthetic oligonucleotide
gctcccactccatgaagtatttctccacatcc

SEQ ID NO: 15031 - DNA, 32 bp, Artificial Sequence
  Description of Artificial Sequence: Synthetic oligonucleotide
ctcccactccatgaagtatttctccacatccg

SEQ ID NO: 15032 - DNA, 33 bp, Artificial Sequence
  Description of Artificial Sequence: Synthetic oligonucleotide
tcccactccatgaagtatttctccacatccgtg

SEQ ID NO: 15033 - DNA, 32 bp, Artificial Sequence
  Description of Artificial Sequence: Synthetic oligonucleotide
cccactccatgaagtatttctccacatccgtg

SEQ ID NO: 15034 - DNA, 33 bp, Artificial Sequence
  Description of Artificial Sequence: Synthetic oligonucleotide
ccactccatgaagtatttctccacatccgtgtc

SEQ ID NO: 15035 - DNA, 33 bp, Artificial Sequence
  Description of Artificial Sequence: Synthetic oligonucleotide
cactccatgaagtatttctccacatccgtgtcc

SEQ ID NO: 15036 - DNA, 33 bp, Artificial Sequence
  Description of Artificial Sequence: Synthetic oligonucleotide
actccatgaagtatttctccacatccgtgtccc

SEQ ID NO: 15037 - DNA, 32 bp, Artificial Sequence
  Description of Artificial Sequence: Synthetic oligonucleotide
ctccatgaagtatttctccacatccgtgtccc

SEQ ID NO: 15038 - DNA, 32 bp, Artificial Sequence
  Description of Artificial Sequence: Synthetic oligonucleotide
tccatgaagtatttctccacatccgtgtcccg

SEQ ID NO: 15039 - DNA, 31 bp, Artificial Sequence
  Description of Artificial Sequence: Synthetic oligonucleotide
ccatgaagtatttctccacatccgtgtcccg

SEQ ID NO: 15040 - DNA, 31 bp, Artificial Sequence
  Description of Artificial Sequence: Synthetic oligonucleotide
catgaagtatttctccacatccgtgtcccgg

SEQ ID NO: 15041 - DNA, 31 bp, Artificial Sequence
  Description of Artificial Sequence: Synthetic oligonucleotide
atgaagtatttctccacatccgtgtcccggc

SEQ ID NO: 15042 - DNA, 30 bp, Artificial Sequence
  Description of Artificial Sequence: Synthetic oligonucleotide
tgaagtatttctccacatccgtgtcccggc

SEQ ID NO: 15043 - DNA, 29 bp, Artificial Sequence
  Description of Artificial Sequence: Synthetic oligonucleotide
gaagtatttctccacatccgtgtcccggc

SEQ ID NO: 15044 - DNA, 29 bp, Artificial Sequence
  Description of Artificial Sequence: Synthetic oligonucleotide
aagtatttctccacatccgtgtcccggcc

SEQ ID NO: 15045 - DNA, 28 bp, Artificial Sequence
  Description of Artificial Sequence: Synthetic oligonucleotide
agtatttctccacatccgtgtcccggcc

SEQ ID NO: 15046 - DNA, 21 bp, Artificial Sequence
  Description of Artificial Sequence: Synthetic oligonucleotide
gcgcttcctccgcgggtgcca

SEQ ID NO: 15047 - DNA, 21 bp, Artificial Sequence
  Description of Artificial Sequence: Synthetic oligonucleotide
cgcttcctccgcgggtgccac

SEQ ID NO: 15048 - DNA, 22 bp, Artificial Sequence
  Description of Artificial Sequence: Synthetic oligonucleotide
gcttcctccgcgggtgccacca

SEQ ID NO: 15049 - DNA, 24 bp, Artificial Sequence
  Description of Artificial Sequence: Synthetic oligonucleotide
cttcctccgcgggtgccaccagta

SEQ ID NO: 15050 - DNA, 24 bp, Artificial Sequence
  Description of Artificial Sequence: Synthetic oligonucleotide
ttcctccgcgggtgccaccagtac

SEQ ID NO: 15051 - DNA, 23 bp, Artificial Sequence
  Description of Artificial Sequence: Synthetic oligonucleotide
tcctccgcgggtgccaccagtac

SEQ ID NO: 15052 - DNA, 22 bp, Artificial Sequence
  Description of Artificial Sequence: Synthetic oligonucleotide
cctccgcgggtgccaccagtac

SEQ ID NO: 15053 - DNA, 22 bp, Artificial Sequence
  Description of Artificial Sequence: Synthetic oligonucleotide
ctccgcgggtgccaccagtacg

SEQ ID NO: 15054 - DNA, 22 bp, Artificial Sequence
  Description of Artificial Sequence: Synthetic oligonucleotide
tccgcgggtgccaccagtacgc

SEQ ID NO: 15055 - DNA, 21 bp, Artificial Sequence
  Description of Artificial Sequence: Synthetic oligonucleotide
ccgcgggtgccaccagtacgc

SEQ ID NO: 15056 - DNA, 23 bp, Artificial Sequence
  Description of Artificial Sequence: Synthetic oligonucleotide
cgcgggtgccaccagtacgccta

SEQ ID NO: 15057 - DNA, 23 bp, Artificial Sequence
  Description of Artificial Sequence: Synthetic oligonucleotide
gcgggtgccaccagtacgcctac

SEQ ID NO: 15058 - DNA, 24 bp, Artificial Sequence
  Description of Artificial Sequence: Synthetic oligonucleotide
cgggtgccaccagtacgcctacga

SEQ ID NO: 15059 - DNA, 24 bp, Artificial Sequence
  Description of Artificial Sequence: Synthetic oligonucleotide
gggtgccaccagtacgcctacgac

SEQ ID NO: 15060 - DNA, 24 bp, Artificial Sequence
  Description of Artificial Sequence: Synthetic oligonucleotide
ggtgccaccagtacgcctacgacg

SEQ ID NO: 15061 - DNA, 24 bp, Artificial Sequence
  Description of Artificial Sequence: Synthetic oligonucleotide
gtgccaccagtacgcctacgacgg

SEQ ID NO: 15062 - DNA, 26 bp, Artificial Sequence
  Description of Artificial Sequence: Synthetic oligonucleotide
tgccaccagtacgcctacgacggcaa

SEQ ID NO: 15063 - DNA, 25 bp, Artificial Sequence
  Description of Artificial Sequence: Synthetic oligonucleotide
gccaccagtacgcctacgacggcaa

SEQ ID NO: 15064 - DNA, 26 bp, Artificial Sequence
  Description of Artificial Sequence: Synthetic oligonucleotide
ggccggttctcacaccctccagatga

SEQ ID NO: 15065 - DNA, 26 bp, Artificial Sequence
  Description of Artificial Sequence: Synthetic oligonucleotide
gccggttctcacaccctccagatgac

SEQ ID NO: 15066 - DNA, 27 bp, Artificial Sequence
  Description of Artificial Sequence: Synthetic oligonucleotide
ccggttctcacaccctccagatgacgt

SEQ ID NO: 15067 - DNA, 29 bp, Artificial Sequence
  Description of Artificial Sequence: Synthetic oligonucleotide
cggttctcacaccctccagatgacgtttg

SEQ ID NO: 15068 - DNA, 29 bp, Artificial Sequence
  Description of Artificial Sequence: Synthetic oligonucleotide
ggttctcacaccctccagatgacgtttgg

SEQ ID NO: 15069 - DNA, 29 bp, Artificial Sequence
  Description of Artificial Sequence: Synthetic oligonucleotide
gttctcacaccctccagatgacgtttggc

SEQ ID NO: 15070 - DNA, 30 bp, Artificial Sequence
  Description of Artificial Sequence: Synthetic oligonucleotide
ttctcacaccctccagatgacgtttggctg

SEQ ID NO: 15071 - DNA, 29 bp, Artificial Sequence
  Description of Artificial Sequence: Synthetic oligonucleotide
tctcacaccctccagatgacgtttggctg

SEQ ID NO: 15072 - DNA, 28 bp, Artificial Sequence
  Description of Artificial Sequence: Synthetic oligonucleotide
ctcacaccctccagatgacgtttggctg

SEQ ID NO: 15073 - DNA, 28 bp, Artificial Sequence
  Description of Artificial Sequence: Synthetic oligonucleotide
tcacaccctccagatgacgtttggctgc

SEQ ID NO: 15074 - DNA, 27 bp, Artificial Sequence
  Description of Artificial Sequence: Synthetic oligonucleotide
cacaccctccagatgacgtttggctgc

SEQ ID NO: 15075 - DNA, 27 bp, Artificial Sequence
  Description of Artificial Sequence: Synthetic oligonucleotide
acaccctccagatgacgtttggctgcg

SEQ ID NO: 15076 - DNA, 27 bp, Artificial Sequence
  Description of Artificial Sequence: Synthetic oligonucleotide
caccctccagatgacgtttggctgcga

SEQ ID NO: 15077 - DNA, 27 bp, Artificial Sequence
  Description of Artificial Sequence: Synthetic oligonucleotide
accctccagatgacgtttggctgcgac

SEQ ID NO: 15078 - DNA, 26 bp, Artificial Sequence
  Description of Artificial Sequence: Synthetic oligonucleotide
ccctccagatgacgtttggctgcgac

SEQ ID NO: 15079 - DNA, 27 bp, Artificial Sequence
  Description of Artificial Sequence: Synthetic oligonucleotide
cctccagatgacgtttggctgcgacgt

SEQ ID NO: 15080 - DNA, 27 bp, Artificial Sequence
  Description of Artificial Sequence: Synthetic oligonucleotide
ctccagatgacgtttggctgcgacgtg

SEQ ID NO: 15081 - DNA, 27 bp, Artificial Sequence
  Description of Artificial Sequence: Synthetic oligonucleotide
tccagatgacgtttggctgcgacgtgg

SEQ ID NO: 15082 - DNA, 26 bp, Artificial Sequence
  Description of Artificial Sequence: Synthetic oligonucleotide
ccagatgacgtttggctgcgacgtgg

SEQ ID NO: 15083 - DNA, 26 bp, Artificial Sequence
  Description of Artificial Sequence: Synthetic oligonucleotide
cagatgacgtttggctgcgacgtggg

SEQ ID NO: 15084 - DNA, 27 bp, Artificial Sequence
  Description of Artificial Sequence: Synthetic oligonucleotide
agatgacgtttggctgcgacgtggggt

SEQ ID NO: 15085 - DNA, 26 bp, Artificial Sequence
  Description of Artificial Sequence: Synthetic oligonucleotide
gatgacgtttggctgcgacgtggggt

SEQ ID NO: 15086 - DNA, 26 bp, Artificial Sequence
  Description of Artificial Sequence: Synthetic oligonucleotide
atgacgtttggctgcgacgtggggtc

SEQ ID NO: 15087 - DNA, 25 bp, Artificial Sequence
  Description of Artificial Sequence: Synthetic oligonucleotide
tgacgtttggctgcgacgtggggtc

SEQ ID NO: 15088 - DNA, 24 bp, Artificial Sequence
  Description of Artificial Sequence: Synthetic oligonucleotide
gacgtttggctgcgacgtggggtc

SEQ ID NO: 15089 - DNA, 24 bp, Artificial Sequence
  Description of Artificial Sequence: Synthetic oligonucleotide
acgtttggctgcgacgtggggtcg

SEQ ID NO: 15090 - DNA, 23 bp, Artificial Sequence
  Description of Artificial Sequence: Synthetic oligonucleotide
cgtttggctgcgacgtggggtcg

SEQ ID NO: 15091 - DNA, 26 bp, Artificial Sequence
  Description of Artificial Sequence: Synthetic oligonucleotide
cttcctccgcgggtaccaccagtaca

SEQ ID NO: 15092 - DNA, 26 bp, Artificial Sequence
  Description of Artificial Sequence: Synthetic oligonucleotide
ttcctccgcgggtaccaccagtacac

SEQ ID NO: 15093 - DNA, 25 bp, Artificial Sequence
  Description of Artificial Sequence: Synthetic oligonucleotide
tcctccgcgggtaccaccagtacac

SEQ ID NO: 15094 - DNA, 24 bp, Artificial Sequence
  Description of Artificial Sequence: Synthetic oligonucleotide
cctccgcgggtaccaccagtacac

SEQ ID NO: 15095 - DNA, 26 bp, Artificial Sequence
  Description of Artificial Sequence: Synthetic oligonucleotide
ctccgcgggtaccaccagtacaccta

SEQ ID NO: 15096 - DNA, 26 bp, Artificial Sequence
  Description of Artificial Sequence: Synthetic oligonucleotide
tccgcgggtaccaccagtacacctac

SEQ ID NO: 15097 - DNA, 25 bp, Artificial Sequence
  Description of Artificial Sequence: Synthetic oligonucleotide
ccgcgggtaccaccagtacacctac

SEQ ID NO: 15098 - DNA, 26 bp, Artificial Sequence
  Description of Artificial Sequence: Synthetic oligonucleotide
cgcgggtaccaccagtacacctacga

SEQ ID NO: 15099 - DNA, 26 bp, Artificial Sequence
  Description of Artificial Sequence: Synthetic oligonucleotide
gcgggtaccaccagtacacctacgac

SEQ ID NO: 15100 - DNA, 26 bp, Artificial Sequence
  Description of Artificial Sequence: Synthetic oligonucleotide
cgggtaccaccagtacacctacgacg

SEQ ID NO: 15101 - DNA, 26 bp, Artificial Sequence
  Description of Artificial Sequence: Synthetic oligonucleotide
gggtaccaccagtacacctacgacgg

SEQ ID NO: 15102 - DNA, 27 bp, Artificial Sequence
  Description of Artificial Sequence: Synthetic oligonucleotide
ggtaccaccagtacacctacgacggca

SEQ ID NO: 15103 - DNA, 28 bp, Artificial Sequence
  Description of Artificial Sequence: Synthetic oligonucleotide
gtaccaccagtacacctacgacggcaag

SEQ ID NO: 15104 - DNA, 28 bp, Artificial Sequence
  Description of Artificial Sequence: Synthetic oligonucleotide
taccaccagtacacctacgacggcaagg

SEQ ID NO: 15105 - DNA, 27 bp, Artificial Sequence
  Description of Artificial Sequence: Synthetic oligonucleotide
accaccagtacacctacgacggcaagg

SEQ ID NO: 15106 - DNA, 27 bp, Artificial Sequence
  Description of Artificial Sequence: Synthetic oligonucleotide
ccaccagtacacctacgacggcaagga

SEQ ID NO: 15107 - DNA, 30 bp, Artificial Sequence
  Description of Artificial Sequence: Synthetic oligonucleotide
caccagtacacctacgacggcaaggattac

SEQ ID NO: 15108 - DNA, 32 bp, Artificial Sequence
  Description of Artificial Sequence: Synthetic oligonucleotide
accagtacacctacgacggcaaggattacatc

SEQ ID NO: 15109 - DNA, 31 bp, Artificial Sequence
  Description of Artificial Sequence: Synthetic oligonucleotide
ccagtacacctacgacggcaaggattacatc

SEQ ID NO: 15110 - DNA, 31 bp, Artificial Sequence
  Description of Artificial Sequence: Synthetic oligonucleotide
cagtacacctacgacggcaaggattacatcg

SEQ ID NO: 15111 - DNA, 31 bp, Artificial Sequence
  Description of Artificial Sequence: Synthetic oligonucleotide
agtacacctacgacggcaaggattacatcgc

SEQ ID NO: 15112 - DNA, 30 bp, Artificial Sequence
  Description of Artificial Sequence: Synthetic oligonucleotide
gtacacctacgacggcaaggattacatcgc

SEQ ID NO: 15113 - DNA, 30 bp, Artificial Sequence
  Description of Artificial Sequence: Synthetic oligonucleotide
tacacctacgacggcaaggattacatcgcc

SEQ ID NO: 15114 - DNA, 29 bp, Artificial Sequence
  Description of Artificial Sequence: Synthetic oligonucleotide
acacctacgacggcaaggattacatcgcc

SEQ ID NO: 15115 - DNA, 28 bp, Artificial Sequence
  Description of Artificial Sequence: Synthetic oligonucleotide
cacctacgacggcaaggattacatcgcc

SEQ ID NO: 15116 - DNA, 28 bp, Artificial Sequence
  Description of Artificial Sequence: Synthetic oligonucleotide
acctacgacggcaaggattacatcgccc

SEQ ID NO: 15117 - DNA, 21 bp, Artificial Sequence
  Description of Artificial Sequence: Synthetic oligonucleotide
cgcggggagccccgcttcatg

SEQ ID NO: 15118 - DNA, 21 bp, Artificial Sequence
  Description of Artificial Sequence: Synthetic oligonucleotide
gcggggagccccgcttcatgg

SEQ ID NO: 15119 - DNA, 21 bp, Artificial Sequence
  Description of Artificial Sequence: Synthetic oligonucleotide
cggggagccccgcttcatggc

SEQ ID NO: 15120 - DNA, 21 bp, Artificial Sequence
  Description of Artificial Sequence: Synthetic oligonucleotide
ggggagccccgcttcatggcc

SEQ ID NO: 15121 - DNA, 22 bp, Artificial Sequence
  Description of Artificial Sequence: Synthetic oligonucleotide
gggagccccgcttcatggccgt

SEQ ID NO: 15122 - DNA, 22 bp, Artificial Sequence
  Description of Artificial Sequence: Synthetic oligonucleotide
ggagccccgcttcatggccgtg

SEQ ID NO: 15123 - DNA, 22 bp, Artificial Sequence
  Description of Artificial Sequence: Synthetic oligonucleotide
gagccccgcttcatggccgtgg

SEQ ID NO: 15124 - DNA, 22 bp, Artificial Sequence
  Description of Artificial Sequence: Synthetic oligonucleotide
agccccgcttcatggccgtggg

SEQ ID NO: 15125 - DNA, 21 bp, Artificial Sequence
  Description of Artificial Sequence: Synthetic oligonucleotide
gccccgcttcatggccgtggg

SEQ ID NO: 15126 - DNA, 23 bp, Artificial Sequence
  Description of Artificial Sequence: Synthetic oligonucleotide
ccccgcttcatggccgtgggcta

SEQ ID NO: 15127 - DNA, 23 bp, Artificial Sequence
  Description of Artificial Sequence: Synthetic oligonucleotide
cccgcttcatggccgtgggctac

SEQ ID NO: 15128 - DNA, 24 bp, Artificial Sequence
  Description of Artificial Sequence: Synthetic oligonucleotide
ccgcttcatggccgtgggctacgt

SEQ ID NO: 15129 - DNA, 24 bp, Artificial Sequence
  Description of Artificial Sequence: Synthetic oligonucleotide
cgcttcatggccgtgggctacgtg

SEQ ID NO: 15130 - DNA, 25 bp, Artificial Sequence
  Description of Artificial Sequence: Synthetic oligonucleotide
gcttcatggccgtgggctacgtgga

SEQ ID NO: 15131 - DNA, 25 bp, Artificial Sequence
  Description of Artificial Sequence: Synthetic oligonucleotide
cttcatggccgtgggctacgtggac

SEQ ID NO: 15132 - DNA, 26 bp, Artificial Sequence
  Description of Artificial Sequence: Synthetic oligonucleotide
ttcatggccgtgggctacgtggacga

SEQ ID NO: 15133 - DNA, 25 bp, Artificial Sequence
  Description of Artificial Sequence: Synthetic oligonucleotide
tcatggccgtgggctacgtggacga

SEQ ID NO: 15134 - DNA, 24 bp, Artificial Sequence
  Description of Artificial Sequence: Synthetic oligonucleotide
catggccgtgggctacgtggacga

SEQ ID NO: 15135 - DNA, 25 bp, Artificial Sequence
  Description of Artificial Sequence: Synthetic oligonucleotide
atggccgtgggctacgtggacgaca

SEQ ID NO: 15136 - DNA, 24 bp, Artificial Sequence
  Description of Artificial Sequence: Synthetic oligonucleotide
tggccgtgggctacgtggacgaca

SEQ ID NO: 15137 - DNA, 23 bp, Artificial Sequence
  Description of Artificial Sequence: Synthetic oligonucleotide
ggccgtgggctacgtggacgaca

SEQ ID NO: 15138 - DNA, 26 bp, Artificial Sequence
  Description of Artificial Sequence: Synthetic oligonucleotide
gcttcatcgccgtgggctacgtggaa

SEQ ID NO: 15139 - DNA, 27 bp, Artificial Sequence
  Description of Artificial Sequence: Synthetic oligonucleotide
cttcatcgccgtgggctacgtggaaga

SEQ ID NO: 15140 - DNA, 27 bp, Artificial Sequence
  Description of Artificial Sequence: Synthetic oligonucleotide
ttcatcgccgtgggctacgtggaagac

SEQ ID NO: 15141 - DNA, 27 bp, Artificial Sequence
  Description of Artificial Sequence: Synthetic oligonucleotide
tcatcgccgtgggctacgtggaagaca

SEQ ID NO: 15142 - DNA, 26 bp, Artificial Sequence
  Description of Artificial Sequence: Synthetic oligonucleotide
catcgccgtgggctacgtggaagaca

SEQ ID NO: 15143 - DNA, 26 bp, Artificial Sequence
  Description of Artificial Sequence: Synthetic oligonucleotide
atcgccgtgggctacgtggaagacac

SEQ ID NO: 15144 - DNA, 25 bp, Artificial Sequence
  Description of Artificial Sequence: Synthetic oligonucleotide
tcgccgtgggctacgtggaagacac

SEQ ID NO: 15145 - DNA, 24 bp, Artificial Sequence
  Description of Artificial Sequence: Synthetic oligonucleotide
cgccgtgggctacgtggaagacac

SEQ ID NO: 15146 - DNA, 24 bp, Artificial Sequence
  Description of Artificial Sequence: Synthetic oligonucleotide
gccgtgggctacgtggaagacacg

SEQ ID NO: 15147 - DNA, 25 bp, Artificial Sequence
  Description of Artificial Sequence: Synthetic oligonucleotide
ccgtgggctacgtggaagacacgca

SEQ ID NO: 15148 - DNA, 27 bp, Artificial Sequence
  Description of Artificial Sequence: Synthetic oligonucleotide
cgtgggctacgtggaagacacgcagtt

SEQ ID NO: 15149 - DNA, 27 bp, Artificial Sequence
  Description of Artificial Sequence: Synthetic oligonucleotide
gtgggctacgtggaagacacgcagttc

SEQ ID NO: 15150 - DNA, 27 bp, Artificial Sequence
  Description of Artificial Sequence: Synthetic oligonucleotide
tgggctacgtggaagacacgcagttcg

SEQ ID NO: 15151 - DNA, 27 bp, Artificial Sequence
  Description of Artificial Sequence: Synthetic oligonucleotide
gggctacgtggaagacacgcagttcgt

SEQ ID NO: 15152 - DNA, 27 bp, Artificial Sequence
  Description of Artificial Sequence: Synthetic oligonucleotide
ggctacgtggaagacacgcagttcgtg

SEQ ID NO: 15153 - DNA, 27 bp, Artificial Sequence
  Description of Artificial Sequence: Synthetic oligonucleotide
gctacgtggaagacacgcagttcgtgc

SEQ ID NO: 15154 - DNA, 27 bp, Artificial Sequence
  Description of Artificial Sequence: Synthetic oligonucleotide
ctacgtggaagacacgcagttcgtgcg

SEQ ID NO: 15155 - DNA, 27 bp, Artificial Sequence
  Description of Artificial Sequence: Synthetic oligonucleotide
tacgtggaagacacgcagttcgtgcgg

SEQ ID NO: 15156 - DNA, 27 bp, Artificial Sequence
  Description of Artificial Sequence: Synthetic oligonucleotide
acgtggaagacacgcagttcgtgcggt

SEQ ID NO: 15157 - DNA, 27 bp, Artificial Sequence
  Description of Artificial Sequence: Synthetic oligonucleotide
cgtggaagacacgcagttcgtgcggtt

SEQ ID NO: 15158 - DNA, 27 bp, Artificial Sequence
  Description of Artificial Sequence: Synthetic oligonucleotide
gtggaagacacgcagttcgtgcggttc

SEQ ID NO: 15159 - DNA, 27 bp, Artificial Sequence
  Description of Artificial Sequence: Synthetic oligonucleotide
tggaagacacgcagttcgtgcggttcg

SEQ ID NO: 15160 - DNA, 27 bp, Artificial Sequence
  Description of Artificial Sequence: Synthetic oligonucleotide
ggaagacacgcagttcgtgcggttcga

SEQ ID NO: 15161 - DNA, 27 bp, Artificial Sequence
  Description of Artificial Sequence: Synthetic oligonucleotide
gaagacacgcagttcgtgcggttcgac

SEQ ID NO: 15162 - DNA, 28 bp, Artificial Sequence
  Description of Artificial Sequence: Synthetic oligonucleotide
aagacacgcagttcgtgcggttcgacag

SEQ ID NO: 15163 - DNA, 27 bp, Artificial Sequence
  Description of Artificial Sequence: Synthetic oligonucleotide
agacacgcagttcgtgcggttcgacag

SEQ ID NO: 15164 - DNA, 31 bp, Artificial Sequence
  Description of Artificial Sequence: Synthetic oligonucleotide
ccggttctcacaccctccagatgatgtttag

SEQ ID NO: 15165 - DNA, 31 bp, Artificial Sequence
  Description of Artificial Sequence: Synthetic oligonucleotide
cggttctcacaccctccagatgatgtttagc

SEQ ID NO: 15166 - DNA, 32 bp, Artificial Sequence
  Description of Artificial Sequence: Synthetic oligonucleotide
ggttctcacaccctccagatgatgtttagctg

SEQ ID NO: 15167 - DNA, 32 bp, Artificial Sequence
  Description of Artificial Sequence: Synthetic oligonucleotide
gttctcacaccctccagatgatgtttagctgc

SEQ ID NO: 15168 - DNA, 32 bp, Artificial Sequence
  Description of Artificial Sequence: Synthetic oligonucleotide
ttctcacaccctccagatgatgtttagctgcg

SEQ ID NO: 15169 - DNA, 31 bp, Artificial Sequence
  Description of Artificial Sequence: Synthetic oligonucleotide
tctcacaccctccagatgatgtttagctgcg

SEQ ID NO: 15170 - DNA, 30 bp, Artificial Sequence
  Description of Artificial Sequence: Synthetic oligonucleotide
ctcacaccctccagatgatgtttagctgcg

SEQ ID NO: 15171 - DNA, 31 bp, Artificial Sequence
  Description of Artificial Sequence: Synthetic oligonucleotide
tcacaccctccagatgatgtttagctgcgac

SEQ ID NO: 15172 - DNA, 30 bp, Artificial Sequence
  Description of Artificial Sequence: Synthetic oligonucleotide
cacaccctccagatgatgtttagctgcgac

SEQ ID NO: 15173 - DNA, 30 bp, Artificial Sequence
  Description of Artificial Sequence: Synthetic oligonucleotide
acaccctccagatgatgtttagctgcgacg

SEQ ID NO: 15174 - DNA, 29 bp, Artificial Sequence
  Description of Artificial Sequence: Synthetic oligonucleotide
caccctccagatgatgtttagctgcgacg

SEQ ID NO: 15175 - DNA, 30 bp, Artificial Sequence
  Description of Artificial Sequence: Synthetic oligonucleotide
accctccagatgatgtttagctgcgacgtg

SEQ ID NO: 15176 - DNA, 29 bp, Artificial Sequence
  Description of Artificial Sequence: Synthetic oligonucleotide
ccctccagatgatgtttagctgcgacgtg

SEQ ID NO: 15177 - DNA, 29 bp, Artificial Sequence
  Description of Artificial Sequence: Synthetic oligonucleotide
cctccagatgatgtttagctgcgacgtgg

SEQ ID NO: 15178 - DNA, 29 bp, Artificial Sequence
  Description of Artificial Sequence: Synthetic oligonucleotide
ctccagatgatgtttagctgcgacgtggg

SEQ ID NO: 15179 - DNA, 29 bp, Artificial Sequence
  Description of Artificial Sequence: Synthetic oligonucleotide
tccagatgatgtttagctgcgacgtgggg

SEQ ID NO: 15180 - DNA, 28 bp, Artificial Sequence
  Description of Artificial Sequence: Synthetic oligonucleotide
ccagatgatgtttagctgcgacgtgggg

SEQ ID NO: 15181 - DNA, 29 bp, Artificial Sequence
  Description of Artificial Sequence: Synthetic oligonucleotide
cagatgatgtttagctgcgacgtggggtc

SEQ ID NO: 15182 - DNA, 29 bp, Artificial Sequence
  Description of Artificial Sequence: Synthetic oligonucleotide
agatgatgtttagctgcgacgtggggtcg

SEQ ID NO: 15183 - DNA, 28 bp, Artificial Sequence
  Description of Artificial Sequence: Synthetic oligonucleotide
gatgatgtttagctgcgacgtggggtcg

SEQ ID NO: 15184 - DNA, 28 bp, Artificial Sequence
  Description of Artificial Sequence: Synthetic oligonucleotide
atgatgtttagctgcgacgtggggtcgg

SEQ ID NO: 15185 - DNA, 27 bp, Artificial Sequence
  Description of Artificial Sequence: Synthetic oligonucleotide
tgatgtttagctgcgacgtggggtcgg

SEQ ID NO: 15186 - DNA, 27 bp, Artificial Sequence
  Description of Artificial Sequence: Synthetic oligonucleotide
gatgtttagctgcgacgtggggtcgga

SEQ ID NO: 15187 - DNA, 27 bp, Artificial Sequence
  Description of Artificial Sequence: Synthetic oligonucleotide
atgtttagctgcgacgtggggtcggac

SEQ ID NO: 15188 - DNA, 26 bp, Artificial Sequence
  Description of Artificial Sequence: Synthetic oligonucleotide
tgtttagctgcgacgtggggtcggac

SEQ ID NO: 15189 - DNA, 25 bp, Artificial Sequence
  Description of Artificial Sequence: Synthetic oligonucleotide
gtttagctgcgacgtggggtcggac

SEQ ID NO: 15190 - DNA, 25 bp, Artificial Sequence
  Description of Artificial Sequence: Synthetic oligonucleotide
tttagctgcgacgtggggtcggacg

SEQ ID NO: 15191 - DNA, 24 bp, Artificial Sequence
  Description of Artificial Sequence: Synthetic oligonucleotide
ttagctgcgacgtggggtcggacg

SEQ ID NO: 15192 - DNA, 23 bp, Artificial Sequence
  Description of Artificial Sequence: Synthetic oligonucleotide
tagctgcgacgtggggtcggacg

SEQ ID NO: 15193 - DNA, 22 bp, Artificial Sequence
  Description of Artificial Sequence: Synthetic oligonucleotide
agctgcgacgtggggtcggacg

SEQ ID NO: 15194 - DNA, 28 bp, Artificial Sequence
  Description of Artificial Sequence: Synthetic oligonucleotide
acagggaaagtgaaggcccactcacagg

SEQ ID NO: 15195 - DNA, 27 bp, Artificial Sequence
  Description of Artificial Sequence: Synthetic oligonucleotide
cagggaaagtgaaggcccactcacagg

SEQ ID NO: 15196 - DNA, 27 bp, Artificial Sequence
  Description of Artificial Sequence: Synthetic oligonucleotide
agggaaagtgaaggcccactcacaggc

SEQ ID NO: 15197 - DNA, 27 bp, Artificial Sequence
  Description of Artificial Sequence: Synthetic oligonucleotide
gggaaagtgaaggcccactcacaggct

SEQ ID NO: 15198 - DNA, 27 bp, Artificial Sequence
  Description of Artificial Sequence: Synthetic oligonucleotide
ggaaagtgaaggcccactcacaggctg

SEQ ID NO: 15199 - DNA, 28 bp, Artificial Sequence
  Description of Artificial Sequence: Synthetic oligonucleotide
gaaagtgaaggcccactcacaggctgac

SEQ ID NO: 15200 - DNA, 28 bp, Artificial Sequence
  Description of Artificial Sequence: Synthetic oligonucleotide
aaagtgaaggcccactcacaggctgacc

SEQ ID NO: 15201 - DNA, 27 bp, Artificial Sequence
  Description of Artificial Sequence: Synthetic oligonucleotide
aagtgaaggcccactcacaggctgacc

SEQ ID NO: 15202 - DNA, 26 bp, Artificial Sequence
  Description of Artificial Sequence: Synthetic oligonucleotide
agtgaaggcccactcacaggctgacc

SEQ ID NO: 15203 - DNA, 25 bp, Artificial Sequence
  Description of Artificial Sequence: Synthetic oligonucleotide
gtgaaggcccactcacaggctgacc

SEQ ID NO: 15204 - DNA, 26 bp, Artificial Sequence
  Description of Artificial Sequence: Synthetic oligonucleotide
tgaaggcccactcacaggctgaccga

SEQ ID NO: 15205 - DNA, 25 bp, Artificial Sequence
  Description of Artificial Sequence: Synthetic oligonucleotide
gaaggcccactcacaggctgaccga

SEQ ID NO: 15206 - DNA, 26 bp, Artificial Sequence
  Description of Artificial Sequence: Synthetic oligonucleotide
aaggcccactcacaggctgaccgaga

SEQ ID NO: 15207 - DNA, 25 bp, Artificial Sequence
  Description of Artificial Sequence: Synthetic oligonucleotide
aggcccactcacaggctgaccgaga

SEQ ID NO: 15208 - DNA, 24 bp, Artificial Sequence
  Description of Artificial Sequence: Synthetic oligonucleotide
ggcccactcacaggctgaccgaga

SEQ ID NO: 15209 - DNA, 26 bp, Artificial Sequence
  Description of Artificial Sequence: Synthetic oligonucleotide
gcccactcacaggctgaccgagagaa

SEQ ID NO: 15210 - DNA, 26 bp, Artificial Sequence
  Description of Artificial Sequence: Synthetic oligonucleotide
cccactcacaggctgaccgagagaac

SEQ ID NO: 15211 - DNA, 27 bp, Artificial Sequence
  Description of Artificial Sequence: Synthetic oligonucleotide
ccactcacaggctgaccgagagaacct

SEQ ID NO: 15212 - DNA, 27 bp, Artificial Sequence
  Description of Artificial Sequence: Synthetic oligonucleotide
cactcacaggctgaccgagagaacctg

SEQ ID NO: 15213 - DNA, 27 bp, Artificial Sequence
  Description of Artificial Sequence: Synthetic oligonucleotide
actcacaggctgaccgagagaacctgc

SEQ ID NO: 15214 - DNA, 26 bp, Artificial Sequence
  Description of Artificial Sequence: Synthetic oligonucleotide
ctcacaggctgaccgagagaacctgc

SEQ ID NO: 15215 - DNA, 26 bp, Artificial Sequence
  Description of Artificial Sequence: Synthetic oligonucleotide
tcacaggctgaccgagagaacctgcg

SEQ ID NO: 15216 - DNA, 25 bp, Artificial Sequence
  Description of Artificial Sequence: Synthetic oligonucleotide
cacaggctgaccgagagaacctgcg

SEQ ID NO: 15217 - DNA, 27 bp, Artificial Sequence
  Description of Artificial Sequence: Synthetic oligonucleotide
acaggctgaccgagagaacctgcggat

SEQ ID NO: 15218 - DNA, 26 bp, Artificial Sequence
  Description of Artificial Sequence: Synthetic oligonucleotide
caggctgaccgagagaacctgcggat

SEQ ID NO: 15219 - DNA, 26 bp, Artificial Sequence
  Description of Artificial Sequence: Synthetic oligonucleotide
aggctgaccgagagaacctgcggatc

SEQ ID NO: 15220 - DNA, 25 bp, Artificial Sequence
  Description of Artificial Sequence: Synthetic oligonucleotide
ggctgaccgagagaacctgcggatc

SEQ ID NO: 15221 - DNA, 25 bp, Artificial Sequence
  Description of Artificial Sequence: Synthetic oligonucleotide
gctgaccgagagaacctgcggatcg

SEQ ID NO: 15222 - DNA, 31 bp, Artificial Sequence
  Description of Artificial Sequence: Synthetic oligonucleotide
gccggttctcacaccatccagatgatgtttg

SEQ ID NO: 15223 - DNA, 31 bp, Artificial Sequence
  Description of Artificial Sequence: Synthetic oligonucleotide
ccggttctcacaccatccagatgatgtttgg

SEQ ID NO: 15224 - DNA, 31 bp, Artificial Sequence
  Description of Artificial Sequence: Synthetic oligonucleotide
cggttctcacaccatccagatgatgtttggc

SEQ ID NO: 15225 - DNA, 32 bp, Artificial Sequence
  Description of Artificial Sequence: Synthetic oligonucleotide
ggttctcacaccatccagatgatgtttggctg

SEQ ID NO: 15226 - DNA, 32 bp, Artificial Sequence
  Description of Artificial Sequence: Synthetic oligonucleotide
gttctcacaccatccagatgatgtttggctgc

SEQ ID NO: 15227 - DNA, 32 bp, Artificial Sequence
  Description of Artificial Sequence: Synthetic oligonucleotide
ttctcacaccatccagatgatgtttggctgcg

SEQ ID NO: 15228 - DNA, 31 bp, Artificial Sequence
  Description of Artificial Sequence: Synthetic oligonucleotide
tctcacaccatccagatgatgtttggctgcg

SEQ ID NO: 15229 - DNA, 30 bp, Artificial Sequence
  Description of Artificial Sequence: Synthetic oligonucleotide
ctcacaccatccagatgatgtttggctgcg

SEQ ID NO: 15230 - DNA, 31 bp, Artificial Sequence
  Description of Artificial Sequence: Synthetic oligonucleotide
tcacaccatccagatgatgtttggctgcgac

SEQ ID NO: 15231 - DNA, 30 bp, Artificial Sequence
  Description of Artificial Sequence: Synthetic oligonucleotide
cacaccatccagatgatgtttggctgcgac

SEQ ID NO: 15232 - DNA, 30 bp, Artificial Sequence
  Description of Artificial Sequence: Synthetic oligonucleotide
acaccatccagatgatgtttggctgcgacg

SEQ ID NO: 15233 - DNA, 29 bp, Artificial Sequence
  Description of Artificial Sequence: Synthetic oligonucleotide
caccatccagatgatgtttggctgcgacg

SEQ ID NO: 15234 - DNA, 30 bp, Artificial Sequence
  Description of Artificial Sequence: Synthetic oligonucleotide
accatccagatgatgtttggctgcgacgtg

SEQ ID NO: 15235 - DNA, 29 bp, Artificial Sequence
  Description of Artificial Sequence: Synthetic oligonucleotide
ccatccagatgatgtttggctgcgacgtg

SEQ ID NO: 15236 - DNA, 29 bp, Artificial Sequence
  Description of Artificial Sequence: Synthetic oligonucleotide
catccagatgatgtttggctgcgacgtgg

SEQ ID NO: 15237 - DNA, 29 bp, Artificial Sequence
  Description of Artificial Sequence: Synthetic oligonucleotide
atccagatgatgtttggctgcgacgtggg

SEQ ID NO: 15238 - DNA, 27 bp, Artificial Sequence
  Description of Artificial Sequence: Synthetic oligonucleotide
cctgaaagaggacctgcgctcttggag

SEQ ID NO: 15239 - DNA, 27 bp, Artificial Sequence
  Description of Artificial Sequence: Synthetic oligonucleotide
ctgaaagaggacctgcgctcttggagc

SEQ ID NO: 15240 - DNA, 27 bp, Artificial Sequence
  Description of Artificial Sequence: Synthetic oligonucleotide
tgaaagaggacctgcgctcttggagcg

SEQ ID NO: 15241 - DNA, 26 bp, Artificial Sequence
  Description of Artificial Sequence: Synthetic oligonucleotide
gaaagaggacctgcgctcttggagcg

SEQ ID NO: 15242 - DNA, 26 bp, Artificial Sequence
  Description of Artificial Sequence: Synthetic oligonucleotide
aaagaggacctgcgctcttggagcgc

SEQ ID NO: 15243 - DNA, 25 bp, Artificial Sequence
  Description of Artificial Sequence: Synthetic oligonucleotide
aagaggacctgcgctcttggagcgc

SEQ ID NO: 15244 - DNA, 24 bp, Artificial Sequence
  Description of Artificial Sequence: Synthetic oligonucleotide
agaggacctgcgctcttggagcgc

SEQ ID NO: 15245 - DNA, 23 bp, Artificial Sequence
  Description of Artificial Sequence: Synthetic oligonucleotide
gaggacctgcgctcttggagcgc

SEQ ID NO: 15246 - DNA, 23 bp, Artificial Sequence
  Description of Artificial Sequence: Synthetic oligonucleotide
aggacctgcgctcttggagcgcg

SEQ ID NO: 15247 - DNA, 22 bp, Artificial Sequence
  Description of Artificial Sequence: Synthetic oligonucleotide
ggacctgcgctcttggagcgcg

SEQ ID NO: 15248 - DNA, 22 bp, Artificial Sequence
  Description of Artificial Sequence: Synthetic oligonucleotide
gacctgcgctcttggagcgcgg

SEQ ID NO: 15249 - DNA, 22 bp, Artificial Sequence
  Description of Artificial Sequence: Synthetic oligonucleotide
acctgcgctcttggagcgcggc

SEQ ID NO: 15250 - DNA, 21 bp, Artificial Sequence
  Description of Artificial Sequence: Synthetic oligonucleotide
cctgcgctcttggagcgcggc

SEQ ID NO: 15251 - DNA, 21 bp, Artificial Sequence
  Description of Artificial Sequence: Synthetic oligonucleotide
ctgcgctcttggagcgcggcg

SEQ ID NO: 15252 - DNA, 22 bp, Artificial Sequence
  Description of Artificial Sequence: Synthetic oligonucleotide
tgcgctcttggagcgcggcgga

SEQ ID NO: 15253 - DNA, 21 bp, Artificial Sequence
  Description of Artificial Sequence: Synthetic oligonucleotide
gcgctcttggagcgcggcgga

SEQ ID NO: 15254 - DNA, 23 bp, Artificial Sequence
  Description of Artificial Sequence: Synthetic oligonucleotide
cgctcttggagcgcggcggacat

SEQ ID NO: 15255 - DNA, 23 bp, Artificial Sequence
  Description of Artificial Sequence: Synthetic oligonucleotide
gctcttggagcgcggcggacatg

SEQ ID NO: 15256 - DNA, 23 bp, Artificial Sequence
  Description of Artificial Sequence: Synthetic oligonucleotide
ctcttggagcgcggcggacatgg

SEQ ID NO: 15257 - DNA, 23 bp, Artificial Sequence
  Description of Artificial Sequence: Synthetic oligonucleotide
tcttggagcgcggcggacatggc

SEQ ID NO: 15258 - DNA, 22 bp, Artificial Sequence
  Description of Artificial Sequence: Synthetic oligonucleotide
cttggagcgcggcggacatggc

SEQ ID NO: 15259 - DNA, 22 bp, Artificial Sequence
  Description of Artificial Sequence: Synthetic oligonucleotide
ttggagcgcggcggacatggcg

SEQ ID NO: 15260 - DNA, 21 bp, Artificial Sequence
  Description of Artificial Sequence: Synthetic oligonucleotide
tggagcgcggcggacatggcg

SEQ ID NO: 15261 - DNA, 20 bp, Artificial Sequence
  Description of Artificial Sequence: Synthetic oligonucleotide
ggagcgcggcggacatggcg

SEQ ID NO: 15262 - DNA, 20 bp, Artificial Sequence
  Description of Artificial Sequence: Synthetic oligonucleotide
gagcgcggcggacatggcgg

SEQ ID NO: 15263 - DNA, 21 bp, Artificial Sequence
  Description of Artificial Sequence: Synthetic oligonucleotide
agcgcggcggacatggcggct

SEQ ID NO: 15264 - DNA, 20 bp, Artificial Sequence
  Description of Artificial Sequence: Synthetic oligonucleotide
gcgcggcggacatggcggct

SEQ ID NO: 15265 - DNA, 29 bp, Artificial Sequence
  Description of Artificial Sequence: Synthetic oligonucleotide
aggtatttctccacatccgtgtcccggtc

SEQ ID NO: 15266 - DNA, 28 bp, Artificial Sequence
  Description of Artificial Sequence: Synthetic oligonucleotide
ggtatttctccacatccgtgtcccggtc

SEQ ID NO: 15267 - DNA, 28 bp, Artificial Sequence
  Description of Artificial Sequence: Synthetic oligonucleotide
gtatttctccacatccgtgtcccggtcc

SEQ ID NO: 15268 - DNA, 28 bp, Artificial Sequence
  Description of Artificial Sequence: Synthetic oligonucleotide
tatttctccacatccgtgtcccggtccg

SEQ ID NO: 15269 - DNA, 27 bp, Artificial Sequence
  Description of Artificial Sequence: Synthetic oligonucleotide
atttctccacatccgtgtcccggtccg

SEQ ID NO: 15270 - DNA, 26 bp, Artificial Sequence
  Description of Artificial Sequence: Synthetic oligonucleotide
tttctccacatccgtgtcccggtccg

SEQ ID NO: 15271 - DNA, 25 bp, Artificial Sequence
  Description of Artificial Sequence: Synthetic oligonucleotide
ttctccacatccgtgtcccggtccg

SEQ ID NO: 15272 - DNA, 24 bp, Artificial Sequence
  Description of Artificial Sequence: Synthetic oligonucleotide
tctccacatccgtgtcccggtccg

SEQ ID NO: 15273 - DNA, 23 bp, Artificial Sequence
  Description of Artificial Sequence: Synthetic oligonucleotide
ctccacatccgtgtcccggtccg

SEQ ID NO: 15274 - DNA, 23 bp, Artificial Sequence
  Description of Artificial Sequence: Synthetic oligonucleotide
tccacatccgtgtcccggtccgg

SEQ ID NO: 15275 - DNA, 22 bp, Artificial Sequence
  Description of Artificial Sequence: Synthetic oligonucleotide
ccacatccgtgtcccggtccgg

SEQ ID NO: 15276 - DNA, 22 bp, Artificial Sequence
  Description of Artificial Sequence: Synthetic oligonucleotide
cacatccgtgtcccggtccggc

SEQ ID NO: 15277 - DNA, 22 bp, Artificial Sequence
  Description of Artificial Sequence: Synthetic oligonucleotide
acatccgtgtcccggtccggcc

SEQ ID NO: 15278 - DNA, 21 bp, Artificial Sequence
  Description of Artificial Sequence: Synthetic oligonucleotide
catccgtgtcccggtccggcc

SEQ ID NO: 15279 - DNA, 21 bp, Artificial Sequence
  Description of Artificial Sequence: Synthetic oligonucleotide
atccgtgtcccggtccggccg

SEQ ID NO: 15280 - DNA, 20 bp, Artificial Sequence
  Description of Artificial Sequence: Synthetic oligonucleotide
tccgtgtcccggtccggccg

SEQ ID NO: 15281 - DNA, 20 bp, Artificial Sequence
  Description of Artificial Sequence: Synthetic oligonucleotide
ccgtgtcccggtccggccgt

SEQ ID NO: 15282 - DNA, 20 bp, Artificial Sequence
  Description of Artificial Sequence: Synthetic oligonucleotide
cgtgtcccggtccggccgct

SEQ ID NO: 15283 - DNA, 20 bp, Artificial Sequence
  Description of Artificial Sequence: Synthetic oligonucleotide
gtgtcccggtccggccgcgt

SEQ ID NO: 15284 - DNA, 20 bp, Artificial Sequence
  Description of Artificial Sequence: Synthetic oligonucleotide
tgtcccggtccggccgcggt

SEQ ID NO: 15285 - DNA, 20 bp, Artificial Sequence
  Description of Artificial Sequence: Synthetic oligonucleotide
gtcccggtccggccgcggtt

SEQ ID NO: 15286 - DNA, 20 bp, Artificial Sequence
  Description of Artificial Sequence: Synthetic oligonucleotide
tcccggtccggccgcgggtt

SEQ ID NO: 15287 - DNA, 20 bp, Artificial Sequence
  Description of Artificial Sequence: Synthetic oligonucleotide
cccggtccggccgcgggttt

SEQ ID NO: 15288 - DNA, 20 bp, Artificial Sequence
  Description of Artificial Sequence: Synthetic oligonucleotide
ccggtccggccgcggggatt

SEQ ID NO: 15289 - DNA, 20 bp, Artificial Sequence
  Description of Artificial Sequence: Synthetic oligonucleotide
cggtccggccgcggggagtt

SEQ ID NO: 15290 - DNA, 20 bp, Artificial Sequence
  Description of Artificial Sequence: Synthetic oligonucleotide
ggtccggccgcggggagctt

SEQ ID NO: 15291 - DNA, 20 bp, Artificial Sequence
  Description of Artificial Sequence: Synthetic oligonucleotide
gtccggccgcggggagcctt

SEQ ID NO: 15292 - DNA, 20 bp, Artificial Sequence
  Description of Artificial Sequence: Synthetic oligonucleotide
tccggccgcggggagccctt

SEQ ID NO: 15293 - DNA, 27 bp, Artificial Sequence
  Description of Artificial Sequence: Synthetic oligonucleotide
gcaggagaggcctgagtattgggacga

SEQ ID NO: 15294 - DNA, 27 bp, Artificial Sequence
  Description of Artificial Sequence: Synthetic oligonucleotide
caggagaggcctgagtattgggacgag

SEQ ID NO: 15295 - DNA, 27 bp, Artificial Sequence
  Description of Artificial Sequence: Synthetic oligonucleotide
aggagaggcctgagtattgggacgagg

SEQ ID NO: 15296 - DNA, 27 bp, Artificial Sequence
  Description of Artificial Sequence: Synthetic oligonucleotide
ggagaggcctgagtattgggacgagga

SEQ ID NO: 15297 - DNA, 27 bp, Artificial Sequence
  Description of Artificial Sequence: Synthetic oligonucleotide
gagaggcctgagtattgggacgaggag

SEQ ID NO: 15298 - DNA, 28 bp, Artificial Sequence
  Description of Artificial Sequence: Synthetic oligonucleotide
agaggcctgagtattgggacgaggagac

SEQ ID NO: 15299 - DNA, 27 bp, Artificial Sequence
  Description of Artificial Sequence: Synthetic oligonucleotide
gaggcctgagtattgggacgaggagac

SEQ ID NO: 15300 - DNA, 28 bp, Artificial Sequence
  Description of Artificial Sequence: Synthetic oligonucleotide
aggcctgagtattgggacgaggagacag

SEQ ID NO: 15301 - DNA, 27 bp, Artificial Sequence
  Description of Artificial Sequence: Synthetic oligonucleotide
ggcctgagtattgggacgaggagacag

SEQ ID NO: 15302 - DNA, 27 bp, Artificial Sequence
  Description of Artificial Sequence: Synthetic oligonucleotide
gcctgagtattgggacgaggagacagg

SEQ ID NO: 15303 - DNA, 27 bp, Artificial Sequence
  Description of Artificial Sequence: Synthetic oligonucleotide
cctgagtattgggacgaggagacaggg

SEQ ID NO: 15304 - DNA, 30 bp, Artificial Sequence
  Description of Artificial Sequence: Synthetic oligonucleotide
ctgagtattgggacgaggagacagggaaag

SEQ ID NO: 15305 - DNA, 31 bp, Artificial Sequence
  Description of Artificial Sequence: Synthetic oligonucleotide
tgagtattgggacgaggagacagggaaagtg

SEQ ID NO: 15306 - DNA, 26 bp, Artificial Sequence
  Description of Artificial Sequence: Synthetic oligonucleotide
gcggagcagcagagagcctacctgaa

SEQ ID NO: 15307 - DNA, 26 bp, Artificial Sequence
  Description of Artificial Sequence: Synthetic oligonucleotide
cggagcagcagagagcctacctgaag

SEQ ID NO: 15308 - DNA, 26 bp, Artificial Sequence
  Description of Artificial Sequence: Synthetic oligonucleotide
ggagcagcagagagcctacctgaagg

SEQ ID NO: 15309 - DNA, 26 bp, Artificial Sequence
  Description of Artificial Sequence: Synthetic oligonucleotide
gagcagcagagagcctacctgaaggg

SEQ ID NO: 15310 - DNA, 27 bp, Artificial Sequence
  Description of Artificial Sequence: Synthetic oligonucleotide
agcagcagagagcctacctgaagggca

SEQ ID NO: 15311 - DNA, 26 bp, Artificial Sequence
  Description of Artificial Sequence: Synthetic oligonucleotide
gcagcagagagcctacctgaagggca

SEQ ID NO: 15312 - DNA, 26 bp, Artificial Sequence
  Description of Artificial Sequence: Synthetic oligonucleotide
cagcagagagcctacctgaagggcac

SEQ ID NO: 15313 - DNA, 27 bp, Artificial Sequence
  Description of Artificial Sequence: Synthetic oligonucleotide
agcagagagcctacctgaagggcacgt

SEQ ID NO: 15314 - DNA, 26 bp, Artificial Sequence
  Description of Artificial Sequence: Synthetic oligonucleotide
gcagagagcctacctgaagggcacgt

SEQ ID NO: 15315 - DNA, 26 bp, Artificial Sequence
  Description of Artificial Sequence: Synthetic oligonucleotide
cagagagcctacctgaagggcacgtg

SEQ ID NO: 15316 - DNA, 26 bp, Artificial Sequence
  Description of Artificial Sequence: Synthetic oligonucleotide
agagagcctacctgaagggcacgtgc

SEQ ID NO: 15317 - DNA, 25 bp, Artificial Sequence
  Description of Artificial Sequence: Synthetic oligonucleotide
gagagcctacctgaagggcacgtgc

SEQ ID NO: 15318 - DNA, 26 bp, Artificial Sequence
  Description of Artificial Sequence: Synthetic oligonucleotide
agagcctacctgaagggcacgtgcgt

SEQ ID NO: 15319 - DNA, 25 bp, Artificial Sequence
  Description of Artificial Sequence: Synthetic oligonucleotide
gagcctacctgaagggcacgtgcgt

SEQ ID NO: 15320 - DNA, 25 bp, Artificial Sequence
  Description of Artificial Sequence: Synthetic oligonucleotide
agcctacctgaagggcacgtgcgtg

SEQ ID NO: 15321 - DNA, 24 bp, Artificial Sequence
  Description of Artificial Sequence: Synthetic oligonucleotide
gcctacctgaagggcacgtgcgtg

SEQ ID NO: 15322 - DNA, 25 bp, Artificial Sequence
  Description of Artificial Sequence: Synthetic oligonucleotide
cctacctgaagggcacgtgcgtgga

SEQ ID NO: 15323 - DNA, 26 bp, Artificial Sequence
  Description of Artificial Sequence: Synthetic oligonucleotide
ctacctgaagggcacgtgcgtggagt

SEQ ID NO: 15324 - DNA, 26 bp, Artificial Sequence
  Description of Artificial Sequence: Synthetic oligonucleotide
tacctgaagggcacgtgcgtggagtg

SEQ ID NO: 15325 - DNA, 25 bp, Artificial Sequence
  Description of Artificial Sequence: Synthetic oligonucleotide
acctgaagggcacgtgcgtggagtg

SEQ ID NO: 15326 - DNA, 24 bp, Artificial Sequence
  Description of Artificial Sequence: Synthetic oligonucleotide
cctgaagggcacgtgcgtggagtg

SEQ ID NO: 15327 - DNA, 24 bp, Artificial Sequence
  Description of Artificial Sequence: Synthetic oligonucleotide
ctgaagggcacgtgcgtggagtgg

SEQ ID NO: 15328 - DNA, 25 bp, Artificial Sequence
  Description of Artificial Sequence: Synthetic oligonucleotide
tgaagggcacgtgcgtggagtggct

SEQ ID NO: 15329 - DNA, 24 bp, Artificial Sequence
  Description of Artificial Sequence: Synthetic oligonucleotide
gaagggcacgtgcgtggagtggct

SEQ ID NO: 15330 - DNA, 24 bp, Artificial Sequence
  Description of Artificial Sequence: Synthetic oligonucleotide
aagggcacgtgcgtggagtggctc

SEQ ID NO: 15331 - DNA, 32 bp, Artificial Sequence
  Description of Artificial Sequence: Synthetic oligonucleotide
gcttccactccatgaggtatttctccacatcc

SEQ ID NO: 15332 - DNA, 32 bp, Artificial Sequence
  Description of Artificial Sequence: Synthetic oligonucleotide
cttccactccatgaggtatttctccacatccg

SEQ ID NO: 15333 - DNA, 33 bp, Artificial Sequence
  Description of Artificial Sequence: Synthetic oligonucleotide
ttccactccatgaggtatttctccacatccgtg

SEQ ID NO: 15334 - DNA, 32 bp, Artificial Sequence
  Description of Artificial Sequence: Synthetic oligonucleotide
tccactccatgaggtatttctccacatccgtg

SEQ ID NO: 15335 - DNA, 26 bp, Artificial Sequence
  Description of Artificial Sequence: Synthetic oligonucleotide
gagaacgggaaggagacgctgcagct

SEQ ID NO: 15336 - DNA, 27 bp, Artificial Sequence
  Description of Artificial Sequence: Synthetic oligonucleotide
agaacgggaaggagacgctgcagctca

SEQ ID NO: 15337 - DNA, 26 bp, Artificial Sequence
  Description of Artificial Sequence: Synthetic oligonucleotide
gaacgggaaggagacgctgcagctca

SEQ ID NO: 15338 - DNA, 26 bp, Artificial Sequence
  Description of Artificial Sequence: Synthetic oligonucleotide
aacgggaaggagacgctgcagctcac

SEQ ID NO: 15339 - DNA, 25 bp, Artificial Sequence
  Description of Artificial Sequence: Synthetic oligonucleotide
acgggaaggagacgctgcagctcac

SEQ ID NO: 15340 - DNA, 24 bp, Artificial Sequence
  Description of Artificial Sequence: Synthetic oligonucleotide
cgggaaggagacgctgcagctcac

SEQ ID NO: 15341 - DNA, 24 bp, Artificial Sequence
  Description of Artificial Sequence: Synthetic oligonucleotide
gggaaggagacgctgcagctcacg

SEQ ID NO: 15342 - DNA, 24 bp, Artificial Sequence
  Description of Artificial Sequence: Synthetic oligonucleotide
ggaaggagacgctgcagctcacgg

SEQ ID NO: 15343 - DNA, 27 bp, Artificial Sequence
  Description of Artificial Sequence: Synthetic oligonucleotide
cggacatggcggctcagatcaccaaga

SEQ ID NO: 15344 - DNA, 27 bp, Artificial Sequence
  Description of Artificial Sequence: Synthetic oligonucleotide
ggacatggcggctcagatcaccaagag

SEQ ID NO: 15345 - DNA, 27 bp, Artificial Sequence
  Description of Artificial Sequence: Synthetic oligonucleotide
gacatggcggctcagatcaccaagagc

SEQ ID NO: 15346 - DNA, 29 bp, Artificial Sequence
  Description of Artificial Sequence: Synthetic oligonucleotide
acatggcggctcagatcaccaagagcaag

SEQ ID NO: 15347 - DNA, 28 bp, Artificial Sequence
  Description of Artificial Sequence: Synthetic oligonucleotide
catggcggctcagatcaccaagagcaag

SEQ ID NO: 15348 - DNA, 29 bp, Artificial Sequence
  Description of Artificial Sequence: Synthetic oligonucleotide
atggcggctcagatcaccaagagcaagtg

SEQ ID NO: 15349 - DNA, 28 bp, Artificial Sequence
  Description of Artificial Sequence: Synthetic oligonucleotide
tggcggctcagatcaccaagagcaagtg

SEQ ID NO: 15350 - DNA, 27 bp, Artificial Sequence
  Description of Artificial Sequence: Synthetic oligonucleotide
ggcggctcagatcaccaagagcaagtg

SEQ ID NO: 15351 - DNA, 27 bp, Artificial Sequence
  Description of Artificial Sequence: Synthetic oligonucleotide
gcggctcagatcaccaagagcaagtgg

SEQ ID NO: 15352 - DNA, 27 bp, Artificial Sequence
  Description of Artificial Sequence: Synthetic oligonucleotide
cggctcagatcaccaagagcaagtggg

SEQ ID NO: 15353 - DNA, 28 bp, Artificial Sequence
  Description of Artificial Sequence: Synthetic oligonucleotide
ggctcagatcaccaagagcaagtgggag

SEQ ID NO: 15354 - DNA, 28 bp, Artificial Sequence
  Description of Artificial Sequence: Synthetic oligonucleotide
gctcagatcaccaagagcaagtgggagg

SEQ ID NO: 15355 - DNA, 28 bp, Artificial Sequence
  Description of Artificial Sequence: Synthetic oligonucleotide
ctcagatcaccaagagcaagtgggaggc

SEQ ID NO: 15356 - DNA, 28 bp, Artificial Sequence
  Description of Artificial Sequence: Synthetic oligonucleotide
tcagatcaccaagagcaagtgggaggcg

SEQ ID NO: 15357 - DNA, 27 bp, Artificial Sequence
  Description of Artificial Sequence: Synthetic oligonucleotide
cagatcaccaagagcaagtgggaggcg

SEQ ID NO: 15358 - DNA, 27 bp, Artificial Sequence
  Description of Artificial Sequence: Synthetic oligonucleotide
agatcaccaagagcaagtgggaggcgg

SEQ ID NO: 15359 - DNA, 26 bp, Artificial Sequence
  Description of Artificial Sequence: Synthetic oligonucleotide
gatcaccaagagcaagtgggaggcgg

SEQ ID NO: 15360 - DNA, 26 bp, Artificial Sequence
  Description of Artificial Sequence: Synthetic oligonucleotide
atcaccaagagcaagtgggaggcggc

SEQ ID NO: 15361 - DNA, 25 bp, Artificial Sequence
  Description of Artificial Sequence: Synthetic oligonucleotide
tcaccaagagcaagtgggaggcggc

SEQ ID NO: 15362 - DNA, 24 bp, Artificial Sequence
  Description of Artificial Sequence: Synthetic oligonucleotide
caccaagagcaagtgggaggcggc

SEQ ID NO: 15363 - DNA, 24 bp, Artificial Sequence
  Description of Artificial Sequence: Synthetic oligonucleotide
accaagagcaagtgggaggcggcc

SEQ ID NO: 15364 - DNA, 23 bp, Artificial Sequence
  Description of Artificial Sequence: Synthetic oligonucleotide
ccaagagcaagtgggaggcggcc

SEQ ID NO: 15365 - DNA, 25 bp, Artificial Sequence
  Description of Artificial Sequence: Synthetic oligonucleotide
caagagcaagtgggaggcggcccat

SEQ ID NO: 15366 - DNA, 26 bp, Artificial Sequence
  Description of Artificial Sequence: Synthetic oligonucleotide
aagagcaagtgggaggcggcccatgt

SEQ ID NO: 15367 - DNA, 25 bp, Artificial Sequence
  Description of Artificial Sequence: Synthetic oligonucleotide
agagcaagtgggaggcggcccatgt

SEQ ID NO: 15368 - DNA, 24 bp, Artificial Sequence
  Description of Artificial Sequence: Synthetic oligonucleotide
gagcaagtgggaggcggcccatgt

SEQ ID NO: 15369 - DNA, 24 bp, Artificial Sequence
  Description of Artificial Sequence: Synthetic oligonucleotide
agcaagtgggaggcggcccatgtg

SEQ ID NO: 15370 - DNA, 25 bp, Artificial Sequence
  Description of Artificial Sequence: Synthetic oligonucleotide
gacatggcggctcagaccaccaagc

SEQ ID NO: 15371 - DNA, 25 bp, Artificial Sequence
  Description of Artificial Sequence: Synthetic oligonucleotide
acatggcggctcagaccaccaagcg

SEQ ID NO: 15372 - DNA, 24 bp, Artificial Sequence
  Description of Artificial Sequence: Synthetic oligonucleotide
catggcggctcagaccaccaagcg

SEQ ID NO: 15373 - DNA, 26 bp, Artificial Sequence
  Description of Artificial Sequence: Synthetic oligonucleotide
atggcggctcagaccaccaagcgcaa

SEQ ID NO: 15374 - DNA, 25 bp, Artificial Sequence
  Description of Artificial Sequence: Synthetic oligonucleotide
tggcggctcagaccaccaagcgcaa

SEQ ID NO: 15375 - DNA, 24 bp, Artificial Sequence
  Description of Artificial Sequence: Synthetic oligonucleotide
ggcggctcagaccaccaagcgcaa

SEQ ID NO: 15376 - DNA, 25 bp, Artificial Sequence
  Description of Artificial Sequence: Synthetic oligonucleotide
gcggctcagaccaccaagcgcaagt

SEQ ID NO: 15377 - DNA, 25 bp, Artificial Sequence
  Description of Artificial Sequence: Synthetic oligonucleotide
cggctcagaccaccaagcgcaagtg

SEQ ID NO: 15378 - DNA, 25 bp, Artificial Sequence
  Description of Artificial Sequence: Synthetic oligonucleotide
ggctcagaccaccaagcgcaagtgg

SEQ ID NO: 15379 - DNA, 32 bp, Artificial Sequence
  Description of Artificial Sequence: Synthetic oligonucleotide
ttctcacaccctccagatgatgtttggctgag

SEQ ID NO: 15380 - DNA, 31 bp, Artificial Sequence
  Description of Artificial Sequence: Synthetic oligonucleotide
tctcacaccctccagatgatgtttggctgag

SEQ ID NO: 15381 - DNA, 30 bp, Artificial Sequence
  Description of Artificial Sequence: Synthetic oligonucleotide
ctcacaccctccagatgatgtttggctgag

SEQ ID NO: 15382 - DNA, 31 bp, Artificial Sequence
  Description of Artificial Sequence: Synthetic oligonucleotide
tcacaccctccagatgatgtttggctgagac

SEQ ID NO: 15383 - DNA, 30 bp, Artificial Sequence
  Description of Artificial Sequence: Synthetic oligonucleotide
cacaccctccagatgatgtttggctgagac

SEQ ID NO: 15384 - DNA, 30 bp, Artificial Sequence
  Description of Artificial Sequence: Synthetic oligonucleotide
acaccctccagatgatgtttggctgagacg

SEQ ID NO: 15385 - DNA, 29 bp, Artificial Sequence
  Description of Artificial Sequence: Synthetic oligonucleotide
caccctccagatgatgtttggctgagacg

SEQ ID NO: 15386 - DNA, 30 bp, Artificial Sequence
  Description of Artificial Sequence: Synthetic oligonucleotide
accctccagatgatgtttggctgagacgtg

SEQ ID NO: 15387 - DNA, 29 bp, Artificial Sequence
  Description of Artificial Sequence: Synthetic oligonucleotide
ccctccagatgatgtttggctgagacgtg

SEQ ID NO: 15388 - DNA, 29 bp, Artificial Sequence
  Description of Artificial Sequence: Synthetic oligonucleotide
cctccagatgatgtttggctgagacgtgg

SEQ ID NO: 15389 - DNA, 29 bp, Artificial Sequence
  Description of Artificial Sequence: Synthetic oligonucleotide
ctccagatgatgtttggctgagacgtggg

SEQ ID NO: 15390 - DNA, 29 bp, Artificial Sequence
  Description of Artificial Sequence: Synthetic oligonucleotide
tccagatgatgtttggctgagacgtgggg

SEQ ID NO: 15391 - DNA, 28 bp, Artificial Sequence
  Description of Artificial Sequence: Synthetic oligonucleotide
ccagatgatgtttggctgagacgtgggg

SEQ ID NO: 15392 - DNA, 29 bp, Artificial Sequence
  Description of Artificial Sequence: Synthetic oligonucleotide
cagatgatgtttggctgagacgtggggtc

SEQ ID NO: 15393 - DNA, 29 bp, Artificial Sequence
  Description of Artificial Sequence: Synthetic oligonucleotide
agatgatgtttggctgagacgtggggtcg

SEQ ID NO: 15394 - DNA, 28 bp, Artificial Sequence
  Description of Artificial Sequence: Synthetic oligonucleotide
gatgatgtttggctgagacgtggggtcg

SEQ ID NO: 15395 - DNA, 28 bp, Artificial Sequence
  Description of Artificial Sequence: Synthetic oligonucleotide
atgatgtttggctgagacgtggggtcgg

SEQ ID NO: 15396 - DNA, 27 bp, Artificial Sequence
  Description of Artificial Sequence: Synthetic oligonucleotide
tgatgtttggctgagacgtggggtcgg

SEQ ID NO: 15397 - DNA, 27 bp, Artificial Sequence
  Description of Artificial Sequence: Synthetic oligonucleotide
gatgtttggctgagacgtggggtcgga

SEQ ID NO: 15398 - DNA, 27 bp, Artificial Sequence
  Description of Artificial Sequence: Synthetic oligonucleotide
atgtttggctgagacgtggggtcggac

SEQ ID NO: 15399 - DNA, 26 bp, Artificial Sequence
  Description of Artificial Sequence: Synthetic oligonucleotide
tgtttggctgagacgtggggtcggac

SEQ ID NO: 15400 - DNA, 25 bp, Artificial Sequence
  Description of Artificial Sequence: Synthetic oligonucleotide
gtttggctgagacgtggggtcggac

SEQ ID NO: 15401 - DNA, 25 bp, Artificial Sequence
  Description of Artificial Sequence: Synthetic oligonucleotide
tttggctgagacgtggggtcggacg

SEQ ID NO: 15402 - DNA, 24 bp, Artificial Sequence
  Description of Artificial Sequence: Synthetic oligonucleotide
ttggctgagacgtggggtcggacg

SEQ ID NO: 15403 - DNA, 23 bp, Artificial Sequence
  Description of Artificial Sequence: Synthetic oligonucleotide
tggctgagacgtggggtcggacg

SEQ ID NO: 15404 - DNA, 22 bp, Artificial Sequence
  Description of Artificial Sequence: Synthetic oligonucleotide
ggctgagacgtggggtcggacg

SEQ ID NO: 15405 - DNA, 22 bp, Artificial Sequence
  Description of Artificial Sequence: Synthetic oligonucleotide
gctgagacgtggggtcggacgg

SEQ ID NO: 15406 - DNA, 22 bp, Artificial Sequence
  Description of Artificial Sequence: Synthetic oligonucleotide
ctgagacgtggggtcggacggg

SEQ ID NO: 15407 - DNA, 22 bp, Artificial Sequence
  Description of Artificial Sequence: Synthetic oligonucleotide
tgagacgtggggtcggacgggc

SEQ ID NO: 15408 - DNA, 21 bp, Artificial Sequence
  Description of Artificial Sequence: Synthetic oligonucleotide
gagacgtggggtcggacgggc

SEQ ID NO: 15409 - DNA, 21 bp, Artificial Sequence
  Description of Artificial Sequence: Synthetic oligonucleotide
agacgtggggtcggacgggcg

SEQ ID NO: 15410 - DNA, 24 bp, Artificial Sequence
  Description of Artificial Sequence: Synthetic oligonucleotide
gcccatgtggcggagcagcagaca

SEQ ID NO: 15411 - DNA, 24 bp, Artificial Sequence
  Description of Artificial Sequence: Synthetic oligonucleotide
cccatgtggcggagcagcagacag

SEQ ID NO: 15412 - DNA, 24 bp, Artificial Sequence
  Description of Artificial Sequence: Synthetic oligonucleotide
ccatgtggcggagcagcagacagc

SEQ ID NO: 15413 - DNA, 26 bp, Artificial Sequence
  Description of Artificial Sequence: Synthetic oligonucleotide
catgtggcggagcagcagacagccta

SEQ ID NO: 15414 - DNA, 26 bp, Artificial Sequence
  Description of Artificial Sequence: Synthetic oligonucleotide
atgtggcggagcagcagacagcctac

SEQ ID NO: 15415 - DNA, 25 bp, Artificial Sequence
  Description of Artificial Sequence: Synthetic oligonucleotide
tgtggcggagcagcagacagcctac

SEQ ID NO: 15416 - DNA, 24 bp, Artificial Sequence
  Description of Artificial Sequence: Synthetic oligonucleotide
gtggcggagcagcagacagcctac

SEQ ID NO: 15417 - DNA, 25 bp, Artificial Sequence
  Description of Artificial Sequence: Synthetic oligonucleotide
tggcggagcagcagacagcctacct

SEQ ID NO: 15418 - DNA, 25 bp, Artificial Sequence
  Description of Artificial Sequence: Synthetic oligonucleotide
cagcagacagcctacctggagggca

SEQ ID NO: 15419 - DNA, 25 bp, Artificial Sequence
  Description of Artificial Sequence: Synthetic oligonucleotide
agcagacagcctacctggagggcac

SEQ ID NO: 15420 - DNA, 24 bp, Artificial Sequence
  Description of Artificial Sequence: Synthetic oligonucleotide
gcagacagcctacctggagggcac

SEQ ID NO: 15421 - DNA, 25 bp, Artificial Sequence
  Description of Artificial Sequence: Synthetic oligonucleotide
cagacagcctacctggagggcacgt

SEQ ID NO: 15422 - DNA, 25 bp, Artificial Sequence
  Description of Artificial Sequence: Synthetic oligonucleotide
agacagcctacctggagggcacgtg

SEQ ID NO: 15423 - DNA, 23 bp, Artificial Sequence
  Description of Artificial Sequence: Synthetic oligonucleotide
cggcggacatggcggctcagatc

SEQ ID NO: 15424 - DNA, 23 bp, Artificial Sequence
  Description of Artificial Sequence: Synthetic oligonucleotide
ggcggacatggcggctcagatcc

SEQ ID NO: 15425 - DNA, 23 bp, Artificial Sequence
  Description of Artificial Sequence: Synthetic oligonucleotide
gcggacatggcggctcagatccc

SEQ ID NO: 15426 - DNA, 25 bp, Artificial Sequence
  Description of Artificial Sequence: Synthetic oligonucleotide
cggacatggcggctcagatccccaa

SEQ ID NO: 15427 - DNA, 25 bp, Artificial Sequence
  Description of Artificial Sequence: Synthetic oligonucleotide
ggacatggcggctcagatccccaag

SEQ ID NO: 15428 - DNA, 25 bp, Artificial Sequence
  Description of Artificial Sequence: Synthetic oligonucleotide
gacatggcggctcagatccccaagc

SEQ ID NO: 15429 - DNA, 25 bp, Artificial Sequence
  Description of Artificial Sequence: Synthetic oligonucleotide
acatggcggctcagatccccaagcg

SEQ ID NO: 15430 - DNA, 24 bp, Artificial Sequence
  Description of Artificial Sequence: Synthetic oligonucleotide
catggcggctcagatccccaagcg

SEQ ID NO: 15431 - DNA, 26 bp, Artificial Sequence
  Description of Artificial Sequence: Synthetic oligonucleotide
atggcggctcagatccccaagcgcaa

SEQ ID NO: 15432 - DNA, 25 bp, Artificial Sequence
  Description of Artificial Sequence: Synthetic oligonucleotide
tggcggctcagatccccaagcgcaa

SEQ ID NO: 15433 - DNA, 24 bp, Artificial Sequence
  Description of Artificial Sequence: Synthetic oligonucleotide
ggcggctcagatccccaagcgcaa

SEQ ID NO: 15434 - DNA, 25 bp, Artificial Sequence
  Description of Artificial Sequence: Synthetic oligonucleotide
gcggctcagatccccaagcgcaagt

SEQ ID NO: 15435 - DNA, 25 bp, Artificial Sequence
  Description of Artificial Sequence: Synthetic oligonucleotide
cggctcagatccccaagcgcaagtg

SEQ ID NO: 15436 - DNA, 25 bp, Artificial Sequence
  Description of Artificial Sequence: Synthetic oligonucleotide
ggctcagatccccaagcgcaagtgg

SEQ ID NO: 15437 - DNA, 26 bp, Artificial Sequence
  Description of Artificial Sequence: Synthetic oligonucleotide
gctcagatccccaagcgcaagtggga

SEQ ID NO: 15438 - DNA, 26 bp, Artificial Sequence
  Description of Artificial Sequence: Synthetic oligonucleotide
ctcagatccccaagcgcaagtgggag

SEQ ID NO: 15439 - DNA, 26 bp, Artificial Sequence
  Description of Artificial Sequence: Synthetic oligonucleotide
tcagatccccaagcgcaagtgggagg

SEQ ID NO: 15440 - DNA, 25 bp, Artificial Sequence
  Description of Artificial Sequence: Synthetic oligonucleotide
cagatccccaagcgcaagtgggagg

SEQ ID NO: 15441 - DNA, 25 bp, Artificial Sequence
  Description of Artificial Sequence: Synthetic oligonucleotide
agatccccaagcgcaagtgggaggc

SEQ ID NO: 15442 - DNA, 24 bp, Artificial Sequence
  Description of Artificial Sequence: Synthetic oligonucleotide
gatccccaagcgcaagtgggaggc

SEQ ID NO: 15443 - DNA, 24 bp, Artificial Sequence
  Description of Artificial Sequence: Synthetic oligonucleotide
atccccaagcgcaagtgggaggcg

SEQ ID NO: 15444 - DNA, 23 bp, Artificial Sequence
  Description of Artificial Sequence: Synthetic oligonucleotide
tccccaagcgcaagtgggaggcg

SEQ ID NO: 15445 - DNA, 22 bp, Artificial Sequence
  Description of Artificial Sequence: Synthetic oligonucleotide
ccccaagcgcaagtgggaggcg

SEQ ID NO: 15446 - DNA, 22 bp, Artificial Sequence
  Description of Artificial Sequence: Synthetic oligonucleotide
cccaagcgcaagtgggaggcgg

SEQ ID NO: 15447 - DNA, 20 bp, Artificial Sequence
  Description of Artificial Sequence: Synthetic oligonucleotide
acgtggggtcggacgggcgc

SEQ ID NO: 15448 - DNA, 20 bp, Artificial Sequence
  Description of Artificial Sequence: Synthetic oligonucleotide
cgtggggtcggacgggcgct

SEQ ID NO: 15449 - DNA, 20 bp, Artificial Sequence
  Description of Artificial Sequence: Synthetic oligonucleotide
gtggggtcggacgggcgcct

SEQ ID NO: 15450 - DNA, 20 bp, Artificial Sequence
  Description of Artificial Sequence: Synthetic oligonucleotide
tggggtcggacgggcgcctc

SEQ ID NO: 15451 - DNA, 20 bp, Artificial Sequence
  Description of Artificial Sequence: Synthetic oligonucleotide
ggggtcggacgggcgcctct

SEQ ID NO: 15452 - DNA, 20 bp, Artificial Sequence
  Description of Artificial Sequence: Synthetic oligonucleotide
gggtcggacgggcgcctcct

SEQ ID NO: 15453 - DNA, 20 bp, Artificial Sequence
  Description of Artificial Sequence: Synthetic oligonucleotide
ggtcggacgggcgcctcctc

SEQ ID NO: 15454 - DNA, 20 bp, Artificial Sequence
  Description of Artificial Sequence: Synthetic oligonucleotide
gtcggacgggcgcctcctcc

SEQ ID NO: 15455 - DNA, 20 bp, Artificial Sequence
  Description of Artificial Sequence: Synthetic oligonucleotide
tcggacgggcgcctcctccg

SEQ ID NO: 15456 - DNA, 21 bp, Artificial Sequence
  Description of Artificial Sequence: Synthetic oligonucleotide
cgcctcctccgcgggtaccac

SEQ ID NO: 15457 - DNA, 22 bp, Artificial Sequence
  Description of Artificial Sequence: Synthetic oligonucleotide
gcctcctccgcgggtaccacca

SEQ ID NO: 15458 - DNA, 24 bp, Artificial Sequence
  Description of Artificial Sequence: Synthetic oligonucleotide
cctcctccgcgggtaccaccagta

SEQ ID NO: 15459 - DNA, 24 bp, Artificial Sequence
  Description of Artificial Sequence: Synthetic oligonucleotide
ctcctccgcgggtaccaccagtac

SEQ ID NO: 15460 - DNA, 26 bp, Artificial Sequence
  Description of Artificial Sequence: Synthetic oligonucleotide
aagcgcaagtgggaggcggtccatgt

SEQ ID NO: 15461 - DNA, 25 bp, Artificial Sequence
  Description of Artificial Sequence: Synthetic oligonucleotide
agcgcaagtgggaggcggtccatgt

SEQ ID NO: 15462 - DNA, 24 bp, Artificial Sequence
  Description of Artificial Sequence: Synthetic oligonucleotide
gcgcaagtgggaggcggtccatgt

SEQ ID NO: 15463 - DNA, 24 bp, Artificial Sequence
  Description of Artificial Sequence: Synthetic oligonucleotide
cgcaagtgggaggcggtccatgtg

SEQ ID NO: 15464 - DNA, 24 bp, Artificial Sequence
  Description of Artificial Sequence: Synthetic oligonucleotide
gcaagtgggaggcggtccatgtgg

SEQ ID NO: 15465 - DNA, 24 bp, Artificial Sequence
  Description of Artificial Sequence: Synthetic oligonucleotide
caagtgggaggcggtccatgtggc

SEQ ID NO: 15466 - DNA, 24 bp, Artificial Sequence
  Description of Artificial Sequence: Synthetic oligonucleotide
aagtgggaggcggtccatgtggcg

SEQ ID NO: 15467 - DNA, 23 bp, Artificial Sequence
  Description of Artificial Sequence: Synthetic oligonucleotide
agtgggaggcggtccatgtggcg

SEQ ID NO: 15468 - DNA, 22 bp, Artificial Sequence
  Description of Artificial Sequence: Synthetic oligonucleotide
gtgggaggcggtccatgtggcg

SEQ ID NO: 15469 - DNA, 23 bp, Artificial Sequence
  Description of Artificial Sequence: Synthetic oligonucleotide
tgggaggcggtccatgtggcgga

SEQ ID NO: 15470 - DNA, 22 bp, Artificial Sequence
  Description of Artificial Sequence: Synthetic oligonucleotide
gggaggcggtccatgtggcgga

SEQ ID NO: 15471 - DNA, 22 bp, Artificial Sequence
  Description of Artificial Sequence: Synthetic oligonucleotide
ggaggcggtccatgtggcggag

SEQ ID NO: 15472 - DNA, 23 bp, Artificial Sequence
  Description of Artificial Sequence: Synthetic oligonucleotide
gaggcggtccatgtggcggagca

SEQ ID NO: 15473 - DNA, 23 bp, Artificial Sequence
  Description of Artificial Sequence: Synthetic oligonucleotide
aggcggtccatgtggcggagcag

SEQ ID NO: 15474 - DNA, 22 bp, Artificial Sequence
  Description of Artificial Sequence: Synthetic oligonucleotide
ggcggtccatgtggcggagcag

SEQ ID NO: 15475 - DNA, 23 bp, Artificial Sequence
  Description of Artificial Sequence: Synthetic oligonucleotide
gcggtccatgtggcggagcagca

SEQ ID NO: 15476 - DNA, 24 bp, Artificial Sequence
  Description of Artificial Sequence: Synthetic oligonucleotide
cggtccatgtggcggagcagcaga

SEQ ID NO: 15477 - DNA, 25 bp, Artificial Sequence
  Description of Artificial Sequence: Synthetic oligonucleotide
ggtccatgtggcggagcagcagaga

SEQ ID NO: 15478 - DNA, 25 bp, Artificial Sequence
  Description of Artificial Sequence: Synthetic oligonucleotide
gtccatgtggcggagcagcagagag

SEQ ID NO: 15479 - DNA, 25 bp, Artificial Sequence
  Description of Artificial Sequence: Synthetic oligonucleotide
tccatgtggcggagcagcagagagc

SEQ ID NO: 15480 - DNA, 21 bp, Artificial Sequence
  Description of Artificial Sequence: Synthetic oligonucleotide
cggccgcggggagccccaatt

SEQ ID NO: 15481 - DNA, 23 bp, Artificial Sequence
  Description of Artificial Sequence: Synthetic oligonucleotide
ggccgcggggagccccaattcat

SEQ ID NO: 15482 - DNA, 23 bp, Artificial Sequence
  Description of Artificial Sequence: Synthetic oligonucleotide
gccgcggggagccccaattcatc

SEQ ID NO: 15483 - DNA, 23 bp, Artificial Sequence
  Description of Artificial Sequence: Synthetic oligonucleotide
ccgcggggagccccaattcatcg

SEQ ID NO: 15484 - DNA, 23 bp, Artificial Sequence
  Description of Artificial Sequence: Synthetic oligonucleotide
cgcggggagccccaattcatcgc

SEQ ID NO: 15485 - DNA, 23 bp, Artificial Sequence
  Description of Artificial Sequence: Synthetic oligonucleotide
gcggggagccccaattcatcgcc

SEQ ID NO: 15486 - DNA, 24 bp, Artificial Sequence
  Description of Artificial Sequence: Synthetic oligonucleotide
cggggagccccaattcatcgccgt

SEQ ID NO: 15487 - DNA, 24 bp, Artificial Sequence
  Description of Artificial Sequence: Synthetic oligonucleotide
ggggagccccaattcatcgccgtg

SEQ ID NO: 15488 - DNA, 24 bp, Artificial Sequence
  Description of Artificial Sequence: Synthetic oligonucleotide
gggagccccaattcatcgccgtgg

SEQ ID NO: 15489 - DNA, 24 bp, Artificial Sequence
  Description of Artificial Sequence: Synthetic oligonucleotide
ggagccccaattcatcgccgtggg

SEQ ID NO: 15490 - DNA, 26 bp, Artificial Sequence
  Description of Artificial Sequence: Synthetic oligonucleotide
gagccccaattcatcgccgtgggcta

SEQ ID NO: 15491 - DNA, 26 bp, Artificial Sequence
  Description of Artificial Sequence: Synthetic oligonucleotide
agccccaattcatcgccgtgggctac

SEQ ID NO: 15492 - DNA, 25 bp, Artificial Sequence
  Description of Artificial Sequence: Synthetic oligonucleotide
gccccaattcatcgccgtgggctac

SEQ ID NO: 15493 - DNA, 26 bp, Artificial Sequence
  Description of Artificial Sequence: Synthetic oligonucleotide
ccccaattcatcgccgtgggctacgt

SEQ ID NO: 15494 - DNA, 26 bp, Artificial Sequence
  Description of Artificial Sequence: Synthetic oligonucleotide
cccaattcatcgccgtgggctacgtg

SEQ ID NO: 15495 - DNA, 27 bp, Artificial Sequence
  Description of Artificial Sequence: Synthetic oligonucleotide
ccaattcatcgccgtgggctacgtgga

SEQ ID NO: 15496 - DNA, 27 bp, Artificial Sequence
  Description of Artificial Sequence: Synthetic oligonucleotide
caattcatcgccgtgggctacgtggac

SEQ ID NO: 15497 - DNA, 27 bp, Artificial Sequence
  Description of Artificial Sequence: Synthetic oligonucleotide
aattcatcgccgtgggctacgtggacg

SEQ ID NO: 15498 - DNA, 26 bp, Artificial Sequence
  Description of Artificial Sequence: Synthetic oligonucleotide
cgcgggtaccaccagtacgcctacaa

SEQ ID NO: 15499 - DNA, 26 bp, Artificial Sequence
  Description of Artificial Sequence: Synthetic oligonucleotide
gcgggtaccaccagtacgcctacaac

SEQ ID NO: 15500 - DNA, 26 bp, Artificial Sequence
  Description of Artificial Sequence: Synthetic oligonucleotide
cgggtaccaccagtacgcctacaacg

SEQ ID NO: 15501 - DNA, 26 bp, Artificial Sequence
  Description of Artificial Sequence: Synthetic oligonucleotide
gggtaccaccagtacgcctacaacgg

SEQ ID NO: 15502 - DNA, 27 bp, Artificial Sequence
  Description of Artificial Sequence: Synthetic oligonucleotide
ggtaccaccagtacgcctacaacggca

SEQ ID NO: 15503 - DNA, 28 bp, Artificial Sequence
  Description of Artificial Sequence: Synthetic oligonucleotide
gtaccaccagtacgcctacaacggcaag

SEQ ID NO: 15504 - DNA, 28 bp, Artificial Sequence
  Description of Artificial Sequence: Synthetic oligonucleotide
taccaccagtacgcctacaacggcaagg

SEQ ID NO: 15505 - DNA, 27 bp, Artificial Sequence
  Description of Artificial Sequence: Synthetic oligonucleotide
accaccagtacgcctacaacggcaagg

SEQ ID NO: 15506 - DNA, 27 bp, Artificial Sequence
  Description of Artificial Sequence: Synthetic oligonucleotide
ccaccagtacgcctacaacggcaagga

SEQ ID NO: 15507 - DNA, 30 bp, Artificial Sequence
  Description of Artificial Sequence: Synthetic oligonucleotide
caccagtacgcctacaacggcaaggattac

SEQ ID NO: 15508 - DNA, 32 bp, Artificial Sequence
  Description of Artificial Sequence: Synthetic oligonucleotide
accagtacgcctacaacggcaaggattacatc

SEQ ID NO: 15509 - DNA, 31 bp, Artificial Sequence
  Description of Artificial Sequence: Synthetic oligonucleotide
ccagtacgcctacaacggcaaggattacatc

SEQ ID NO: 15510 - DNA, 31 bp, Artificial Sequence
  Description of Artificial Sequence: Synthetic oligonucleotide
cagtacgcctacaacggcaaggattacatcg

SEQ ID NO: 15511 - DNA, 31 bp, Artificial Sequence
  Description of Artificial Sequence: Synthetic oligonucleotide
agtacgcctacaacggcaaggattacatcgc

SEQ ID NO: 15512 - DNA, 30 bp, Artificial Sequence
  Description of Artificial Sequence: Synthetic oligonucleotide
gtacgcctacaacggcaaggattacatcgc

SEQ ID NO: 15513 - DNA, 30 bp, Artificial Sequence
  Description of Artificial Sequence: Synthetic oligonucleotide
tacgcctacaacggcaaggattacatcgcc

SEQ ID NO: 15514 - DNA, 29 bp, Artificial Sequence
  Description of Artificial Sequence: Synthetic oligonucleotide
acgcctacaacggcaaggattacatcgcc

SEQ ID NO: 15515 - DNA, 28 bp, Artificial Sequence
  Description of Artificial Sequence: Synthetic oligonucleotide
cgcctacaacggcaaggattacatcgcc

SEQ ID NO: 15516 - DNA, 28 bp, Artificial Sequence
  Description of Artificial Sequence: Synthetic oligonucleotide
gcctacaacggcaaggattacatcgccc

SEQ ID NO: 15517 - DNA, 29 bp, Artificial Sequence
  Description of Artificial Sequence: Synthetic oligonucleotide
cctacaacggcaaggattacatcgccctg

SEQ ID NO: 15518 - DNA, 32 bp, Artificial Sequence
  Description of Artificial Sequence: Synthetic oligonucleotide
ctacaacggcaaggattacatcgccctgaaag

SEQ ID NO: 15519 - DNA, 33 bp, Artificial Sequence
  Description of Artificial Sequence: Synthetic oligonucleotide
tacaacggcaaggattacatcgccctgaaagag

SEQ ID NO: 15520 - DNA, 32 bp, Artificial Sequence
  Description of Artificial Sequence: Synthetic oligonucleotide
acaacggcaaggattacatcgccctgaaagag

SEQ ID NO: 15521 - DNA, 31 bp, Artificial Sequence
  Description of Artificial Sequence: Synthetic oligonucleotide
caacggcaaggattacatcgccctgaaagag

SEQ ID NO: 15522 - DNA, 31 bp, Artificial Sequence
  Description of Artificial Sequence: Synthetic oligonucleotide
aacggcaaggattacatcgccctgaaagagg

SEQ ID NO: 15523 - DNA, 22 bp, Artificial Sequence
  Description of Artificial Sequence: Synthetic oligonucleotide
cgcggggagccccgcttcatca

SEQ ID NO: 15524 - DNA, 22 bp, Artificial Sequence
  Description of Artificial Sequence: Synthetic oligonucleotide
gcggggagccccgcttcatcac

SEQ ID NO: 15525 - DNA, 22 bp, Artificial Sequence
  Description of Artificial Sequence: Synthetic oligonucleotide
cggggagccccgcttcatcacc

SEQ ID NO: 15526 - DNA, 23 bp, Artificial Sequence
  Description of Artificial Sequence: Synthetic oligonucleotide
ggggagccccgcttcatcaccgt

SEQ ID NO: 15527 - DNA, 23 bp, Artificial Sequence
  Description of Artificial Sequence: Synthetic oligonucleotide
gggagccccgcttcatcaccgtg

SEQ ID NO: 15528 - DNA, 23 bp, Artificial Sequence
  Description of Artificial Sequence: Synthetic oligonucleotide
ggagccccgcttcatcaccgtgg

SEQ ID NO: 15529 - DNA, 23 bp, Artificial Sequence
  Description of Artificial Sequence: Synthetic oligonucleotide
gagccccgcttcatcaccgtggg

SEQ ID NO: 15530 - DNA, 25 bp, Artificial Sequence
  Description of Artificial Sequence: Synthetic oligonucleotide
agccccgcttcatcaccgtgggcta

SEQ ID NO: 15531 - DNA, 24 bp, Artificial Sequence
  Description of Artificial Sequence: Synthetic oligonucleotide
gccccgcttcatcaccgtgggcta

SEQ ID NO: 15532 - DNA, 24 bp, Artificial Sequence
  Description of Artificial Sequence: Synthetic oligonucleotide
ccccgcttcatcaccgtgggctac

SEQ ID NO: 15533 - DNA, 25 bp, Artificial Sequence
  Description of Artificial Sequence: Synthetic oligonucleotide
cccgcttcatcaccgtgggctacgt

SEQ ID NO: 15534 - DNA, 25 bp, Artificial Sequence
  Description of Artificial Sequence: Synthetic oligonucleotide
ccgcttcatcaccgtgggctacgtg

SEQ ID NO: 15535 - DNA, 26 bp, Artificial Sequence
  Description of Artificial Sequence: Synthetic oligonucleotide
cgcttcatcaccgtgggctacgtgga

SEQ ID NO: 15536 - DNA, 26 bp, Artificial Sequence
  Description of Artificial Sequence: Synthetic oligonucleotide
gcttcatcaccgtgggctacgtggac

SEQ ID NO: 15537 - DNA, 27 bp, Artificial Sequence
  Description of Artificial Sequence: Synthetic oligonucleotide
cttcatcaccgtgggctacgtggacga

SEQ ID NO: 15538 - DNA, 27 bp, Artificial Sequence
  Description of Artificial Sequence: Synthetic oligonucleotide
ttcatcaccgtgggctacgtggacgac

SEQ ID NO: 15539 - DNA, 27 bp, Artificial Sequence
  Description of Artificial Sequence: Synthetic oligonucleotide
tcatcaccgtgggctacgtggacgaca

SEQ ID NO: 15540 - DNA, 26 bp, Artificial Sequence
  Description of Artificial Sequence: Synthetic oligonucleotide
catcaccgtgggctacgtggacgaca

SEQ ID NO: 15541 - DNA, 26 bp, Artificial Sequence
  Description of Artificial Sequence: Synthetic oligonucleotide
atcaccgtgggctacgtggacgacac

SEQ ID NO: 15542 - DNA, 25 bp, Artificial Sequence
  Description of Artificial Sequence: Synthetic oligonucleotide
tcaccgtgggctacgtggacgacac

SEQ ID NO: 15543 - DNA, 24 bp, Artificial Sequence
  Description of Artificial Sequence: Synthetic oligonucleotide
caccgtgggctacgtggacgacac

SEQ ID NO: 15544 - DNA, 24 bp, Artificial Sequence
  Description of Artificial Sequence: Synthetic oligonucleotide
accgtgggctacgtggacgacacg

SEQ ID NO: 15545 - DNA, 28 bp, Artificial Sequence
  Description of Artificial Sequence: Synthetic oligonucleotide
gcagatacctggagaacgggaaggagag

SEQ ID NO: 15546 - DNA, 28 bp, Artificial Sequence
  Description of Artificial Sequence: Synthetic oligonucleotide
cagatacctggagaacgggaaggagagg

SEQ ID NO: 15547 - DNA, 28 bp, Artificial Sequence
  Description of Artificial Sequence: Synthetic oligonucleotide
agatacctggagaacgggaaggagaggc

SEQ ID NO: 15548 - DNA, 27 bp, Artificial Sequence
  Description of Artificial Sequence: Synthetic oligonucleotide
gatacctggagaacgggaaggagaggc

SEQ ID NO: 15549 - DNA, 28 bp, Artificial Sequence
  Description of Artificial Sequence: Synthetic oligonucleotide
atacctggagaacgggaaggagaggctg

SEQ ID NO: 15550 - DNA, 27 bp, Artificial Sequence
  Description of Artificial Sequence: Synthetic oligonucleotide
tacctggagaacgggaaggagaggctg

SEQ ID NO: 15551 - DNA, 26 bp, Artificial Sequence
  Description of Artificial Sequence: Synthetic oligonucleotide
acctggagaacgggaaggagaggctg

SEQ ID NO: 15552 - DNA, 25 bp, Artificial Sequence
  Description of Artificial Sequence: Synthetic oligonucleotide
cctggagaacgggaaggagaggctg

SEQ ID NO: 15553 - DNA, 26 bp, Artificial Sequence
  Description of Artificial Sequence: Synthetic oligonucleotide
ctggagaacgggaaggagaggctgca

SEQ ID NO: 15554 - DNA, 26 bp, Artificial Sequence
  Description of Artificial Sequence: Synthetic oligonucleotide
tggagaacgggaaggagaggctgcag

SEQ ID NO: 15555 - DNA, 25 bp, Artificial Sequence
  Description of Artificial Sequence: Synthetic oligonucleotide
ggagaacgggaaggagaggctgcag

SEQ ID NO: 15556 - DNA, 25 bp, Artificial Sequence
  Description of Artificial Sequence: Synthetic oligonucleotide
gagaacgggaaggagaggctgcagc

SEQ ID NO: 15557 - DNA, 25 bp, Artificial Sequence
  Description of Artificial Sequence: Synthetic oligonucleotide
agaacgggaaggagaggctgcagcg

SEQ ID NO: 15558 - DNA, 24 bp, Artificial Sequence
  Description of Artificial Sequence: Synthetic oligonucleotide
gaacgggaaggagaggctgcagcg

SEQ ID NO: 15559 - DNA, 25 bp, Artificial Sequence
  Description of Artificial Sequence: Synthetic oligonucleotide
aacgggaaggagaggctgcagcgca

SEQ ID NO: 15560 - DNA, 24 bp, Artificial Sequence
  Description of Artificial Sequence: Synthetic oligonucleotide
acgggaaggagaggctgcagcgca

SEQ ID NO: 15561 - DNA, 23 bp, Artificial Sequence
  Description of Artificial Sequence: Synthetic oligonucleotide
cgggaaggagaggctgcagcgca

SEQ ID NO: 15562 - DNA, 23 bp, Artificial Sequence
  Description of Artificial Sequence: Synthetic oligonucleotide
gggaaggagaggctgcagcgcac

SEQ ID NO: 15563 - DNA, 23 bp, Artificial Sequence
  Description of Artificial Sequence: Synthetic oligonucleotide
ggaaggagaggctgcagcgcacg

SEQ ID NO: 15564 - DNA, 24 bp, Artificial Sequence
  Description of Artificial Sequence: Synthetic oligonucleotide
gaaggagaggctgcagcgcacgga

SEQ ID NO: 15565 - DNA, 24 bp, Artificial Sequence
  Description of Artificial Sequence: Synthetic oligonucleotide
aaggagaggctgcagcgcacggac

SEQ ID NO: 15566 - DNA, 23 bp, Artificial Sequence
  Description of Artificial Sequence: Synthetic oligonucleotide
aggagaggctgcagcgcacggac

SEQ ID NO: 15567 - DNA, 22 bp, Artificial Sequence
  Description of Artificial Sequence: Synthetic oligonucleotide
ggagaggctgcagcgcacggac

SEQ ID NO: 15568 - DNA, 22 bp, Artificial Sequence
  Description of Artificial Sequence: Synthetic oligonucleotide
gagaggctgcagcgcacggacc

SEQ ID NO: 15569 - DNA, 22 bp, Artificial Sequence
  Description of Artificial Sequence: Synthetic oligonucleotide
agaggctgcagcgcacggaccc

SEQ ID NO: 15570 - DNA, 21 bp, Artificial Sequence
  Description of Artificial Sequence: Synthetic oligonucleotide
gaggctgcagcgcacggaccc

SEQ ID NO: 15571 - DNA, 21 bp, Artificial Sequence
  Description of Artificial Sequence: Synthetic oligonucleotide
aggctgcagcgcacggacccc

SEQ ID NO: 15572 - DNA, 20 bp, Artificial Sequence
  Description of Artificial Sequence: Synthetic oligonucleotide
ggctgcagcgcacggacccc

SEQ ID NO: 15573 - DNA, 20 bp, Artificial Sequence
  Description of Artificial Sequence: Synthetic oligonucleotide
tcccggcccggccgcgcttt

SEQ ID NO: 15574 - DNA, 20 bp, Artificial Sequence
  Description of Artificial Sequence: Synthetic oligonucleotide
cccggcccggccgcgctttt

SEQ ID NO: 15575 - DNA, 20 bp, Artificial Sequence
  Description of Artificial Sequence: Synthetic oligonucleotide
ccggcccggccgcgcgtttt

SEQ ID NO: 15576 - DNA, 20 bp, Artificial Sequence
  Description of Artificial Sequence: Synthetic oligonucleotide
cggcccggccgcgcggattt

SEQ ID NO: 15577 - DNA, 20 bp, Artificial Sequence
  Description of Artificial Sequence: Synthetic oligonucleotide
ggcccggccgcgcggagttt

SEQ ID NO: 15578 - DNA, 20 bp, Artificial Sequence
  Description of Artificial Sequence: Synthetic oligonucleotide
gcccggccgcgcggagcttt

SEQ ID NO: 15579 - DNA, 20 bp, Artificial Sequence
  Description of Artificial Sequence: Synthetic oligonucleotide
cccggccgcgcggagccttt

SEQ ID NO: 15580 - DNA, 20 bp, Artificial Sequence
  Description of Artificial Sequence: Synthetic oligonucleotide
ccggccgcgcggagcccttt

SEQ ID NO: 15581 - DNA, 20 bp, Artificial Sequence
  Description of Artificial Sequence: Synthetic oligonucleotide
cggccgcgcggagccccttt

SEQ ID NO: 15582 - DNA, 20 bp, Artificial Sequence
  Description of Artificial Sequence: Synthetic oligonucleotide
ggccgcgcggagccccgttt

SEQ ID NO: 15583 - DNA, 20 bp, Artificial Sequence
  Description of Artificial Sequence: Synthetic oligonucleotide
gccgcgcggagccccgcttt

SEQ ID NO: 15584 - DNA, 21 bp, Artificial Sequence
  Description of Artificial Sequence: Synthetic oligonucleotide
ccgcgcggagccccgcttcat

SEQ ID NO: 15585 - DNA, 21 bp, Artificial Sequence
  Description of Artificial Sequence: Synthetic oligonucleotide
cgcgcggagccccgcttcatc

SEQ ID NO: 15586 - DNA, 21 bp, Artificial Sequence
  Description of Artificial Sequence: Synthetic oligonucleotide
gcgcggagccccgcttcatcg

SEQ ID NO: 15587 - DNA, 21 bp, Artificial Sequence
  Description of Artificial Sequence: Synthetic oligonucleotide
cgcggagccccgcttcatcgc

SEQ ID NO: 15588 - DNA, 21 bp, Artificial Sequence
  Description of Artificial Sequence: Synthetic oligonucleotide
gcggagccccgcttcatcgcc

SEQ ID NO: 15589 - DNA, 22 bp, Artificial Sequence
  Description of Artificial Sequence: Synthetic oligonucleotide
cggagccccgcttcatcgccgt

SEQ ID NO: 15590 - DNA, 25 bp, Artificial Sequence
  Description of Artificial Sequence: Synthetic oligonucleotide
agcagagagcctacctggagggcct

SEQ ID NO: 15591 - DNA, 24 bp, Artificial Sequence
  Description of Artificial Sequence: Synthetic oligonucleotide
gcagagagcctacctggagggcct

SEQ ID NO: 15592 - DNA, 25 bp, Artificial Sequence
  Description of Artificial Sequence: Synthetic oligonucleotide
cagagagcctacctggagggcctgt

SEQ ID NO: 15593 - DNA, 25 bp, Artificial Sequence
  Description of Artificial Sequence: Synthetic oligonucleotide
agagagcctacctggagggcctgtg

SEQ ID NO: 15594 - DNA, 24 bp, Artificial Sequence
  Description of Artificial Sequence: Synthetic oligonucleotide
gagagcctacctggagggcctgtg

SEQ ID NO: 15595 - DNA, 24 bp, Artificial Sequence
  Description of Artificial Sequence: Synthetic oligonucleotide
agagcctacctggagggcctgtgc

SEQ ID NO: 15596 - DNA, 23 bp, Artificial Sequence
  Description of Artificial Sequence: Synthetic oligonucleotide
gagcctacctggagggcctgtgc

SEQ ID NO: 15597 - DNA, 24 bp, Artificial Sequence
  Description of Artificial Sequence: Synthetic oligonucleotide
agcctacctggagggcctgtgcgt

SEQ ID NO: 15598 - DNA, 23 bp, Artificial Sequence
  Description of Artificial Sequence: Synthetic oligonucleotide
gcctacctggagggcctgtgcgt

SEQ ID NO: 15599 - DNA, 23 bp, Artificial Sequence
  Description of Artificial Sequence: Synthetic oligonucleotide
cctacctggagggcctgtgcgtg

SEQ ID NO: 15600 - DNA, 24 bp, Artificial Sequence
  Description of Artificial Sequence: Synthetic oligonucleotide
ctacctggagggcctgtgcgtgga

SEQ ID NO: 15601 - DNA, 24 bp, Artificial Sequence
  Description of Artificial Sequence: Synthetic oligonucleotide
tacctggagggcctgtgcgtggac

SEQ ID NO: 15602 - DNA, 23 bp, Artificial Sequence
  Description of Artificial Sequence: Synthetic oligonucleotide
acctggagggcctgtgcgtggac

SEQ ID NO: 15603 - DNA, 22 bp, Artificial Sequence
  Description of Artificial Sequence: Synthetic oligonucleotide
cctggagggcctgtgcgtggac

SEQ ID NO: 15604 - DNA, 22 bp, Artificial Sequence
  Description of Artificial Sequence: Synthetic oligonucleotide
ctggagggcctgtgcgtggacg

SEQ ID NO: 15605 - DNA, 22 bp, Artificial Sequence
  Description of Artificial Sequence: Synthetic oligonucleotide
tggagggcctgtgcgtggacgg

SEQ ID NO: 15606 - DNA, 21 bp, Artificial Sequence
  Description of Artificial Sequence: Synthetic oligonucleotide
ggagggcctgtgcgtggacgg

SEQ ID NO: 15607 - DNA, 21 bp, Artificial Sequence
  Description of Artificial Sequence: Synthetic oligonucleotide
gagggcctgtgcgtggacggg

SEQ ID NO: 15608 - DNA, 22 bp, Artificial Sequence
  Description of Artificial Sequence: Synthetic oligonucleotide
agggcctgtgcgtggacgggct

SEQ ID NO: 15609 - DNA, 21 bp, Artificial Sequence
  Description of Artificial Sequence: Synthetic oligonucleotide
gggcctgtgcgtggacgggct

SEQ ID NO: 15610 - DNA, 21 bp, Artificial Sequence
  Description of Artificial Sequence: Synthetic oligonucleotide
ggcctgtgcgtggacgggctc

SEQ ID NO: 15611 - DNA, 21 bp, Artificial Sequence
  Description of Artificial Sequence: Synthetic oligonucleotide
gcctgtgcgtggacgggctcc

SEQ ID NO: 15612 - DNA, 21 bp, Artificial Sequence
  Description of Artificial Sequence: Synthetic oligonucleotide
cctgtgcgtggacgggctccg

SEQ ID NO: 15613 - DNA, 22 bp, Artificial Sequence
  Description of Artificial Sequence: Synthetic oligonucleotide
ctgtgcgtggacgggctccgca

SEQ ID NO: 15614 - DNA, 25 bp, Artificial Sequence
  Description of Artificial Sequence: Synthetic oligonucleotide
tgtgcgtggacgggctccgcagata

SEQ ID NO: 15615 - DNA, 21 bp, Artificial Sequence
  Description of Artificial Sequence: Synthetic oligonucleotide
gctgcagcgcacggaccccca

SEQ ID NO: 15616 - DNA, 23 bp, Artificial Sequence
  Description of Artificial Sequence: Synthetic oligonucleotide
ctgcagcgcacggacccccacaa

SEQ ID NO: 15617 - DNA, 24 bp, Artificial Sequence
  Description of Artificial Sequence: Synthetic oligonucleotide
tgcagcgcacggacccccacaaga

SEQ ID NO: 15618 - DNA, 23 bp, Artificial Sequence
  Description of Artificial Sequence: Synthetic oligonucleotide
gcagcgcacggacccccacaaga

SEQ ID NO: 15619 - DNA, 24 bp, Artificial Sequence
  Description of Artificial Sequence: Synthetic oligonucleotide
cagcgcacggacccccacaagaca

SEQ ID NO: 15620 - DNA, 27 bp, Artificial Sequence
  Description of Artificial Sequence: Synthetic oligonucleotide
agcgcacggacccccacaagacacata

SEQ ID NO: 15621 - DNA, 27 bp, Artificial Sequence
  Description of Artificial Sequence: Synthetic oligonucleotide
gcgcacggacccccacaagacacatat

SEQ ID NO: 15622 - DNA, 27 bp, Artificial Sequence
  Description of Artificial Sequence: Synthetic oligonucleotide
cgcacggacccccacaagacacatatg

SEQ ID NO: 15623 - DNA, 28 bp, Artificial Sequence
  Description of Artificial Sequence: Synthetic oligonucleotide
gcacggacccccacaagacacatatgac

SEQ ID NO: 15624 - DNA, 28 bp, Artificial Sequence
  Description of Artificial Sequence: Synthetic oligonucleotide
cacggacccccacaagacacatatgacc

SEQ ID NO: 15625 - DNA, 28 bp, Artificial Sequence
  Description of Artificial Sequence: Synthetic oligonucleotide
acggacccccacaagacacatatgaccc

SEQ ID NO: 15626 - DNA, 27 bp, Artificial Sequence
  Description of Artificial Sequence: Synthetic oligonucleotide
cggacccccacaagacacatatgaccc

SEQ ID NO: 15627 - DNA, 28 bp, Artificial Sequence
  Description of Artificial Sequence: Synthetic oligonucleotide
ggacccccacaagacacatatgacccac

SEQ ID NO: 15628 - DNA, 28 bp, Artificial Sequence
  Description of Artificial Sequence: Synthetic oligonucleotide
gacccccacaagacacatatgacccacc

SEQ ID NO: 15629 - DNA, 29 bp, Artificial Sequence
  Description of Artificial Sequence: Synthetic oligonucleotide
acccccacaagacacatatgacccaccac

SEQ ID NO: 15630 - DNA, 28 bp, Artificial Sequence
  Description of Artificial Sequence: Synthetic oligonucleotide
cccccacaagacacatatgacccaccac

SEQ ID NO: 15631 - DNA, 28 bp, Artificial Sequence
  Description of Artificial Sequence: Synthetic oligonucleotide
ccccacaagacacatatgacccaccacc

SEQ ID NO: 15632 - DNA, 28 bp, Artificial Sequence
  Description of Artificial Sequence: Synthetic oligonucleotide
cccacaagacacatatgacccaccaccc

SEQ ID NO: 15633 - DNA, 28 bp, Artificial Sequence
  Description of Artificial Sequence: Synthetic oligonucleotide
ccacaagacacatatgacccaccacccc

SEQ ID NO: 15634 - DNA, 30 bp, Artificial Sequence
  Description of Artificial Sequence: Synthetic oligonucleotide
cacaagacacatatgacccaccaccccatc

SEQ ID NO: 15635 - DNA, 31 bp, Artificial Sequence
  Description of Artificial Sequence: Synthetic oligonucleotide
acaagacacatatgacccaccaccccatctc

SEQ ID NO: 15636 - DNA, 25 bp, Artificial Sequence
  Description of Artificial Sequence: Synthetic oligonucleotide
cccatgtggcggagcagtggagagt

SEQ ID NO: 15637 - DNA, 27 bp, Artificial Sequence
  Description of Artificial Sequence: Synthetic oligonucleotide
ccatgtggcggagcagtggagagtcta

SEQ ID NO: 15638 - DNA, 27 bp, Artificial Sequence
  Description of Artificial Sequence: Synthetic oligonucleotide
catgtggcggagcagtggagagtctac

SEQ ID NO: 15639 - DNA, 27 bp, Artificial Sequence
  Description of Artificial Sequence: Synthetic oligonucleotide
atgtggcggagcagtggagagtctacc

SEQ ID NO: 15640 - DNA, 27 bp, Artificial Sequence
  Description of Artificial Sequence: Synthetic oligonucleotide
tgtggcggagcagtggagagtctacct

SEQ ID NO: 15641 - DNA, 26 bp, Artificial Sequence
  Description of Artificial Sequence: Synthetic oligonucleotide
gtggcggagcagtggagagtctacct

SEQ ID NO: 15642 - DNA, 26 bp, Artificial Sequence
  Description of Artificial Sequence: Synthetic oligonucleotide
tggcggagcagtggagagtctacctg

SEQ ID NO: 15643 - DNA, 25 bp, Artificial Sequence
  Description of Artificial Sequence: Synthetic oligonucleotide
ggcggagcagtggagagtctacctg

SEQ ID NO: 15644 - DNA, 26 bp, Artificial Sequence
  Description of Artificial Sequence: Synthetic oligonucleotide
gcggagcagtggagagtctacctgga

SEQ ID NO: 15645 - DNA, 26 bp, Artificial Sequence
  Description of Artificial Sequence: Synthetic oligonucleotide
cggagcagtggagagtctacctggag

SEQ ID NO: 15646 - DNA, 26 bp, Artificial Sequence
  Description of Artificial Sequence: Synthetic oligonucleotide
ggagcagtggagagtctacctggagg

SEQ ID NO: 15647 - DNA, 26 bp, Artificial Sequence
  Description of Artificial Sequence: Synthetic oligonucleotide
gagcagtggagagtctacctggaggg

SEQ ID NO: 15648 - DNA, 27 bp, Artificial Sequence
  Description of Artificial Sequence: Synthetic oligonucleotide
agcagtggagagtctacctggagggca

SEQ ID NO: 15649 - DNA, 26 bp, Artificial Sequence
  Description of Artificial Sequence: Synthetic oligonucleotide
gcagtggagagtctacctggagggca

SEQ ID NO: 15650 - DNA, 26 bp, Artificial Sequence
  Description of Artificial Sequence: Synthetic oligonucleotide
cagtggagagtctacctggagggcac

SEQ ID NO: 15651 - DNA, 27 bp, Artificial Sequence
  Description of Artificial Sequence: Synthetic oligonucleotide
agtggagagtctacctggagggcacgt

SEQ ID NO: 15652 - DNA, 26 bp, Artificial Sequence
  Description of Artificial Sequence: Synthetic oligonucleotide
gtggagagtctacctggagggcacgt

SEQ ID NO: 15653 - DNA, 26 bp, Artificial Sequence
  Description of Artificial Sequence: Synthetic oligonucleotide
tggagagtctacctggagggcacgtg

SEQ ID NO: 15654 - DNA, 25 bp, Artificial Sequence
  Description of Artificial Sequence: Synthetic oligonucleotide
tacctggagggcacgtgcgtggact

SEQ ID NO: 15655 - DNA, 24 bp, Artificial Sequence
  Description of Artificial Sequence: Synthetic oligonucleotide
acctggagggcacgtgcgtggact

SEQ ID NO: 15656 - DNA, 23 bp, Artificial Sequence
  Description of Artificial Sequence: Synthetic oligonucleotide
cctggagggcacgtgcgtggact

SEQ ID NO: 15657 - DNA, 23 bp, Artificial Sequence
  Description of Artificial Sequence: Synthetic oligonucleotide
ctggagggcacgtgcgtggactg

SEQ ID NO: 15658 - DNA, 23 bp, Artificial Sequence
  Description of Artificial Sequence: Synthetic oligonucleotide
tggagggcacgtgcgtggactgg

SEQ ID NO: 15659 - DNA, 22 bp, Artificial Sequence
  Description of Artificial Sequence: Synthetic oligonucleotide
ggagggcacgtgcgtggactgg

SEQ ID NO: 15660 - DNA, 23 bp, Artificial Sequence
  Description of Artificial Sequence: Synthetic oligonucleotide
gagggcacgtgcgtggactggct

SEQ ID NO: 15661 - DNA, 23 bp, Artificial Sequence
  Description of Artificial Sequence: Synthetic oligonucleotide
agggcacgtgcgtggactggctc

SEQ ID NO: 15662 - DNA, 22 bp, Artificial Sequence
  Description of Artificial Sequence: Synthetic oligonucleotide
gggcacgtgcgtggactggctc

SEQ ID NO: 15663 - DNA, 22 bp, Artificial Sequence
  Description of Artificial Sequence: Synthetic oligonucleotide
ggcacgtgcgtggactggctcc

SEQ ID NO: 15664 - DNA, 22 bp, Artificial Sequence
  Description of Artificial Sequence: Synthetic oligonucleotide
gcacgtgcgtggactggctccg

SEQ ID NO: 15665 - DNA, 23 bp, Artificial Sequence
  Description of Artificial Sequence: Synthetic oligonucleotide
cacgtgcgtggactggctccgca

SEQ ID NO: 15666 - DNA, 26 bp, Artificial Sequence
  Description of Artificial Sequence: Synthetic oligonucleotide
acgtgcgtggactggctccgcagata

SEQ ID NO: 15667 - DNA, 25 bp, Artificial Sequence
  Description of Artificial Sequence: Synthetic oligonucleotide
cgtgcgtggactggctccgcagata

SEQ ID NO: 15668 - DNA, 25 bp, Artificial Sequence
  Description of Artificial Sequence: Synthetic oligonucleotide
gtgcgtggactggctccgcagatac

SEQ ID NO: 15669 - DNA, 26 bp, Artificial Sequence
  Description of Artificial Sequence: Synthetic oligonucleotide
tgcgtggactggctccgcagatacct

SEQ ID NO: 15670 - DNA, 25 bp, Artificial Sequence
  Description of Artificial Sequence: Synthetic oligonucleotide
gcgtggactggctccgcagatacct

SEQ ID NO: 15671 - DNA, 25 bp, Artificial Sequence
  Description of Artificial Sequence: Synthetic oligonucleotide
cgtggactggctccgcagatacctg

SEQ ID NO: 15672 - DNA, 26 bp, Artificial Sequence
  Description of Artificial Sequence: Synthetic oligonucleotide
gtggactggctccgcagatacctgga

SEQ ID NO: 15673 - DNA, 27 bp, Artificial Sequence
  Description of Artificial Sequence: Synthetic oligonucleotide
tggactggctccgcagatacctggaga

SEQ ID NO: 15674 - DNA, 27 bp, Artificial Sequence
  Description of Artificial Sequence: Synthetic oligonucleotide
ggactggctccgcagatacctggagaa

SEQ ID NO: 15675 - DNA, 27 bp, Artificial Sequence
  Description of Artificial Sequence: Synthetic oligonucleotide
gactggctccgcagatacctggagaac

SEQ ID NO: 15676 - DNA, 27 bp, Artificial Sequence
  Description of Artificial Sequence: Synthetic oligonucleotide
actggctccgcagatacctggagaacg

SEQ ID NO: 15677 - DNA, 26 bp, Artificial Sequence
  Description of Artificial Sequence: Synthetic oligonucleotide
ctggctccgcagatacctggagaacg

SEQ ID NO: 15678 - DNA, 22 bp, Artificial Sequence
  Description of Artificial Sequence: Synthetic oligonucleotide
ggtcggacgggcgcttcctcca

SEQ ID NO: 15679 - DNA, 22 bp, Artificial Sequence
  Description of Artificial Sequence: Synthetic oligonucleotide
gtcggacgggcgcttcctccac

SEQ ID NO: 15680 - DNA, 22 bp, Artificial Sequence
  Description of Artificial Sequence: Synthetic oligonucleotide
tcggacgggcgcttcctccacg

SEQ ID NO: 15681 - DNA, 23 bp, Artificial Sequence
  Description of Artificial Sequence: Synthetic oligonucleotide
gggcgcttcctccacgggtacca

SEQ ID NO: 15682 - DNA, 23 bp, Artificial Sequence
  Description of Artificial Sequence: Synthetic oligonucleotide
ggcgcttcctccacgggtaccac

SEQ ID NO: 15683 - DNA, 24 bp, Artificial Sequence
  Description of Artificial Sequence: Synthetic oligonucleotide
gcgcttcctccacgggtaccacca

SEQ ID NO: 15684 - DNA, 26 bp, Artificial Sequence
  Description of Artificial Sequence: Synthetic oligonucleotide
cgcttcctccacgggtaccaccagta

SEQ ID NO: 15685 - DNA, 26 bp, Artificial Sequence
  Description of Artificial Sequence: Synthetic oligonucleotide
gcttcctccacgggtaccaccagtac

SEQ ID NO: 15686 - DNA, 26 bp, Artificial Sequence
  Description of Artificial Sequence: Synthetic oligonucleotide
cttcctccacgggtaccaccagtacg

SEQ ID NO: 15687 - DNA, 26 bp, Artificial Sequence
  Description of Artificial Sequence: Synthetic oligonucleotide
ttcctccacgggtaccaccagtacgc

SEQ ID NO: 15688 - DNA, 25 bp, Artificial Sequence
  Description of Artificial Sequence: Synthetic oligonucleotide
tcctccacgggtaccaccagtacgc

SEQ ID NO: 15689 - DNA, 24 bp, Artificial Sequence
  Description of Artificial Sequence: Synthetic oligonucleotide
cctccacgggtaccaccagtacgc

SEQ ID NO: 15690 - DNA, 26 bp, Artificial Sequence
  Description of Artificial Sequence: Synthetic oligonucleotide
ctccacgggtaccaccagtacgccta

SEQ ID NO: 15691 - DNA, 26 bp, Artificial Sequence
  Description of Artificial Sequence: Synthetic oligonucleotide
tccacgggtaccaccagtacgcctac

SEQ ID NO: 15692 - DNA, 25 bp, Artificial Sequence
  Description of Artificial Sequence: Synthetic oligonucleotide
ccacgggtaccaccagtacgcctac

SEQ ID NO: 15693 - DNA, 26 bp, Artificial Sequence
  Description of Artificial Sequence: Synthetic oligonucleotide
cacgggtaccaccagtacgcctacga

SEQ ID NO: 15694 - DNA, 26 bp, Artificial Sequence
  Description of Artificial Sequence: Synthetic oligonucleotide
acgggtaccaccagtacgcctacgac

SEQ ID NO: 15695 - DNA, 21 bp, Artificial Sequence
  Description of Artificial Sequence: Synthetic oligonucleotide
ttggaccgcggcggacagggc

SEQ ID NO: 15696 - DNA, 20 bp, Artificial Sequence
  Description of Artificial Sequence: Synthetic oligonucleotide
tggaccgcggcggacagggc

SEQ ID NO: 15697 - DNA, 20 bp, Artificial Sequence
  Description of Artificial Sequence: Synthetic oligonucleotide
ggaccgcggcggacagggct

SEQ ID NO: 15698 - DNA, 20 bp, Artificial Sequence
  Description of Artificial Sequence: Synthetic oligonucleotide
gaccgcggcggacagggcgt

SEQ ID NO: 15699 - DNA, 20 bp, Artificial Sequence
  Description of Artificial Sequence: Synthetic oligonucleotide
accgcggcggacagggcggt

SEQ ID NO: 15700 - DNA, 20 bp, Artificial Sequence
  Description of Artificial Sequence: Synthetic oligonucleotide
ccgcggcggacagggcggtt

SEQ ID NO: 15701 - DNA, 20 bp, Artificial Sequence
  Description of Artificial Sequence: Synthetic oligonucleotide
cgcggcggacagggcggctt

SEQ ID NO: 15702 - DNA, 20 bp, Artificial Sequence
  Description of Artificial Sequence: Synthetic oligonucleotide
gcggcggacagggcggctca

SEQ ID NO: 15703 - DNA, 22 bp, Artificial Sequence
  Description of Artificial Sequence: Synthetic oligonucleotide
cggcggacagggcggctcagat

SEQ ID NO: 15704 - DNA, 23 bp, Artificial Sequence
  Description of Artificial Sequence: Synthetic oligonucleotide
ggcggacagggcggctcagatca

SEQ ID NO: 15705 - DNA, 23 bp, Artificial Sequence
  Description of Artificial Sequence: Synthetic oligonucleotide
gcggacagggcggctcagatcac

SEQ ID NO: 15706 - DNA, 25 bp, Artificial Sequence
  Description of Artificial Sequence: Synthetic oligonucleotide
cggacagggcggctcagatcaccaa

SEQ ID NO: 15707 - DNA, 25 bp, Artificial Sequence
  Description of Artificial Sequence: Synthetic oligonucleotide
ggacagggcggctcagatcaccaag

SEQ ID NO: 15708 - DNA, 25 bp, Artificial Sequence
  Description of Artificial Sequence: Synthetic oligonucleotide
gacagggcggctcagatcaccaagc

SEQ ID NO: 15709 - DNA, 25 bp, Artificial Sequence
  Description of Artificial Sequence: Synthetic oligonucleotide
acagggcggctcagatcaccaagcg

SEQ ID NO: 15710 - DNA, 24 bp, Artificial Sequence
  Description of Artificial Sequence: Synthetic oligonucleotide
cagggcggctcagatcaccaagcg

SEQ ID NO: 15711 - DNA, 26 bp, Artificial Sequence
  Description of Artificial Sequence: Synthetic oligonucleotide
agggcggctcagatcaccaagcgcaa

SEQ ID NO: 15712 - DNA, 25 bp, Artificial Sequence
  Description of Artificial Sequence: Synthetic oligonucleotide
gggcggctcagatcaccaagcgcaa

SEQ ID NO: 15713 - DNA, 26 bp, Artificial Sequence
  Description of Artificial Sequence: Synthetic oligonucleotide
gccggagtattgggacgaggagacac

SEQ ID NO: 15714 - DNA, 25 bp, Artificial Sequence
  Description of Artificial Sequence: Synthetic oligonucleotide
aggggccggagtattgggacgagca

SEQ ID NO: 15715 - DNA, 24 bp, Artificial Sequence
  Description of Artificial Sequence: Synthetic oligonucleotide
ggggccggagtattgggacgagca

SEQ ID NO: 15716 - DNA, 25 bp, Artificial Sequence
  Description of Artificial Sequence: Synthetic oligonucleotide
gggccggagtattgggacgagcaga

SEQ ID NO: 15717 - DNA, 26 bp, Artificial Sequence
  Description of Artificial Sequence: Synthetic oligonucleotide
ggccggagtattgggacgagcagaca

SEQ ID NO: 15718 - DNA, 26 bp, Artificial Sequence
  Description of Artificial Sequence: Synthetic oligonucleotide
gccggagtattgggacgagcagacag

SEQ ID NO: 15719 - DNA, 26 bp, Artificial Sequence
  Description of Artificial Sequence: Synthetic oligonucleotide
ccggagtattgggacgagcagacagg

SEQ ID NO: 15720 - DNA, 27 bp, Artificial Sequence
  Description of Artificial Sequence: Synthetic oligonucleotide
cggagtattgggacgagcagacaggga

SEQ ID NO: 15721 - DNA, 29 bp, Artificial Sequence
  Description of Artificial Sequence: Synthetic oligonucleotide
ggagtattgggacgagcagacagggaaag

SEQ ID NO: 15722 - DNA, 30 bp, Artificial Sequence
  Description of Artificial Sequence: Synthetic oligonucleotide
gagtattgggacgagcagacagggaaagtg

SEQ ID NO: 15723 - DNA, 32 bp, Artificial Sequence
  Description of Artificial Sequence: Synthetic oligonucleotide
agtattgggacgagcagacagggaaagtgaag

SEQ ID NO: 15724 - DNA, 31 bp, Artificial Sequence
  Description of Artificial Sequence: Synthetic oligonucleotide
gtattgggacgagcagacagggaaagtgaag

SEQ ID NO: 15725 - DNA, 31 bp, Artificial Sequence
  Description of Artificial Sequence: Synthetic oligonucleotide
tattgggacgagcagacagggaaagtgaagg

SEQ ID NO: 15726 - DNA, 30 bp, Artificial Sequence
  Description of Artificial Sequence: Synthetic oligonucleotide
attgggacgagcagacagggaaagtgaagg

SEQ ID NO: 15727 - DNA, 29 bp, Artificial Sequence
  Description of Artificial Sequence: Synthetic oligonucleotide
ttgggacgagcagacagggaaagtgaagg

SEQ ID NO: 15728 - DNA, 28 bp, Artificial Sequence
  Description of Artificial Sequence: Synthetic oligonucleotide
tgggacgagcagacagggaaagtgaagg

SEQ ID NO: 15729 - DNA, 27 bp, Artificial Sequence
  Description of Artificial Sequence: Synthetic oligonucleotide
gggacgagcagacagggaaagtgaagg

SEQ ID NO: 15730 - DNA, 27 bp, Artificial Sequence
  Description of Artificial Sequence: Synthetic oligonucleotide
ggacgagcagacagggaaagtgaaggc

SEQ ID NO: 15731 - DNA, 27 bp, Artificial Sequence
  Description of Artificial Sequence: Synthetic oligonucleotide
gacgagcagacagggaaagtgaaggcc

SEQ ID NO: 15732 - DNA, 27 bp, Artificial Sequence
  Description of Artificial Sequence: Synthetic oligonucleotide
acgagcagacagggaaagtgaaggccc

SEQ ID NO: 15733 - DNA, 27 bp, Artificial Sequence
  Description of Artificial Sequence: Synthetic oligonucleotide
cgagcagacagggaaagtgaaggccca

SEQ ID NO: 15734 - DNA, 27 bp, Artificial Sequence
  Description of Artificial Sequence: Synthetic oligonucleotide
gagcagacagggaaagtgaaggcccac

SEQ ID NO: 15735 - DNA, 28 bp, Artificial Sequence
  Description of Artificial Sequence: Synthetic oligonucleotide
agcagacagggaaagtgaaggcccactc

SEQ ID NO: 15736 - DNA, 27 bp, Artificial Sequence
  Description of Artificial Sequence: Synthetic oligonucleotide
gcagacagggaaagtgaaggcccactc

SEQ ID NO: 15737 - DNA, 28 bp, Artificial Sequence
  Description of Artificial Sequence: Synthetic oligonucleotide
cagacagggaaagtgaaggcccactcac

SEQ ID NO: 15738 - DNA, 31 bp, Artificial Sequence
  Description of Artificial Sequence: Synthetic oligonucleotide
acagggaaagtgaaggcccactcacagattg

SEQ ID NO: 15739 - DNA, 30 bp, Artificial Sequence
  Description of Artificial Sequence: Synthetic oligonucleotide
cagggaaagtgaaggcccactcacagattg

SEQ ID NO: 15740 - DNA, 31 bp, Artificial Sequence
  Description of Artificial Sequence: Synthetic oligonucleotide
agggaaagtgaaggcccactcacagattgac

SEQ ID NO: 15741 - DNA, 30 bp, Artificial Sequence
  Description of Artificial Sequence: Synthetic oligonucleotide
gggaaagtgaaggcccactcacagattgac

SEQ ID NO: 15742 - DNA, 29 bp, Artificial Sequence
  Description of Artificial Sequence: Synthetic oligonucleotide
tgaaggcccactcacagattgaccgagag

SEQ ID NO: 15743 - DNA, 28 bp, Artificial Sequence
  Description of Artificial Sequence: Synthetic oligonucleotide
gaaggcccactcacagattgaccgagag

SEQ ID NO: 15744 - DNA, 30 bp, Artificial Sequence
  Description of Artificial Sequence: Synthetic oligonucleotide
aaggcccactcacagattgaccgagagaac

SEQ ID NO: 15745 - DNA, 29 bp, Artificial Sequence
  Description of Artificial Sequence: Synthetic oligonucleotide
aggcccactcacagattgaccgagagaac

SEQ ID NO: 15746 - DNA, 28 bp, Artificial Sequence
  Description of Artificial Sequence: Synthetic oligonucleotide
ggcccactcacagattgaccgagagaac

SEQ ID NO: 15747 - DNA, 28 bp, Artificial Sequence
  Description of Artificial Sequence: Synthetic oligonucleotide
gcccactcacagattgaccgagagaacc

SEQ ID NO: 15748 - DNA, 29 bp, Artificial Sequence
  Description of Artificial Sequence: Synthetic oligonucleotide
cccactcacagattgaccgagagaacctg

SEQ ID NO: 15749 - DNA, 29 bp, Artificial Sequence
  Description of Artificial Sequence: Synthetic oligonucleotide
ccactcacagattgaccgagagaacctgc

SEQ ID NO: 15750 - DNA, 29 bp, Artificial Sequence
  Description of Artificial Sequence: Synthetic oligonucleotide
cactcacagattgaccgagagaacctgcg

SEQ ID NO: 15751 - DNA, 29 bp, Artificial Sequence
  Description of Artificial Sequence: Synthetic oligonucleotide
actcacagattgaccgagagaacctgcgg

SEQ ID NO: 15752 - DNA, 28 bp, Artificial Sequence
  Description of Artificial Sequence: Synthetic oligonucleotide
ctcacagattgaccgagagaacctgcgg

SEQ ID NO: 15753 - DNA, 30 bp, Artificial Sequence
  Description of Artificial Sequence: Synthetic oligonucleotide
tcacagattgaccgagagaacctgcggatc

SEQ ID NO: 15754 - DNA, 29 bp, Artificial Sequence
  Description of Artificial Sequence: Synthetic oligonucleotide
cacagattgaccgagagaacctgcggatc

SEQ ID NO: 15755 - DNA, 29 bp, Artificial Sequence
  Description of Artificial Sequence: Synthetic oligonucleotide
acagattgaccgagagaacctgcggatcg

SEQ ID NO: 15756 - DNA, 28 bp, Artificial Sequence
  Description of Artificial Sequence: Synthetic oligonucleotide
cagattgaccgagagaacctgcggatcg

SEQ ID NO: 15757 - DNA, 28 bp, Artificial Sequence
  Description of Artificial Sequence: Synthetic oligonucleotide
agattgaccgagagaacctgcggatcgc

SEQ ID NO: 15758 - DNA, 27 bp, Artificial Sequence
  Description of Artificial Sequence: Synthetic oligonucleotide
gattgaccgagagaacctgcggatcgc

SEQ ID NO: 15759 - DNA, 27 bp, Artificial Sequence
  Description of Artificial Sequence: Synthetic oligonucleotide
attgaccgagagaacctgcggatcgcg

SEQ ID NO: 15760 - DNA, 26 bp, Artificial Sequence
  Description of Artificial Sequence: Synthetic oligonucleotide
ttgaccgagagaacctgcggatcgcg

SEQ ID NO: 15761 - DNA, 28 bp, Artificial Sequence
  Description of Artificial Sequence: Synthetic oligonucleotide
atagagcaggaggggccggagtattgac

SEQ ID NO: 15762 - DNA, 27 bp, Artificial Sequence
  Description of Artificial Sequence: Synthetic oligonucleotide
tagagcaggaggggccggagtattgac

SEQ ID NO: 15763 - DNA, 26 bp, Artificial Sequence
  Description of Artificial Sequence: Synthetic oligonucleotide
agagcaggaggggccggagtattgac

SEQ ID NO: 15764 - DNA, 25 bp, Artificial Sequence
  Description of Artificial Sequence: Synthetic oligonucleotide
gagcaggaggggccggagtattgac

SEQ ID NO: 15765 - DNA, 26 bp, Artificial Sequence
  Description of Artificial Sequence: Synthetic oligonucleotide
agcaggaggggccggagtattgacga

SEQ ID NO: 15766 - DNA, 25 bp, Artificial Sequence
  Description of Artificial Sequence: Synthetic oligonucleotide
gcaggaggggccggagtattgacga

SEQ ID NO: 15767 - DNA, 25 bp, Artificial Sequence
  Description of Artificial Sequence: Synthetic oligonucleotide
caggaggggccggagtattgacgag

SEQ ID NO: 15768 - DNA, 26 bp, Artificial Sequence
  Description of Artificial Sequence: Synthetic oligonucleotide
aggaggggccggagtattgacgagga

SEQ ID NO: 15769 - DNA, 25 bp, Artificial Sequence
  Description of Artificial Sequence: Synthetic oligonucleotide
ggaggggccggagtattgacgagga

SEQ ID NO: 15770 - DNA, 26 bp, Artificial Sequence
  Description of Artificial Sequence: Synthetic oligonucleotide
gaggggccggagtattgacgaggaga

SEQ ID NO: 15771 - DNA, 27 bp, Artificial Sequence
  Description of Artificial Sequence: Synthetic oligonucleotide
aggggccggagtattgacgaggagaca

SEQ ID NO: 15772 - DNA, 26 bp, Artificial Sequence
  Description of Artificial Sequence: Synthetic oligonucleotide
ggggccggagtattgacgaggagaca

SEQ ID NO: 15773 - DNA, 26 bp, Artificial Sequence
  Description of Artificial Sequence: Synthetic oligonucleotide
gggccggagtattgacgaggagacag

SEQ ID NO: 15774 - DNA, 26 bp, Artificial Sequence
  Description of Artificial Sequence: Synthetic oligonucleotide
ggccggagtattgacgaggagacagg

SEQ ID NO: 15775 - DNA, 27 bp, Artificial Sequence
  Description of Artificial Sequence: Synthetic oligonucleotide
gccggagtattgacgaggagacaggga

SEQ ID NO: 15776 - DNA, 29 bp, Artificial Sequence
  Description of Artificial Sequence: Synthetic oligonucleotide
ccggagtattgacgaggagacagggaaag

SEQ ID NO: 15777 - DNA, 30 bp, Artificial Sequence
  Description of Artificial Sequence: Synthetic oligonucleotide
cggagtattgacgaggagacagggaaagtg

SEQ ID NO: 15778 - DNA, 32 bp, Artificial Sequence
  Description of Artificial Sequence: Synthetic oligonucleotide
ggagtattgacgaggagacagggaaagtgaag

SEQ ID NO: 15779 - DNA, 32 bp, Artificial Sequence
  Description of Artificial Sequence: Synthetic oligonucleotide
gagtattgacgaggagacagggaaagtgaagg

SEQ ID NO: 15780 - DNA, 32 bp, Artificial Sequence
  Description of Artificial Sequence: Synthetic oligonucleotide
agtattgacgaggagacagggaaagtgaaggc

SEQ ID NO: 15781 - DNA, 31 bp, Artificial Sequence
  Description of Artificial Sequence: Synthetic oligonucleotide
gtattgacgaggagacagggaaagtgaaggc

SEQ ID NO: 15782 - DNA, 31 bp, Artificial Sequence
  Description of Artificial Sequence: Synthetic oligonucleotide
tattgacgaggagacagggaaagtgaaggcc

SEQ ID NO: 15783 - DNA, 30 bp, Artificial Sequence
  Description of Artificial Sequence: Synthetic oligonucleotide
attgacgaggagacagggaaagtgaaggcc

SEQ ID NO: 15784 - DNA, 29 bp, Artificial Sequence
  Description of Artificial Sequence: Synthetic oligonucleotide
ttgacgaggagacagggaaagtgaaggcc

SEQ ID NO: 15785 - DNA, 28 bp, Artificial Sequence
  Description of Artificial Sequence: Synthetic oligonucleotide
tgacgaggagacagggaaagtgaaggcc

SEQ ID NO: 15786 - DNA, 23 bp, Artificial Sequence
  Description of Artificial Sequence: Synthetic oligonucleotide
gccgcgagccagaggatggagct

SEQ ID NO: 15787 - DNA, 23 bp, Artificial Sequence
  Description of Artificial Sequence: Synthetic oligonucleotide
ccgcgagccagaggatggagctg

SEQ ID NO: 15788 - DNA, 23 bp, Artificial Sequence
  Description of Artificial Sequence: Synthetic oligonucleotide
cgcgagccagaggatggagctgc

SEQ ID NO: 15789 - DNA, 23 bp, Artificial Sequence
  Description of Artificial Sequence: Synthetic oligonucleotide
gcgagccagaggatggagctgcg

SEQ ID NO: 15790 - DNA, 23 bp, Artificial Sequence
  Description of Artificial Sequence: Synthetic oligonucleotide
cgagccagaggatggagctgcgg

SEQ ID NO: 15791 - DNA, 23 bp, Artificial Sequence
  Description of Artificial Sequence: Synthetic oligonucleotide
gagccagaggatggagctgcggg

SEQ ID NO: 15792 - DNA, 23 bp, Artificial Sequence
  Description of Artificial Sequence: Synthetic oligonucleotide
agccagaggatggagctgcgggc

SEQ ID NO: 15793 - DNA, 22 bp, Artificial Sequence
  Description of Artificial Sequence: Synthetic oligonucleotide
gccagaggatggagctgcgggc

SEQ ID NO: 15794 - DNA, 22 bp, Artificial Sequence
  Description of Artificial Sequence: Synthetic oligonucleotide
ccagaggatggagctgcgggcg

SEQ ID NO: 15795 - DNA, 22 bp, Artificial Sequence
  Description of Artificial Sequence: Synthetic oligonucleotide
cagaggatggagctgcgggcgc

SEQ ID NO: 15796 - DNA, 22 bp, Artificial Sequence
  Description of Artificial Sequence: Synthetic oligonucleotide
agaggatggagctgcgggcgcc

SEQ ID NO: 15797 - DNA, 21 bp, Artificial Sequence
  Description of Artificial Sequence: Synthetic oligonucleotide
gaggatggagctgcgggcgcc

SEQ ID NO: 15798 - DNA, 22 bp, Artificial Sequence
  Description of Artificial Sequence: Synthetic oligonucleotide
aggatggagctgcgggcgccgt

SEQ ID NO: 15799 - DNA, 21 bp, Artificial Sequence
  Description of Artificial Sequence: Synthetic oligonucleotide
ggatggagctgcgggcgccgt

SEQ ID NO: 15800 - DNA, 21 bp, Artificial Sequence
  Description of Artificial Sequence: Synthetic oligonucleotide
gatggagctgcgggcgccgtg

SEQ ID NO: 15801 - DNA, 24 bp, Artificial Sequence
  Description of Artificial Sequence: Synthetic oligonucleotide
atggagctgcgggcgccgtggata

SEQ ID NO: 15802 - DNA, 23 bp, Artificial Sequence
  Description of Artificial Sequence: Synthetic oligonucleotide
tggagctgcgggcgccgtggata

SEQ ID NO: 15803 - DNA, 22 bp, Artificial Sequence
  Description of Artificial Sequence: Synthetic oligonucleotide
ggagctgcgggcgccgtggata

SEQ ID NO: 15804 - DNA, 23 bp, Artificial Sequence
  Description of Artificial Sequence: Synthetic oligonucleotide
gagctgcgggcgccgtggataga

SEQ ID NO: 15805 - DNA, 23 bp, Artificial Sequence
  Description of Artificial Sequence: Synthetic oligonucleotide
agctgcgggcgccgtggatagag

SEQ ID NO: 15806 - DNA, 22 bp, Artificial Sequence
  Description of Artificial Sequence: Synthetic oligonucleotide
gctgcgggcgccgtggatagag

SEQ ID NO: 15807 - DNA, 23 bp, Artificial Sequence
  Description of Artificial Sequence: Synthetic oligonucleotide
ctgcgggcgccgtggatagagca

SEQ ID NO: 15808 - DNA, 23 bp, Artificial Sequence
  Description of Artificial Sequence: Synthetic oligonucleotide
tgcgggcgccgtggatagagcag

SEQ ID NO: 15809 - DNA, 31 bp, Artificial Sequence
  Description of Artificial Sequence: Synthetic oligonucleotide
gctcccactccatgagctatttctccacatc

SEQ ID NO: 15810 - DNA, 31 bp, Artificial Sequence
  Description of Artificial Sequence: Synthetic oligonucleotide
ctcccactccatgagctatttctccacatcc

SEQ ID NO: 15811 - DNA, 31 bp, Artificial Sequence
  Description of Artificial Sequence: Synthetic oligonucleotide
tcccactccatgagctatttctccacatccg

SEQ ID NO: 15812 - DNA, 30 bp, Artificial Sequence
  Description of Artificial Sequence: Synthetic oligonucleotide
cccactccatgagctatttctccacatccg

SEQ ID NO: 15813 - DNA, 31 bp, Artificial Sequence
  Description of Artificial Sequence: Synthetic oligonucleotide
ccactccatgagctatttctccacatccgtg

SEQ ID NO: 15814 - DNA, 32 bp, Artificial Sequence
  Description of Artificial Sequence: Synthetic oligonucleotide
cactccatgagctatttctccacatccgtgtc

SEQ ID NO: 15815 - DNA, 32 bp, Artificial Sequence
  Description of Artificial Sequence: Synthetic oligonucleotide
actccatgagctatttctccacatccgtgtcc

SEQ ID NO: 15816 - DNA, 31 bp, Artificial Sequence
  Description of Artificial Sequence: Synthetic oligonucleotide
ctccatgagctatttctccacatccgtgtcc

SEQ ID NO: 15817 - DNA, 31 bp, Artificial Sequence
  Description of Artificial Sequence: Synthetic oligonucleotide
tccatgagctatttctccacatccgtgtccc

SEQ ID NO: 15818 - DNA, 30 bp, Artificial Sequence
  Description of Artificial Sequence: Synthetic oligonucleotide
ccatgagctatttctccacatccgtgtccc

SEQ ID NO: 15819 - DNA, 30 bp, Artificial Sequence
  Description of Artificial Sequence: Synthetic oligonucleotide
catgagctatttctccacatccgtgtcccg

SEQ ID NO: 15820 - DNA, 30 bp, Artificial Sequence
  Description of Artificial Sequence: Synthetic oligonucleotide
atgagctatttctccacatccgtgtcccgg

SEQ ID NO: 15821 - DNA, 29 bp, Artificial Sequence
  Description of Artificial Sequence: Synthetic oligonucleotide
tgagctatttctccacatccgtgtcccgg

SEQ ID NO: 15822 - DNA, 28 bp, Artificial Sequence
  Description of Artificial Sequence: Synthetic oligonucleotide
gagctatttctccacatccgtgtcccgg

SEQ ID NO: 15823 - DNA, 28 bp, Artificial Sequence
  Description of Artificial Sequence: Synthetic oligonucleotide
agctatttctccacatccgtgtcccggc

SEQ ID NO: 15824 - DNA, 27 bp, Artificial Sequence
  Description of Artificial Sequence: Synthetic oligonucleotide
gctatttctccacatccgtgtcccggc

SEQ ID NO: 15825 - DNA, 27 bp, Artificial Sequence
  Description of Artificial Sequence: Synthetic oligonucleotide
ctatttctccacatccgtgtcccggcc

SEQ ID NO: 15826 - DNA, 26 bp, Artificial Sequence
  Description of Artificial Sequence: Synthetic oligonucleotide
cgcgggtaccaccagtacgcctacta

SEQ ID NO: 15827 - DNA, 26 bp, Artificial Sequence
  Description of Artificial Sequence: Synthetic oligonucleotide
gcgggtaccaccagtacgcctactac

SEQ ID NO: 15828 - DNA, 26 bp, Artificial Sequence
  Description of Artificial Sequence: Synthetic oligonucleotide
cgggtaccaccagtacgcctactacg

SEQ ID NO: 15829 - DNA, 26 bp, Artificial Sequence
  Description of Artificial Sequence: Synthetic oligonucleotide
gggtaccaccagtacgcctactacgg

SEQ ID NO: 15830 - DNA, 27 bp, Artificial Sequence
  Description of Artificial Sequence: Synthetic oligonucleotide
ggtaccaccagtacgcctactacggca

SEQ ID NO: 15831 - DNA, 28 bp, Artificial Sequence
  Description of Artificial Sequence: Synthetic oligonucleotide
gtaccaccagtacgcctactacggcaag

SEQ ID NO: 15832 - DNA, 28 bp, Artificial Sequence
  Description of Artificial Sequence: Synthetic oligonucleotide
taccaccagtacgcctactacggcaagg

SEQ ID NO: 15833 - DNA, 27 bp, Artificial Sequence
  Description of Artificial Sequence: Synthetic oligonucleotide
accaccagtacgcctactacggcaagg

SEQ ID NO: 15834 - DNA, 27 bp, Artificial Sequence
  Description of Artificial Sequence: Synthetic oligonucleotide
ccaccagtacgcctactacggcaagga

SEQ ID NO: 15835 - DNA, 30 bp, Artificial Sequence
  Description of Artificial Sequence: Synthetic oligonucleotide
caccagtacgcctactacggcaaggattac

SEQ ID NO: 15836 - DNA, 32 bp, Artificial Sequence
  Description of Artificial Sequence: Synthetic oligonucleotide
accagtacgcctactacggcaaggattacatc

SEQ ID NO: 15837 - DNA, 31 bp, Artificial Sequence
  Description of Artificial Sequence: Synthetic oligonucleotide
ccagtacgcctactacggcaaggattacatc

SEQ ID NO: 15838 - DNA, 31 bp, Artificial Sequence
  Description of Artificial Sequence: Synthetic oligonucleotide
cagtacgcctactacggcaaggattacatcg

SEQ ID NO: 15839 - DNA, 31 bp, Artificial Sequence
  Description of Artificial Sequence: Synthetic oligonucleotide
agtacgcctactacggcaaggattacatcgc

SEQ ID NO: 15840 - DNA, 30 bp, Artificial Sequence
  Description of Artificial Sequence: Synthetic oligonucleotide
gtacgcctactacggcaaggattacatcgc

SEQ ID NO: 15841 - DNA, 30 bp, Artificial Sequence
  Description of Artificial Sequence: Synthetic oligonucleotide
tacgcctactacggcaaggattacatcgcc

SEQ ID NO: 15842 - DNA, 29 bp, Artificial Sequence
  Description of Artificial Sequence: Synthetic oligonucleotide
acgcctactacggcaaggattacatcgcc

SEQ ID NO: 15843 - DNA, 28 bp, Artificial Sequence
  Description of Artificial Sequence: Synthetic oligonucleotide
cgcctactacggcaaggattacatcgcc

SEQ ID NO: 15844 - DNA, 28 bp, Artificial Sequence
  Description of Artificial Sequence: Synthetic oligonucleotide
gcctactacggcaaggattacatcgccc

SEQ ID NO: 15845 - DNA, 29 bp, Artificial Sequence
  Description of Artificial Sequence: Synthetic oligonucleotide
cctactacggcaaggattacatcgccctg

SEQ ID NO: 15846 - DNA, 32 bp, Artificial Sequence
  Description of Artificial Sequence: Synthetic oligonucleotide
ctactacggcaaggattacatcgccctgaaag

SEQ ID NO: 15847 - DNA, 33 bp, Artificial Sequence
  Description of Artificial Sequence: Synthetic oligonucleotide
tactacggcaaggattacatcgccctgaaagag

SEQ ID NO: 15848 - DNA, 32 bp, Artificial Sequence
  Description of Artificial Sequence: Synthetic oligonucleotide
actacggcaaggattacatcgccctgaaagag

SEQ ID NO: 15849 - DNA, 31 bp, Artificial Sequence
  Description of Artificial Sequence: Synthetic oligonucleotide
ctacggcaaggattacatcgccctgaaagag

SEQ ID NO: 15850 - DNA, 31 bp, Artificial Sequence
  Description of Artificial Sequence: Synthetic oligonucleotide
tacggcaaggattacatcgccctgaaagagg

SEQ ID NO: 15851 - DNA, 22 bp, Artificial Sequence
  Description of Artificial Sequence: Synthetic oligonucleotide
gctgcagcgcacggacccccaa

SEQ ID NO: 15852 - DNA, 23 bp, Artificial Sequence
  Description of Artificial Sequence: Synthetic oligonucleotide
ctgcagcgcacggacccccaaga

SEQ ID NO: 15853 - DNA, 24 bp, Artificial Sequence
  Description of Artificial Sequence: Synthetic oligonucleotide
tgcagcgcacggacccccaagaca

SEQ ID NO: 15854 - DNA, 23 bp, Artificial Sequence
  Description of Artificial Sequence: Synthetic oligonucleotide
gcagcgcacggacccccaagaca

SEQ ID NO: 15855 - DNA, 27 bp, Artificial Sequence
  Description of Artificial Sequence: Synthetic oligonucleotide
cagcgcacggacccccaagacacatat

SEQ ID NO: 15856 - DNA, 27 bp, Artificial Sequence
  Description of Artificial Sequence: Synthetic oligonucleotide
agcgcacggacccccaagacacatatg

SEQ ID NO: 15857 - DNA, 27 bp, Artificial Sequence
  Description of Artificial Sequence: Synthetic oligonucleotide
gcgcacggacccccaagacacatatga

SEQ ID NO: 15858 - DNA, 27 bp, Artificial Sequence
  Description of Artificial Sequence: Synthetic oligonucleotide
cgcacggacccccaagacacatatgac

SEQ ID NO: 15859 - DNA, 27 bp, Artificial Sequence
  Description of Artificial Sequence: Synthetic oligonucleotide
gcacggacccccaagacacatatgacc

SEQ ID NO: 15860 - DNA, 27 bp, Artificial Sequence
  Description of Artificial Sequence: Synthetic oligonucleotide
cacggacccccaagacacatatgaccc

SEQ ID NO: 15861 - DNA, 28 bp, Artificial Sequence
  Description of Artificial Sequence: Synthetic oligonucleotide
acggacccccaagacacatatgacccac

SEQ ID NO: 15862 - DNA, 27 bp, Artificial Sequence
  Description of Artificial Sequence: Synthetic oligonucleotide
cggacccccaagacacatatgacccac

SEQ ID NO: 15863 - DNA, 27 bp, Artificial Sequence
  Description of Artificial Sequence: Synthetic oligonucleotide
ggacccccaagacacatatgacccacc

SEQ ID NO: 15864 - DNA, 28 bp, Artificial Sequence
  Description of Artificial Sequence: Synthetic oligonucleotide
gacccccaagacacatatgacccaccac

SEQ ID NO: 15865 - DNA, 27 bp, Artificial Sequence
  Description of Artificial Sequence: Synthetic oligonucleotide
agatgatgtttggctgcgacgtggggc

SEQ ID NO: 15866 - DNA, 26 bp, Artificial Sequence
  Description of Artificial Sequence: Synthetic oligonucleotide
gatgatgtttggctgcgacgtggggc

SEQ ID NO: 15867 - DNA, 26 bp, Artificial Sequence
  Description of Artificial Sequence: Synthetic oligonucleotide
atgatgtttggctgcgacgtggggcc

SEQ ID NO: 15868 - DNA, 25 bp, Artificial Sequence
  Description of Artificial Sequence: Synthetic oligonucleotide
tgatgtttggctgcgacgtggggcc

SEQ ID NO: 15869 - DNA, 24 bp, Artificial Sequence
  Description of Artificial Sequence: Synthetic oligonucleotide
gatgtttggctgcgacgtggggcc

SEQ ID NO: 15870 - DNA, 24 bp, Artificial Sequence
  Description of Artificial Sequence: Synthetic oligonucleotide
atgtttggctgcgacgtggggccg

SEQ ID NO: 15871 - DNA, 23 bp, Artificial Sequence
  Description of Artificial Sequence: Synthetic oligonucleotide
tgtttggctgcgacgtggggccg

SEQ ID NO: 15872 - DNA, 22 bp, Artificial Sequence
  Description of Artificial Sequence: Synthetic oligonucleotide
gtttggctgcgacgtggggccg

SEQ ID NO: 15873 - DNA, 23 bp, Artificial Sequence
  Description of Artificial Sequence: Synthetic oligonucleotide
tttggctgcgacgtggggccgga

SEQ ID NO: 15874 - DNA, 22 bp, Artificial Sequence
  Description of Artificial Sequence: Synthetic oligonucleotide
ttggctgcgacgtggggccgga

SEQ ID NO: 15875 - DNA, 24 bp, Artificial Sequence
  Description of Artificial Sequence: Synthetic oligonucleotide
ctcttggaccgcggcggacatgga

SEQ ID NO: 15876 - DNA, 24 bp, Artificial Sequence
  Description of Artificial Sequence: Synthetic oligonucleotide
tcttggaccgcggcggacatggag

SEQ ID NO: 15877 - DNA, 23 bp, Artificial Sequence
  Description of Artificial Sequence: Synthetic oligonucleotide
cttggaccgcggcggacatggag

SEQ ID NO: 15878 - DNA, 23 bp, Artificial Sequence
  Description of Artificial Sequence: Synthetic oligonucleotide
ttggaccgcggcggacatggagg

SEQ ID NO: 15879 - DNA, 22 bp, Artificial Sequence
  Description of Artificial Sequence: Synthetic oligonucleotide
tggaccgcggcggacatggagg

SEQ ID NO: 15880 - DNA, 21 bp, Artificial Sequence
  Description of Artificial Sequence: Synthetic oligonucleotide
ggaccgcggcggacatggagg

SEQ ID NO: 15881 - DNA, 22 bp, Artificial Sequence
  Description of Artificial Sequence: Synthetic oligonucleotide
gaccgcggcggacatggaggct

SEQ ID NO: 15882 - DNA, 23 bp, Artificial Sequence
  Description of Artificial Sequence: Synthetic oligonucleotide
accgcggcggacatggaggctca

SEQ ID NO: 15883 - DNA, 22 bp, Artificial Sequence
  Description of Artificial Sequence: Synthetic oligonucleotide
ccgcggcggacatggaggctca

SEQ ID NO: 15884 - DNA, 24 bp, Artificial Sequence
  Description of Artificial Sequence: Synthetic oligonucleotide
cgcggcggacatggaggctcagat

SEQ ID NO: 15885 - DNA, 25 bp, Artificial Sequence
  Description of Artificial Sequence: Synthetic oligonucleotide
gcggcggacatggaggctcagatca

SEQ ID NO: 15886 - DNA, 25 bp, Artificial Sequence
  Description of Artificial Sequence: Synthetic oligonucleotide
cggcggacatggaggctcagatcac

SEQ ID NO: 15887 - DNA, 27 bp, Artificial Sequence
  Description of Artificial Sequence: Synthetic oligonucleotide
ggcggacatggaggctcagatcaccaa

SEQ ID NO: 15888 - DNA, 27 bp, Artificial Sequence
  Description of Artificial Sequence: Synthetic oligonucleotide
gcggacatggaggctcagatcaccaag

SEQ ID NO: 15889 - DNA, 27 bp, Artificial Sequence
  Description of Artificial Sequence: Synthetic oligonucleotide
cggacatggaggctcagatcaccaagc

SEQ ID NO: 15890 - DNA, 27 bp, Artificial Sequence
  Description of Artificial Sequence: Synthetic oligonucleotide
ggacatggaggctcagatcaccaagcg

SEQ ID NO: 15891 - DNA, 27 bp, Artificial Sequence
  Description of Artificial Sequence: Synthetic oligonucleotide
gacatggaggctcagatcaccaagcgc

SEQ ID NO: 15892 - DNA, 29 bp, Artificial Sequence
  Description of Artificial Sequence: Synthetic oligonucleotide
acatggaggctcagatcaccaagcgcaag

SEQ ID NO: 15893 - DNA, 28 bp, Artificial Sequence
  Description of Artificial Sequence: Synthetic oligonucleotide
catggaggctcagatcaccaagcgcaag

SEQ ID NO: 15894 - DNA, 29 bp, Artificial Sequence
  Description of Artificial Sequence: Synthetic oligonucleotide
atggaggctcagatcaccaagcgcaagtg

SEQ ID NO: 15895 - DNA, 28 bp, Artificial Sequence
  Description of Artificial Sequence: Synthetic oligonucleotide
tggaggctcagatcaccaagcgcaagtg

SEQ ID NO: 15896 - DNA, 27 bp, Artificial Sequence
  Description of Artificial Sequence: Synthetic oligonucleotide
ggaggctcagatcaccaagcgcaagtg

SEQ ID NO: 15897 - DNA, 27 bp, Artificial Sequence
  Description of Artificial Sequence: Synthetic oligonucleotide
gaggctcagatcaccaagcgcaagtgg

SEQ ID NO: 15898 - DNA, 27 bp, Artificial Sequence
  Description of Artificial Sequence: Synthetic oligonucleotide
aggctcagatcaccaagcgcaagtggg

SEQ ID NO: 15899 - DNA, 30 bp, Artificial Sequence
  Description of Artificial Sequence: Synthetic oligonucleotide
gctcccactccatgaggtatttctccatgg

SEQ ID NO: 15900 - DNA, 30 bp, Artificial Sequence
  Description of Artificial Sequence: Synthetic oligonucleotide
ctcccactccatgaggtatttctccatggg

SEQ ID NO: 15901 - DNA, 31 bp, Artificial Sequence
  Description of Artificial Sequence: Synthetic oligonucleotide
tcccactccatgaggtatttctccatgggtg

SEQ ID NO: 15902 - DNA, 30 bp, Artificial Sequence
  Description of Artificial Sequence: Synthetic oligonucleotide
cccactccatgaggtatttctccatgggtg

SEQ ID NO: 15903 - DNA, 31 bp, Artificial Sequence
  Description of Artificial Sequence: Synthetic oligonucleotide
ccactccatgaggtatttctccatgggtgtc

SEQ ID NO: 15904 - DNA, 31 bp, Artificial Sequence
  Description of Artificial Sequence: Synthetic oligonucleotide
cactccatgaggtatttctccatgggtgtcc

SEQ ID NO: 15905 - DNA, 31 bp, Artificial Sequence
  Description of Artificial Sequence: Synthetic oligonucleotide
actccatgaggtatttctccatgggtgtccc

SEQ ID NO: 15906 - DNA, 30 bp, Artificial Sequence
  Description of Artificial Sequence: Synthetic oligonucleotide
ctccatgaggtatttctccatgggtgtccc

SEQ ID NO: 15907 - DNA, 30 bp, Artificial Sequence
  Description of Artificial Sequence: Synthetic oligonucleotide
tccatgaggtatttctccatgggtgtcccg

SEQ ID NO: 15908 - DNA, 29 bp, Artificial Sequence
  Description of Artificial Sequence: Synthetic oligonucleotide
ccatgaggtatttctccatgggtgtcccg

SEQ ID NO: 15909 - DNA, 29 bp, Artificial Sequence
  Description of Artificial Sequence: Synthetic oligonucleotide
catgaggtatttctccatgggtgtcccgg

SEQ ID NO: 15910 - DNA, 29 bp, Artificial Sequence
  Description of Artificial Sequence: Synthetic oligonucleotide
atgaggtatttctccatgggtgtcccggc

SEQ ID NO: 15911 - DNA, 28 bp, Artificial Sequence
  Description of Artificial Sequence: Synthetic oligonucleotide
tgaggtatttctccatgggtgtcccggc

SEQ ID NO: 15912 - DNA, 27 bp, Artificial Sequence
  Description of Artificial Sequence: Synthetic oligonucleotide
gaggtatttctccatgggtgtcccggc

SEQ ID NO: 15913 - DNA, 27 bp, Artificial Sequence
  Description of Artificial Sequence: Synthetic oligonucleotide
aggtatttctccatgggtgtcccggcc

SEQ ID NO: 15914 - DNA, 26 bp, Artificial Sequence
  Description of Artificial Sequence: Synthetic oligonucleotide
ggtatttctccatgggtgtcccggcc

SEQ ID NO: 15915 - DNA, 26 bp, Artificial Sequence
  Description of Artificial Sequence: Synthetic oligonucleotide
gtatttctccatgggtgtcccggccc

SEQ ID NO: 15916 - DNA, 26 bp, Artificial Sequence
  Description of Artificial Sequence: Synthetic oligonucleotide
tatttctccatgggtgtcccggcccg

SEQ ID NO: 15917 - DNA, 25 bp, Artificial Sequence
  Description of Artificial Sequence: Synthetic oligonucleotide
atttctccatgggtgtcccggcccg

SEQ ID NO: 15918 - DNA, 24 bp, Artificial Sequence
  Description of Artificial Sequence: Synthetic oligonucleotide
tttctccatgggtgtcccggcccg

SEQ ID NO: 15919 - DNA, 23 bp, Artificial Sequence
  Description of Artificial Sequence: Synthetic oligonucleotide
ttctccatgggtgtcccggcccg

SEQ ID NO: 15920 - DNA, 22 bp, Artificial Sequence
  Description of Artificial Sequence: Synthetic oligonucleotide
tctccatgggtgtcccggcccg

SEQ ID NO: 15921 - DNA, 21 bp, Artificial Sequence
  Description of Artificial Sequence: Synthetic oligonucleotide
ctccatgggtgtcccggcccg

SEQ ID NO: 15922 - DNA, 21 bp, Artificial Sequence
  Description of Artificial Sequence: Synthetic oligonucleotide
tccatgggtgtcccggcccgg

SEQ ID NO: 15923 - DNA, 20 bp, Artificial Sequence
  Description of Artificial Sequence: Synthetic oligonucleotide
ccatgggtgtcccggcccgg

SEQ ID NO: 15924 - DNA, 20 bp, Artificial Sequence
  Description of Artificial Sequence: Synthetic oligonucleotide
catgggtgtcccggcccggc

SEQ ID NO: 15925 - DNA, 20 bp, Artificial Sequence
  Description of Artificial Sequence: Synthetic oligonucleotide
atgggtgtcccggcccggcc

SEQ ID NO: 15926 - DNA, 20 bp, Artificial Sequence
  Description of Artificial Sequence: Synthetic oligonucleotide
tgggtgtcccggcccggcct

SEQ ID NO: 15927 - DNA, 20 bp, Artificial Sequence
  Description of Artificial Sequence: Synthetic oligonucleotide
gggtgtcccggcccggcctt

SEQ ID NO: 15928 - DNA, 20 bp, Artificial Sequence
  Description of Artificial Sequence: Synthetic oligonucleotide
ggtgtcccggcccggccgtt

SEQ ID NO: 15929 - DNA, 24 bp, Artificial Sequence
  Description of Artificial Sequence: Synthetic oligonucleotide
gccgtggatagagcaggaggggct

SEQ ID NO: 15930 - DNA, 24 bp, Artificial Sequence
  Description of Artificial Sequence: Synthetic oligonucleotide
ccgtggatagagcaggaggggctg

SEQ ID NO: 15931 - DNA, 25 bp, Artificial Sequence
  Description of Artificial Sequence: Synthetic oligonucleotide
cgtggatagagcaggaggggctgga

SEQ ID NO: 15932 - DNA, 27 bp, Artificial Sequence
  Description of Artificial Sequence: Synthetic oligonucleotide
gtggatagagcaggaggggctggagta

SEQ ID NO: 15933 - DNA, 29 bp, Artificial Sequence
  Description of Artificial Sequence: Synthetic oligonucleotide
tggatagagcaggaggggctggagtattg

SEQ ID NO: 15934 - DNA, 28 bp, Artificial Sequence
  Description of Artificial Sequence: Synthetic oligonucleotide
ggatagagcaggaggggctggagtattg

SEQ ID NO: 15935 - DNA, 28 bp, Artificial Sequence
  Description of Artificial Sequence: Synthetic oligonucleotide
gatagagcaggaggggctggagtattgg

SEQ ID NO: 15936 - DNA, 28 bp, Artificial Sequence
  Description of Artificial Sequence: Synthetic oligonucleotide
atagagcaggaggggctggagtattggg

SEQ ID NO: 15937 - DNA, 27 bp, Artificial Sequence
  Description of Artificial Sequence: Synthetic oligonucleotide
tagagcaggaggggctggagtattggg

SEQ ID NO: 15938 - DNA, 27 bp, Artificial Sequence
  Description of Artificial Sequence: Synthetic oligonucleotide
agagcaggaggggctggagtattggga

SEQ ID NO: 15939 - DNA, 26 bp, Artificial Sequence
  Description of Artificial Sequence: Synthetic oligonucleotide
gagcaggaggggctggagtattggga

SEQ ID NO: 15940 - DNA, 26 bp, Artificial Sequence
  Description of Artificial Sequence: Synthetic oligonucleotide
agcaggaggggctggagtattgggac

SEQ ID NO: 15941 - DNA, 25 bp, Artificial Sequence
  Description of Artificial Sequence: Synthetic oligonucleotide
gcaggaggggctggagtattgggac

SEQ ID NO: 15942 - DNA, 26 bp, Artificial Sequence
  Description of Artificial Sequence: Synthetic oligonucleotide
caggaggggctggagtattgggacga

SEQ ID NO: 15943 - DNA, 26 bp, Artificial Sequence
  Description of Artificial Sequence: Synthetic oligonucleotide
aggaggggctggagtattgggacgag

SEQ ID NO: 15944 - DNA, 25 bp, Artificial Sequence
  Description of Artificial Sequence: Synthetic oligonucleotide
ggaggggctggagtattgggacgag

SEQ ID NO: 15945 - DNA, 26 bp, Artificial Sequence
  Description of Artificial Sequence: Synthetic oligonucleotide
gaggggctggagtattgggacgagga

SEQ ID NO: 15946 - DNA, 27 bp, Artificial Sequence
  Description of Artificial Sequence: Synthetic oligonucleotide
aggggctggagtattgggacgaggaga

SEQ ID NO: 15947 - DNA, 26 bp, Artificial Sequence
  Description of Artificial Sequence: Synthetic oligonucleotide
ggggctggagtattgggacgaggaga

SEQ ID NO: 15948 - DNA, 27 bp, Artificial Sequence
  Description of Artificial Sequence: Synthetic oligonucleotide
gggctggagtattgggacgaggagaca

SEQ ID NO: 15949 - DNA, 27 bp, Artificial Sequence
  Description of Artificial Sequence: Synthetic oligonucleotide
ggctggagtattgggacgaggagacag

SEQ ID NO: 15950 - DNA, 27 bp, Artificial Sequence
  Description of Artificial Sequence: Synthetic oligonucleotide
gctggagtattgggacgaggagacagg

SEQ ID NO: 15951 - DNA, 27 bp, Artificial Sequence
  Description of Artificial Sequence: Synthetic oligonucleotide
ctggagtattgggacgaggagacaggg

SEQ ID NO: 15952 - DNA, 30 bp, Artificial Sequence
  Description of Artificial Sequence: Synthetic oligonucleotide
tggagtattgggacgaggagacagggaaag

SEQ ID NO: 15953 - DNA, 23 bp, Artificial Sequence
  Description of Artificial Sequence: Synthetic oligonucleotide
tgggaggcggcccatgtggcgta

SEQ ID NO: 15954 - DNA, 22 bp, Artificial Sequence
  Description of Artificial Sequence: Synthetic oligonucleotide
gggaggcggcccatgtggcgta

SEQ ID NO: 15955 - DNA, 22 bp, Artificial Sequence
  Description of Artificial Sequence: Synthetic oligonucleotide
ggaggcggcccatgtggcgtag

SEQ ID NO: 15956 - DNA, 23 bp, Artificial Sequence
  Description of Artificial Sequence: Synthetic oligonucleotide
gaggcggcccatgtggcgtagca

SEQ ID NO: 15957 - DNA, 23 bp, Artificial Sequence
  Description of Artificial Sequence: Synthetic oligonucleotide
aggcggcccatgtggcgtagcag

SEQ ID NO: 15958 - DNA, 22 bp, Artificial Sequence
  Description of Artificial Sequence: Synthetic oligonucleotide
ggcggcccatgtggcgtagcag

SEQ ID NO: 15959 - DNA, 23 bp, Artificial Sequence
  Description of Artificial Sequence: Synthetic oligonucleotide
gcggcccatgtggcgtagcagca

SEQ ID NO: 15960 - DNA, 24 bp, Artificial Sequence
  Description of Artificial Sequence: Synthetic oligonucleotide
cggcccatgtggcgtagcagcaga

SEQ ID NO: 15961 - DNA, 25 bp, Artificial Sequence
  Description of Artificial Sequence: Synthetic oligonucleotide
ggcccatgtggcgtagcagcagaga

SEQ ID NO: 15962 - DNA, 25 bp, Artificial Sequence
  Description of Artificial Sequence: Synthetic oligonucleotide
gcccatgtggcgtagcagcagagag

SEQ ID NO: 15963 - DNA, 25 bp, Artificial Sequence
  Description of Artificial Sequence: Synthetic oligonucleotide
cccatgtggcgtagcagcagagagc

SEQ ID NO: 15964 - DNA, 27 bp, Artificial Sequence
  Description of Artificial Sequence: Synthetic oligonucleotide
ccatgtggcgtagcagcagagagccta

SEQ ID NO: 15965 - DNA, 27 bp, Artificial Sequence
  Description of Artificial Sequence: Synthetic oligonucleotide
catgtggcgtagcagcagagagcctac

SEQ ID NO: 15966 - DNA, 27 bp, Artificial Sequence
  Description of Artificial Sequence: Synthetic oligonucleotide
atgtggcgtagcagcagagagcctacc

SEQ ID NO: 15967 - DNA, 27 bp, Artificial Sequence
  Description of Artificial Sequence: Synthetic oligonucleotide
tgtggcgtagcagcagagagcctacct

SEQ ID NO: 15968 - DNA, 26 bp, Artificial Sequence
  Description of Artificial Sequence: Synthetic oligonucleotide
gtggcgtagcagcagagagcctacct

SEQ ID NO: 15969 - DNA, 26 bp, Artificial Sequence
  Description of Artificial Sequence: Synthetic oligonucleotide
tggcgtagcagcagagagcctacctg

SEQ ID NO: 15970 - DNA, 25 bp, Artificial Sequence
  Description of Artificial Sequence: Synthetic oligonucleotide
ggcgtagcagcagagagcctacctg

SEQ ID NO: 15971 - DNA, 26 bp, Artificial Sequence
  Description of Artificial Sequence: Synthetic oligonucleotide
gcgtagcagcagagagcctacctgga

SEQ ID NO: 15972 - DNA, 26 bp, Artificial Sequence
  Description of Artificial Sequence: Synthetic oligonucleotide
cgtagcagcagagagcctacctggag

SEQ ID NO: 15973 - DNA, 26 bp, Artificial Sequence
  Description of Artificial Sequence: Synthetic oligonucleotide
gtagcagcagagagcctacctggagg

SEQ ID NO: 15974 - DNA, 26 bp, Artificial Sequence
  Description of Artificial Sequence: Synthetic oligonucleotide
tagcagcagagagcctacctggaggg

SEQ ID NO: 15975 - DNA, 27 bp, Artificial Sequence
  Description of Artificial Sequence: Synthetic oligonucleotide
cttcatcgccgtgggctacgtggacta

SEQ ID NO: 15976 - DNA, 27 bp, Artificial Sequence
  Description of Artificial Sequence: Synthetic oligonucleotide
ttcatcgccgtgggctacgtggactac

SEQ ID NO: 15977 - DNA, 27 bp, Artificial Sequence
  Description of Artificial Sequence: Synthetic oligonucleotide
tcatcgccgtgggctacgtggactaca

SEQ ID NO: 15978 - DNA, 26 bp, Artificial Sequence
  Description of Artificial Sequence: Synthetic oligonucleotide
catcgccgtgggctacgtggactaca

SEQ ID NO: 15979 - DNA, 26 bp, Artificial Sequence
  Description of Artificial Sequence: Synthetic oligonucleotide
atcgccgtgggctacgtggactacac

SEQ ID NO: 15980 - DNA, 25 bp, Artificial Sequence
  Description of Artificial Sequence: Synthetic oligonucleotide
tcgccgtgggctacgtggactacac

SEQ ID NO: 15981 - DNA, 24 bp, Artificial Sequence
  Description of Artificial Sequence: Synthetic oligonucleotide
cgccgtgggctacgtggactacac

SEQ ID NO: 15982 - DNA, 24 bp, Artificial Sequence
  Description of Artificial Sequence: Synthetic oligonucleotide
gccgtgggctacgtggactacacg

SEQ ID NO: 15983 - DNA, 25 bp, Artificial Sequence
  Description of Artificial Sequence: Synthetic oligonucleotide
ccgtgggctacgtggactacacgca

SEQ ID NO: 15984 - DNA, 27 bp, Artificial Sequence
  Description of Artificial Sequence: Synthetic oligonucleotide
cgtgggctacgtggactacacgcagtt

SEQ ID NO: 15985 - DNA, 27 bp, Artificial Sequence
  Description of Artificial Sequence: Synthetic oligonucleotide
gtgggctacgtggactacacgcagttc

SEQ ID NO: 15986 - DNA, 27 bp, Artificial Sequence
  Description of Artificial Sequence: Synthetic oligonucleotide
tgggctacgtggactacacgcagttcg

SEQ ID NO: 15987 - DNA, 27 bp, Artificial Sequence
  Description of Artificial Sequence: Synthetic oligonucleotide
gggctacgtggactacacgcagttcgt

SEQ ID NO: 15988 - DNA, 27 bp, Artificial Sequence
  Description of Artificial Sequence: Synthetic oligonucleotide
ggctacgtggactacacgcagttcgtg

SEQ ID NO: 15989 - DNA, 27 bp, Artificial Sequence
  Description of Artificial Sequence: Synthetic oligonucleotide
gctacgtggactacacgcagttcgtgc

SEQ ID NO: 15990 - DNA, 27 bp, Artificial Sequence
  Description of Artificial Sequence: Synthetic oligonucleotide
ctacgtggactacacgcagttcgtgcg

SEQ ID NO: 15991 - DNA, 27 bp, Artificial Sequence
  Description of Artificial Sequence: Synthetic oligonucleotide
tacgtggactacacgcagttcgtgcgg

SEQ ID NO: 15992 - DNA, 27 bp, Artificial Sequence
  Description of Artificial Sequence: Synthetic oligonucleotide
acgtggactacacgcagttcgtgcggt

SEQ ID NO: 15993 - DNA, 27 bp, Artificial Sequence
  Description of Artificial Sequence: Synthetic oligonucleotide
cgtggactacacgcagttcgtgcggtt

SEQ ID NO: 15994 - DNA, 27 bp, Artificial Sequence
  Description of Artificial Sequence: Synthetic oligonucleotide
gtggactacacgcagttcgtgcggttc

SEQ ID NO: 15995 - DNA, 27 bp, Artificial Sequence
  Description of Artificial Sequence: Synthetic oligonucleotide
tggactacacgcagttcgtgcggttcg

SEQ ID NO: 15996 - DNA, 27 bp, Artificial Sequence
  Description of Artificial Sequence: Synthetic oligonucleotide
ggactacacgcagttcgtgcggttcga

SEQ ID NO: 15997 - DNA, 27 bp, Artificial Sequence
  Description of Artificial Sequence: Synthetic oligonucleotide
gactacacgcagttcgtgcggttcgac

SEQ ID NO: 15998 - DNA, 28 bp, Artificial Sequence
  Description of Artificial Sequence: Synthetic oligonucleotide
actacacgcagttcgtgcggttcgacag

SEQ ID NO: 15999 - DNA, 27 bp, Artificial Sequence
  Description of Artificial Sequence: Synthetic oligonucleotide
ctacacgcagttcgtgcggttcgacag

SEQ ID NO: 16000 - DNA, 27 bp, Artificial Sequence
  Description of Artificial Sequence: Synthetic oligonucleotide
tacacgcagttcgtgcggttcgacagc

SEQ ID NO: 16001 - DNA, 27 bp, Artificial Sequence
  Description of Artificial Sequence: Synthetic oligonucleotide
gaggccggttctcacaccctccagata

SEQ ID NO: 16002 - DNA, 29 bp, Artificial Sequence
  Description of Artificial Sequence: Synthetic oligonucleotide
aggccggttctcacaccctccagataatg

SEQ ID NO: 16003 - DNA, 28 bp, Artificial Sequence
  Description of Artificial Sequence: Synthetic oligonucleotide
ggccggttctcacaccctccagataatg

SEQ ID NO: 16004 - DNA, 31 bp, Artificial Sequence
  Description of Artificial Sequence: Synthetic oligonucleotide
gccggttctcacaccctccagataatgtatg

SEQ ID NO: 16005 - DNA, 31 bp, Artificial Sequence
  Description of Artificial Sequence: Synthetic oligonucleotide
ccggttctcacaccctccagataatgtatgg

SEQ ID NO: 16006 - DNA, 31 bp, Artificial Sequence
  Description of Artificial Sequence: Synthetic oligonucleotide
cggttctcacaccctccagataatgtatggc

SEQ ID NO: 16007 - DNA, 32 bp, Artificial Sequence
  Description of Artificial Sequence: Synthetic oligonucleotide
ggttctcacaccctccagataatgtatggctg

SEQ ID NO: 16008 - DNA, 32 bp, Artificial Sequence
  Description of Artificial Sequence: Synthetic oligonucleotide
gttctcacaccctccagataatgtatggctgc

SEQ ID NO: 16009 - DNA, 32 bp, Artificial Sequence
  Description of Artificial Sequence: Synthetic oligonucleotide
ttctcacaccctccagataatgtatggctgcg

SEQ ID NO: 16010 - DNA, 31 bp, Artificial Sequence
  Description of Artificial Sequence: Synthetic oligonucleotide
tctcacaccctccagataatgtatggctgcg

SEQ ID NO: 16011 - DNA, 30 bp, Artificial Sequence
  Description of Artificial Sequence: Synthetic oligonucleotide
ctcacaccctccagataatgtatggctgcg

SEQ ID NO: 16012 - DNA, 31 bp, Artificial Sequence
  Description of Artificial Sequence: Synthetic oligonucleotide
tcacaccctccagataatgtatggctgcgac

SEQ ID NO: 16013 - DNA, 30 bp, Artificial Sequence
  Description of Artificial Sequence: Synthetic oligonucleotide
cacaccctccagataatgtatggctgcgac

SEQ ID NO: 16014 - DNA, 30 bp, Artificial Sequence
  Description of Artificial Sequence: Synthetic oligonucleotide
acaccctccagataatgtatggctgcgacg

SEQ ID NO: 16015 - DNA, 29 bp, Artificial Sequence
  Description of Artificial Sequence: Synthetic oligonucleotide
caccctccagataatgtatggctgcgacg

SEQ ID NO: 16016 - DNA, 30 bp, Artificial Sequence
  Description of Artificial Sequence: Synthetic oligonucleotide
accctccagataatgtatggctgcgacgtg

SEQ ID NO: 16017 - DNA, 29 bp, Artificial Sequence
  Description of Artificial Sequence: Synthetic oligonucleotide
ccctccagataatgtatggctgcgacgtg

SEQ ID NO: 16018 - DNA, 29 bp, Artificial Sequence
  Description of Artificial Sequence: Synthetic oligonucleotide
cctccagataatgtatggctgcgacgtgg

SEQ ID NO: 16019 - DNA, 29 bp, Artificial Sequence
  Description of Artificial Sequence: Synthetic oligonucleotide
ctccagataatgtatggctgcgacgtggg

SEQ ID NO: 16020 - DNA, 29 bp, Artificial Sequence
  Description of Artificial Sequence: Synthetic oligonucleotide
cggttctcacaccctccagaggatgtttg

SEQ ID NO: 16021 - DNA, 29 bp, Artificial Sequence
  Description of Artificial Sequence: Synthetic oligonucleotide
ggttctcacaccctccagaggatgtttgg

SEQ ID NO: 16022 - DNA, 29 bp, Artificial Sequence
  Description of Artificial Sequence: Synthetic oligonucleotide
gttctcacaccctccagaggatgtttggc

SEQ ID NO: 16023 - DNA, 30 bp, Artificial Sequence
  Description of Artificial Sequence: Synthetic oligonucleotide
ttctcacaccctccagaggatgtttggctg

SEQ ID NO: 16024 - DNA, 29 bp, Artificial Sequence
  Description of Artificial Sequence: Synthetic oligonucleotide
tctcacaccctccagaggatgtttggctg

SEQ ID NO: 16025 - DNA, 28 bp, Artificial Sequence
  Description of Artificial Sequence: Synthetic oligonucleotide
ctcacaccctccagaggatgtttggctg

SEQ ID NO: 16026 - DNA, 28 bp, Artificial Sequence
  Description of Artificial Sequence: Synthetic oligonucleotide
tcacaccctccagaggatgtttggctgc

SEQ ID NO: 16027 - DNA, 27 bp, Artificial Sequence
  Description of Artificial Sequence: Synthetic oligonucleotide
cacaccctccagaggatgtttggctgc

SEQ ID NO: 16028 - DNA, 27 bp, Artificial Sequence
  Description of Artificial Sequence: Synthetic oligonucleotide
acaccctccagaggatgtttggctgcg

SEQ ID NO: 16029 - DNA, 27 bp, Artificial Sequence
  Description of Artificial Sequence: Synthetic oligonucleotide
caccctccagaggatgtttggctgcga

SEQ ID NO: 16030 - DNA, 27 bp, Artificial Sequence
  Description of Artificial Sequence: Synthetic oligonucleotide
accctccagaggatgtttggctgcgac

SEQ ID NO: 16031 - DNA, 26 bp, Artificial Sequence
  Description of Artificial Sequence: Synthetic oligonucleotide
ccctccagaggatgtttggctgcgac

SEQ ID NO: 16032 - DNA, 27 bp, Artificial Sequence
  Description of Artificial Sequence: Synthetic oligonucleotide
cctccagaggatgtttggctgcgacgt

SEQ ID NO: 16033 - DNA, 27 bp, Artificial Sequence
  Description of Artificial Sequence: Synthetic oligonucleotide
ctccagaggatgtttggctgcgacgtg

SEQ ID NO: 16034 - DNA, 24 bp, Artificial Sequence
  Description of Artificial Sequence: Synthetic oligonucleotide
cccatgtggcggagcagcagagac

SEQ ID NO: 16035 - DNA, 24 bp, Artificial Sequence
  Description of Artificial Sequence: Synthetic oligonucleotide
ccatgtggcggagcagcagagacc

SEQ ID NO: 16036 - DNA, 26 bp, Artificial Sequence
  Description of Artificial Sequence: Synthetic oligonucleotide
catgtggcggagcagcagagacccta

SEQ ID NO: 16037 - DNA, 26 bp, Artificial Sequence
  Description of Artificial Sequence: Synthetic oligonucleotide
atgtggcggagcagcagagaccctac

SEQ ID NO: 16038 - DNA, 25 bp, Artificial Sequence
  Description of Artificial Sequence: Synthetic oligonucleotide
tgtggcggagcagcagagaccctac

SEQ ID NO: 16039 - DNA, 24 bp, Artificial Sequence
  Description of Artificial Sequence: Synthetic oligonucleotide
gtggcggagcagcagagaccctac

SEQ ID NO: 16040 - DNA, 25 bp, Artificial Sequence
  Description of Artificial Sequence: Synthetic oligonucleotide
tggcggagcagcagagaccctacct

SEQ ID NO: 16041 - DNA, 24 bp, Artificial Sequence
  Description of Artificial Sequence: Synthetic oligonucleotide
ggcggagcagcagagaccctacct

SEQ ID NO: 16042 - DNA, 24 bp, Artificial Sequence
  Description of Artificial Sequence: Synthetic oligonucleotide
gcggagcagcagagaccctacctg

SEQ ID NO: 16043 - DNA, 25 bp, Artificial Sequence
  Description of Artificial Sequence: Synthetic oligonucleotide
cggagcagcagagaccctacctgga

SEQ ID NO: 16044 - DNA, 25 bp, Artificial Sequence
  Description of Artificial Sequence: Synthetic oligonucleotide
ggagcagcagagaccctacctggag

SEQ ID NO: 16045 - DNA, 25 bp, Artificial Sequence
  Description of Artificial Sequence: Synthetic oligonucleotide
gagcagcagagaccctacctggagg

SEQ ID NO: 16046 - DNA, 25 bp, Artificial Sequence
  Description of Artificial Sequence: Synthetic oligonucleotide
agcagcagagaccctacctggaggg

SEQ ID NO: 16047 - DNA, 24 bp, Artificial Sequence
  Description of Artificial Sequence: Synthetic oligonucleotide
gcagcagagaccctacctggaggg

SEQ ID NO: 16048 - DNA, 25 bp, Artificial Sequence
  Description of Artificial Sequence: Synthetic oligonucleotide
cagcagagaccctacctggagggca

SEQ ID NO: 16049 - DNA, 25 bp, Artificial Sequence
  Description of Artificial Sequence: Synthetic oligonucleotide
agcagagaccctacctggagggcac

SEQ ID NO: 16050 - DNA, 24 bp, Artificial Sequence
  Description of Artificial Sequence: Synthetic oligonucleotide
gcagagaccctacctggagggcac

SEQ ID NO: 16051 - DNA, 25 bp, Artificial Sequence
  Description of Artificial Sequence: Synthetic oligonucleotide
cagagaccctacctggagggcacgt

SEQ ID NO: 16052 - DNA, 25 bp, Artificial Sequence
  Description of Artificial Sequence: Synthetic oligonucleotide
agagaccctacctggagggcacgtg

SEQ ID NO: 16053 - DNA, 24 bp, Artificial Sequence
  Description of Artificial Sequence: Synthetic oligonucleotide
gagaccctacctggagggcacgtg

SEQ ID NO: 16054 - DNA, 24 bp, Artificial Sequence
  Description of Artificial Sequence: Synthetic oligonucleotide
agaccctacctggagggcacgtgc

SEQ ID NO: 16055 - DNA, 23 bp, Artificial Sequence
  Description of Artificial Sequence: Synthetic oligonucleotide
gaccctacctggagggcacgtgc

SEQ ID NO: 16056 - DNA, 24 bp, Artificial Sequence
  Description of Artificial Sequence: Synthetic oligonucleotide
accctacctggagggcacgtgcgt

SEQ ID NO: 16057 - DNA, 23 bp, Artificial Sequence
  Description of Artificial Sequence: Synthetic oligonucleotide
ccctacctggagggcacgtgcgt

SEQ ID NO: 16058 - DNA, 25 bp, Artificial Sequence
  Description of Artificial Sequence: Synthetic oligonucleotide
agcagagagcctacctggagggcga

SEQ ID NO: 16059 - DNA, 24 bp, Artificial Sequence
  Description of Artificial Sequence: Synthetic oligonucleotide
gcagagagcctacctggagggcga

SEQ ID NO: 16060 - DNA, 25 bp, Artificial Sequence
  Description of Artificial Sequence: Synthetic oligonucleotide
cagagagcctacctggagggcgagt

SEQ ID NO: 16061 - DNA, 25 bp, Artificial Sequence
  Description of Artificial Sequence: Synthetic oligonucleotide
agagagcctacctggagggcgagtg

SEQ ID NO: 16062 - DNA, 24 bp, Artificial Sequence
  Description of Artificial Sequence: Synthetic oligonucleotide
tacctggagggcgagtgcgtggac

SEQ ID NO: 16063 - DNA, 23 bp, Artificial Sequence
  Description of Artificial Sequence: Synthetic oligonucleotide
acctggagggcgagtgcgtggac

SEQ ID NO: 16064 - DNA, 22 bp, Artificial Sequence
  Description of Artificial Sequence: Synthetic oligonucleotide
cctggagggcgagtgcgtggac

SEQ ID NO: 16065 - DNA, 22 bp, Artificial Sequence
  Description of Artificial Sequence: Synthetic oligonucleotide
ctggagggcgagtgcgtggacg

SEQ ID NO: 16066 - DNA, 22 bp, Artificial Sequence
  Description of Artificial Sequence: Synthetic oligonucleotide
tggagggcgagtgcgtggacgg

SEQ ID NO: 16067 - DNA, 21 bp, Artificial Sequence
  Description of Artificial Sequence: Synthetic oligonucleotide
ggagggcgagtgcgtggacgg

SEQ ID NO: 16068 - DNA, 21 bp, Artificial Sequence
  Description of Artificial Sequence: Synthetic oligonucleotide
gagggcgagtgcgtggacggg

SEQ ID NO: 16069 - DNA, 22 bp, Artificial Sequence
  Description of Artificial Sequence: Synthetic oligonucleotide
agggcgagtgcgtggacgggct

SEQ ID NO: 16070 - DNA, 21 bp, Artificial Sequence
  Description of Artificial Sequence: Synthetic oligonucleotide
gggcgagtgcgtggacgggct

SEQ ID NO: 16071 - DNA, 21 bp, Artificial Sequence
  Description of Artificial Sequence: Synthetic oligonucleotide
ggcgagtgcgtggacgggctc

SEQ ID NO: 16072 - DNA, 21 bp, Artificial Sequence
  Description of Artificial Sequence: Synthetic oligonucleotide
gcgagtgcgtggacgggctcc

SEQ ID NO: 16073 - DNA, 21 bp, Artificial Sequence
  Description of Artificial Sequence: Synthetic oligonucleotide
cgagtgcgtggacgggctccg

SEQ ID NO: 16074 - DNA, 22 bp, Artificial Sequence
  Description of Artificial Sequence: Synthetic oligonucleotide
gagtgcgtggacgggctccgca

SEQ ID NO: 16075 - DNA, 25 bp, Artificial Sequence
  Description of Artificial Sequence: Synthetic oligonucleotide
agtgcgtggacgggctccgcagata

SEQ ID NO: 16076 - DNA, 24 bp, Artificial Sequence
  Description of Artificial Sequence: Synthetic oligonucleotide
ggcgctgtggatagagcaggaggg

SEQ ID NO: 16077 - DNA, 24 bp, Artificial Sequence
  Description of Artificial Sequence: Synthetic oligonucleotide
gcgctgtggatagagcaggagggg

SEQ ID NO: 16078 - DNA, 24 bp, Artificial Sequence
  Description of Artificial Sequence: Synthetic oligonucleotide
cgctgtggatagagcaggaggggc

SEQ ID NO: 16079 - DNA, 24 bp, Artificial Sequence
  Description of Artificial Sequence: Synthetic oligonucleotide
gctgtggatagagcaggaggggcc

SEQ ID NO: 16080 - DNA, 24 bp, Artificial Sequence
  Description of Artificial Sequence: Synthetic oligonucleotide
ctgtggatagagcaggaggggccg

SEQ ID NO: 16081 - DNA, 25 bp, Artificial Sequence
  Description of Artificial Sequence: Synthetic oligonucleotide
tgtggatagagcaggaggggccgga

SEQ ID NO: 16082 - DNA, 30 bp, Artificial Sequence
  Description of Artificial Sequence: Synthetic oligonucleotide
gaaagtgaaggcccactcacagactgactg

SEQ ID NO: 16083 - DNA, 31 bp, Artificial Sequence
  Description of Artificial Sequence: Synthetic oligonucleotide
aaagtgaaggcccactcacagactgactgag

SEQ ID NO: 16084 - DNA, 30 bp, Artificial Sequence
  Description of Artificial Sequence: Synthetic oligonucleotide
aagtgaaggcccactcacagactgactgag

SEQ ID NO: 16085 - DNA, 29 bp, Artificial Sequence
  Description of Artificial Sequence: Synthetic oligonucleotide
agtgaaggcccactcacagactgactgag

SEQ ID NO: 16086 - DNA, 28 bp, Artificial Sequence
  Description of Artificial Sequence: Synthetic oligonucleotide
gtgaaggcccactcacagactgactgag

SEQ ID NO: 16087 - DNA, 29 bp, Artificial Sequence
  Description of Artificial Sequence: Synthetic oligonucleotide
tgaaggcccactcacagactgactgagag

SEQ ID NO: 16088 - DNA, 28 bp, Artificial Sequence
  Description of Artificial Sequence: Synthetic oligonucleotide
gaaggcccactcacagactgactgagag

SEQ ID NO: 16089 - DNA, 30 bp, Artificial Sequence
  Description of Artificial Sequence: Synthetic oligonucleotide
aaggcccactcacagactgactgagagaac

SEQ ID NO: 16090 - DNA, 29 bp, Artificial Sequence
  Description of Artificial Sequence: Synthetic oligonucleotide
aggcccactcacagactgactgagagaac

SEQ ID NO: 16091 - DNA, 28 bp, Artificial Sequence
  Description of Artificial Sequence: Synthetic oligonucleotide
ggcccactcacagactgactgagagaac

SEQ ID NO: 16092 - DNA, 28 bp, Artificial Sequence
  Description of Artificial Sequence: Synthetic oligonucleotide
gcccactcacagactgactgagagaacc

SEQ ID NO: 16093 - DNA, 29 bp, Artificial Sequence
  Description of Artificial Sequence: Synthetic oligonucleotide
cccactcacagactgactgagagaacctg

SEQ ID NO: 16094 - DNA, 29 bp, Artificial Sequence
  Description of Artificial Sequence: Synthetic oligonucleotide
ccactcacagactgactgagagaacctgc

SEQ ID NO: 16095 - DNA, 29 bp, Artificial Sequence
  Description of Artificial Sequence: Synthetic oligonucleotide
cactcacagactgactgagagaacctgcg

SEQ ID NO: 16096 - DNA, 29 bp, Artificial Sequence
  Description of Artificial Sequence: Synthetic oligonucleotide
actcacagactgactgagagaacctgcgg

SEQ ID NO: 16097 - DNA, 28 bp, Artificial Sequence
  Description of Artificial Sequence: Synthetic oligonucleotide
ctcacagactgactgagagaacctgcgg

SEQ ID NO: 16098 - DNA, 30 bp, Artificial Sequence
  Description of Artificial Sequence: Synthetic oligonucleotide
tcacagactgactgagagaacctgcggatc

SEQ ID NO: 16099 - DNA, 29 bp, Artificial Sequence
  Description of Artificial Sequence: Synthetic oligonucleotide
cacagactgactgagagaacctgcggatc

SEQ ID NO: 16100 - DNA, 29 bp, Artificial Sequence
  Description of Artificial Sequence: Synthetic oligonucleotide
acagactgactgagagaacctgcggatcg

SEQ ID NO: 16101 - DNA, 28 bp, Artificial Sequence
  Description of Artificial Sequence: Synthetic oligonucleotide
cagactgactgagagaacctgcggatcg

SEQ ID NO: 16102 - DNA, 28 bp, Artificial Sequence
  Description of Artificial Sequence: Synthetic oligonucleotide
agactgactgagagaacctgcggatcgc

SEQ ID NO: 16103 - DNA, 27 bp, Artificial Sequence
  Description of Artificial Sequence: Synthetic oligonucleotide
gactgactgagagaacctgcggatcgc

SEQ ID NO: 16104 - DNA, 27 bp, Artificial Sequence
  Description of Artificial Sequence: Synthetic oligonucleotide
actgactgagagaacctgcggatcgcg

SEQ ID NO: 16105 - DNA, 26 bp, Artificial Sequence
  Description of Artificial Sequence: Synthetic oligonucleotide
ctgactgagagaacctgcggatcgcg

SEQ ID NO: 16106 - DNA, 27 bp, Artificial Sequence
  Description of Artificial Sequence: Synthetic oligonucleotide
tgactgagagaacctgcggatcgcgct

SEQ ID NO: 16107 - DNA, 26 bp, Artificial Sequence
  Description of Artificial Sequence: Synthetic oligonucleotide
gactgagagaacctgcggatcgcgct

SEQ ID NO: 16108 - DNA, 26 bp, Artificial Sequence
  Description of Artificial Sequence: Synthetic oligonucleotide
actgagagaacctgcggatcgcgctc

SEQ ID NO: 16109 - DNA, 25 bp, Artificial Sequence
  Description of Artificial Sequence: Synthetic oligonucleotide
ctgagagaacctgcggatcgcgctc

SEQ ID NO: 16110 - DNA, 25 bp, Artificial Sequence
  Description of Artificial Sequence: Synthetic oligonucleotide
tgagagaacctgcggatcgcgctcc

SEQ ID NO: 16111 - DNA, 28 bp, Artificial Sequence
  Description of Artificial Sequence: Synthetic oligonucleotide
gcccactcacagactgaccgagagaaac

SEQ ID NO: 16112 - DNA, 29 bp, Artificial Sequence
  Description of Artificial Sequence: Synthetic oligonucleotide
cccactcacagactgaccgagagaaactg

SEQ ID NO: 16113 - DNA, 29 bp, Artificial Sequence
  Description of Artificial Sequence: Synthetic oligonucleotide
ccactcacagactgaccgagagaaactgc

SEQ ID NO: 16114 - DNA, 29 bp, Artificial Sequence
  Description of Artificial Sequence: Synthetic oligonucleotide
cactcacagactgaccgagagaaactgcg

SEQ ID NO: 16115 - DNA, 29 bp, Artificial Sequence
  Description of Artificial Sequence: Synthetic oligonucleotide
actcacagactgaccgagagaaactgcgg

SEQ ID NO: 16116 - DNA, 28 bp, Artificial Sequence
  Description of Artificial Sequence: Synthetic oligonucleotide
ctcacagactgaccgagagaaactgcgg

SEQ ID NO: 16117 - DNA, 30 bp, Artificial Sequence
  Description of Artificial Sequence: Synthetic oligonucleotide
tcacagactgaccgagagaaactgcggatc

SEQ ID NO: 16118 - DNA, 29 bp, Artificial Sequence
  Description of Artificial Sequence: Synthetic oligonucleotide
cacagactgaccgagagaaactgcggatc

SEQ ID NO: 16119 - DNA, 29 bp, Artificial Sequence
  Description of Artificial Sequence: Synthetic oligonucleotide
acagactgaccgagagaaactgcggatcg

SEQ ID NO: 16120 - DNA, 28 bp, Artificial Sequence
  Description of Artificial Sequence: Synthetic oligonucleotide
cagactgaccgagagaaactgcggatcg

SEQ ID NO: 16121 - DNA, 28 bp, Artificial Sequence
  Description of Artificial Sequence: Synthetic oligonucleotide
agactgaccgagagaaactgcggatcgc

SEQ ID NO: 16122 - DNA, 27 bp, Artificial Sequence
  Description of Artificial Sequence: Synthetic oligonucleotide
gactgaccgagagaaactgcggatcgc

SEQ ID NO: 16123 - DNA, 27 bp, Artificial Sequence
  Description of Artificial Sequence: Synthetic oligonucleotide
actgaccgagagaaactgcggatcgcg

SEQ ID NO: 16124 - DNA, 26 bp, Artificial Sequence
  Description of Artificial Sequence: Synthetic oligonucleotide
ctgaccgagagaaactgcggatcgcg

SEQ ID NO: 16125 - DNA, 27 bp, Artificial Sequence
  Description of Artificial Sequence: Synthetic oligonucleotide
tgaccgagagaaactgcggatcgcgct

SEQ ID NO: 16126 - DNA, 26 bp, Artificial Sequence
  Description of Artificial Sequence: Synthetic oligonucleotide
gaccgagagaaactgcggatcgcgct

SEQ ID NO: 16127 - DNA, 26 bp, Artificial Sequence
  Description of Artificial Sequence: Synthetic oligonucleotide
accgagagaaactgcggatcgcgctc

SEQ ID NO: 16128 - DNA, 25 bp, Artificial Sequence
  Description of Artificial Sequence: Synthetic oligonucleotide
ccgagagaaactgcggatcgcgctc

SEQ ID NO: 16129 - DNA, 25 bp, Artificial Sequence
  Description of Artificial Sequence: Synthetic oligonucleotide
cgagagaaactgcggatcgcgctcc

SEQ ID NO: 16130 - DNA, 25 bp, Artificial Sequence
  Description of Artificial Sequence: Synthetic oligonucleotide
gagagaaactgcggatcgcgctccg

SEQ ID NO: 16131 - DNA, 27 bp, Artificial Sequence
  Description of Artificial Sequence: Synthetic oligonucleotide
agagaaactgcggatcgcgctccgcta

SEQ ID NO: 16132 - DNA, 26 bp, Artificial Sequence
  Description of Artificial Sequence: Synthetic oligonucleotide
gagaaactgcggatcgcgctccgcta

SEQ ID NO: 16133 - DNA, 27 bp, Artificial Sequence
  Description of Artificial Sequence: Synthetic oligonucleotide
agaaactgcggatcgcgctccgctact

SEQ ID NO: 16134 - DNA, 27 bp, Artificial Sequence
  Description of Artificial Sequence: Synthetic oligonucleotide
gaaactgcggatcgcgctccgctacta

SEQ ID NO: 16135 - DNA, 27 bp, Artificial Sequence
  Description of Artificial Sequence: Synthetic oligonucleotide
aaactgcggatcgcgctccgctactac

SEQ ID NO: 16136 - DNA, 27 bp, Artificial Sequence
  Description of Artificial Sequence: Synthetic oligonucleotide
aactgcggatcgcgctccgctactaca

SEQ ID NO: 16137 - DNA, 27 bp, Artificial Sequence
  Description of Artificial Sequence: Synthetic oligonucleotide
actgcggatcgcgctccgctactacaa

SEQ ID NO: 16138 - DNA, 25 bp, Artificial Sequence
  Description of Artificial Sequence: Synthetic oligonucleotide
gaggccggttctcacaccctccagt

SEQ ID NO: 16139 - DNA, 25 bp, Artificial Sequence
  Description of Artificial Sequence: Synthetic oligonucleotide
aggccggttctcacaccctccagtg

SEQ ID NO: 16140 - DNA, 24 bp, Artificial Sequence
  Description of Artificial Sequence: Synthetic oligonucleotide
ggccggttctcacaccctccagtg

SEQ ID NO: 16141 - DNA, 26 bp, Artificial Sequence
  Description of Artificial Sequence: Synthetic oligonucleotide
gccggttctcacaccctccagtggat

SEQ ID NO: 16142 - DNA, 27 bp, Artificial Sequence
  Description of Artificial Sequence: Synthetic oligonucleotide
ccggttctcacaccctccagtggatga

SEQ ID NO: 16143 - DNA, 29 bp, Artificial Sequence
  Description of Artificial Sequence: Synthetic oligonucleotide
cggttctcacaccctccagtggatgattg

SEQ ID NO: 16144 - DNA, 29 bp, Artificial Sequence
  Description of Artificial Sequence: Synthetic oligonucleotide
ggttctcacaccctccagtggatgattgg

SEQ ID NO: 16145 - DNA, 29 bp, Artificial Sequence
  Description of Artificial Sequence: Synthetic oligonucleotide
gttctcacaccctccagtggatgattggc

SEQ ID NO: 16146 - DNA, 30 bp, Artificial Sequence
  Description of Artificial Sequence: Synthetic oligonucleotide
ttctcacaccctccagtggatgattggctg

SEQ ID NO: 16147 - DNA, 29 bp, Artificial Sequence
  Description of Artificial Sequence: Synthetic oligonucleotide
tctcacaccctccagtggatgattggctg

SEQ ID NO: 16148 - DNA, 28 bp, Artificial Sequence
  Description of Artificial Sequence: Synthetic oligonucleotide
ctcacaccctccagtggatgattggctg

SEQ ID NO: 16149 - DNA, 28 bp, Artificial Sequence
  Description of Artificial Sequence: Synthetic oligonucleotide
tcacaccctccagtggatgattggctgc

SEQ ID NO: 16150 - DNA, 27 bp, Artificial Sequence
  Description of Artificial Sequence: Synthetic oligonucleotide
cacaccctccagtggatgattggctgc

SEQ ID NO: 16151 - DNA, 27 bp, Artificial Sequence
  Description of Artificial Sequence: Synthetic oligonucleotide
acaccctccagtggatgattggctgcg

SEQ ID NO: 16152 - DNA, 27 bp, Artificial Sequence
  Description of Artificial Sequence: Synthetic oligonucleotide
caccctccagtggatgattggctgcga

SEQ ID NO: 16153 - DNA, 27 bp, Artificial Sequence
  Description of Artificial Sequence: Synthetic oligonucleotide
accctccagtggatgattggctgcgac

SEQ ID NO: 16154 - DNA, 26 bp, Artificial Sequence
  Description of Artificial Sequence: Synthetic oligonucleotide
ccctccagtggatgattggctgcgac

SEQ ID NO: 16155 - DNA, 27 bp, Artificial Sequence
  Description of Artificial Sequence: Synthetic oligonucleotide
cctccagtggatgattggctgcgacgt

SEQ ID NO: 16156 - DNA, 27 bp, Artificial Sequence
  Description of Artificial Sequence: Synthetic oligonucleotide
ctccagtggatgattggctgcgacgtg

SEQ ID NO: 16157 - DNA, 27 bp, Artificial Sequence
  Description of Artificial Sequence: Synthetic oligonucleotide
tccagtggatgattggctgcgacgtgg

SEQ ID NO: 16158 - DNA, 26 bp, Artificial Sequence
  Description of Artificial Sequence: Synthetic oligonucleotide
ccagtggatgattggctgcgacgtgg

SEQ ID NO: 16159 - DNA, 26 bp, Artificial Sequence
  Description of Artificial Sequence: Synthetic oligonucleotide
cagtggatgattggctgcgacgtggg

SEQ ID NO: 16160 - DNA, 27 bp, Artificial Sequence
  Description of Artificial Sequence: Synthetic oligonucleotide
agtggatgattggctgcgacgtggggt

SEQ ID NO: 16161 - DNA, 26 bp, Artificial Sequence
  Description of Artificial Sequence: Synthetic oligonucleotide
gtggatgattggctgcgacgtggggt

SEQ ID NO: 16162 - DNA, 26 bp, Artificial Sequence
  Description of Artificial Sequence: Synthetic oligonucleotide
tggatgattggctgcgacgtggggtc

SEQ ID NO: 16163 - DNA, 25 bp, Artificial Sequence
  Description of Artificial Sequence: Synthetic oligonucleotide
ggatgattggctgcgacgtggggtc

SEQ ID NO: 16164 - DNA, 25 bp, Artificial Sequence
  Description of Artificial Sequence: Synthetic oligonucleotide
gatgattggctgcgacgtggggtcg

SEQ ID NO: 16165 - DNA, 26 bp, Artificial Sequence
  Description of Artificial Sequence: Synthetic oligonucleotide
atgattggctgcgacgtggggtcgga

SEQ ID NO: 16166 - DNA, 25 bp, Artificial Sequence
  Description of Artificial Sequence: Synthetic oligonucleotide
tgattggctgcgacgtggggtcgga

SEQ ID NO: 16167 - DNA, 24 bp, Artificial Sequence
  Description of Artificial Sequence: Synthetic oligonucleotide
gattggctgcgacgtggggtcgga

SEQ ID NO: 16168 - DNA, 24 bp, Artificial Sequence
  Description of Artificial Sequence: Synthetic oligonucleotide
attggctgcgacgtggggtcggac

SEQ ID NO: 16169 - DNA, 21 bp, Artificial Sequence
  Description of Artificial Sequence: Synthetic oligonucleotide
gtgcgtggacgggctccgcag

SEQ ID NO: 16170 - DNA, 23 bp, Artificial Sequence
  Description of Artificial Sequence: Synthetic oligonucleotide
tgcgtggacgggctccgcagcta

SEQ ID NO: 16171 - DNA, 22 bp, Artificial Sequence
  Description of Artificial Sequence: Synthetic oligonucleotide
gcgtggacgggctccgcagcta

SEQ ID NO: 16172 - DNA, 22 bp, Artificial Sequence
  Description of Artificial Sequence: Synthetic oligonucleotide
cgtggacgggctccgcagctac

SEQ ID NO: 16173 - DNA, 23 bp, Artificial Sequence
  Description of Artificial Sequence: Synthetic oligonucleotide
gtggacgggctccgcagctacct

SEQ ID NO: 16174 - DNA, 23 bp, Artificial Sequence
  Description of Artificial Sequence: Synthetic oligonucleotide
tggacgggctccgcagctacctg

SEQ ID NO: 16175 - DNA, 22 bp, Artificial Sequence
  Description of Artificial Sequence: Synthetic oligonucleotide
ggacgggctccgcagctacctg

SEQ ID NO: 16176 - DNA, 23 bp, Artificial Sequence
  Description of Artificial Sequence: Synthetic oligonucleotide
gacgggctccgcagctacctgga

SEQ ID NO: 16177 - DNA, 25 bp, Artificial Sequence
  Description of Artificial Sequence: Synthetic oligonucleotide
acgggctccgcagctacctggagaa

SEQ ID NO: 16178 - DNA, 24 bp, Artificial Sequence
  Description of Artificial Sequence: Synthetic oligonucleotide
cgggctccgcagctacctggagaa

SEQ ID NO: 16179 - DNA, 24 bp, Artificial Sequence
  Description of Artificial Sequence: Synthetic oligonucleotide
gggctccgcagctacctggagaac

SEQ ID NO: 16180 - DNA, 24 bp, Artificial Sequence
  Description of Artificial Sequence: Synthetic oligonucleotide
ggctccgcagctacctggagaacg

SEQ ID NO: 16181 - DNA, 24 bp, Artificial Sequence
  Description of Artificial Sequence: Synthetic oligonucleotide
gctccgcagctacctggagaacgg

SEQ ID NO: 16182 - DNA, 26 bp, Artificial Sequence
  Description of Artificial Sequence: Synthetic oligonucleotide
ctccgcagctacctggagaacgggaa

SEQ ID NO: 16183 - DNA, 26 bp, Artificial Sequence
  Description of Artificial Sequence: Synthetic oligonucleotide
tccgcagctacctggagaacgggaag

SEQ ID NO: 16184 - DNA, 25 bp, Artificial Sequence
  Description of Artificial Sequence: Synthetic oligonucleotide
ccgcagctacctggagaacgggaag

SEQ ID NO: 16185 - DNA, 26 bp, Artificial Sequence
  Description of Artificial Sequence: Synthetic oligonucleotide
cgcagctacctggagaacgggaagga

SEQ ID NO: 16186 - DNA, 27 bp, Artificial Sequence
  Description of Artificial Sequence: Synthetic oligonucleotide
gcagctacctggagaacgggaaggaga

SEQ ID NO: 16187 - DNA, 27 bp, Artificial Sequence
  Description of Artificial Sequence: Synthetic oligonucleotide
cagctacctggagaacgggaaggagac

SEQ ID NO: 16188 - DNA, 27 bp, Artificial Sequence
  Description of Artificial Sequence: Synthetic oligonucleotide
agctacctggagaacgggaaggagacg

SEQ ID NO: 16189 - DNA, 26 bp, Artificial Sequence
  Description of Artificial Sequence: Synthetic oligonucleotide
gctacctggagaacgggaaggagacg

SEQ ID NO: 16190 - DNA, 27 bp, Artificial Sequence
  Description of Artificial Sequence: Synthetic oligonucleotide
ctacctggagaacgggaaggagacgct

SEQ ID NO: 16191 - DNA, 20 bp, Artificial Sequence
  Description of Artificial Sequence: Synthetic oligonucleotide
cccggccgcggggagctctt

SEQ ID NO: 16192 - DNA, 20 bp, Artificial Sequence
  Description of Artificial Sequence: Synthetic oligonucleotide
ccggccgcggggagctcctt

SEQ ID NO: 16193 - DNA, 20 bp, Artificial Sequence
  Description of Artificial Sequence: Synthetic oligonucleotide
cggccgcggggagctccgtt

SEQ ID NO: 16194 - DNA, 20 bp, Artificial Sequence
  Description of Artificial Sequence: Synthetic oligonucleotide
ggccgcggggagctccgctt

SEQ ID NO: 16195 - DNA, 22 bp, Artificial Sequence
  Description of Artificial Sequence: Synthetic oligonucleotide
gccgcggggagctccgcttcat

SEQ ID NO: 16196 - DNA, 22 bp, Artificial Sequence
  Description of Artificial Sequence: Synthetic oligonucleotide
ccgcggggagctccgcttcatc

SEQ ID NO: 16197 - DNA, 22 bp, Artificial Sequence
  Description of Artificial Sequence: Synthetic oligonucleotide
cgcggggagctccgcttcatcg

SEQ ID NO: 16198 - DNA, 22 bp, Artificial Sequence
  Description of Artificial Sequence: Synthetic oligonucleotide
gcggggagctccgcttcatcgc

SEQ ID NO: 16199 - DNA, 22 bp, Artificial Sequence
  Description of Artificial Sequence: Synthetic oligonucleotide
cggggagctccgcttcatcgcc

SEQ ID NO: 16200 - DNA, 23 bp, Artificial Sequence
  Description of Artificial Sequence: Synthetic oligonucleotide
ggggagctccgcttcatcgccgt

SEQ ID NO: 16201 - DNA, 23 bp, Artificial Sequence
  Description of Artificial Sequence: Synthetic oligonucleotide
gggagctccgcttcatcgccgtg

SEQ ID NO: 16202 - DNA, 23 bp, Artificial Sequence
  Description of Artificial Sequence: Synthetic oligonucleotide
ggagctccgcttcatcgccgtgg

SEQ ID NO: 16203 - DNA, 23 bp, Artificial Sequence
  Description of Artificial Sequence: Synthetic oligonucleotide
gagctccgcttcatcgccgtggg

SEQ ID NO: 16204 - DNA, 25 bp, Artificial Sequence
  Description of Artificial Sequence: Synthetic oligonucleotide
agctccgcttcatcgccgtgggcta

SEQ ID NO: 16205 - DNA, 24 bp, Artificial Sequence
  Description of Artificial Sequence: Synthetic oligonucleotide
gctccgcttcatcgccgtgggcta

SEQ ID NO: 16206 - DNA, 24 bp, Artificial Sequence
  Description of Artificial Sequence: Synthetic oligonucleotide
ctccgcttcatcgccgtgggctac

SEQ ID NO: 16207 - DNA, 25 bp, Artificial Sequence
  Description of Artificial Sequence: Synthetic oligonucleotide
tccgcttcatcgccgtgggctacgt

SEQ ID NO: 16208 - DNA, 26 bp, Artificial Sequence
  Description of Artificial Sequence: Synthetic oligonucleotide
gtaccaccagtacgcctacgacggca

SEQ ID NO: 16209 - DNA, 26 bp, Artificial Sequence
  Description of Artificial Sequence: Synthetic oligonucleotide
taccaccagtacgcctacgacggcag

SEQ ID NO: 16210 - DNA, 25 bp, Artificial Sequence
  Description of Artificial Sequence: Synthetic oligonucleotide
accaccagtacgcctacgacggcag

SEQ ID NO: 16211 - DNA, 24 bp, Artificial Sequence
  Description of Artificial Sequence: Synthetic oligonucleotide
ccaccagtacgcctacgacggcag

SEQ ID NO: 16212 - DNA, 24 bp, Artificial Sequence
  Description of Artificial Sequence: Synthetic oligonucleotide
caccagtacgcctacgacggcagg

SEQ ID NO: 16213 - DNA, 27 bp, Artificial Sequence
  Description of Artificial Sequence: Synthetic oligonucleotide
accagtacgcctacgacggcagggatt

SEQ ID NO: 16214 - DNA, 27 bp, Artificial Sequence
  Description of Artificial Sequence: Synthetic oligonucleotide
ccagtacgcctacgacggcagggatta

SEQ ID NO: 16215 - DNA, 27 bp, Artificial Sequence
  Description of Artificial Sequence: Synthetic oligonucleotide
cagtacgcctacgacggcagggattac

SEQ ID NO: 16216 - DNA, 29 bp, Artificial Sequence
  Description of Artificial Sequence: Synthetic oligonucleotide
agtacgcctacgacggcagggattacatc

SEQ ID NO: 16217 - DNA, 28 bp, Artificial Sequence
  Description of Artificial Sequence: Synthetic oligonucleotide
gtacgcctacgacggcagggattacatc

SEQ ID NO: 16218 - DNA, 28 bp, Artificial Sequence
  Description of Artificial Sequence: Synthetic oligonucleotide
tacgcctacgacggcagggattacatcg

SEQ ID NO: 16219 - DNA, 27 bp, Artificial Sequence
  Description of Artificial Sequence: Synthetic oligonucleotide
acgcctacgacggcagggattacatcg

SEQ ID NO: 16220 - DNA, 26 bp, Artificial Sequence
  Description of Artificial Sequence: Synthetic oligonucleotide
cgcctacgacggcagggattacatcg

SEQ ID NO: 16221 - DNA, 26 bp, Artificial Sequence
  Description of Artificial Sequence: Synthetic oligonucleotide
gcctacgacggcagggattacatcgc

SEQ ID NO: 16222 - DNA, 26 bp, Artificial Sequence
  Description of Artificial Sequence: Synthetic oligonucleotide
cctacgacggcagggattacatcgcc

SEQ ID NO: 16223 - DNA, 27 bp, Artificial Sequence
  Description of Artificial Sequence: Synthetic oligonucleotide
ctacgacggcagggattacatcgccct

SEQ ID NO: 16224 - DNA, 27 bp, Artificial Sequence
  Description of Artificial Sequence: Synthetic oligonucleotide
tacgacggcagggattacatcgccctg

SEQ ID NO: 16225 - DNA, 27 bp, Artificial Sequence
  Description of Artificial Sequence: Synthetic oligonucleotide
acgacggcagggattacatcgccctga

SEQ ID NO: 16226 - DNA, 27 bp, Artificial Sequence
  Description of Artificial Sequence: Synthetic oligonucleotide
cgacggcagggattacatcgccctgaa

SEQ ID NO: 16227 - DNA, 28 bp, Artificial Sequence
  Description of Artificial Sequence: Synthetic oligonucleotide
gacggcagggattacatcgccctgaaag

SEQ ID NO: 16228 - DNA, 29 bp, Artificial Sequence
  Description of Artificial Sequence: Synthetic oligonucleotide
acggcagggattacatcgccctgaaagag

SEQ ID NO: 16229 - DNA, 28 bp, Artificial Sequence
  Description of Artificial Sequence: Synthetic oligonucleotide
cggcagggattacatcgccctgaaagag

SEQ ID NO: 16230 - DNA, 28 bp, Artificial Sequence
  Description of Artificial Sequence: Synthetic oligonucleotide
ggcagggattacatcgccctgaaagagg

SEQ ID NO: 16231 - DNA, 29 bp, Artificial Sequence
  Description of Artificial Sequence: Synthetic oligonucleotide
gcagggattacatcgccctgaaagaggac

SEQ ID NO: 16232 - DNA, 29 bp, Artificial Sequence
  Description of Artificial Sequence: Synthetic oligonucleotide
cagggattacatcgccctgaaagaggacc

SEQ ID NO: 16233 - DNA, 30 bp, Artificial Sequence
  Description of Artificial Sequence: Synthetic oligonucleotide
agggattacatcgccctgaaagaggacctg

SEQ ID NO: 16234 - DNA, 29 bp, Artificial Sequence
  Description of Artificial Sequence: Synthetic oligonucleotide
gggattacatcgccctgaaagaggacctg

SEQ ID NO: 16235 - DNA, 23 bp, Artificial Sequence
  Description of Artificial Sequence: Synthetic oligonucleotide
aggcggcccatgtggtggagcag

SEQ ID NO: 16236 - DNA, 22 bp, Artificial Sequence
  Description of Artificial Sequence: Synthetic oligonucleotide
ggcggcccatgtggtggagcag

SEQ ID NO: 16237 - DNA, 23 bp, Artificial Sequence
  Description of Artificial Sequence: Synthetic oligonucleotide
gcggcccatgtggtggagcagca

SEQ ID NO: 16238 - DNA, 24 bp, Artificial Sequence
  Description of Artificial Sequence: Synthetic oligonucleotide
cggcccatgtggtggagcagcaga

SEQ ID NO: 16239 - DNA, 25 bp, Artificial Sequence
  Description of Artificial Sequence: Synthetic oligonucleotide
ggcccatgtggtggagcagcagaga

SEQ ID NO: 16240 - DNA, 25 bp, Artificial Sequence
  Description of Artificial Sequence: Synthetic oligonucleotide
gcccatgtggtggagcagcagagag

SEQ ID NO: 16241 - DNA, 25 bp, Artificial Sequence
  Description of Artificial Sequence: Synthetic oligonucleotide
cccatgtggtggagcagcagagagc

SEQ ID NO: 16242 - DNA, 27 bp, Artificial Sequence
  Description of Artificial Sequence: Synthetic oligonucleotide
ccatgtggtggagcagcagagagccta

SEQ ID NO: 16243 - DNA, 27 bp, Artificial Sequence
  Description of Artificial Sequence: Synthetic oligonucleotide
catgtggtggagcagcagagagcctac

SEQ ID NO: 16244 - DNA, 27 bp, Artificial Sequence
  Description of Artificial Sequence: Synthetic oligonucleotide
atgtggtggagcagcagagagcctacc

SEQ ID NO: 16245 - DNA, 27 bp, Artificial Sequence
  Description of Artificial Sequence: Synthetic oligonucleotide
tgtggtggagcagcagagagcctacct

SEQ ID NO: 16246 - DNA, 26 bp, Artificial Sequence
  Description of Artificial Sequence: Synthetic oligonucleotide
gtggtggagcagcagagagcctacct

SEQ ID NO: 16247 - DNA, 26 bp, Artificial Sequence
  Description of Artificial Sequence: Synthetic oligonucleotide
tggtggagcagcagagagcctacctg

SEQ ID NO: 16248 - DNA, 25 bp, Artificial Sequence
  Description of Artificial Sequence: Synthetic oligonucleotide
ggtggagcagcagagagcctacctg

SEQ ID NO: 16249 - DNA, 26 bp, Artificial Sequence
  Description of Artificial Sequence: Synthetic oligonucleotide
gtggagcagcagagagcctacctgga

SEQ ID NO: 16250 - DNA, 26 bp, Artificial Sequence
  Description of Artificial Sequence: Synthetic oligonucleotide
tggagcagcagagagcctacctggag

SEQ ID NO: 16251 - DNA, 20 bp, Artificial Sequence
  Description of Artificial Sequence: Synthetic oligonucleotide
acgggcgcttcctccgcggg

SEQ ID NO: 16252 - DNA, 21 bp, Artificial Sequence
  Description of Artificial Sequence: Synthetic oligonucleotide
gggcgcttcctccgcgggcat

SEQ ID NO: 16253 - DNA, 27 bp, Artificial Sequence
  Description of Artificial Sequence: Synthetic oligonucleotide
gacacgcagttcgtgcggttcgacaga

SEQ ID NO: 16254 - DNA, 27 bp, Artificial Sequence
  Description of Artificial Sequence: Synthetic oligonucleotide
acacgcagttcgtgcggttcgacagag

SEQ ID NO: 16255 - DNA, 27 bp, Artificial Sequence
  Description of Artificial Sequence: Synthetic oligonucleotide
cacgcagttcgtgcggttcgacagaga

SEQ ID NO: 16256 - DNA, 27 bp, Artificial Sequence
  Description of Artificial Sequence: Synthetic oligonucleotide
acgcagttcgtgcggttcgacagagac

SEQ ID NO: 16257 - DNA, 26 bp, Artificial Sequence
  Description of Artificial Sequence: Synthetic oligonucleotide
cgcagttcgtgcggttcgacagagac

SEQ ID NO: 16258 - DNA, 26 bp, Artificial Sequence
  Description of Artificial Sequence: Synthetic oligonucleotide
gcagttcgtgcggttcgacagagacg

SEQ ID NO: 16259 - DNA, 26 bp, Artificial Sequence
  Description of Artificial Sequence: Synthetic oligonucleotide
cagttcgtgcggttcgacagagacgc

SEQ ID NO: 16260 - DNA, 26 bp, Artificial Sequence
  Description of Artificial Sequence: Synthetic oligonucleotide
agttcgtgcggttcgacagagacgcc

SEQ ID NO: 16261 - DNA, 25 bp, Artificial Sequence
  Description of Artificial Sequence: Synthetic oligonucleotide
gttcgtgcggttcgacagagacgcc

SEQ ID NO: 16262 - DNA, 25 bp, Artificial Sequence
  Description of Artificial Sequence: Synthetic oligonucleotide
ttcgtgcggttcgacagagacgccg

SEQ ID NO: 16263 - DNA, 24 bp, Artificial Sequence
  Description of Artificial Sequence: Synthetic oligonucleotide
tcgtgcggttcgacagagacgccg

SEQ ID NO: 16264 - DNA, 23 bp, Artificial Sequence
  Description of Artificial Sequence: Synthetic oligonucleotide
cgtgcggttcgacagagacgccg

SEQ ID NO: 16265 - DNA, 23 bp, Artificial Sequence
  Description of Artificial Sequence: Synthetic oligonucleotide
gtgcggttcgacagagacgccgc

SEQ ID NO: 16266 - DNA, 24 bp, Artificial Sequence
  Description of Artificial Sequence: Synthetic oligonucleotide
tgcggttcgacagagacgccgcga

SEQ ID NO: 16267 - DNA, 23 bp, Artificial Sequence
  Description of Artificial Sequence: Synthetic oligonucleotide
gcggttcgacagagacgccgcga

SEQ ID NO: 16268 - DNA, 23 bp, Artificial Sequence
  Description of Artificial Sequence: Synthetic oligonucleotide
cggttcgacagagacgccgcgag

SEQ ID NO: 16269 - DNA, 23 bp, Artificial Sequence
  Description of Artificial Sequence: Synthetic oligonucleotide
ggttcgacagagacgccgcgagc

SEQ ID NO: 16270 - DNA, 24 bp, Artificial Sequence
  Description of Artificial Sequence: Synthetic oligonucleotide
gttcgacagagacgccgcgagcca

SEQ ID NO: 16271 - DNA, 25 bp, Artificial Sequence
  Description of Artificial Sequence: Synthetic oligonucleotide
ttcgacagagacgccgcgagccaga

SEQ ID NO: 16272 - DNA, 24 bp, Artificial Sequence
  Description of Artificial Sequence: Synthetic oligonucleotide
tcgacagagacgccgcgagccaga

SEQ ID NO: 16273 - DNA, 23 bp, Artificial Sequence
  Description of Artificial Sequence: Synthetic oligonucleotide
cgacagagacgccgcgagccaga

SEQ ID NO: 16274 - DNA, 23 bp, Artificial Sequence
  Description of Artificial Sequence: Synthetic oligonucleotide
gacagagacgccgcgagccagag

SEQ ID NO: 16275 - DNA, 25 bp, Artificial Sequence
  Description of Artificial Sequence: Synthetic oligonucleotide
acagagacgccgcgagccagaggat

SEQ ID NO: 16276 - DNA, 24 bp, Artificial Sequence
  Description of Artificial Sequence: Synthetic oligonucleotide
cagagacgccgcgagccagaggat

SEQ ID NO: 16277 - DNA, 24 bp, Artificial Sequence
  Description of Artificial Sequence: Synthetic oligonucleotide
agagacgccgcgagccagaggatg

SEQ ID NO: 16278 - DNA, 23 bp, Artificial Sequence
  Description of Artificial Sequence: Synthetic oligonucleotide
gagacgccgcgagccagaggatg

SEQ ID NO: 16279 - DNA, 24 bp, Artificial Sequence
  Description of Artificial Sequence: Synthetic oligonucleotide
agacgccgcgagccagaggatgga

SEQ ID NO: 16280 - DNA, 21 bp, Artificial Sequence
  Description of Artificial Sequence: Synthetic oligonucleotide
agggcacgtgcgtggacgggc

SEQ ID NO: 16281 - DNA, 20 bp, Artificial Sequence
  Description of Artificial Sequence: Synthetic oligonucleotide
gggcacgtgcgtggacgggc

SEQ ID NO: 16282 - DNA, 20 bp, Artificial Sequence
  Description of Artificial Sequence: Synthetic oligonucleotide
ggcacgtgcgtggacgggcg

SEQ ID NO: 16283 - DNA, 20 bp, Artificial Sequence
  Description of Artificial Sequence: Synthetic oligonucleotide
gcacgtgcgtggacgggcgc

SEQ ID NO: 16284 - DNA, 20 bp, Artificial Sequence
  Description of Artificial Sequence: Synthetic oligonucleotide
cacgtgcgtggacgggcgcc

SEQ ID NO: 16285 - DNA, 20 bp, Artificial Sequence
  Description of Artificial Sequence: Synthetic oligonucleotide
acgtgcgtggacgggcgccg

SEQ ID NO: 16286 - DNA, 20 bp, Artificial Sequence
  Description of Artificial Sequence: Synthetic oligonucleotide
cgtgcgtggacgggcgccgt

SEQ ID NO: 16287 - DNA, 20 bp, Artificial Sequence
  Description of Artificial Sequence: Synthetic oligonucleotide
gtgcgtggacgggcgccgca

SEQ ID NO: 16288 - DNA, 23 bp, Artificial Sequence
  Description of Artificial Sequence: Synthetic oligonucleotide
tgcgtggacgggcgccgcagata

SEQ ID NO: 16289 - DNA, 22 bp, Artificial Sequence
  Description of Artificial Sequence: Synthetic oligonucleotide
gcgtggacgggcgccgcagata

SEQ ID NO: 16290 - DNA, 22 bp, Artificial Sequence
  Description of Artificial Sequence: Synthetic oligonucleotide
cgtggacgggcgccgcagatac

SEQ ID NO: 16291 - DNA, 23 bp, Artificial Sequence
  Description of Artificial Sequence: Synthetic oligonucleotide
gtggacgggcgccgcagatacct

SEQ ID NO: 16292 - DNA, 23 bp, Artificial Sequence
  Description of Artificial Sequence: Synthetic oligonucleotide
tggacgggcgccgcagatacctg

SEQ ID NO: 16293 - DNA, 22 bp, Artificial Sequence
  Description of Artificial Sequence: Synthetic oligonucleotide
ggacgggcgccgcagatacctg

SEQ ID NO: 16294 - DNA, 23 bp, Artificial Sequence
  Description of Artificial Sequence: Synthetic oligonucleotide
gacgggcgccgcagatacctgga

SEQ ID NO: 16295 - DNA, 25 bp, Artificial Sequence
  Description of Artificial Sequence: Synthetic oligonucleotide
acgggcgccgcagatacctggagaa

SEQ ID NO: 16296 - DNA, 24 bp, Artificial Sequence
  Description of Artificial Sequence: Synthetic oligonucleotide
cgggcgccgcagatacctggagaa

SEQ ID NO: 16297 - DNA, 24 bp, Artificial Sequence
  Description of Artificial Sequence: Synthetic oligonucleotide
gggcgccgcagatacctggagaac

SEQ ID NO: 16298 - DNA, 24 bp, Artificial Sequence
  Description of Artificial Sequence: Synthetic oligonucleotide
ggcgccgcagatacctggagaacg

SEQ ID NO: 16299 - DNA, 24 bp, Artificial Sequence
  Description of Artificial Sequence: Synthetic oligonucleotide
gcgccgcagatacctggagaacgg

SEQ ID NO: 16300 - DNA, 26 bp, Artificial Sequence
  Description of Artificial Sequence: Synthetic oligonucleotide
cgccgcagatacctggagaacgggaa

SEQ ID NO: 16301 - DNA, 26 bp, Artificial Sequence
  Description of Artificial Sequence: Synthetic oligonucleotide
gccgcagatacctggagaacgggaag

SEQ ID NO: 16302 - DNA, 28 bp, Artificial Sequence
  Description of Artificial Sequence: Synthetic oligonucleotide
ccccaagacacatatgacccaccacctc

SEQ ID NO: 16303 - DNA, 30 bp, Artificial Sequence
  Description of Artificial Sequence: Synthetic oligonucleotide
cccaagacacatatgacccaccacctcatc

SEQ ID NO: 16304 - DNA, 31 bp, Artificial Sequence
  Description of Artificial Sequence: Synthetic oligonucleotide
ccaagacacatatgacccaccacctcatctc

SEQ ID NO: 16305 - DNA, 32 bp, Artificial Sequence
  Description of Artificial Sequence: Synthetic oligonucleotide
caagacacatatgacccaccacctcatctctg

SEQ ID NO: 16306 - DNA, 33 bp, Artificial Sequence
  Description of Artificial Sequence: Synthetic oligonucleotide
aagacacatatgacccaccacctcatctctgac

SEQ ID NO: 16307 - DNA, 32 bp, Artificial Sequence
  Description of Artificial Sequence: Synthetic oligonucleotide
agacacatatgacccaccacctcatctctgac

SEQ ID NO: 16308 - DNA, 31 bp, Artificial Sequence
  Description of Artificial Sequence: Synthetic oligonucleotide
gacacatatgacccaccacctcatctctgac

SEQ ID NO: 16309 - DNA, 31 bp, Artificial Sequence
  Description of Artificial Sequence: Synthetic oligonucleotide
acacatatgacccaccacctcatctctgacc

SEQ ID NO: 16310 - DNA, 30 bp, Artificial Sequence
  Description of Artificial Sequence: Synthetic oligonucleotide
cacatatgacccaccacctcatctctgacc

SEQ ID NO: 16311 - DNA, 32 bp, Artificial Sequence
  Description of Artificial Sequence: Synthetic oligonucleotide
acatatgacccaccacctcatctctgaccatg

SEQ ID NO: 16312 - DNA, 31 bp, Artificial Sequence
  Description of Artificial Sequence: Synthetic oligonucleotide
catatgacccaccacctcatctctgaccatg

SEQ ID NO: 16313 - DNA, 32 bp, Artificial Sequence
  Description of Artificial Sequence: Synthetic oligonucleotide
atatgacccaccacctcatctctgaccatgag

SEQ ID NO: 16314 - DNA, 31 bp, Artificial Sequence
  Description of Artificial Sequence: Synthetic oligonucleotide
tatgacccaccacctcatctctgaccatgag

SEQ ID NO: 16315 - DNA, 30 bp, Artificial Sequence
  Description of Artificial Sequence: Synthetic oligonucleotide
atgacccaccacctcatctctgaccatgag

SEQ ID NO: 16316 - DNA, 29 bp, Artificial Sequence
  Description of Artificial Sequence: Synthetic oligonucleotide
tgacccaccacctcatctctgaccatgag

SEQ ID NO: 16317 - DNA, 28 bp, Artificial Sequence
  Description of Artificial Sequence: Synthetic oligonucleotide
gacccaccacctcatctctgaccatgag

SEQ ID NO: 16318 - DNA, 28 bp, Artificial Sequence
  Description of Artificial Sequence: Synthetic oligonucleotide
acccaccacctcatctctgaccatgagg

SEQ ID NO: 16319 - DNA, 27 bp, Artificial Sequence
  Description of Artificial Sequence: Synthetic oligonucleotide
cccaccacctcatctctgaccatgagg

SEQ ID NO: 16320 - DNA, 27 bp, Artificial Sequence
  Description of Artificial Sequence: Synthetic oligonucleotide
ccaccacctcatctctgaccatgaggc

SEQ ID NO: 16321 - DNA, 27 bp, Artificial Sequence
  Description of Artificial Sequence: Synthetic oligonucleotide
caccacctcatctctgaccatgaggcc

SEQ ID NO: 16322 - DNA, 28 bp, Artificial Sequence
  Description of Artificial Sequence: Synthetic oligonucleotide
accacctcatctctgaccatgaggccac

SEQ ID NO: 16323 - DNA, 27 bp, Artificial Sequence
  Description of Artificial Sequence: Synthetic oligonucleotide
ccacctcatctctgaccatgaggccac

SEQ ID NO: 16324 - DNA, 28 bp, Artificial Sequence
  Description of Artificial Sequence: Synthetic oligonucleotide
cacctcatctctgaccatgaggccactc

SEQ ID NO: 16325 - DNA, 29 bp, Artificial Sequence
  Description of Artificial Sequence: Synthetic oligonucleotide
acctcatctctgaccatgaggccactctg

SEQ ID NO: 16326 - DNA, 28 bp, Artificial Sequence
  Description of Artificial Sequence: Synthetic oligonucleotide
cctcatctctgaccatgaggccactctg

SEQ ID NO: 16327 - DNA, 29 bp, Artificial Sequence
  Description of Artificial Sequence: Synthetic oligonucleotide
ctcatctctgaccatgaggccactctgag

SEQ ID NO: 16328 - DNA, 31 bp, Artificial Sequence
  Description of Artificial Sequence: Synthetic oligonucleotide
tcatctctgaccatgaggccactctgagatg

SEQ ID NO: 16329 - DNA, 26 bp, Artificial Sequence
  Description of Artificial Sequence: Synthetic oligonucleotide
gccggagtattgggaccaggagacag

SEQ ID NO: 16330 - DNA, 26 bp, Artificial Sequence
  Description of Artificial Sequence: Synthetic oligonucleotide
ccggagtattgggaccaggagacagg

SEQ ID NO: 16331 - DNA, 27 bp, Artificial Sequence
  Description of Artificial Sequence: Synthetic oligonucleotide
cggagtattgggaccaggagacaggga

SEQ ID NO: 16332 - DNA, 29 bp, Artificial Sequence
  Description of Artificial Sequence: Synthetic oligonucleotide
ggagtattgggaccaggagacagggaaag

SEQ ID NO: 16333 - DNA, 30 bp, Artificial Sequence
  Description of Artificial Sequence: Synthetic oligonucleotide
gagtattgggaccaggagacagggaaagtg

SEQ ID NO: 16334 - DNA, 32 bp, Artificial Sequence
  Description of Artificial Sequence: Synthetic oligonucleotide
agtattgggaccaggagacagggaaagtgaag

SEQ ID NO: 16335 - DNA, 31 bp, Artificial Sequence
  Description of Artificial Sequence: Synthetic oligonucleotide
gtattgggaccaggagacagggaaagtgaag

SEQ ID NO: 16336 - DNA, 31 bp, Artificial Sequence
  Description of Artificial Sequence: Synthetic oligonucleotide
tattgggaccaggagacagggaaagtgaagg

SEQ ID NO: 16337 - DNA, 30 bp, Artificial Sequence
  Description of Artificial Sequence: Synthetic oligonucleotide
attgggaccaggagacagggaaagtgaagg

SEQ ID NO: 16338 - DNA, 29 bp, Artificial Sequence
  Description of Artificial Sequence: Synthetic oligonucleotide
ttgggaccaggagacagggaaagtgaagg

SEQ ID NO: 16339 - DNA, 28 bp, Artificial Sequence
  Description of Artificial Sequence: Synthetic oligonucleotide
tgggaccaggagacagggaaagtgaagg

SEQ ID NO: 16340 - DNA, 27 bp, Artificial Sequence
  Description of Artificial Sequence: Synthetic oligonucleotide
gggaccaggagacagggaaagtgaagg

SEQ ID NO: 16341 - DNA, 27 bp, Artificial Sequence
  Description of Artificial Sequence: Synthetic oligonucleotide
ggaccaggagacagggaaagtgaaggc

SEQ ID NO: 16342 - DNA, 27 bp, Artificial Sequence
  Description of Artificial Sequence: Synthetic oligonucleotide
gaccaggagacagggaaagtgaaggcc

SEQ ID NO: 16343 - DNA, 27 bp, Artificial Sequence
  Description of Artificial Sequence: Synthetic oligonucleotide
accaggagacagggaaagtgaaggccc

SEQ ID NO: 16344 - DNA, 27 bp, Artificial Sequence
  Description of Artificial Sequence: Synthetic oligonucleotide
ccaggagacagggaaagtgaaggccca

SEQ ID NO: 16345 - DNA, 27 bp, Artificial Sequence
  Description of Artificial Sequence: Synthetic oligonucleotide
caggagacagggaaagtgaaggcccac

SEQ ID NO: 16346 - DNA, 26 bp, Artificial Sequence
  Description of Artificial Sequence: Synthetic oligonucleotide
gagaacgggaaggagacgctgcagca

SEQ ID NO: 16347 - DNA, 27 bp, Artificial Sequence
  Description of Artificial Sequence: Synthetic oligonucleotide
agaacgggaaggagacgctgcagcaca

SEQ ID NO: 16348 - DNA, 26 bp, Artificial Sequence
  Description of Artificial Sequence: Synthetic oligonucleotide
gaacgggaaggagacgctgcagcaca

SEQ ID NO: 16349 - DNA, 26 bp, Artificial Sequence
  Description of Artificial Sequence: Synthetic oligonucleotide
aacgggaaggagacgctgcagcacac

SEQ ID NO: 16350 - DNA, 25 bp, Artificial Sequence
  Description of Artificial Sequence: Synthetic oligonucleotide
acgggaaggagacgctgcagcacac

SEQ ID NO: 16351 - DNA, 24 bp, Artificial Sequence
  Description of Artificial Sequence: Synthetic oligonucleotide
cgggaaggagacgctgcagcacac

SEQ ID NO: 16352 - DNA, 24 bp, Artificial Sequence
  Description of Artificial Sequence: Synthetic oligonucleotide
gggaaggagacgctgcagcacacg

SEQ ID NO: 16353 - DNA, 25 bp, Artificial Sequence
  Description of Artificial Sequence: Synthetic oligonucleotide
ggaaggagacgctgcagcacacgga

SEQ ID NO: 16354 - DNA, 25 bp, Artificial Sequence
  Description of Artificial Sequence: Synthetic oligonucleotide
gaaggagacgctgcagcacacggac

SEQ ID NO: 16355 - DNA, 25 bp, Artificial Sequence
  Description of Artificial Sequence: Synthetic oligonucleotide
aaggagacgctgcagcacacggacc

SEQ ID NO: 16356 - DNA, 24 bp, Artificial Sequence
  Description of Artificial Sequence: Synthetic oligonucleotide
aggagacgctgcagcacacggacc

SEQ ID NO: 16357 - DNA, 23 bp, Artificial Sequence
  Description of Artificial Sequence: Synthetic oligonucleotide
ggagacgctgcagcacacggacc

SEQ ID NO: 16358 - DNA, 23 bp, Artificial Sequence
  Description of Artificial Sequence: Synthetic oligonucleotide
gagacgctgcagcacacggaccc

SEQ ID NO: 16359 - DNA, 23 bp, Artificial Sequence
  Description of Artificial Sequence: Synthetic oligonucleotide
agacgctgcagcacacggacccc

SEQ ID NO: 16360 - DNA, 22 bp, Artificial Sequence
  Description of Artificial Sequence: Synthetic oligonucleotide
gacgctgcagcacacggacccc

SEQ ID NO: 16361 - DNA, 22 bp, Artificial Sequence
  Description of Artificial Sequence: Synthetic oligonucleotide
acgctgcagcacacggaccccc

SEQ ID NO: 16362 - DNA, 21 bp, Artificial Sequence
  Description of Artificial Sequence: Synthetic oligonucleotide
cgctgcagcacacggaccccc

SEQ ID NO: 16363 - DNA, 21 bp, Artificial Sequence
  Description of Artificial Sequence: Synthetic oligonucleotide
gctgcagcacacggacccccc

SEQ ID NO: 16364 - DNA, 23 bp, Artificial Sequence
  Description of Artificial Sequence: Synthetic oligonucleotide
ctgcagcacacggacccccccaa

SEQ ID NO: 16365 - DNA, 24 bp, Artificial Sequence
  Description of Artificial Sequence: Synthetic oligonucleotide
tgcagcacacggacccccccaaga

SEQ ID NO: 16366 - DNA, 23 bp, Artificial Sequence
  Description of Artificial Sequence: Synthetic oligonucleotide
gcagcacacggacccccccaaga

SEQ ID NO: 16367 - DNA, 24 bp, Artificial Sequence
  Description of Artificial Sequence: Synthetic oligonucleotide
cagcacacggacccccccaagaca

SEQ ID NO: 16368 - DNA, 27 bp, Artificial Sequence
  Description of Artificial Sequence: Synthetic oligonucleotide
agcacacggacccccccaagacacata

SEQ ID NO: 16369 - DNA, 27 bp, Artificial Sequence
  Description of Artificial Sequence: Synthetic oligonucleotide
gcacacggacccccccaagacacatat

SEQ ID NO: 16370 - DNA, 27 bp, Artificial Sequence
  Description of Artificial Sequence: Synthetic oligonucleotide
cacacggacccccccaagacacatatg

SEQ ID NO: 16371 - DNA, 28 bp, Artificial Sequence
  Description of Artificial Sequence: Synthetic oligonucleotide
acacggacccccccaagacacatatgac

SEQ ID NO: 16372 - DNA, 31 bp, Artificial Sequence
  Description of Artificial Sequence: Synthetic oligonucleotide
agatacacctgccatgtgcagcatgaggatc

SEQ ID NO: 16373 - DNA, 30 bp, Artificial Sequence
  Description of Artificial Sequence: Synthetic oligonucleotide
gatacacctgccatgtgcagcatgaggatc

SEQ ID NO: 16374 - DNA, 31 bp, Artificial Sequence
  Description of Artificial Sequence: Synthetic oligonucleotide
atacacctgccatgtgcagcatgaggatctg

SEQ ID NO: 16375 - DNA, 30 bp, Artificial Sequence
  Description of Artificial Sequence: Synthetic oligonucleotide
tacacctgccatgtgcagcatgaggatctg

SEQ ID NO: 16376 - DNA, 29 bp, Artificial Sequence
  Description of Artificial Sequence: Synthetic oligonucleotide
acacctgccatgtgcagcatgaggatctg

SEQ ID NO: 16377 - DNA, 28 bp, Artificial Sequence
  Description of Artificial Sequence: Synthetic oligonucleotide
cacctgccatgtgcagcatgaggatctg

SEQ ID NO: 16378 - DNA, 28 bp, Artificial Sequence
  Description of Artificial Sequence: Synthetic oligonucleotide
acctgccatgtgcagcatgaggatctgc

SEQ ID NO: 16379 - DNA, 27 bp, Artificial Sequence
  Description of Artificial Sequence: Synthetic oligonucleotide
cctgccatgtgcagcatgaggatctgc

SEQ ID NO: 16380 - DNA, 27 bp, Artificial Sequence
  Description of Artificial Sequence: Synthetic oligonucleotide
ctgccatgtgcagcatgaggatctgcc

SEQ ID NO: 16381 - DNA, 27 bp, Artificial Sequence
  Description of Artificial Sequence: Synthetic oligonucleotide
tgccatgtgcagcatgaggatctgccc

SEQ ID NO: 16382 - DNA, 27 bp, Artificial Sequence
  Description of Artificial Sequence: Synthetic oligonucleotide
gccatgtgcagcatgaggatctgccca

SEQ ID NO: 16383 - DNA, 28 bp, Artificial Sequence
  Description of Artificial Sequence: Synthetic oligonucleotide
ccatgtgcagcatgaggatctgcccaag

SEQ ID NO: 16384 - DNA, 28 bp, Artificial Sequence
  Description of Artificial Sequence: Synthetic oligonucleotide
catgtgcagcatgaggatctgcccaagc

SEQ ID NO: 16385 - DNA, 28 bp, Artificial Sequence
  Description of Artificial Sequence: Synthetic oligonucleotide
atgtgcagcatgaggatctgcccaagcc

SEQ ID NO: 16386 - DNA, 27 bp, Artificial Sequence
  Description of Artificial Sequence: Synthetic oligonucleotide
tgtgcagcatgaggatctgcccaagcc

SEQ ID NO: 16387 - DNA, 26 bp, Artificial Sequence
  Description of Artificial Sequence: Synthetic oligonucleotide
gtgcagcatgaggatctgcccaagcc

SEQ ID NO: 16388 - DNA, 26 bp, Artificial Sequence
  Description of Artificial Sequence: Synthetic oligonucleotide
tgcagcatgaggatctgcccaagccc

SEQ ID NO: 16389 - DNA, 25 bp, Artificial Sequence
  Description of Artificial Sequence: Synthetic oligonucleotide
gcagcatgaggatctgcccaagccc

SEQ ID NO: 16390 - DNA, 26 bp, Artificial Sequence
  Description of Artificial Sequence: Synthetic oligonucleotide
cagcatgaggatctgcccaagcccct

SEQ ID NO: 16391 - DNA, 27 bp, Artificial Sequence
  Description of Artificial Sequence: Synthetic oligonucleotide
agcatgaggatctgcccaagcccctca

SEQ ID NO: 16392 - DNA, 26 bp, Artificial Sequence
  Description of Artificial Sequence: Synthetic oligonucleotide
gcatgaggatctgcccaagcccctca

SEQ ID NO: 16393 - DNA, 26 bp, Artificial Sequence
  Description of Artificial Sequence: Synthetic oligonucleotide
catgaggatctgcccaagcccctcac

SEQ ID NO: 16394 - DNA, 26 bp, Artificial Sequence
  Description of Artificial Sequence: Synthetic oligonucleotide
atgaggatctgcccaagcccctcacc

SEQ ID NO: 16395 - DNA, 25 bp, Artificial Sequence
  Description of Artificial Sequence: Synthetic oligonucleotide
tgaggatctgcccaagcccctcacc

SEQ ID NO: 16396 - DNA, 24 bp, Artificial Sequence
  Description of Artificial Sequence: Synthetic oligonucleotide
gaggatctgcccaagcccctcacc

SEQ ID NO: 16397 - DNA, 25 bp, Artificial Sequence
  Description of Artificial Sequence: Synthetic oligonucleotide
aggatctgcccaagcccctcaccct

SEQ ID NO: 16398 - DNA, 24 bp, Artificial Sequence
  Description of Artificial Sequence: Synthetic oligonucleotide
ggatctgcccaagcccctcaccct

SEQ ID NO: 16399 - DNA, 25 bp, Artificial Sequence
  Description of Artificial Sequence: Synthetic oligonucleotide
gatctgcccaagcccctcaccctga

SEQ ID NO: 16400 - DNA, 27 bp, Artificial Sequence
  Description of Artificial Sequence: Synthetic oligonucleotide
atctgcccaagcccctcaccctgagat

SEQ ID NO: 16401 - DNA, 24 bp, Artificial Sequence
  Description of Artificial Sequence: Synthetic oligonucleotide
atcgccgtgggctacgtggacgac

SEQ ID NO: 16402 - DNA, 23 bp, Artificial Sequence
  Description of Artificial Sequence: Synthetic oligonucleotide
tcgccgtgggctacgtggacgac

SEQ ID NO: 16403 - DNA, 22 bp, Artificial Sequence
  Description of Artificial Sequence: Synthetic oligonucleotide
cgccgtgggctacgtggacgac

SEQ ID NO: 16404 - DNA, 22 bp, Artificial Sequence
  Description of Artificial Sequence: Synthetic oligonucleotide
gccgtgggctacgtggacgacc

SEQ ID NO: 16405 - DNA, 22 bp, Artificial Sequence
  Description of Artificial Sequence: Synthetic oligonucleotide
ccgtgggctacgtggacgaccc

SEQ ID NO: 16406 - DNA, 22 bp, Artificial Sequence
  Description of Artificial Sequence: Synthetic oligonucleotide
cgtgggctacgtggacgacccg

SEQ ID NO: 16407 - DNA, 23 bp, Artificial Sequence
  Description of Artificial Sequence: Synthetic oligonucleotide
gtgggctacgtggacgacccgca

SEQ ID NO: 16408 - DNA, 25 bp, Artificial Sequence
  Description of Artificial Sequence: Synthetic oligonucleotide
tgggctacgtggacgacccgcagtt

SEQ ID NO: 16409 - DNA, 24 bp, Artificial Sequence
  Description of Artificial Sequence: Synthetic oligonucleotide
gggctacgtggacgacccgcagtt

SEQ ID NO: 16410 - DNA, 24 bp, Artificial Sequence
  Description of Artificial Sequence: Synthetic oligonucleotide
ggctacgtggacgacccgcagttc

SEQ ID NO: 16411 - DNA, 25 bp, Artificial Sequence
  Description of Artificial Sequence: Synthetic oligonucleotide
gctacgtggacgacccgcagttcgt

SEQ ID NO: 16412 - DNA, 25 bp, Artificial Sequence
  Description of Artificial Sequence: Synthetic oligonucleotide
ctacgtggacgacccgcagttcgtg

SEQ ID NO: 16413 - DNA, 25 bp, Artificial Sequence
  Description of Artificial Sequence: Synthetic oligonucleotide
tacgtggacgacccgcagttcgtgc

SEQ ID NO: 16414 - DNA, 24 bp, Artificial Sequence
  Description of Artificial Sequence: Synthetic oligonucleotide
acgtggacgacccgcagttcgtgc

SEQ ID NO: 16415 - DNA, 23 bp, Artificial Sequence
  Description of Artificial Sequence: Synthetic oligonucleotide
cgtggacgacccgcagttcgtgc

SEQ ID NO: 16416 - DNA, 23 bp, Artificial Sequence
  Description of Artificial Sequence: Synthetic oligonucleotide
gtggacgacccgcagttcgtgcg

SEQ ID NO: 16417 - DNA, 25 bp, Artificial Sequence
  Description of Artificial Sequence: Synthetic oligonucleotide
tggacgacccgcagttcgtgcggtt

SEQ ID NO: 16418 - DNA, 24 bp, Artificial Sequence
  Description of Artificial Sequence: Synthetic oligonucleotide
ggacgacccgcagttcgtgcggtt

SEQ ID NO: 16419 - DNA, 24 bp, Artificial Sequence
  Description of Artificial Sequence: Synthetic oligonucleotide
gacgacccgcagttcgtgcggttc

SEQ ID NO: 16420 - DNA, 25 bp, Artificial Sequence
  Description of Artificial Sequence: Synthetic oligonucleotide
acgacccgcagttcgtgcggttcga

SEQ ID NO: 16421 - DNA, 24 bp, Artificial Sequence
  Description of Artificial Sequence: Synthetic oligonucleotide
cgacccgcagttcgtgcggttcga

SEQ ID NO: 16422 - DNA, 25 bp, Artificial Sequence
  Description of Artificial Sequence: Synthetic oligonucleotide
gacccgcagttcgtgcggttcgaca

SEQ ID NO: 16423 - DNA, 25 bp, Artificial Sequence
  Description of Artificial Sequence: Synthetic oligonucleotide
acccgcagttcgtgcggttcgacag

SEQ ID NO: 16424 - DNA, 24 bp, Artificial Sequence
  Description of Artificial Sequence: Synthetic oligonucleotide
cccgcagttcgtgcggttcgacag

SEQ ID NO: 16425 - DNA, 24 bp, Artificial Sequence
  Description of Artificial Sequence: Synthetic oligonucleotide
ccgcagttcgtgcggttcgacagc

SEQ ID NO: 16426 - DNA, 24 bp, Artificial Sequence
  Description of Artificial Sequence: Synthetic oligonucleotide
cgaggccggttctcacaccctcct

SEQ ID NO: 16427 - DNA, 26 bp, Artificial Sequence
  Description of Artificial Sequence: Synthetic oligonucleotide
gaggccggttctcacaccctcctgat

SEQ ID NO: 16428 - DNA, 27 bp, Artificial Sequence
  Description of Artificial Sequence: Synthetic oligonucleotide
aggccggttctcacaccctcctgatga

SEQ ID NO: 16429 - DNA, 27 bp, Artificial Sequence
  Description of Artificial Sequence: Synthetic oligonucleotide
ggccggttctcacaccctcctgatgat

SEQ ID NO: 16430 - DNA, 27 bp, Artificial Sequence
  Description of Artificial Sequence: Synthetic oligonucleotide
gccggttctcacaccctcctgatgatg

SEQ ID NO: 16431 - DNA, 30 bp, Artificial Sequence
  Description of Artificial Sequence: Synthetic oligonucleotide
ccggttctcacaccctcctgatgatgtttg

SEQ ID NO: 16432 - DNA, 30 bp, Artificial Sequence
  Description of Artificial Sequence: Synthetic oligonucleotide
cggttctcacaccctcctgatgatgtttgg

SEQ ID NO: 16433 - DNA, 30 bp, Artificial Sequence
  Description of Artificial Sequence: Synthetic oligonucleotide
ggttctcacaccctcctgatgatgtttggc

SEQ ID NO: 16434 - DNA, 31 bp, Artificial Sequence
  Description of Artificial Sequence: Synthetic oligonucleotide
gttctcacaccctcctgatgatgtttggctg

SEQ ID NO: 16435 - DNA, 31 bp, Artificial Sequence
  Description of Artificial Sequence: Synthetic oligonucleotide
ttctcacaccctcctgatgatgtttggctgc

SEQ ID NO: 16436 - DNA, 30 bp, Artificial Sequence
  Description of Artificial Sequence: Synthetic oligonucleotide
tctcacaccctcctgatgatgtttggctgc

SEQ ID NO: 16437 - DNA, 29 bp, Artificial Sequence
  Description of Artificial Sequence: Synthetic oligonucleotide
ctcacaccctcctgatgatgtttggctgc

SEQ ID NO: 16438 - DNA, 29 bp, Artificial Sequence
  Description of Artificial Sequence: Synthetic oligonucleotide
tcacaccctcctgatgatgtttggctgcg

SEQ ID NO: 16439 - DNA, 28 bp, Artificial Sequence
  Description of Artificial Sequence: Synthetic oligonucleotide
cacaccctcctgatgatgtttggctgcg

SEQ ID NO: 16440 - DNA, 29 bp, Artificial Sequence
  Description of Artificial Sequence: Synthetic oligonucleotide
acaccctcctgatgatgtttggctgcgac

SEQ ID NO: 16441 - DNA, 28 bp, Artificial Sequence
  Description of Artificial Sequence: Synthetic oligonucleotide
caccctcctgatgatgtttggctgcgac

SEQ ID NO: 16442 - DNA, 28 bp, Artificial Sequence
  Description of Artificial Sequence: Synthetic oligonucleotide
accctcctgatgatgtttggctgcgacg

SEQ ID NO: 16443 - DNA, 27 bp, Artificial Sequence
  Description of Artificial Sequence: Synthetic oligonucleotide
ccctcctgatgatgtttggctgcgacg

SEQ ID NO: 16444 - DNA, 28 bp, Artificial Sequence
  Description of Artificial Sequence: Synthetic oligonucleotide
cctcctgatgatgtttggctgcgacgtg

SEQ ID NO: 16445 - DNA, 28 bp, Artificial Sequence
  Description of Artificial Sequence: Synthetic oligonucleotide
ctcctgatgatgtttggctgcgacgtgg

SEQ ID NO: 16446 - DNA, 28 bp, Artificial Sequence
  Description of Artificial Sequence: Synthetic oligonucleotide
tcctgatgatgtttggctgcgacgtggg

SEQ ID NO: 16447 - DNA, 27 bp, Artificial Sequence
  Description of Artificial Sequence: Synthetic oligonucleotide
cctgatgatgtttggctgcgacgtggg

SEQ ID NO: 16448 - DNA, 27 bp, Artificial Sequence
  Description of Artificial Sequence: Synthetic oligonucleotide
ctgatgatgtttggctgcgacgtgggg

SEQ ID NO: 16449 - DNA, 28 bp, Artificial Sequence
  Description of Artificial Sequence: Synthetic oligonucleotide
tgatgatgtttggctgcgacgtggggtc

SEQ ID NO: 16450 - DNA, 27 bp, Artificial Sequence
  Description of Artificial Sequence: Synthetic oligonucleotide
ctgagatgctgggccctgggcttctaa

SEQ ID NO: 16451 - DNA, 27 bp, Artificial Sequence
  Description of Artificial Sequence: Synthetic oligonucleotide
tgagatgctgggccctgggcttctaac

SEQ ID NO: 16452 - DNA, 26 bp, Artificial Sequence
  Description of Artificial Sequence: Synthetic oligonucleotide
gagatgctgggccctgggcttctaac

SEQ ID NO: 16453 - DNA, 27 bp, Artificial Sequence
  Description of Artificial Sequence: Synthetic oligonucleotide
agatgctgggccctgggcttctaacct

SEQ ID NO: 16454 - DNA, 26 bp, Artificial Sequence
  Description of Artificial Sequence: Synthetic oligonucleotide
gatgctgggccctgggcttctaacct

SEQ ID NO: 16455 - DNA, 26 bp, Artificial Sequence
  Description of Artificial Sequence: Synthetic oligonucleotide
atgctgggccctgggcttctaacctg

SEQ ID NO: 16456 - DNA, 25 bp, Artificial Sequence
  Description of Artificial Sequence: Synthetic oligonucleotide
tgctgggccctgggcttctaacctg

SEQ ID NO: 16457 - DNA, 24 bp, Artificial Sequence
  Description of Artificial Sequence: Synthetic oligonucleotide
gctgggccctgggcttctaacctg

SEQ ID NO: 16458 - DNA, 24 bp, Artificial Sequence
  Description of Artificial Sequence: Synthetic oligonucleotide
ctgggccctgggcttctaacctgc

SEQ ID NO: 16459 - DNA, 24 bp, Artificial Sequence
  Description of Artificial Sequence: Synthetic oligonucleotide
tgggccctgggcttctaacctgcg

SEQ ID NO: 16460 - DNA, 23 bp, Artificial Sequence
  Description of Artificial Sequence: Synthetic oligonucleotide
gggccctgggcttctaacctgcg

SEQ ID NO: 16461 - DNA, 24 bp, Artificial Sequence
  Description of Artificial Sequence: Synthetic oligonucleotide
ggccctgggcttctaacctgcgga

SEQ ID NO: 16462 - DNA, 26 bp, Artificial Sequence
  Description of Artificial Sequence: Synthetic oligonucleotide
gccctgggcttctaacctgcggagat

SEQ ID NO: 16463 - DNA, 27 bp, Artificial Sequence
  Description of Artificial Sequence: Synthetic oligonucleotide
ccctgggcttctaacctgcggagatca

SEQ ID NO: 16464 - DNA, 27 bp, Artificial Sequence
  Description of Artificial Sequence: Synthetic oligonucleotide
cctgggcttctaacctgcggagatcac

SEQ ID NO: 16465 - DNA, 28 bp, Artificial Sequence
  Description of Artificial Sequence: Synthetic oligonucleotide
ctgggcttctaacctgcggagatcacac

SEQ ID NO: 16466 - DNA, 29 bp, Artificial Sequence
  Description of Artificial Sequence: Synthetic oligonucleotide
tgggcttctaacctgcggagatcacactg

SEQ ID NO: 16467 - DNA, 28 bp, Artificial Sequence
  Description of Artificial Sequence: Synthetic oligonucleotide
gggcttctaacctgcggagatcacactg

SEQ ID NO: 16468 - DNA, 29 bp, Artificial Sequence
  Description of Artificial Sequence: Synthetic oligonucleotide
ggcttctaacctgcggagatcacactgac

SEQ ID NO: 16469 - DNA, 29 bp, Artificial Sequence
  Description of Artificial Sequence: Synthetic oligonucleotide
gcttctaacctgcggagatcacactgacc

SEQ ID NO: 16470 - DNA, 30 bp, Artificial Sequence
  Description of Artificial Sequence: Synthetic oligonucleotide
cttctaacctgcggagatcacactgacctg

SEQ ID NO: 16471 - DNA, 30 bp, Artificial Sequence
  Description of Artificial Sequence: Synthetic oligonucleotide
ttctaacctgcggagatcacactgacctgg

SEQ ID NO: 16472 - DNA, 29 bp, Artificial Sequence
  Description of Artificial Sequence: Synthetic oligonucleotide
tctaacctgcggagatcacactgacctgg

SEQ ID NO: 16473 - DNA, 28 bp, Artificial Sequence
  Description of Artificial Sequence: Synthetic oligonucleotide
ctaacctgcggagatcacactgacctgg

SEQ ID NO: 16474 - DNA, 28 bp, Artificial Sequence
  Description of Artificial Sequence: Synthetic oligonucleotide
taacctgcggagatcacactgacctggc

SEQ ID NO: 16475 - DNA, 27 bp, Artificial Sequence
  Description of Artificial Sequence: Synthetic oligonucleotide
aacctgcggagatcacactgacctggc

SEQ ID NO: 16476 - DNA, 27 bp, Artificial Sequence
  Description of Artificial Sequence: Synthetic oligonucleotide
acctgcggagatcacactgacctggca

SEQ ID NO: 16477 - DNA, 26 bp, Artificial Sequence
  Description of Artificial Sequence: Synthetic oligonucleotide
tccgcgggtaccaccagtacgcctaa

SEQ ID NO: 16478 - DNA, 25 bp, Artificial Sequence
  Description of Artificial Sequence: Synthetic oligonucleotide
ccgcgggtaccaccagtacgcctaa

SEQ ID NO: 16479 - DNA, 26 bp, Artificial Sequence
  Description of Artificial Sequence: Synthetic oligonucleotide
cgcgggtaccaccagtacgcctaaga

SEQ ID NO: 16480 - DNA, 26 bp, Artificial Sequence
  Description of Artificial Sequence: Synthetic oligonucleotide
gcgggtaccaccagtacgcctaagac

SEQ ID NO: 16481 - DNA, 26 bp, Artificial Sequence
  Description of Artificial Sequence: Synthetic oligonucleotide
cgggtaccaccagtacgcctaagacg

SEQ ID NO: 16482 - DNA, 26 bp, Artificial Sequence
  Description of Artificial Sequence: Synthetic oligonucleotide
gggtaccaccagtacgcctaagacgg

SEQ ID NO: 16483 - DNA, 27 bp, Artificial Sequence
  Description of Artificial Sequence: Synthetic oligonucleotide
ggtaccaccagtacgcctaagacggca

SEQ ID NO: 16484 - DNA, 28 bp, Artificial Sequence
  Description of Artificial Sequence: Synthetic oligonucleotide
gtaccaccagtacgcctaagacggcaag

SEQ ID NO: 16485 - DNA, 28 bp, Artificial Sequence
  Description of Artificial Sequence: Synthetic oligonucleotide
taccaccagtacgcctaagacggcaagg

SEQ ID NO: 16486 - DNA, 27 bp, Artificial Sequence
  Description of Artificial Sequence: Synthetic oligonucleotide
accaccagtacgcctaagacggcaagg

SEQ ID NO: 16487 - DNA, 27 bp, Artificial Sequence
  Description of Artificial Sequence: Synthetic oligonucleotide
ccaccagtacgcctaagacggcaagga

SEQ ID NO: 16488 - DNA, 30 bp, Artificial Sequence
  Description of Artificial Sequence: Synthetic oligonucleotide
caccagtacgcctaagacggcaaggattac

SEQ ID NO: 16489 - DNA, 32 bp, Artificial Sequence
  Description of Artificial Sequence: Synthetic oligonucleotide
accagtacgcctaagacggcaaggattacatc

SEQ ID NO: 16490 - DNA, 31 bp, Artificial Sequence
  Description of Artificial Sequence: Synthetic oligonucleotide
ccagtacgcctaagacggcaaggattacatc

SEQ ID NO: 16491 - DNA, 31 bp, Artificial Sequence
  Description of Artificial Sequence: Synthetic oligonucleotide
cagtacgcctaagacggcaaggattacatcg

SEQ ID NO: 16492 - DNA, 31 bp, Artificial Sequence
  Description of Artificial Sequence: Synthetic oligonucleotide
agtacgcctaagacggcaaggattacatcgc

SEQ ID NO: 16493 - DNA, 30 bp, Artificial Sequence
  Description of Artificial Sequence: Synthetic oligonucleotide
gtacgcctaagacggcaaggattacatcgc

SEQ ID NO: 16494 - DNA, 30 bp, Artificial Sequence
  Description of Artificial Sequence: Synthetic oligonucleotide
tacgcctaagacggcaaggattacatcgcc

SEQ ID NO: 16495 - DNA, 32 bp, Artificial Sequence
  Description of Artificial Sequence: Synthetic oligonucleotide
ctaagacggcaaggattacatcgccctgaaag

SEQ ID NO: 16496 - DNA, 33 bp, Artificial Sequence
  Description of Artificial Sequence: Synthetic oligonucleotide
taagacggcaaggattacatcgccctgaaagag

SEQ ID NO: 16497 - DNA, 32 bp, Artificial Sequence
  Description of Artificial Sequence: Synthetic oligonucleotide
aagacggcaaggattacatcgccctgaaagag

SEQ ID NO: 16498 - DNA, 31 bp, Artificial Sequence
  Description of Artificial Sequence: Synthetic oligonucleotide
agacggcaaggattacatcgccctgaaagag

SEQ ID NO: 16499 - DNA, 24 bp, Artificial Sequence
  Description of Artificial Sequence: Synthetic oligonucleotide
aagcgcaagtgggaggcggcccaa

SEQ ID NO: 16500 - DNA, 23 bp, Artificial Sequence
  Description of Artificial Sequence: Synthetic oligonucleotide
agcgcaagtgggaggcggcccaa

SEQ ID NO: 16501 - DNA, 22 bp, Artificial Sequence
  Description of Artificial Sequence: Synthetic oligonucleotide
gcgcaagtgggaggcggcccaa

SEQ ID NO: 16502 - DNA, 23 bp, Artificial Sequence
  Description of Artificial Sequence: Synthetic oligonucleotide
cgcaagtgggaggcggcccaagt

SEQ ID NO: 16503 - DNA, 23 bp, Artificial Sequence
  Description of Artificial Sequence: Synthetic oligonucleotide
gcaagtgggaggcggcccaagtg

SEQ ID NO: 16504 - DNA, 23 bp, Artificial Sequence
  Description of Artificial Sequence: Synthetic oligonucleotide
caagtgggaggcggcccaagtgg

SEQ ID NO: 16505 - DNA, 23 bp, Artificial Sequence
  Description of Artificial Sequence: Synthetic oligonucleotide
aagtgggaggcggcccaagtggc

SEQ ID NO: 16506 - DNA, 22 bp, Artificial Sequence
  Description of Artificial Sequence: Synthetic oligonucleotide
agtgggaggcggcccaagtggc

SEQ ID NO: 16507 - DNA, 21 bp, Artificial Sequence
  Description of Artificial Sequence: Synthetic oligonucleotide
gtgggaggcggcccaagtggc

SEQ ID NO: 16508 - DNA, 21 bp, Artificial Sequence
  Description of Artificial Sequence: Synthetic oligonucleotide
tgggaggcggcccaagtggcg

SEQ ID NO: 16509 - DNA, 20 bp, Artificial Sequence
  Description of Artificial Sequence: Synthetic oligonucleotide
gggaggcggcccaagtggcg

SEQ ID NO: 16510 - DNA, 21 bp, Artificial Sequence
  Description of Artificial Sequence: Synthetic oligonucleotide
ggaggcggcccaagtggcgga

SEQ ID NO: 16511 - DNA, 21 bp, Artificial Sequence
  Description of Artificial Sequence: Synthetic oligonucleotide
gaggcggcccaagtggcggag

SEQ ID NO: 16512 - DNA, 22 bp, Artificial Sequence
  Description of Artificial Sequence: Synthetic oligonucleotide
aggcggcccaagtggcggagca

SEQ ID NO: 16513 - DNA, 21 bp, Artificial Sequence
  Description of Artificial Sequence: Synthetic oligonucleotide
ggcggcccaagtggcggagca

SEQ ID NO: 16514 - DNA, 21 bp, Artificial Sequence
  Description of Artificial Sequence: Synthetic oligonucleotide
gcggcccaagtggcggagcag

SEQ ID NO: 16515 - DNA, 22 bp, Artificial Sequence
  Description of Artificial Sequence: Synthetic oligonucleotide
cggcccaagtggcggagcagca

SEQ ID NO: 16516 - DNA, 23 bp, Artificial Sequence
  Description of Artificial Sequence: Synthetic oligonucleotide
ggcccaagtggcggagcagcaga

SEQ ID NO: 16517 - DNA, 24 bp, Artificial Sequence
  Description of Artificial Sequence: Synthetic oligonucleotide
gcccaagtggcggagcagcagaga

SEQ ID NO: 16518 - DNA, 24 bp, Artificial Sequence
  Description of Artificial Sequence: Synthetic oligonucleotide
cccaagtggcggagcagcagagag

SEQ ID NO: 16519 - DNA, 24 bp, Artificial Sequence
  Description of Artificial Sequence: Synthetic oligonucleotide
ccaagtggcggagcagcagagagc

SEQ ID NO: 16520 - DNA, 26 bp, Artificial Sequence
  Description of Artificial Sequence: Synthetic oligonucleotide
caagtggcggagcagcagagagccta

SEQ ID NO: 16521 - DNA, 26 bp, Artificial Sequence
  Description of Artificial Sequence: Synthetic oligonucleotide
aagtggcggagcagcagagagcctac

SEQ ID NO: 16522 - DNA, 25 bp, Artificial Sequence
  Description of Artificial Sequence: Synthetic oligonucleotide
agtggcggagcagcagagagcctac

SEQ ID NO: 16523 - DNA, 27 bp, Artificial Sequence
  Description of Artificial Sequence: Synthetic oligonucleotide
agaacgggaaggagacgctgcagcgaa

SEQ ID NO: 16524 - DNA, 26 bp, Artificial Sequence
  Description of Artificial Sequence: Synthetic oligonucleotide
gaacgggaaggagacgctgcagcgaa

SEQ ID NO: 16525 - DNA, 26 bp, Artificial Sequence
  Description of Artificial Sequence: Synthetic oligonucleotide
aacgggaaggagacgctgcagcgaag

SEQ ID NO: 16526 - DNA, 25 bp, Artificial Sequence
  Description of Artificial Sequence: Synthetic oligonucleotide
acgggaaggagacgctgcagcgaag

SEQ ID NO: 16527 - DNA, 24 bp, Artificial Sequence
  Description of Artificial Sequence: Synthetic oligonucleotide
cgggaaggagacgctgcagcgaag

SEQ ID NO: 16528 - DNA, 25 bp, Artificial Sequence
  Description of Artificial Sequence: Synthetic oligonucleotide
gggaaggagacgctgcagcgaagga

SEQ ID NO: 16529 - DNA, 26 bp, Artificial Sequence
  Description of Artificial Sequence: Synthetic oligonucleotide
ggaaggagacgctgcagcgaaggaga

SEQ ID NO: 16530 - DNA, 26 bp, Artificial Sequence
  Description of Artificial Sequence: Synthetic oligonucleotide
gaaggagacgctgcagcgaaggagac

SEQ ID NO: 16531 - DNA, 26 bp, Artificial Sequence
  Description of Artificial Sequence: Synthetic oligonucleotide
aaggagacgctgcagcgaaggagacg

SEQ ID NO: 16532 - DNA, 25 bp, Artificial Sequence
  Description of Artificial Sequence: Synthetic oligonucleotide
aggagacgctgcagcgaaggagacg

SEQ ID NO: 16533 - DNA, 24 bp, Artificial Sequence
  Description of Artificial Sequence: Synthetic oligonucleotide
ggagacgctgcagcgaaggagacg

SEQ ID NO: 16534 - DNA, 25 bp, Artificial Sequence
  Description of Artificial Sequence: Synthetic oligonucleotide
gagacgctgcagcgaaggagacgct

SEQ ID NO: 16535 - DNA, 25 bp, Artificial Sequence
  Description of Artificial Sequence: Synthetic oligonucleotide
agacgctgcagcgaaggagacgctg

SEQ ID NO: 16536 - DNA, 24 bp, Artificial Sequence
  Description of Artificial Sequence: Synthetic oligonucleotide
gacgctgcagcgaaggagacgctg

SEQ ID NO: 16537 - DNA, 25 bp, Artificial Sequence
  Description of Artificial Sequence: Synthetic oligonucleotide
acgctgcagcgaaggagacgctgca

SEQ ID NO: 16538 - DNA, 24 bp, Artificial Sequence
  Description of Artificial Sequence: Synthetic oligonucleotide
cgctgcagcgaaggagacgctgca

SEQ ID NO: 16539 - DNA, 24 bp, Artificial Sequence
  Description of Artificial Sequence: Synthetic oligonucleotide
gctgcagcgaaggagacgctgcag

SEQ ID NO: 16540 - DNA, 24 bp, Artificial Sequence
  Description of Artificial Sequence: Synthetic oligonucleotide
ctgcagcgaaggagacgctgcagc

SEQ ID NO: 16541 - DNA, 24 bp, Artificial Sequence
  Description of Artificial Sequence: Synthetic oligonucleotide
tgcagcgaaggagacgctgcagcg

SEQ ID NO: 16542 - DNA, 23 bp, Artificial Sequence
  Description of Artificial Sequence: Synthetic oligonucleotide
gcagcgaaggagacgctgcagcg

SEQ ID NO: 16543 - DNA, 24 bp, Artificial Sequence
  Description of Artificial Sequence: Synthetic oligonucleotide
cagcgaaggagacgctgcagcgca

SEQ ID NO: 16544 - DNA, 24 bp, Artificial Sequence
  Description of Artificial Sequence: Synthetic oligonucleotide
agcgaaggagacgctgcagcgcac

SEQ ID NO: 16545 - DNA, 23 bp, Artificial Sequence
  Description of Artificial Sequence: Synthetic oligonucleotide
gcgaaggagacgctgcagcgcac

SEQ ID NO: 16546 - DNA, 23 bp, Artificial Sequence
  Description of Artificial Sequence: Synthetic oligonucleotide
cgaaggagacgctgcagcgcacg

SEQ ID NO: 16547 - DNA, 33 bp, Artificial Sequence
  Description of Artificial Sequence: Synthetic oligonucleotide
gctcccaatccatgaggtatttcttcacatccg

SEQ ID NO: 16548 - DNA, 34 bp, Artificial Sequence
  Description of Artificial Sequence: Synthetic oligonucleotide
ctcccaatccatgaggtatttcttcacatccgtg

SEQ ID NO: 16549 - DNA, 35 bp, Artificial Sequence
  Description of Artificial Sequence: Synthetic oligonucleotide
tcccaatccatgaggtatttcttcacatccgtgtc

SEQ ID NO: 16550 - DNA, 34 bp, Artificial Sequence
  Description of Artificial Sequence: Synthetic oligonucleotide
cccaatccatgaggtatttcttcacatccgtgtc

SEQ ID NO: 16551 - DNA, 34 bp, Artificial Sequence
  Description of Artificial Sequence: Synthetic oligonucleotide
ccaatccatgaggtatttcttcacatccgtgtcc

SEQ ID NO: 16552 - DNA, 34 bp, Artificial Sequence
  Description of Artificial Sequence: Synthetic oligonucleotide
caatccatgaggtatttcttcacatccgtgtccc

SEQ ID NO: 16553 - DNA, 34 bp, Artificial Sequence
  Description of Artificial Sequence: Synthetic oligonucleotide
aatccatgaggtatttcttcacatccgtgtcccg

SEQ ID NO: 16554 - DNA, 33 bp, Artificial Sequence
  Description of Artificial Sequence: Synthetic oligonucleotide
atccatgaggtatttcttcacatccgtgtcccg

SEQ ID NO: 16555 - DNA, 25 bp, Artificial Sequence
  Description of Artificial Sequence: Synthetic oligonucleotide
ggcccatgtggcggagcagcagaaa

SEQ ID NO: 16556 - DNA, 25 bp, Artificial Sequence
  Description of Artificial Sequence: Synthetic oligonucleotide
gcccatgtggcggagcagcagaaag

SEQ ID NO: 16557 - DNA, 25 bp, Artificial Sequence
  Description of Artificial Sequence: Synthetic oligonucleotide
cccatgtggcggagcagcagaaagc

SEQ ID NO: 16558 - DNA, 27 bp, Artificial Sequence
  Description of Artificial Sequence: Synthetic oligonucleotide
ccatgtggcggagcagcagaaagccta

SEQ ID NO: 16559 - DNA, 27 bp, Artificial Sequence
  Description of Artificial Sequence: Synthetic oligonucleotide
catgtggcggagcagcagaaagcctac

SEQ ID NO: 16560 - DNA, 27 bp, Artificial Sequence
  Description of Artificial Sequence: Synthetic oligonucleotide
atgtggcggagcagcagaaagcctacc

SEQ ID NO: 16561 - DNA, 27 bp, Artificial Sequence
  Description of Artificial Sequence: Synthetic oligonucleotide
tgtggcggagcagcagaaagcctacct

SEQ ID NO: 16562 - DNA, 26 bp, Artificial Sequence
  Description of Artificial Sequence: Synthetic oligonucleotide
gtggcggagcagcagaaagcctacct

SEQ ID NO: 16563 - DNA, 26 bp, Artificial Sequence
  Description of Artificial Sequence: Synthetic oligonucleotide
tggcggagcagcagaaagcctacctg

SEQ ID NO: 16564 - DNA, 25 bp, Artificial Sequence
  Description of Artificial Sequence: Synthetic oligonucleotide
ggcggagcagcagaaagcctacctg

SEQ ID NO: 16565 - DNA, 26 bp, Artificial Sequence
  Description of Artificial Sequence: Synthetic oligonucleotide
gcggagcagcagaaagcctacctgga

SEQ ID NO: 16566 - DNA, 26 bp, Artificial Sequence
  Description of Artificial Sequence: Synthetic oligonucleotide
cggagcagcagaaagcctacctggag

SEQ ID NO: 16567 - DNA, 26 bp, Artificial Sequence
  Description of Artificial Sequence: Synthetic oligonucleotide
ggagcagcagaaagcctacctggagg

SEQ ID NO: 16568 - DNA, 26 bp, Artificial Sequence
  Description of Artificial Sequence: Synthetic oligonucleotide
gagcagcagaaagcctacctggaggg

SEQ ID NO: 16569 - DNA, 27 bp, Artificial Sequence
  Description of Artificial Sequence: Synthetic oligonucleotide
agcagcagaaagcctacctggagggca

SEQ ID NO: 16570 - DNA, 26 bp, Artificial Sequence
  Description of Artificial Sequence: Synthetic oligonucleotide
gcagcagaaagcctacctggagggca

SEQ ID NO: 16571 - DNA, 26 bp, Artificial Sequence
  Description of Artificial Sequence: Synthetic oligonucleotide
cagcagaaagcctacctggagggcac

SEQ ID NO: 16572 - DNA, 27 bp, Artificial Sequence
  Description of Artificial Sequence: Synthetic oligonucleotide
agcagaaagcctacctggagggcacgt

SEQ ID NO: 16573 - DNA, 26 bp, Artificial Sequence
  Description of Artificial Sequence: Synthetic oligonucleotide
gcagaaagcctacctggagggcacgt

SEQ ID NO: 16574 - DNA, 26 bp, Artificial Sequence
  Description of Artificial Sequence: Synthetic oligonucleotide
cagaaagcctacctggagggcacgtg

SEQ ID NO: 16575 - DNA, 26 bp, Artificial Sequence
  Description of Artificial Sequence: Synthetic oligonucleotide
agaaagcctacctggagggcacgtgc

SEQ ID NO: 16576 - DNA, 30 bp, Artificial Sequence
  Description of Artificial Sequence: Synthetic oligonucleotide
ccggttctcacaccgtccagatgatgtttg

SEQ ID NO: 16577 - DNA, 30 bp, Artificial Sequence
  Description of Artificial Sequence: Synthetic oligonucleotide
cggttctcacaccgtccagatgatgtttgg

SEQ ID NO: 16578 - DNA, 30 bp, Artificial Sequence
  Description of Artificial Sequence: Synthetic oligonucleotide
ggttctcacaccgtccagatgatgtttggc

SEQ ID NO: 16579 - DNA, 31 bp, Artificial Sequence
  Description of Artificial Sequence: Synthetic oligonucleotide
gttctcacaccgtccagatgatgtttggctg

SEQ ID NO: 16580 - DNA, 31 bp, Artificial Sequence
  Description of Artificial Sequence: Synthetic oligonucleotide
ttctcacaccgtccagatgatgtttggctgc

SEQ ID NO: 16581 - DNA, 30 bp, Artificial Sequence
  Description of Artificial Sequence: Synthetic oligonucleotide
tctcacaccgtccagatgatgtttggctgc

SEQ ID NO: 16582 - DNA, 29 bp, Artificial Sequence
  Description of Artificial Sequence: Synthetic oligonucleotide
ctcacaccgtccagatgatgtttggctgc

SEQ ID NO: 16583 - DNA, 29 bp, Artificial Sequence
  Description of Artificial Sequence: Synthetic oligonucleotide
tcacaccgtccagatgatgtttggctgcg

SEQ ID NO: 16584 - DNA, 28 bp, Artificial Sequence
  Description of Artificial Sequence: Synthetic oligonucleotide
cacaccgtccagatgatgtttggctgcg

SEQ ID NO: 16585 - DNA, 29 bp, Artificial Sequence
  Description of Artificial Sequence: Synthetic oligonucleotide
acaccgtccagatgatgtttggctgcgac

SEQ ID NO: 16586 - DNA, 28 bp, Artificial Sequence
  Description of Artificial Sequence: Synthetic oligonucleotide
caccgtccagatgatgtttggctgcgac

SEQ ID NO: 16587 - DNA, 28 bp, Artificial Sequence
  Description of Artificial Sequence: Synthetic oligonucleotide
accgtccagatgatgtttggctgcgacg

SEQ ID NO: 16588 - DNA, 27 bp, Artificial Sequence
  Description of Artificial Sequence: Synthetic oligonucleotide
ccgtccagatgatgtttggctgcgacg

SEQ ID NO: 16589 - DNA, 28 bp, Artificial Sequence
  Description of Artificial Sequence: Synthetic oligonucleotide
cgtccagatgatgtttggctgcgacgtg

SEQ ID NO: 16590 - DNA, 28 bp, Artificial Sequence
  Description of Artificial Sequence: Synthetic oligonucleotide
gtccagatgatgtttggctgcgacgtgg

SEQ ID NO: 16591 - DNA, 24 bp, Artificial Sequence
  Description of Artificial Sequence: Synthetic oligonucleotide
acctgggcaggctcccactccatg

SEQ ID NO: 16592 - DNA, 23 bp, Artificial Sequence
  Description of Artificial Sequence: Synthetic oligonucleotide
cctgggcaggctcccactccatg

SEQ ID NO: 16593 - DNA, 23 bp, Artificial Sequence
  Description of Artificial Sequence: Synthetic oligonucleotide
ctgggcaggctcccactccatgg

SEQ ID NO: 16594 - DNA, 23 bp, Artificial Sequence
  Description of Artificial Sequence: Synthetic oligonucleotide
tgggcaggctcccactccatggg

SEQ ID NO: 16595 - DNA, 22 bp, Artificial Sequence
  Description of Artificial Sequence: Synthetic oligonucleotide
gggcaggctcccactccatggg

SEQ ID NO: 16596 - DNA, 27 bp, Artificial Sequence
  Description of Artificial Sequence: Synthetic oligonucleotide
ggcaggctcccactccatggggtattt

SEQ ID NO: 16597 - DNA, 27 bp, Artificial Sequence
  Description of Artificial Sequence: Synthetic oligonucleotide
gcaggctcccactccatggggtatttc

SEQ ID NO: 16598 - DNA, 28 bp, Artificial Sequence
  Description of Artificial Sequence: Synthetic oligonucleotide
caggctcccactccatggggtatttctc

SEQ ID NO: 16599 - DNA, 28 bp, Artificial Sequence
  Description of Artificial Sequence: Synthetic oligonucleotide
aggctcccactccatggggtatttctcc

SEQ ID NO: 16600 - DNA, 27 bp, Artificial Sequence
  Description of Artificial Sequence: Synthetic oligonucleotide
ggctcccactccatggggtatttctcc

SEQ ID NO: 16601 - DNA, 28 bp, Artificial Sequence
  Description of Artificial Sequence: Synthetic oligonucleotide
gctcccactccatggggtatttctccac

SEQ ID NO: 16602 - DNA, 30 bp, Artificial Sequence
  Description of Artificial Sequence: Synthetic oligonucleotide
ctcccactccatggggtatttctccacatc

SEQ ID NO: 16603 - DNA, 30 bp, Artificial Sequence
  Description of Artificial Sequence: Synthetic oligonucleotide
tcccactccatggggtatttctccacatcc

SEQ ID NO: 16604 - DNA, 29 bp, Artificial Sequence
  Description of Artificial Sequence: Synthetic oligonucleotide
cccactccatggggtatttctccacatcc

SEQ ID NO: 16605 - DNA, 29 bp, Artificial Sequence
  Description of Artificial Sequence: Synthetic oligonucleotide
ccactccatggggtatttctccacatccg

SEQ ID NO: 16606 - DNA, 30 bp, Artificial Sequence
  Description of Artificial Sequence: Synthetic oligonucleotide
cactccatggggtatttctccacatccgtg

SEQ ID NO: 16607 - DNA, 31 bp, Artificial Sequence
  Description of Artificial Sequence: Synthetic oligonucleotide
actccatggggtatttctccacatccgtgtc

SEQ ID NO: 16608 - DNA, 30 bp, Artificial Sequence
  Description of Artificial Sequence: Synthetic oligonucleotide
ctccatggggtatttctccacatccgtgtc

SEQ ID NO: 16609 - DNA, 30 bp, Artificial Sequence
  Description of Artificial Sequence: Synthetic oligonucleotide
tccatggggtatttctccacatccgtgtcc

SEQ ID NO: 16610 - DNA, 29 bp, Artificial Sequence
  Description of Artificial Sequence: Synthetic oligonucleotide
ccatggggtatttctccacatccgtgtcc

SEQ ID NO: 16611 - DNA, 29 bp, Artificial Sequence
  Description of Artificial Sequence: Synthetic oligonucleotide
catggggtatttctccacatccgtgtccc

SEQ ID NO: 16612 - DNA, 29 bp, Artificial Sequence
  Description of Artificial Sequence: Synthetic oligonucleotide
atggggtatttctccacatccgtgtcccg

SEQ ID NO: 16613 - DNA, 28 bp, Artificial Sequence
  Description of Artificial Sequence: Synthetic oligonucleotide
tggggtatttctccacatccgtgtcccg

SEQ ID NO: 16614 - DNA, 27 bp, Artificial Sequence
  Description of Artificial Sequence: Synthetic oligonucleotide
ggggtatttctccacatccgtgtcccg

SEQ ID NO: 16615 - DNA, 27 bp, Artificial Sequence
  Description of Artificial Sequence: Synthetic oligonucleotide
gggtatttctccacatccgtgtcccgg

SEQ ID NO: 16616 - DNA, 25 bp, Artificial Sequence
  Description of Artificial Sequence: Synthetic oligonucleotide
acgggcgcttcctccgcgggtataa

SEQ ID NO: 16617 - DNA, 24 bp, Artificial Sequence
  Description of Artificial Sequence: Synthetic oligonucleotide
cgggcgcttcctccgcgggtataa

SEQ ID NO: 16618 - DNA, 24 bp, Artificial Sequence
  Description of Artificial Sequence: Synthetic oligonucleotide
gggcgcttcctccgcgggtataac

SEQ ID NO: 16619 - DNA, 21 bp, Artificial Sequence
  Description of Artificial Sequence: Synthetic oligonucleotide
aggcggcccatgtggcggagc

SEQ ID NO: 16620 - DNA, 20 bp, Artificial Sequence
  Description of Artificial Sequence: Synthetic oligonucleotide
ggcggcccatgtggcggagc

SEQ ID NO: 16621 - DNA, 20 bp, Artificial Sequence
  Description of Artificial Sequence: Synthetic oligonucleotide
gcggcccatgtggcggagcg

SEQ ID NO: 16622 - DNA, 20 bp, Artificial Sequence
  Description of Artificial Sequence: Synthetic oligonucleotide
cggcccatgtggcggagcgg

SEQ ID NO: 16623 - DNA, 21 bp, Artificial Sequence
  Description of Artificial Sequence: Synthetic oligonucleotide
ggcccatgtggcggagcggca

SEQ ID NO: 16624 - DNA, 22 bp, Artificial Sequence
  Description of Artificial Sequence: Synthetic oligonucleotide
gcccatgtggcggagcggcaga

SEQ ID NO: 16625 - DNA, 23 bp, Artificial Sequence
  Description of Artificial Sequence: Synthetic oligonucleotide
cccatgtggcggagcggcagaga

SEQ ID NO: 16626 - DNA, 23 bp, Artificial Sequence
  Description of Artificial Sequence: Synthetic oligonucleotide
ccatgtggcggagcggcagagag

SEQ ID NO: 16627 - DNA, 23 bp, Artificial Sequence
  Description of Artificial Sequence: Synthetic oligonucleotide
catgtggcggagcggcagagagc

SEQ ID NO: 16628 - DNA, 25 bp, Artificial Sequence
  Description of Artificial Sequence: Synthetic oligonucleotide
atgtggcggagcggcagagagccta

SEQ ID NO: 16629 - DNA, 24 bp, Artificial Sequence
  Description of Artificial Sequence: Synthetic oligonucleotide
tgtggcggagcggcagagagccta

SEQ ID NO: 16630 - DNA, 23 bp, Artificial Sequence
  Description of Artificial Sequence: Synthetic oligonucleotide
gtggcggagcggcagagagccta

SEQ ID NO: 16631 - DNA, 23 bp, Artificial Sequence
  Description of Artificial Sequence: Synthetic oligonucleotide
tggcggagcggcagagagcctac

SEQ ID NO: 16632 - DNA, 22 bp, Artificial Sequence
  Description of Artificial Sequence: Synthetic oligonucleotide
ggcggagcggcagagagcctac

SEQ ID NO: 16633 - DNA, 23 bp, Artificial Sequence
  Description of Artificial Sequence: Synthetic oligonucleotide
gcggagcggcagagagcctacct

SEQ ID NO: 16634 - DNA, 23 bp, Artificial Sequence
  Description of Artificial Sequence: Synthetic oligonucleotide
cggagcggcagagagcctacctg

SEQ ID NO: 16635 - DNA, 24 bp, Artificial Sequence
  Description of Artificial Sequence: Synthetic oligonucleotide
ggagcggcagagagcctacctgga

SEQ ID NO: 16636 - DNA, 24 bp, Artificial Sequence
  Description of Artificial Sequence: Synthetic oligonucleotide
gagcggcagagagcctacctggag

SEQ ID NO: 16637 - DNA, 24 bp, Artificial Sequence
  Description of Artificial Sequence: Synthetic oligonucleotide
agcggcagagagcctacctggagg

SEQ ID NO: 16638 - DNA, 23 bp, Artificial Sequence
  Description of Artificial Sequence: Synthetic oligonucleotide
gcggcagagagcctacctggagg

SEQ ID NO: 16639 - DNA, 23 bp, Artificial Sequence
  Description of Artificial Sequence: Synthetic oligonucleotide
cggcagagagcctacctggaggg

SEQ ID NO: 16640 - DNA, 24 bp, Artificial Sequence
  Description of Artificial Sequence: Synthetic oligonucleotide
ggcagagagcctacctggagggca

SEQ ID NO: 16641 - DNA, 23 bp, Artificial Sequence
  Description of Artificial Sequence: Synthetic oligonucleotide
cgtggacgggctccgcagatacc

SEQ ID NO: 16642 - DNA, 23 bp, Artificial Sequence
  Description of Artificial Sequence: Synthetic oligonucleotide
gtggacgggctccgcagataccg

SEQ ID NO: 16643 - DNA, 23 bp, Artificial Sequence
  Description of Artificial Sequence: Synthetic oligonucleotide
tggacgggctccgcagataccgg

SEQ ID NO: 16644 - DNA, 22 bp, Artificial Sequence
  Description of Artificial Sequence: Synthetic oligonucleotide
ggacgggctccgcagataccgg

SEQ ID NO: 16645 - DNA, 23 bp, Artificial Sequence
  Description of Artificial Sequence: Synthetic oligonucleotide
gacgggctccgcagataccggga

SEQ ID NO: 16646 - DNA, 25 bp, Artificial Sequence
  Description of Artificial Sequence: Synthetic oligonucleotide
acgggctccgcagataccgggagaa

SEQ ID NO: 16647 - DNA, 24 bp, Artificial Sequence
  Description of Artificial Sequence: Synthetic oligonucleotide
cgggctccgcagataccgggagaa

SEQ ID NO: 16648 - DNA, 24 bp, Artificial Sequence
  Description of Artificial Sequence: Synthetic oligonucleotide
gggctccgcagataccgggagaac

SEQ ID NO: 16649 - DNA, 24 bp, Artificial Sequence
  Description of Artificial Sequence: Synthetic oligonucleotide
ggctccgcagataccgggagaacg

SEQ ID NO: 16650 - DNA, 24 bp, Artificial Sequence
  Description of Artificial Sequence: Synthetic oligonucleotide
gctccgcagataccgggagaacgg

SEQ ID NO: 16651 - DNA, 26 bp, Artificial Sequence
  Description of Artificial Sequence: Synthetic oligonucleotide
ctccgcagataccgggagaacgggaa

SEQ ID NO: 16652 - DNA, 26 bp, Artificial Sequence
  Description of Artificial Sequence: Synthetic oligonucleotide
tccgcagataccgggagaacgggaag

SEQ ID NO: 16653 - DNA, 25 bp, Artificial Sequence
  Description of Artificial Sequence: Synthetic oligonucleotide
ccgcagataccgggagaacgggaag

SEQ ID NO: 16654 - DNA, 26 bp, Artificial Sequence
  Description of Artificial Sequence: Synthetic oligonucleotide
cgcagataccgggagaacgggaagga

SEQ ID NO: 16655 - DNA, 27 bp, Artificial Sequence
  Description of Artificial Sequence: Synthetic oligonucleotide
gcagataccgggagaacgggaaggaga

SEQ ID NO: 16656 - DNA, 27 bp, Artificial Sequence
  Description of Artificial Sequence: Synthetic oligonucleotide
cagataccgggagaacgggaaggagac

SEQ ID NO: 16657 - DNA, 27 bp, Artificial Sequence
  Description of Artificial Sequence: Synthetic oligonucleotide
agataccgggagaacgggaaggagacg

SEQ ID NO: 16658 - DNA, 26 bp, Artificial Sequence
  Description of Artificial Sequence: Synthetic oligonucleotide
gataccgggagaacgggaaggagacg

SEQ ID NO: 16659 - DNA, 27 bp, Artificial Sequence
  Description of Artificial Sequence: Synthetic oligonucleotide
ataccgggagaacgggaaggagacgct

SEQ ID NO: 16660 - DNA, 26 bp, Artificial Sequence
  Description of Artificial Sequence: Synthetic oligonucleotide
taccgggagaacgggaaggagacgct

SEQ ID NO: 16661 - DNA, 25 bp, Artificial Sequence
  Description of Artificial Sequence: Synthetic oligonucleotide
accgggagaacgggaaggagacgct

SEQ ID NO: 16662 - DNA, 24 bp, Artificial Sequence
  Description of Artificial Sequence: Synthetic oligonucleotide
ccgggagaacgggaaggagacgct

SEQ ID NO: 16663 - DNA, 24 bp, Artificial Sequence
  Description of Artificial Sequence: Synthetic oligonucleotide
cgggagaacgggaaggagacgctg

SEQ ID NO: 16664 - DNA, 25 bp, Artificial Sequence
  Description of Artificial Sequence: Synthetic oligonucleotide
gggagaacgggaaggagacgctgca

SEQ ID NO: 16665 - DNA, 28 bp, Artificial Sequence
  Description of Artificial Sequence: Synthetic oligonucleotide
ctcagatcaccaagcgcaagtgggagac

SEQ ID NO: 16666 - DNA, 28 bp, Artificial Sequence
  Description of Artificial Sequence: Synthetic oligonucleotide
tcagatcaccaagcgcaagtgggagacg

SEQ ID NO: 16667 - DNA, 27 bp, Artificial Sequence
  Description of Artificial Sequence: Synthetic oligonucleotide
cagatcaccaagcgcaagtgggagacg

SEQ ID NO: 16668 - DNA, 27 bp, Artificial Sequence
  Description of Artificial Sequence: Synthetic oligonucleotide
agatcaccaagcgcaagtgggagacgg

SEQ ID NO: 16669 - DNA, 26 bp, Artificial Sequence
  Description of Artificial Sequence: Synthetic oligonucleotide
gatcaccaagcgcaagtgggagacgg

SEQ ID NO: 16670 - DNA, 26 bp, Artificial Sequence
  Description of Artificial Sequence: Synthetic oligonucleotide
atcaccaagcgcaagtgggagacggc

SEQ ID NO: 16671 - DNA, 25 bp, Artificial Sequence
  Description of Artificial Sequence: Synthetic oligonucleotide
tcaccaagcgcaagtgggagacggc

SEQ ID NO: 16672 - DNA, 24 bp, Artificial Sequence
  Description of Artificial Sequence: Synthetic oligonucleotide
caccaagcgcaagtgggagacggc

SEQ ID NO: 16673 - DNA, 24 bp, Artificial Sequence
  Description of Artificial Sequence: Synthetic oligonucleotide
accaagcgcaagtgggagacggcc

SEQ ID NO: 16674 - DNA, 23 bp, Artificial Sequence
  Description of Artificial Sequence: Synthetic oligonucleotide
ccaagcgcaagtgggagacggcc

SEQ ID NO: 16675 - DNA, 25 bp, Artificial Sequence
  Description of Artificial Sequence: Synthetic oligonucleotide
caagcgcaagtgggagacggcccat

SEQ ID NO: 16676 - DNA, 26 bp, Artificial Sequence
  Description of Artificial Sequence: Synthetic oligonucleotide
aagcgcaagtgggagacggcccatgt

SEQ ID NO: 16677 - DNA, 25 bp, Artificial Sequence
  Description of Artificial Sequence: Synthetic oligonucleotide
agcgcaagtgggagacggcccatgt

SEQ ID NO: 16678 - DNA, 24 bp, Artificial Sequence
  Description of Artificial Sequence: Synthetic oligonucleotide
gcgcaagtgggagacggcccatgt

SEQ ID NO: 16679 - DNA, 24 bp, Artificial Sequence
  Description of Artificial Sequence: Synthetic oligonucleotide
cgcaagtgggagacggcccatgtg

SEQ ID NO: 16680 - DNA, 24 bp, Artificial Sequence
  Description of Artificial Sequence: Synthetic oligonucleotide
gcaagtgggagacggcccatgtgg

SEQ ID NO: 16681 - DNA, 23 bp, Artificial Sequence
  Description of Artificial Sequence: Synthetic oligonucleotide
agacggcccatgtggcggagcag

SEQ ID NO: 16682 - DNA, 22 bp, Artificial Sequence
  Description of Artificial Sequence: Synthetic oligonucleotide
gacggcccatgtggcggagcag

SEQ ID NO: 16683 - DNA, 23 bp, Artificial Sequence
  Description of Artificial Sequence: Synthetic oligonucleotide
acggcccatgtggcggagcagca

SEQ ID NO: 16684 - DNA, 27 bp, Artificial Sequence
  Description of Artificial Sequence: Synthetic oligonucleotide
gctccgctactacaaccagagcgagga

SEQ ID NO: 16685 - DNA, 27 bp, Artificial Sequence
  Description of Artificial Sequence: Synthetic oligonucleotide
ctccgctactacaaccagagcgaggac

SEQ ID NO: 16686 - DNA, 27 bp, Artificial Sequence
  Description of Artificial Sequence: Synthetic oligonucleotide
tccgctactacaaccagagcgaggacg

SEQ ID NO: 16687 - DNA, 26 bp, Artificial Sequence
  Description of Artificial Sequence: Synthetic oligonucleotide
ccgctactacaaccagagcgaggacg

SEQ ID NO: 16688 - DNA, 27 bp, Artificial Sequence
  Description of Artificial Sequence: Synthetic oligonucleotide
cgctactacaaccagagcgaggacggt

SEQ ID NO: 16689 - DNA, 27 bp, Artificial Sequence
  Description of Artificial Sequence: Synthetic oligonucleotide
cgaggacggttctcacaccatccagag

SEQ ID NO: 16690 - DNA, 27 bp, Artificial Sequence
  Description of Artificial Sequence: Synthetic oligonucleotide
gaggacggttctcacaccatccagagg

SEQ ID NO: 16691 - DNA, 29 bp, Artificial Sequence
  Description of Artificial Sequence: Synthetic oligonucleotide
aggacggttctcacaccatccagaggatg

SEQ ID NO: 16692 - DNA, 28 bp, Artificial Sequence
  Description of Artificial Sequence: Synthetic oligonucleotide
ggacggttctcacaccatccagaggatg

SEQ ID NO: 16693 - DNA, 31 bp, Artificial Sequence
  Description of Artificial Sequence: Synthetic oligonucleotide
gacggttctcacaccatccagaggatgtatg

SEQ ID NO: 16694 - DNA, 31 bp, Artificial Sequence
  Description of Artificial Sequence: Synthetic oligonucleotide
acggttctcacaccatccagaggatgtatgg

SEQ ID NO: 16695 - DNA, 29 bp, Artificial Sequence
  Description of Artificial Sequence: Synthetic oligonucleotide
tggcctggttctctttggagctgtgatcg

SEQ ID NO: 16696 - DNA, 28 bp, Artificial Sequence
  Description of Artificial Sequence: Synthetic oligonucleotide
ggcctggttctctttggagctgtgatcg

SEQ ID NO: 16697 - DNA, 28 bp, Artificial Sequence
  Description of Artificial Sequence: Synthetic oligonucleotide
gcctggttctctttggagctgtgatcgc

SEQ ID NO: 16698 - DNA, 29 bp, Artificial Sequence
  Description of Artificial Sequence: Synthetic oligonucleotide
cctggttctctttggagctgtgatcgctg

SEQ ID NO: 16699 - DNA, 29 bp, Artificial Sequence
  Description of Artificial Sequence: Synthetic oligonucleotide
ctggttctctttggagctgtgatcgctgg

SEQ ID NO: 16700 - DNA, 30 bp, Artificial Sequence
  Description of Artificial Sequence: Synthetic oligonucleotide
tggttctctttggagctgtgatcgctggag

SEQ ID NO: 16701 - DNA, 29 bp, Artificial Sequence
  Description of Artificial Sequence: Synthetic oligonucleotide
ggttctctttggagctgtgatcgctggag

SEQ ID NO: 16702 - DNA, 29 bp, Artificial Sequence
  Description of Artificial Sequence: Synthetic oligonucleotide
gttctctttggagctgtgatcgctggagc

SEQ ID NO: 16703 - DNA, 30 bp, Artificial Sequence
  Description of Artificial Sequence: Synthetic oligonucleotide
ttctctttggagctgtgatcgctggagctg

SEQ ID NO: 16704 - DNA, 29 bp, Artificial Sequence
  Description of Artificial Sequence: Synthetic oligonucleotide
tctctttggagctgtgatcgctggagctg

SEQ ID NO: 16705 - DNA, 28 bp, Artificial Sequence
  Description of Artificial Sequence: Synthetic oligonucleotide
ctctttggagctgtgatcgctggagctg

SEQ ID NO: 16706 - DNA, 29 bp, Artificial Sequence
  Description of Artificial Sequence: Synthetic oligonucleotide
tctttggagctgtgatcgctggagctgtg

SEQ ID NO: 16707 - DNA, 28 bp, Artificial Sequence
  Description of Artificial Sequence: Synthetic oligonucleotide
ctttggagctgtgatcgctggagctgtg

SEQ ID NO: 16708 - DNA, 28 bp, Artificial Sequence
  Description of Artificial Sequence: Synthetic oligonucleotide
tttggagctgtgatcgctggagctgtgg

SEQ ID NO: 16709 - DNA, 27 bp, Artificial Sequence
  Description of Artificial Sequence: Synthetic oligonucleotide
ttggagctgtgatcgctggagctgtgg

SEQ ID NO: 16710 - DNA, 27 bp, Artificial Sequence
  Description of Artificial Sequence: Synthetic oligonucleotide
tggagctgtgatcgctggagctgtggt

SEQ ID NO: 16711 - DNA, 26 bp, Artificial Sequence
  Description of Artificial Sequence: Synthetic oligonucleotide
ggagctgtgatcgctggagctgtggt

SEQ ID NO: 16712 - DNA, 26 bp, Artificial Sequence
  Description of Artificial Sequence: Synthetic oligonucleotide
gagctgtgatcgctggagctgtggtc

SEQ ID NO: 16713 - DNA, 26 bp, Artificial Sequence
  Description of Artificial Sequence: Synthetic oligonucleotide
agctgtgatcgctggagctgtggtcg

SEQ ID NO: 16714 - DNA, 25 bp, Artificial Sequence
  Description of Artificial Sequence: Synthetic oligonucleotide
gctgtgatcgctggagctgtggtcg

SEQ ID NO: 16715 - DNA, 26 bp, Artificial Sequence
  Description of Artificial Sequence: Synthetic oligonucleotide
ctgtgatcgctggagctgtggtcgct

SEQ ID NO: 16716 - DNA, 26 bp, Artificial Sequence
  Description of Artificial Sequence: Synthetic oligonucleotide
tgtgatcgctggagctgtggtcgctg

SEQ ID NO: 16717 - DNA, 25 bp, Artificial Sequence
  Description of Artificial Sequence: Synthetic oligonucleotide
gtgatcgctggagctgtggtcgctg

SEQ ID NO: 16718 - DNA, 26 bp, Artificial Sequence
  Description of Artificial Sequence: Synthetic oligonucleotide
tgatcgctggagctgtggtcgctgct

SEQ ID NO: 16719 - DNA, 25 bp, Artificial Sequence
  Description of Artificial Sequence: Synthetic oligonucleotide
gatcgctggagctgtggtcgctgct

SEQ ID NO: 16720 - DNA, 26 bp, Artificial Sequence
  Description of Artificial Sequence: Synthetic oligonucleotide
atcgctggagctgtggtcgctgctgt

SEQ ID NO: 16721 - DNA, 26 bp, Artificial Sequence
  Description of Artificial Sequence: Synthetic oligonucleotide
gctggagctgtggtcgctgctgtgat

SEQ ID NO: 16722 - DNA, 26 bp, Artificial Sequence
  Description of Artificial Sequence: Synthetic oligonucleotide
tgaaggcccactcacagactgaccgg

SEQ ID NO: 16723 - DNA, 25 bp, Artificial Sequence
  Description of Artificial Sequence: Synthetic oligonucleotide
gaaggcccactcacagactgaccgg

SEQ ID NO: 16724 - DNA, 26 bp, Artificial Sequence
  Description of Artificial Sequence: Synthetic oligonucleotide
aaggcccactcacagactgaccggga

SEQ ID NO: 16725 - DNA, 25 bp, Artificial Sequence
  Description of Artificial Sequence: Synthetic oligonucleotide
aggcccactcacagactgaccggga

SEQ ID NO: 16726 - DNA, 24 bp, Artificial Sequence
  Description of Artificial Sequence: Synthetic oligonucleotide
ggcccactcacagactgaccggga

SEQ ID NO: 16727 - DNA, 25 bp, Artificial Sequence
  Description of Artificial Sequence: Synthetic oligonucleotide
gcccactcacagactgaccgggaga

SEQ ID NO: 16728 - DNA, 25 bp, Artificial Sequence
  Description of Artificial Sequence: Synthetic oligonucleotide
cccactcacagactgaccgggagag

SEQ ID NO: 16729 - DNA, 25 bp, Artificial Sequence
  Description of Artificial Sequence: Synthetic oligonucleotide
ccactcacagactgaccgggagagc

SEQ ID NO: 16730 - DNA, 26 bp, Artificial Sequence
  Description of Artificial Sequence: Synthetic oligonucleotide
cactcacagactgaccgggagagcct

SEQ ID NO: 16731 - DNA, 26 bp, Artificial Sequence
  Description of Artificial Sequence: Synthetic oligonucleotide
actcacagactgaccgggagagcctg

SEQ ID NO: 16732 - DNA, 25 bp, Artificial Sequence
  Description of Artificial Sequence: Synthetic oligonucleotide
ctcacagactgaccgggagagcctg

SEQ ID NO: 16733 - DNA, 25 bp, Artificial Sequence
  Description of Artificial Sequence: Synthetic oligonucleotide
tcacagactgaccgggagagcctgc

SEQ ID NO: 16734 - DNA, 24 bp, Artificial Sequence
  Description of Artificial Sequence: Synthetic oligonucleotide
cacagactgaccgggagagcctgc

SEQ ID NO: 16735 - DNA, 24 bp, Artificial Sequence
  Description of Artificial Sequence: Synthetic oligonucleotide
acagactgaccgggagagcctgcg

SEQ ID NO: 16736 - DNA, 23 bp, Artificial Sequence
  Description of Artificial Sequence: Synthetic oligonucleotide
cagactgaccgggagagcctgcg

SEQ ID NO: 16737 - DNA, 25 bp, Artificial Sequence
  Description of Artificial Sequence: Synthetic oligonucleotide
agactgaccgggagagcctgcggat

SEQ ID NO: 16738 - DNA, 24 bp, Artificial Sequence
  Description of Artificial Sequence: Synthetic oligonucleotide
gactgaccgggagagcctgcggat

SEQ ID NO: 16739 - DNA, 24 bp, Artificial Sequence
  Description of Artificial Sequence: Synthetic oligonucleotide
actgaccgggagagcctgcggatc

SEQ ID NO: 16740 - DNA, 23 bp, Artificial Sequence
  Description of Artificial Sequence: Synthetic oligonucleotide
ctgaccgggagagcctgcggatc

SEQ ID NO: 16741 - DNA, 23 bp, Artificial Sequence
  Description of Artificial Sequence: Synthetic oligonucleotide
tgaccgggagagcctgcggatcg

SEQ ID NO: 16742 - DNA, 22 bp, Artificial Sequence
  Description of Artificial Sequence: Synthetic oligonucleotide
gaccgggagagcctgcggatcg

SEQ ID NO: 16743 - DNA, 22 bp, Artificial Sequence
  Description of Artificial Sequence: Synthetic oligonucleotide
accgggagagcctgcggatcgc

SEQ ID NO: 16744 - DNA, 21 bp, Artificial Sequence
  Description of Artificial Sequence: Synthetic oligonucleotide
ccgggagagcctgcggatcgc

SEQ ID NO: 16745 - DNA, 21 bp, Artificial Sequence
  Description of Artificial Sequence: Synthetic oligonucleotide
cgggagagcctgcggatcgcg

SEQ ID NO: 16746 - DNA, 22 bp, Artificial Sequence
  Description of Artificial Sequence: Synthetic oligonucleotide
gggagagcctgcggatcgcgct

SEQ ID NO: 16747 - DNA, 22 bp, Artificial Sequence
  Description of Artificial Sequence: Synthetic oligonucleotide
ggagagcctgcggatcgcgctc

SEQ ID NO: 16748 - DNA, 26 bp, Artificial Sequence
  Description of Artificial Sequence: Synthetic oligonucleotide
ggcccagtcacagactgaccgagaga

SEQ ID NO: 16749 - DNA, 26 bp, Artificial Sequence
  Description of Artificial Sequence: Synthetic oligonucleotide
gcccagtcacagactgaccgagagag

SEQ ID NO: 16750 - DNA, 26 bp, Artificial Sequence
  Description of Artificial Sequence: Synthetic oligonucleotide
cccagtcacagactgaccgagagagc

SEQ ID NO: 16751 - DNA, 27 bp, Artificial Sequence
  Description of Artificial Sequence: Synthetic oligonucleotide
ccagtcacagactgaccgagagagcct

SEQ ID NO: 16752 - DNA, 27 bp, Artificial Sequence
  Description of Artificial Sequence: Synthetic oligonucleotide
cagtcacagactgaccgagagagcctg

SEQ ID NO: 16753 - DNA, 27 bp, Artificial Sequence
  Description of Artificial Sequence: Synthetic oligonucleotide
agtcacagactgaccgagagagcctgc

SEQ ID NO: 16754 - DNA, 26 bp, Artificial Sequence
  Description of Artificial Sequence: Synthetic oligonucleotide
gtcacagactgaccgagagagcctgc

SEQ ID NO: 16755 - DNA, 26 bp, Artificial Sequence
  Description of Artificial Sequence: Synthetic oligonucleotide
gacatggcggctcagatcacccagca

SEQ ID NO: 16756 - DNA, 27 bp, Artificial Sequence
  Description of Artificial Sequence: Synthetic oligonucleotide
acatggcggctcagatcacccagcaca

SEQ ID NO: 16757 - DNA, 27 bp, Artificial Sequence
  Description of Artificial Sequence: Synthetic oligonucleotide
catggcggctcagatcacccagcacaa

SEQ ID NO: 16758 - DNA, 27 bp, Artificial Sequence
  Description of Artificial Sequence: Synthetic oligonucleotide
atggcggctcagatcacccagcacaag

SEQ ID NO: 16759 - DNA, 27 bp, Artificial Sequence
  Description of Artificial Sequence: Synthetic oligonucleotide
tggcggctcagatcacccagcacaagt

SEQ ID NO: 16760 - DNA, 26 bp, Artificial Sequence
  Description of Artificial Sequence: Synthetic oligonucleotide
ggcggctcagatcacccagcacaagt

SEQ ID NO: 16761 - DNA, 26 bp, Artificial Sequence
  Description of Artificial Sequence: Synthetic oligonucleotide
gcggctcagatcacccagcacaagtg

SEQ ID NO: 16762 - DNA, 26 bp, Artificial Sequence
  Description of Artificial Sequence: Synthetic oligonucleotide
cggctcagatcacccagcacaagtgg

SEQ ID NO: 16763 - DNA, 27 bp, Artificial Sequence
  Description of Artificial Sequence: Synthetic oligonucleotide
ggctcagatcacccagcacaagtggga

SEQ ID NO: 16764 - DNA, 27 bp, Artificial Sequence
  Description of Artificial Sequence: Synthetic oligonucleotide
gctcagatcacccagcacaagtgggag

SEQ ID NO: 16765 - DNA, 28 bp, Artificial Sequence
  Description of Artificial Sequence: Synthetic oligonucleotide
ctcagatcacccagcacaagtgggagac

SEQ ID NO: 16766 - DNA, 28 bp, Artificial Sequence
  Description of Artificial Sequence: Synthetic oligonucleotide
tcagatcacccagcacaagtgggagacg

SEQ ID NO: 16767 - DNA, 27 bp, Artificial Sequence
  Description of Artificial Sequence: Synthetic oligonucleotide
cagatcacccagcacaagtgggagacg

SEQ ID NO: 16768 - DNA, 27 bp, Artificial Sequence
  Description of Artificial Sequence: Synthetic oligonucleotide
agatcacccagcacaagtgggagacgg

SEQ ID NO: 16769 - DNA, 26 bp, Artificial Sequence
  Description of Artificial Sequence: Synthetic oligonucleotide
gatcacccagcacaagtgggagacgg

SEQ ID NO: 16770 - DNA, 26 bp, Artificial Sequence
  Description of Artificial Sequence: Synthetic oligonucleotide
atcacccagcacaagtgggagacggc

SEQ ID NO: 16771 - DNA, 25 bp, Artificial Sequence
  Description of Artificial Sequence: Synthetic oligonucleotide
tcacccagcacaagtgggagacggc

SEQ ID NO: 16772 - DNA, 24 bp, Artificial Sequence
  Description of Artificial Sequence: Synthetic oligonucleotide
cacccagcacaagtgggagacggc

SEQ ID NO: 16773 - DNA, 24 bp, Artificial Sequence
  Description of Artificial Sequence: Synthetic oligonucleotide
acccagcacaagtgggagacggcc

SEQ ID NO: 16774 - DNA, 23 bp, Artificial Sequence
  Description of Artificial Sequence: Synthetic oligonucleotide
cccagcacaagtgggagacggcc

SEQ ID NO: 16775 - DNA, 25 bp, Artificial Sequence
  Description of Artificial Sequence: Synthetic oligonucleotide
ccagcacaagtgggagacggcccat

SEQ ID NO: 16776 - DNA, 26 bp, Artificial Sequence
  Description of Artificial Sequence: Synthetic oligonucleotide
cagcacaagtgggagacggcccatga

SEQ ID NO: 16777 - DNA, 27 bp, Artificial Sequence
  Description of Artificial Sequence: Synthetic oligonucleotide
ccccaagacgcatatgactcaccacgg

SEQ ID NO: 16778 - DNA, 28 bp, Artificial Sequence
  Description of Artificial Sequence: Synthetic oligonucleotide
cccaagacgcatatgactcaccacggtg

SEQ ID NO: 16779 - DNA, 29 bp, Artificial Sequence
  Description of Artificial Sequence: Synthetic oligonucleotide
ccaagacgcatatgactcaccacggtgtc

SEQ ID NO: 16780 - DNA, 30 bp, Artificial Sequence
  Description of Artificial Sequence: Synthetic oligonucleotide
caagacgcatatgactcaccacggtgtctc

SEQ ID NO: 16781 - DNA, 31 bp, Artificial Sequence
  Description of Artificial Sequence: Synthetic oligonucleotide
aagacgcatatgactcaccacggtgtctctg

SEQ ID NO: 16782 - DNA, 30 bp, Artificial Sequence
  Description of Artificial Sequence: Synthetic oligonucleotide
agacgcatatgactcaccacggtgtctctg

SEQ ID NO: 16783 - DNA, 29 bp, Artificial Sequence
  Description of Artificial Sequence: Synthetic oligonucleotide
gacgcatatgactcaccacggtgtctctg

SEQ ID NO: 16784 - DNA, 30 bp, Artificial Sequence
  Description of Artificial Sequence: Synthetic oligonucleotide
acgcatatgactcaccacggtgtctctgac

SEQ ID NO: 16785 - DNA, 29 bp, Artificial Sequence
  Description of Artificial Sequence: Synthetic oligonucleotide
cgcatatgactcaccacggtgtctctgac

SEQ ID NO: 16786 - DNA, 29 bp, Artificial Sequence
  Description of Artificial Sequence: Synthetic oligonucleotide
gcatatgactcaccacggtgtctctgacc

SEQ ID NO: 16787 - DNA, 31 bp, Artificial Sequence
  Description of Artificial Sequence: Synthetic oligonucleotide
catatgactcaccacggtgtctctgaccatg

SEQ ID NO: 16788 - DNA, 32 bp, Artificial Sequence
  Description of Artificial Sequence: Synthetic oligonucleotide
atatgactcaccacggtgtctctgaccatgag

SEQ ID NO: 16789 - DNA, 31 bp, Artificial Sequence
  Description of Artificial Sequence: Synthetic oligonucleotide
tatgactcaccacggtgtctctgaccatgag

SEQ ID NO: 16790 - DNA, 30 bp, Artificial Sequence
  Description of Artificial Sequence: Synthetic oligonucleotide
atgactcaccacggtgtctctgaccatgag

SEQ ID NO: 16791 - DNA, 29 bp, Artificial Sequence
  Description of Artificial Sequence: Synthetic oligonucleotide
tgactcaccacggtgtctctgaccatgag

SEQ ID NO: 16792 - DNA, 28 bp, Artificial Sequence
  Description of Artificial Sequence: Synthetic oligonucleotide
gactcaccacggtgtctctgaccatgag

SEQ ID NO: 16793 - DNA, 28 bp, Artificial Sequence
  Description of Artificial Sequence: Synthetic oligonucleotide
actcaccacggtgtctctgaccatgagg

SEQ ID NO: 16794 - DNA, 27 bp, Artificial Sequence
  Description of Artificial Sequence: Synthetic oligonucleotide
ctcaccacggtgtctctgaccatgagg

SEQ ID NO: 16795 - DNA, 27 bp, Artificial Sequence
  Description of Artificial Sequence: Synthetic oligonucleotide
tcaccacggtgtctctgaccatgaggc

SEQ ID NO: 16796 - DNA, 26 bp, Artificial Sequence
  Description of Artificial Sequence: Synthetic oligonucleotide
caccacggtgtctctgaccatgaggc

SEQ ID NO: 16797 - DNA, 27 bp, Artificial Sequence
  Description of Artificial Sequence: Synthetic oligonucleotide
accacggtgtctctgaccatgaggcca

SEQ ID NO: 16798 - DNA, 26 bp, Artificial Sequence
  Description of Artificial Sequence: Synthetic oligonucleotide
ccacggtgtctctgaccatgaggcca

SEQ ID NO: 16799 - DNA, 26 bp, Artificial Sequence
  Description of Artificial Sequence: Synthetic oligonucleotide
cacggtgtctctgaccatgaggccac

SEQ ID NO: 16800 - DNA, 26 bp, Artificial Sequence
  Description of Artificial Sequence: Synthetic oligonucleotide
acggtgtctctgaccatgaggccacc

SEQ ID NO: 16801 - DNA, 25 bp, Artificial Sequence
  Description of Artificial Sequence: Synthetic oligonucleotide
cggtgtctctgaccatgaggccacc

SEQ ID NO: 16802 - DNA, 26 bp, Artificial Sequence
  Description of Artificial Sequence: Synthetic oligonucleotide
ggtgtctctgaccatgaggccaccct

SEQ ID NO: 16803 - DNA, 27 bp, Artificial Sequence
  Description of Artificial Sequence: Synthetic oligonucleotide
gtgtctctgaccatgaggccaccctga

SEQ ID NO: 16804 - DNA, 28 bp, Artificial Sequence
  Description of Artificial Sequence: Synthetic oligonucleotide
tcagatcacccagcgcaagtgggagatg

SEQ ID NO: 16805 - DNA, 27 bp, Artificial Sequence
  Description of Artificial Sequence: Synthetic oligonucleotide
cagatcacccagcgcaagtgggagatg

SEQ ID NO: 16806 - DNA, 27 bp, Artificial Sequence
  Description of Artificial Sequence: Synthetic oligonucleotide
agatcacccagcgcaagtgggagatgg

SEQ ID NO: 16807 - DNA, 26 bp, Artificial Sequence
  Description of Artificial Sequence: Synthetic oligonucleotide
gatcacccagcgcaagtgggagatgg

SEQ ID NO: 16808 - DNA, 26 bp, Artificial Sequence
  Description of Artificial Sequence: Synthetic oligonucleotide
atcacccagcgcaagtgggagatggc

SEQ ID NO: 16809 - DNA, 25 bp, Artificial Sequence
  Description of Artificial Sequence: Synthetic oligonucleotide
tcacccagcgcaagtgggagatggc

SEQ ID NO: 16810 - DNA, 24 bp, Artificial Sequence
  Description of Artificial Sequence: Synthetic oligonucleotide
cacccagcgcaagtgggagatggc

SEQ ID NO: 16811 - DNA, 24 bp, Artificial Sequence
  Description of Artificial Sequence: Synthetic oligonucleotide
acccagcgcaagtgggagatggcc

SEQ ID NO: 16812 - DNA, 23 bp, Artificial Sequence
  Description of Artificial Sequence: Synthetic oligonucleotide
cccagcgcaagtgggagatggcc

SEQ ID NO: 16813 - DNA, 25 bp, Artificial Sequence
  Description of Artificial Sequence: Synthetic oligonucleotide
ccagcgcaagtgggagatggcccat

SEQ ID NO: 16814 - DNA, 26 bp, Artificial Sequence
  Description of Artificial Sequence: Synthetic oligonucleotide
cagcgcaagtgggagatggcccatga

SEQ ID NO: 16815 - DNA, 26 bp, Artificial Sequence
  Description of Artificial Sequence: Synthetic oligonucleotide
agcgcaagtgggagatggcccatgag

SEQ ID NO: 16816 - DNA, 25 bp, Artificial Sequence
  Description of Artificial Sequence: Synthetic oligonucleotide
gcgcaagtgggagatggcccatgag

SEQ ID NO: 16817 - DNA, 25 bp, Artificial Sequence
  Description of Artificial Sequence: Synthetic oligonucleotide
cgcaagtgggagatggcccatgagg

SEQ ID NO: 16818 - DNA, 25 bp, Artificial Sequence
  Description of Artificial Sequence: Synthetic oligonucleotide
gcaagtgggagatggcccatgaggc

SEQ ID NO: 16819 - DNA, 25 bp, Artificial Sequence
  Description of Artificial Sequence: Synthetic oligonucleotide
caagtgggagatggcccatgaggcg

SEQ ID NO: 16820 - DNA, 26 bp, Artificial Sequence
  Description of Artificial Sequence: Synthetic oligonucleotide
aagtgggagatggcccatgaggcgga

SEQ ID NO: 16821 - DNA, 25 bp, Artificial Sequence
  Description of Artificial Sequence: Synthetic oligonucleotide
agtgggagatggcccatgaggcgga

SEQ ID NO: 16822 - DNA, 24 bp, Artificial Sequence
  Description of Artificial Sequence: Synthetic oligonucleotide
gtgggagatggcccatgaggcgga

SEQ ID NO: 16823 - DNA, 24 bp, Artificial Sequence
  Description of Artificial Sequence: Synthetic oligonucleotide
tgggagatggcccatgaggcggag

SEQ ID NO: 16824 - DNA, 23 bp, Artificial Sequence
  Description of Artificial Sequence: Synthetic oligonucleotide
gggagatggcccatgaggcggag

SEQ ID NO: 16825 - DNA, 24 bp, Artificial Sequence
  Description of Artificial Sequence: Synthetic oligonucleotide
ggagatggcccatgaggcggagca

SEQ ID NO: 16826 - DNA, 25 bp, Artificial Sequence
  Description of Artificial Sequence: Synthetic oligonucleotide
gagatggcccatgaggcggagcagt

SEQ ID NO: 16827 - DNA, 25 bp, Artificial Sequence
  Description of Artificial Sequence: Synthetic oligonucleotide
agatggcccatgaggcggagcagtg

SEQ ID NO: 16828 - DNA, 24 bp, Artificial Sequence
  Description of Artificial Sequence: Synthetic oligonucleotide
gatggcccatgaggcggagcagtg

SEQ ID NO: 16829 - DNA, 25 bp, Artificial Sequence
  Description of Artificial Sequence: Synthetic oligonucleotide
atggcccatgaggcggagcagtgga

SEQ ID NO: 16830 - DNA, 24 bp, Artificial Sequence
  Description of Artificial Sequence: Synthetic oligonucleotide
tggcccatgaggcggagcagtgga

SEQ ID NO: 16831 - DNA, 26 bp, Artificial Sequence
  Description of Artificial Sequence: Synthetic oligonucleotide
ggcccactcacagactcaccgagaga

SEQ ID NO: 16832 - DNA, 26 bp, Artificial Sequence
  Description of Artificial Sequence: Synthetic oligonucleotide
gcccactcacagactcaccgagagag

SEQ ID NO: 16833 - DNA, 26 bp, Artificial Sequence
  Description of Artificial Sequence: Synthetic oligonucleotide
cccactcacagactcaccgagagagc

SEQ ID NO: 16834 - DNA, 27 bp, Artificial Sequence
  Description of Artificial Sequence: Synthetic oligonucleotide
ccactcacagactcaccgagagagcct

SEQ ID NO: 16835 - DNA, 27 bp, Artificial Sequence
  Description of Artificial Sequence: Synthetic oligonucleotide
cactcacagactcaccgagagagcctg

SEQ ID NO: 16836 - DNA, 27 bp, Artificial Sequence
  Description of Artificial Sequence: Synthetic oligonucleotide
actcacagactcaccgagagagcctgc

SEQ ID NO: 16837 - DNA, 26 bp, Artificial Sequence
  Description of Artificial Sequence: Synthetic oligonucleotide
ctcacagactcaccgagagagcctgc

SEQ ID NO: 16838 - DNA, 26 bp, Artificial Sequence
  Description of Artificial Sequence: Synthetic oligonucleotide
tcacagactcaccgagagagcctgcg

SEQ ID NO: 16839 - DNA, 25 bp, Artificial Sequence
  Description of Artificial Sequence: Synthetic oligonucleotide
cacagactcaccgagagagcctgcg

SEQ ID NO: 16840 - DNA, 27 bp, Artificial Sequence
  Description of Artificial Sequence: Synthetic oligonucleotide
acagactcaccgagagagcctgcggat

SEQ ID NO: 16841 - DNA, 26 bp, Artificial Sequence
  Description of Artificial Sequence: Synthetic oligonucleotide
cagactcaccgagagagcctgcggat

SEQ ID NO: 16842 - DNA, 26 bp, Artificial Sequence
  Description of Artificial Sequence: Synthetic oligonucleotide
agactcaccgagagagcctgcggatc

SEQ ID NO: 16843 - DNA, 25 bp, Artificial Sequence
  Description of Artificial Sequence: Synthetic oligonucleotide
gactcaccgagagagcctgcggatc

SEQ ID NO: 16844 - DNA, 25 bp, Artificial Sequence
  Description of Artificial Sequence: Synthetic oligonucleotide
actcaccgagagagcctgcggatcg

SEQ ID NO: 16845 - DNA, 24 bp, Artificial Sequence
  Description of Artificial Sequence: Synthetic oligonucleotide
ctcaccgagagagcctgcggatcg

SEQ ID NO: 16846 - DNA, 24 bp, Artificial Sequence
  Description of Artificial Sequence: Synthetic oligonucleotide
tcaccgagagagcctgcggatcgc

SEQ ID NO: 16847 - DNA, 23 bp, Artificial Sequence
  Description of Artificial Sequence: Synthetic oligonucleotide
caccgagagagcctgcggatcgc

SEQ ID NO: 16848 - DNA, 27 bp, Artificial Sequence
  Description of Artificial Sequence: Synthetic oligonucleotide
catgaggcggagcagtggagagcctaa

SEQ ID NO: 16849 - DNA, 27 bp, Artificial Sequence
  Description of Artificial Sequence: Synthetic oligonucleotide
atgaggcggagcagtggagagcctaac

SEQ ID NO: 16850 - DNA, 27 bp, Artificial Sequence
  Description of Artificial Sequence: Synthetic oligonucleotide
tgaggcggagcagtggagagcctaact

SEQ ID NO: 16851 - DNA, 26 bp, Artificial Sequence
  Description of Artificial Sequence: Synthetic oligonucleotide
gaggcggagcagtggagagcctaact

SEQ ID NO: 16852 - DNA, 26 bp, Artificial Sequence
  Description of Artificial Sequence: Synthetic oligonucleotide
aggcggagcagtggagagcctaactg

SEQ ID NO: 16853 - DNA, 25 bp, Artificial Sequence
  Description of Artificial Sequence: Synthetic oligonucleotide
ggcggagcagtggagagcctaactg

SEQ ID NO: 16854 - DNA, 26 bp, Artificial Sequence
  Description of Artificial Sequence: Synthetic oligonucleotide
gcggagcagtggagagcctaactgga

SEQ ID NO: 16855 - DNA, 26 bp, Artificial Sequence
  Description of Artificial Sequence: Synthetic oligonucleotide
cggagcagtggagagcctaactggag

SEQ ID NO: 16856 - DNA, 26 bp, Artificial Sequence
  Description of Artificial Sequence: Synthetic oligonucleotide
ggagcagtggagagcctaactggagg

SEQ ID NO: 16857 - DNA, 26 bp, Artificial Sequence
  Description of Artificial Sequence: Synthetic oligonucleotide
gagcagtggagagcctaactggaggg

SEQ ID NO: 16858 - DNA, 26 bp, Artificial Sequence
  Description of Artificial Sequence: Synthetic oligonucleotide
agcagtggagagcctaactggagggc

SEQ ID NO: 16859 - DNA, 25 bp, Artificial Sequence
  Description of Artificial Sequence: Synthetic oligonucleotide
gcagtggagagcctaactggagggc

SEQ ID NO: 16860 - DNA, 25 bp, Artificial Sequence
  Description of Artificial Sequence: Synthetic oligonucleotide
cagtggagagcctaactggagggcc

SEQ ID NO: 16861 - DNA, 25 bp, Artificial Sequence
  Description of Artificial Sequence: Synthetic oligonucleotide
agtggagagcctaactggagggccg

SEQ ID NO: 16862 - DNA, 24 bp, Artificial Sequence
  Description of Artificial Sequence: Synthetic oligonucleotide
gtggagagcctaactggagggccg

SEQ ID NO: 16863 - DNA, 25 bp, Artificial Sequence
  Description of Artificial Sequence: Synthetic oligonucleotide
tggagagcctaactggagggccggt

SEQ ID NO: 16864 - DNA, 24 bp, Artificial Sequence
  Description of Artificial Sequence: Synthetic oligonucleotide
ggagagcctaactggagggccggt

SEQ ID NO: 16865 - DNA, 24 bp, Artificial Sequence
  Description of Artificial Sequence: Synthetic oligonucleotide
gagagcctaactggagggccggtg

SEQ ID NO: 16866 - DNA, 24 bp, Artificial Sequence
  Description of Artificial Sequence: Synthetic oligonucleotide
agagcctaactggagggccggtgc

SEQ ID NO: 16867 - DNA, 23 bp, Artificial Sequence
  Description of Artificial Sequence: Synthetic oligonucleotide
gagcctaactggagggccggtgc

SEQ ID NO: 16868 - DNA, 24 bp, Artificial Sequence
  Description of Artificial Sequence: Synthetic oligonucleotide
agcctaactggagggccggtgcgt

SEQ ID NO: 16869 - DNA, 23 bp, Artificial Sequence
  Description of Artificial Sequence: Synthetic oligonucleotide
gcctaactggagggccggtgcgt

SEQ ID NO: 16870 - DNA, 23 bp, Artificial Sequence
  Description of Artificial Sequence: Synthetic oligonucleotide
cctaactggagggccggtgcgtg

SEQ ID NO: 16871 - DNA, 25 bp, Artificial Sequence
  Description of Artificial Sequence: Synthetic oligonucleotide
taactggagggccggtgcgtggagt

SEQ ID NO: 16872 - DNA, 24 bp, Artificial Sequence
  Description of Artificial Sequence: Synthetic oligonucleotide
aactggagggccggtgcgtggagt

SEQ ID NO: 16873 - DNA, 23 bp, Artificial Sequence
  Description of Artificial Sequence: Synthetic oligonucleotide
actggagggccggtgcgtggagt

SEQ ID NO: 16874 - DNA, 25 bp, Artificial Sequence
  Description of Artificial Sequence: Synthetic oligonucleotide
aaggcccactcacagactgaccgcg

SEQ ID NO: 16875 - DNA, 24 bp, Artificial Sequence
  Description of Artificial Sequence: Synthetic oligonucleotide
aggcccactcacagactgaccgcg

SEQ ID NO: 16876 - DNA, 23 bp, Artificial Sequence
  Description of Artificial Sequence: Synthetic oligonucleotide
ggcccactcacagactgaccgcg

SEQ ID NO: 16877 - DNA, 23 bp, Artificial Sequence
  Description of Artificial Sequence: Synthetic oligonucleotide
gcccactcacagactgaccgcgc

SEQ ID NO: 16878 - DNA, 25 bp, Artificial Sequence
  Description of Artificial Sequence: Synthetic oligonucleotide
cccactcacagactgaccgcgcgaa

SEQ ID NO: 16879 - DNA, 25 bp, Artificial Sequence
  Description of Artificial Sequence: Synthetic oligonucleotide
ccactcacagactgaccgcgcgaac

SEQ ID NO: 16880 - DNA, 26 bp, Artificial Sequence
  Description of Artificial Sequence: Synthetic oligonucleotide
cactcacagactgaccgcgcgaacct

SEQ ID NO: 16881 - DNA, 26 bp, Artificial Sequence
  Description of Artificial Sequence: Synthetic oligonucleotide
actcacagactgaccgcgcgaacctg

SEQ ID NO: 16882 - DNA, 25 bp, Artificial Sequence
  Description of Artificial Sequence: Synthetic oligonucleotide
ctcacagactgaccgcgcgaacctg

SEQ ID NO: 16883 - DNA, 25 bp, Artificial Sequence
  Description of Artificial Sequence: Synthetic oligonucleotide
tcacagactgaccgcgcgaacctgg

SEQ ID NO: 16884 - DNA, 24 bp, Artificial Sequence
  Description of Artificial Sequence: Synthetic oligonucleotide
cacagactgaccgcgcgaacctgg

SEQ ID NO: 16885 - DNA, 24 bp, Artificial Sequence
  Description of Artificial Sequence: Synthetic oligonucleotide
acagactgaccgcgcgaacctggg

SEQ ID NO: 16886 - DNA, 23 bp, Artificial Sequence
  Description of Artificial Sequence: Synthetic oligonucleotide
cagactgaccgcgcgaacctggg

SEQ ID NO: 16887 - DNA, 24 bp, Artificial Sequence
  Description of Artificial Sequence: Synthetic oligonucleotide
agactgaccgcgcgaacctgggga

SEQ ID NO: 16888 - DNA, 23 bp, Artificial Sequence
  Description of Artificial Sequence: Synthetic oligonucleotide
gactgaccgcgcgaacctgggga

SEQ ID NO: 16889 - DNA, 23 bp, Artificial Sequence
  Description of Artificial Sequence: Synthetic oligonucleotide
actgaccgcgcgaacctggggac

SEQ ID NO: 16890 - DNA, 22 bp, Artificial Sequence
  Description of Artificial Sequence: Synthetic oligonucleotide
ctgaccgcgcgaacctggggac

SEQ ID NO: 16891 - DNA, 22 bp, Artificial Sequence
  Description of Artificial Sequence: Synthetic oligonucleotide
tgaccgcgcgaacctggggacc

SEQ ID NO: 16892 - DNA, 21 bp, Artificial Sequence
  Description of Artificial Sequence: Synthetic oligonucleotide
gaccgcgcgaacctggggacc

SEQ ID NO: 16893 - DNA, 22 bp, Artificial Sequence
  Description of Artificial Sequence: Synthetic oligonucleotide
accgcgcgaacctggggaccct

SEQ ID NO: 16894 - DNA, 21 bp, Artificial Sequence
  Description of Artificial Sequence: Synthetic oligonucleotide
ccgcgcgaacctggggaccct

SEQ ID NO: 16895 - DNA, 21 bp, Artificial Sequence
  Description of Artificial Sequence: Synthetic oligonucleotide
cgcgcgaacctggggaccctg

SEQ ID NO: 16896 - DNA, 21 bp, Artificial Sequence
  Description of Artificial Sequence: Synthetic oligonucleotide
gcgcgaacctggggaccctgc

SEQ ID NO: 16897 - DNA, 21 bp, Artificial Sequence
  Description of Artificial Sequence: Synthetic oligonucleotide
cgcgaacctggggaccctgcg

SEQ ID NO: 16898 - DNA, 23 bp, Artificial Sequence
  Description of Artificial Sequence: Synthetic oligonucleotide
ctgcagcgcactgacgcccccaa

SEQ ID NO: 16899 - DNA, 24 bp, Artificial Sequence
  Description of Artificial Sequence: Synthetic oligonucleotide
tgcagcgcactgacgcccccaaga

SEQ ID NO: 16900 - DNA, 23 bp, Artificial Sequence
  Description of Artificial Sequence: Synthetic oligonucleotide
gcagcgcactgacgcccccaaga

SEQ ID NO: 16901 - DNA, 23 bp, Artificial Sequence
  Description of Artificial Sequence: Synthetic oligonucleotide
cagcgcactgacgcccccaagac

SEQ ID NO: 16902 - DNA, 23 bp, Artificial Sequence
  Description of Artificial Sequence: Synthetic oligonucleotide
agcgcactgacgcccccaagacg

SEQ ID NO: 16903 - DNA, 22 bp, Artificial Sequence
  Description of Artificial Sequence: Synthetic oligonucleotide
gcgcactgacgcccccaagacg

SEQ ID NO: 16904 - DNA, 26 bp, Artificial Sequence
  Description of Artificial Sequence: Synthetic oligonucleotide
cgcactgacgcccccaagacgcatat

SEQ ID NO: 16905 - DNA, 27 bp, Artificial Sequence
  Description of Artificial Sequence: Synthetic oligonucleotide
gcactgacgcccccaagacgcatatga

SEQ ID NO: 16906 - DNA, 27 bp, Artificial Sequence
  Description of Artificial Sequence: Synthetic oligonucleotide
cactgacgcccccaagacgcatatgac

SEQ ID NO: 16907 - DNA, 28 bp, Artificial Sequence
  Description of Artificial Sequence: Synthetic oligonucleotide
actgacgcccccaagacgcatatgactc

SEQ ID NO: 16908 - DNA, 27 bp, Artificial Sequence
  Description of Artificial Sequence: Synthetic oligonucleotide
ctgacgcccccaagacgcatatgactc

SEQ ID NO: 16909 - DNA, 28 bp, Artificial Sequence
  Description of Artificial Sequence: Synthetic oligonucleotide
tgacgcccccaagacgcatatgactcac

SEQ ID NO: 16910 - DNA, 27 bp, Artificial Sequence
  Description of Artificial Sequence: Synthetic oligonucleotide
ctgcgcggctactacaaccagagcgaa

SEQ ID NO: 16911 - DNA, 27 bp, Artificial Sequence
  Description of Artificial Sequence: Synthetic oligonucleotide
tgcgcggctactacaaccagagcgaag

SEQ ID NO: 16912 - DNA, 27 bp, Artificial Sequence
  Description of Artificial Sequence: Synthetic oligonucleotide
gcgcggctactacaaccagagcgaaga

SEQ ID NO: 16913 - DNA, 27 bp, Artificial Sequence
  Description of Artificial Sequence: Synthetic oligonucleotide
cgcggctactacaaccagagcgaagac

SEQ ID NO: 16914 - DNA, 27 bp, Artificial Sequence
  Description of Artificial Sequence: Synthetic oligonucleotide
gcggctactacaaccagagcgaagacg

SEQ ID NO: 16915 - DNA, 27 bp, Artificial Sequence
  Description of Artificial Sequence: Synthetic oligonucleotide
cggctactacaaccagagcgaagacgg

SEQ ID NO: 16916 - DNA, 29 bp, Artificial Sequence
  Description of Artificial Sequence: Synthetic oligonucleotide
ggctactacaaccagagcgaagacggttc

SEQ ID NO: 16917 - DNA, 30 bp, Artificial Sequence
  Description of Artificial Sequence: Synthetic oligonucleotide
gctactacaaccagagcgaagacggttctc

SEQ ID NO: 16918 - DNA, 31 bp, Artificial Sequence
  Description of Artificial Sequence: Synthetic oligonucleotide
ctactacaaccagagcgaagacggttctcac

SEQ ID NO: 16919 - DNA, 32 bp, Artificial Sequence
  Description of Artificial Sequence: Synthetic oligonucleotide
tactacaaccagagcgaagacggttctcacac

SEQ ID NO: 16920 - DNA, 31 bp, Artificial Sequence
  Description of Artificial Sequence: Synthetic oligonucleotide
actacaaccagagcgaagacggttctcacac

SEQ ID NO: 16921 - DNA, 30 bp, Artificial Sequence
  Description of Artificial Sequence: Synthetic oligonucleotide
ctacaaccagagcgaagacggttctcacac

SEQ ID NO: 16922 - DNA, 30 bp, Artificial Sequence
  Description of Artificial Sequence: Synthetic oligonucleotide
tacaaccagagcgaagacggttctcacacc

SEQ ID NO: 16923 - DNA, 29 bp, Artificial Sequence
  Description of Artificial Sequence: Synthetic oligonucleotide
acaaccagagcgaagacggttctcacacc

SEQ ID NO: 16924 - DNA, 28 bp, Artificial Sequence
  Description of Artificial Sequence: Synthetic oligonucleotide
caaccagagcgaagacggttctcacacc

SEQ ID NO: 16925 - DNA, 30 bp, Artificial Sequence
  Description of Artificial Sequence: Synthetic oligonucleotide
aaccagagcgaagacggttctcacaccatc

SEQ ID NO: 16926 - DNA, 29 bp, Artificial Sequence
  Description of Artificial Sequence: Synthetic oligonucleotide
accagagcgaagacggttctcacaccatc

SEQ ID NO: 16927 - DNA, 28 bp, Artificial Sequence
  Description of Artificial Sequence: Synthetic oligonucleotide
ccagagcgaagacggttctcacaccatc

SEQ ID NO: 16928 - DNA, 28 bp, Artificial Sequence
  Description of Artificial Sequence: Synthetic oligonucleotide
cagagcgaagacggttctcacaccatcc

SEQ ID NO: 16929 - DNA, 29 bp, Artificial Sequence
  Description of Artificial Sequence: Synthetic oligonucleotide
agagcgaagacggttctcacaccatccag

SEQ ID NO: 16930 - DNA, 28 bp, Artificial Sequence
  Description of Artificial Sequence: Synthetic oligonucleotide
gagcgaagacggttctcacaccatccag

SEQ ID NO: 16931 - DNA, 29 bp, Artificial Sequence
  Description of Artificial Sequence: Synthetic oligonucleotide
agcgaagacggttctcacaccatccagag

SEQ ID NO: 16932 - DNA, 28 bp, Artificial Sequence
  Description of Artificial Sequence: Synthetic oligonucleotide
gcgaagacggttctcacaccatccagag

SEQ ID NO: 16933 - DNA, 28 bp, Artificial Sequence
  Description of Artificial Sequence: Synthetic oligonucleotide
cgaagacggttctcacaccatccagagg

SEQ ID NO: 16934 - DNA, 30 bp, Artificial Sequence
  Description of Artificial Sequence: Synthetic oligonucleotide
gaagacggttctcacaccatccagaggatg

SEQ ID NO: 16935 - DNA, 33 bp, Artificial Sequence
  Description of Artificial Sequence: Synthetic oligonucleotide
aagacggttctcacaccatccagaggatgtatg

SEQ ID NO: 16936 - DNA, 32 bp, Artificial Sequence
  Description of Artificial Sequence: Synthetic oligonucleotide
agacggttctcacaccatccagaggatgtatg

SEQ ID NO: 16937 - DNA, 23 bp, Artificial Sequence
  Description of Artificial Sequence: Synthetic oligonucleotide
gcccatgaggcggagcagtggag

SEQ ID NO: 16938 - DNA, 23 bp, Artificial Sequence
  Description of Artificial Sequence: Synthetic oligonucleotide
cccatgaggcggagcagtggagg

SEQ ID NO: 16939 - DNA, 23 bp, Artificial Sequence
  Description of Artificial Sequence: Synthetic oligonucleotide
ccatgaggcggagcagtggaggg

SEQ ID NO: 16940 - DNA, 23 bp, Artificial Sequence
  Description of Artificial Sequence: Synthetic oligonucleotide
catgaggcggagcagtggagggc

SEQ ID NO: 16941 - DNA, 25 bp, Artificial Sequence
  Description of Artificial Sequence: Synthetic oligonucleotide
atgaggcggagcagtggagggccta

SEQ ID NO: 16942 - DNA, 24 bp, Artificial Sequence
  Description of Artificial Sequence: Synthetic oligonucleotide
tgaggcggagcagtggagggccta

SEQ ID NO: 16943 - DNA, 23 bp, Artificial Sequence
  Description of Artificial Sequence: Synthetic oligonucleotide
gaggcggagcagtggagggccta

SEQ ID NO: 16944 - DNA, 23 bp, Artificial Sequence
  Description of Artificial Sequence: Synthetic oligonucleotide
aggcggagcagtggagggcctac

SEQ ID NO: 16945 - DNA, 22 bp, Artificial Sequence
  Description of Artificial Sequence: Synthetic oligonucleotide
ggcggagcagtggagggcctac

SEQ ID NO: 16946 - DNA, 23 bp, Artificial Sequence
  Description of Artificial Sequence: Synthetic oligonucleotide
gcggagcagtggagggcctacct

SEQ ID NO: 16947 - DNA, 23 bp, Artificial Sequence
  Description of Artificial Sequence: Synthetic oligonucleotide
cggagcagtggagggcctacctg

SEQ ID NO: 16948 - DNA, 24 bp, Artificial Sequence
  Description of Artificial Sequence: Synthetic oligonucleotide
ggagcagtggagggcctacctgga

SEQ ID NO: 16949 - DNA, 24 bp, Artificial Sequence
  Description of Artificial Sequence: Synthetic oligonucleotide
gagcagtggagggcctacctggag

SEQ ID NO: 16950 - DNA, 24 bp, Artificial Sequence
  Description of Artificial Sequence: Synthetic oligonucleotide
agcagtggagggcctacctggagg

SEQ ID NO: 16951 - DNA, 23 bp, Artificial Sequence
  Description of Artificial Sequence: Synthetic oligonucleotide
gcagtggagggcctacctggagg

SEQ ID NO: 16952 - DNA, 23 bp, Artificial Sequence
  Description of Artificial Sequence: Synthetic oligonucleotide
cagtggagggcctacctggaggg

SEQ ID NO: 16953 - DNA, 23 bp, Artificial Sequence
  Description of Artificial Sequence: Synthetic oligonucleotide
agtggagggcctacctggagggc

SEQ ID NO: 16954 - DNA, 22 bp, Artificial Sequence
  Description of Artificial Sequence: Synthetic oligonucleotide
gtggagggcctacctggagggc

SEQ ID NO: 16955 - DNA, 22 bp, Artificial Sequence
  Description of Artificial Sequence: Synthetic oligonucleotide
tggagggcctacctggagggcc

SEQ ID NO: 16956 - DNA, 21 bp, Artificial Sequence
  Description of Artificial Sequence: Synthetic oligonucleotide
ggagggcctacctggagggcc

SEQ ID NO: 16957 - DNA, 21 bp, Artificial Sequence
  Description of Artificial Sequence: Synthetic oligonucleotide
gagggcctacctggagggccg

SEQ ID NO: 16958 - DNA, 22 bp, Artificial Sequence
  Description of Artificial Sequence: Synthetic oligonucleotide
agggcctacctggagggccggt

SEQ ID NO: 16959 - DNA, 21 bp, Artificial Sequence
  Description of Artificial Sequence: Synthetic oligonucleotide
gggcctacctggagggccggt

SEQ ID NO: 16960 - DNA, 21 bp, Artificial Sequence
  Description of Artificial Sequence: Synthetic oligonucleotide
ggcctacctggagggccggtg

SEQ ID NO: 16961 - DNA, 27 bp, Artificial Sequence
  Description of Artificial Sequence: Synthetic oligonucleotide
atgaggcggagcagtggagagcctact

SEQ ID NO: 16962 - DNA, 27 bp, Artificial Sequence
  Description of Artificial Sequence: Synthetic oligonucleotide
tgaggcggagcagtggagagcctactt

SEQ ID NO: 16963 - DNA, 26 bp, Artificial Sequence
  Description of Artificial Sequence: Synthetic oligonucleotide
gaggcggagcagtggagagcctactt

SEQ ID NO: 16964 - DNA, 26 bp, Artificial Sequence
  Description of Artificial Sequence: Synthetic oligonucleotide
aggcggagcagtggagagcctacttg

SEQ ID NO: 16965 - DNA, 25 bp, Artificial Sequence
  Description of Artificial Sequence: Synthetic oligonucleotide
ggcggagcagtggagagcctacttg

SEQ ID NO: 16966 - DNA, 26 bp, Artificial Sequence
  Description of Artificial Sequence: Synthetic oligonucleotide
gcggagcagtggagagcctacttgga

SEQ ID NO: 16967 - DNA, 26 bp, Artificial Sequence
  Description of Artificial Sequence: Synthetic oligonucleotide
cggagcagtggagagcctacttggag

SEQ ID NO: 16968 - DNA, 26 bp, Artificial Sequence
  Description of Artificial Sequence: Synthetic oligonucleotide
ggagcagtggagagcctacttggagg

SEQ ID NO: 16969 - DNA, 26 bp, Artificial Sequence
  Description of Artificial Sequence: Synthetic oligonucleotide
gagcagtggagagcctacttggaggg

SEQ ID NO: 16970 - DNA, 26 bp, Artificial Sequence
  Description of Artificial Sequence: Synthetic oligonucleotide
agcagtggagagcctacttggagggc

SEQ ID NO: 16971 - DNA, 25 bp, Artificial Sequence
  Description of Artificial Sequence: Synthetic oligonucleotide
gcagtggagagcctacttggagggc

SEQ ID NO: 16972 - DNA, 25 bp, Artificial Sequence
  Description of Artificial Sequence: Synthetic oligonucleotide
cagtggagagcctacttggagggcc

SEQ ID NO: 16973 - DNA, 25 bp, Artificial Sequence
  Description of Artificial Sequence: Synthetic oligonucleotide
agtggagagcctacttggagggccg

SEQ ID NO: 16974 - DNA, 24 bp, Artificial Sequence
  Description of Artificial Sequence: Synthetic oligonucleotide
gtggagagcctacttggagggccg

SEQ ID NO: 16975 - DNA, 25 bp, Artificial Sequence
  Description of Artificial Sequence: Synthetic oligonucleotide
tggagagcctacttggagggccggt

SEQ ID NO: 16976 - DNA, 24 bp, Artificial Sequence
  Description of Artificial Sequence: Synthetic oligonucleotide
ggagagcctacttggagggccggt

SEQ ID NO: 16977 - DNA, 24 bp, Artificial Sequence
  Description of Artificial Sequence: Synthetic oligonucleotide
gagagcctacttggagggccggtg

SEQ ID NO: 16978 - DNA, 24 bp, Artificial Sequence
  Description of Artificial Sequence: Synthetic oligonucleotide
agagcctacttggagggccggtgc

SEQ ID NO: 16979 - DNA, 23 bp, Artificial Sequence
  Description of Artificial Sequence: Synthetic oligonucleotide
gagcctacttggagggccggtgc

SEQ ID NO: 16980 - DNA, 24 bp, Artificial Sequence
  Description of Artificial Sequence: Synthetic oligonucleotide
agcctacttggagggccggtgcgt

SEQ ID NO: 16981 - DNA, 23 bp, Artificial Sequence
  Description of Artificial Sequence: Synthetic oligonucleotide
gcctacttggagggccggtgcgt

SEQ ID NO: 16982 - DNA, 23 bp, Artificial Sequence
  Description of Artificial Sequence: Synthetic oligonucleotide
cctacttggagggccggtgcgtg

SEQ ID NO: 16983 - DNA, 24 bp, Artificial Sequence
  Description of Artificial Sequence: Synthetic oligonucleotide
ctacttggagggccggtgcgtgga

SEQ ID NO: 16984 - DNA, 25 bp, Artificial Sequence
  Description of Artificial Sequence: Synthetic oligonucleotide
tacttggagggccggtgcgtggagt

SEQ ID NO: 16985 - DNA, 24 bp, Artificial Sequence
  Description of Artificial Sequence: Synthetic oligonucleotide
acttggagggccggtgcgtggagt

SEQ ID NO: 16986 - DNA, 23 bp, Artificial Sequence
  Description of Artificial Sequence: Synthetic oligonucleotide
cttggagggccggtgcgtggagt

SEQ ID NO: 16987 - DNA, 23 bp, Artificial Sequence
  Description of Artificial Sequence: Synthetic oligonucleotide
ttggagggccggtgcgtggagtg

SEQ ID NO: 16988 - DNA, 28 bp, Artificial Sequence
  Description of Artificial Sequence: Synthetic oligonucleotide
gcccccaagacgcatatgactcaccatg

SEQ ID NO: 16989 - DNA, 28 bp, Artificial Sequence
  Description of Artificial Sequence: Synthetic oligonucleotide
cccccaagacgcatatgactcaccatgc

SEQ ID NO: 16990 - DNA, 29 bp, Artificial Sequence
  Description of Artificial Sequence: Synthetic oligonucleotide
ccccaagacgcatatgactcaccatgctg

SEQ ID NO: 16991 - DNA, 30 bp, Artificial Sequence
  Description of Artificial Sequence: Synthetic oligonucleotide
cccaagacgcatatgactcaccatgctgtc

SEQ ID NO: 16992 - DNA, 31 bp, Artificial Sequence
  Description of Artificial Sequence: Synthetic oligonucleotide
ccaagacgcatatgactcaccatgctgtctc

SEQ ID NO: 16993 - DNA, 32 bp, Artificial Sequence
  Description of Artificial Sequence: Synthetic oligonucleotide
caagacgcatatgactcaccatgctgtctctg

SEQ ID NO: 16994 - DNA, 33 bp, Artificial Sequence
  Description of Artificial Sequence: Synthetic oligonucleotide
aagacgcatatgactcaccatgctgtctctgac

SEQ ID NO: 16995 - DNA, 32 bp, Artificial Sequence
  Description of Artificial Sequence: Synthetic oligonucleotide
agacgcatatgactcaccatgctgtctctgac

SEQ ID NO: 16996 - DNA, 31 bp, Artificial Sequence
  Description of Artificial Sequence: Synthetic oligonucleotide
gacgcatatgactcaccatgctgtctctgac

SEQ ID NO: 16997 - DNA, 31 bp, Artificial Sequence
  Description of Artificial Sequence: Synthetic oligonucleotide
acgcatatgactcaccatgctgtctctgacc

SEQ ID NO: 16998 - DNA, 30 bp, Artificial Sequence
  Description of Artificial Sequence: Synthetic oligonucleotide
cgcatatgactcaccatgctgtctctgacc

SEQ ID NO: 16999 - DNA, 32 bp, Artificial Sequence
  Description of Artificial Sequence: Synthetic oligonucleotide
gcatatgactcaccatgctgtctctgaccatg

SEQ ID NO: 17000 - DNA, 33 bp, Artificial Sequence
  Description of Artificial Sequence: Synthetic oligonucleotide
catatgactcaccatgctgtctctgaccatgag

SEQ ID NO: 17001 - DNA, 33 bp, Artificial Sequence
  Description of Artificial Sequence: Synthetic oligonucleotide
atatgactcaccatgctgtctctgaccatgagg

SEQ ID NO: 17002 - DNA, 32 bp, Artificial Sequence
  Description of Artificial Sequence: Synthetic oligonucleotide
tatgactcaccatgctgtctctgaccatgagg

SEQ ID NO: 17003 - DNA, 31 bp, Artificial Sequence
  Description of Artificial Sequence: Synthetic oligonucleotide
atgactcaccatgctgtctctgaccatgagg

SEQ ID NO: 17004 - DNA, 30 bp, Artificial Sequence
  Description of Artificial Sequence: Synthetic oligonucleotide
tgactcaccatgctgtctctgaccatgagg

SEQ ID NO: 17005 - DNA, 29 bp, Artificial Sequence
  Description of Artificial Sequence: Synthetic oligonucleotide
gactcaccatgctgtctctgaccatgagg

SEQ ID NO: 17006 - DNA, 29 bp, Artificial Sequence
  Description of Artificial Sequence: Synthetic oligonucleotide
actcaccatgctgtctctgaccatgaggc

SEQ ID NO: 17007 - DNA, 28 bp, Artificial Sequence
  Description of Artificial Sequence: Synthetic oligonucleotide
ctcaccatgctgtctctgaccatgaggc

SEQ ID NO: 17008 - DNA, 28 bp, Artificial Sequence
  Description of Artificial Sequence: Synthetic oligonucleotide
tcaccatgctgtctctgaccatgaggcc

SEQ ID NO: 17009 - DNA, 27 bp, Artificial Sequence
  Description of Artificial Sequence: Synthetic oligonucleotide
caccatgctgtctctgaccatgaggcc

SEQ ID NO: 17010 - DNA, 28 bp, Artificial Sequence
  Description of Artificial Sequence: Synthetic oligonucleotide
accatgctgtctctgaccatgaggccac

SEQ ID NO: 17011 - DNA, 27 bp, Artificial Sequence
  Description of Artificial Sequence: Synthetic oligonucleotide
ccatgctgtctctgaccatgaggccac

SEQ ID NO: 17012 - DNA, 27 bp, Artificial Sequence
  Description of Artificial Sequence: Synthetic oligonucleotide
catgctgtctctgaccatgaggccacc

SEQ ID NO: 17013 - DNA, 27 bp, Artificial Sequence
  Description of Artificial Sequence: Synthetic oligonucleotide
atgctgtctctgaccatgaggccaccc

SEQ ID NO: 17014 - DNA, 27 bp, Artificial Sequence
  Description of Artificial Sequence: Synthetic oligonucleotide
tgctgtctctgaccatgaggccaccct

SEQ ID NO: 17015 - DNA, 27 bp, Artificial Sequence
  Description of Artificial Sequence: Synthetic oligonucleotide
accctgcgcggctactacaaccagagt

SEQ ID NO: 17016 - DNA, 26 bp, Artificial Sequence
  Description of Artificial Sequence: Synthetic oligonucleotide
ccctgcgcggctactacaaccagagt

SEQ ID NO: 17017 - DNA, 27 bp, Artificial Sequence
  Description of Artificial Sequence: Synthetic oligonucleotide
cctgcgcggctactacaaccagagtga

SEQ ID NO: 17018 - DNA, 27 bp, Artificial Sequence
  Description of Artificial Sequence: Synthetic oligonucleotide
ctgcgcggctactacaaccagagtgag

SEQ ID NO: 17019 - DNA, 27 bp, Artificial Sequence
  Description of Artificial Sequence: Synthetic oligonucleotide
tgcgcggctactacaaccagagtgagg

SEQ ID NO: 17020 - DNA, 27 bp, Artificial Sequence
  Description of Artificial Sequence: Synthetic oligonucleotide
gcgcggctactacaaccagagtgagga

SEQ ID NO: 17021 - DNA, 27 bp, Artificial Sequence
  Description of Artificial Sequence: Synthetic oligonucleotide
cgcggctactacaaccagagtgaggac

SEQ ID NO: 17022 - DNA, 27 bp, Artificial Sequence
  Description of Artificial Sequence: Synthetic oligonucleotide
gcggctactacaaccagagtgaggacg

SEQ ID NO: 17023 - DNA, 27 bp, Artificial Sequence
  Description of Artificial Sequence: Synthetic oligonucleotide
cggctactacaaccagagtgaggacgg

SEQ ID NO: 17024 - DNA, 29 bp, Artificial Sequence
  Description of Artificial Sequence: Synthetic oligonucleotide
ggctactacaaccagagtgaggacggttc

SEQ ID NO: 17025 - DNA, 30 bp, Artificial Sequence
  Description of Artificial Sequence: Synthetic oligonucleotide
gctactacaaccagagtgaggacggttctc

SEQ ID NO: 17026 - DNA, 31 bp, Artificial Sequence
  Description of Artificial Sequence: Synthetic oligonucleotide
ctactacaaccagagtgaggacggttctcac

SEQ ID NO: 17027 - DNA, 32 bp, Artificial Sequence
  Description of Artificial Sequence: Synthetic oligonucleotide
tactacaaccagagtgaggacggttctcacac

SEQ ID NO: 17028 - DNA, 31 bp, Artificial Sequence
  Description of Artificial Sequence: Synthetic oligonucleotide
actacaaccagagtgaggacggttctcacac

SEQ ID NO: 17029 - DNA, 30 bp, Artificial Sequence
  Description of Artificial Sequence: Synthetic oligonucleotide
ctacaaccagagtgaggacggttctcacac

SEQ ID NO: 17030 - DNA, 30 bp, Artificial Sequence
  Description of Artificial Sequence: Synthetic oligonucleotide
tacaaccagagtgaggacggttctcacacc

SEQ ID NO: 17031 - DNA, 29 bp, Artificial Sequence
  Description of Artificial Sequence: Synthetic oligonucleotide
acaaccagagtgaggacggttctcacacc

SEQ ID NO: 17032 - DNA, 28 bp, Artificial Sequence
  Description of Artificial Sequence: Synthetic oligonucleotide
caaccagagtgaggacggttctcacacc

SEQ ID NO: 17033 - DNA, 30 bp, Artificial Sequence
  Description of Artificial Sequence: Synthetic oligonucleotide
aaccagagtgaggacggttctcacaccatc

SEQ ID NO: 17034 - DNA, 29 bp, Artificial Sequence
  Description of Artificial Sequence: Synthetic oligonucleotide
accagagtgaggacggttctcacaccatc

SEQ ID NO: 17035 - DNA, 28 bp, Artificial Sequence
  Description of Artificial Sequence: Synthetic oligonucleotide
ccagagtgaggacggttctcacaccatc

SEQ ID NO: 17036 - DNA, 28 bp, Artificial Sequence
  Description of Artificial Sequence: Synthetic oligonucleotide
cagagtgaggacggttctcacaccatcc

SEQ ID NO: 17037 - DNA, 29 bp, Artificial Sequence
  Description of Artificial Sequence: Synthetic oligonucleotide
agagtgaggacggttctcacaccatccag

SEQ ID NO: 17038 - DNA, 28 bp, Artificial Sequence
  Description of Artificial Sequence: Synthetic oligonucleotide
gagtgaggacggttctcacaccatccag

SEQ ID NO: 17039 - DNA, 29 bp, Artificial Sequence
  Description of Artificial Sequence: Synthetic oligonucleotide
agtgaggacggttctcacaccatccagag

SEQ ID NO: 17040 - DNA, 28 bp, Artificial Sequence
  Description of Artificial Sequence: Synthetic oligonucleotide
gtgaggacggttctcacaccatccagag

SEQ ID NO: 17041 - DNA, 28 bp, Artificial Sequence
  Description of Artificial Sequence: Synthetic oligonucleotide
tgaggacggttctcacaccatccagagg

SEQ ID NO: 17042 - DNA, 28 bp, Artificial Sequence
  Description of Artificial Sequence: Synthetic oligonucleotide
tatttctacacctccgtgtcccggcctg

SEQ ID NO: 17043 - DNA, 27 bp, Artificial Sequence
  Description of Artificial Sequence: Synthetic oligonucleotide
atttctacacctccgtgtcccggcctg

SEQ ID NO: 17044 - DNA, 26 bp, Artificial Sequence
  Description of Artificial Sequence: Synthetic oligonucleotide
tttctacacctccgtgtcccggcctg

SEQ ID NO: 17045 - DNA, 25 bp, Artificial Sequence
  Description of Artificial Sequence: Synthetic oligonucleotide
ttctacacctccgtgtcccggcctg

SEQ ID NO: 17046 - DNA, 24 bp, Artificial Sequence
  Description of Artificial Sequence: Synthetic oligonucleotide
tctacacctccgtgtcccggcctg

SEQ ID NO: 17047 - DNA, 23 bp, Artificial Sequence
  Description of Artificial Sequence: Synthetic oligonucleotide
ctacacctccgtgtcccggcctg

SEQ ID NO: 17048 - DNA, 23 bp, Artificial Sequence
  Description of Artificial Sequence: Synthetic oligonucleotide
tacacctccgtgtcccggcctgg

SEQ ID NO: 17049 - DNA, 22 bp, Artificial Sequence
  Description of Artificial Sequence: Synthetic oligonucleotide
acacctccgtgtcccggcctgg

SEQ ID NO: 17050 - DNA, 21 bp, Artificial Sequence
  Description of Artificial Sequence: Synthetic oligonucleotide
cacctccgtgtcccggcctgg

SEQ ID NO: 17051 - DNA, 21 bp, Artificial Sequence
  Description of Artificial Sequence: Synthetic oligonucleotide
acctccgtgtcccggcctggc

SEQ ID NO: 17052 - DNA, 20 bp, Artificial Sequence
  Description of Artificial Sequence: Synthetic oligonucleotide
cctccgtgtcccggcctggc

SEQ ID NO: 17053 - DNA, 20 bp, Artificial Sequence
  Description of Artificial Sequence: Synthetic oligonucleotide
ctccgtgtcccggcctggcc

SEQ ID NO: 17054 - DNA, 32 bp, Artificial Sequence
  Description of Artificial Sequence: Synthetic oligonucleotide
aacacacggaatgtgaaggcccactcacaaac

SEQ ID NO: 17055 - DNA, 31 bp, Artificial Sequence
  Description of Artificial Sequence: Synthetic oligonucleotide
acacacggaatgtgaaggcccactcacaaac

SEQ ID NO: 17056 - DNA, 30 bp, Artificial Sequence
  Description of Artificial Sequence: Synthetic oligonucleotide
cacacggaatgtgaaggcccactcacaaac

SEQ ID NO: 17057 - DNA, 31 bp, Artificial Sequence
  Description of Artificial Sequence: Synthetic oligonucleotide
acacggaatgtgaaggcccactcacaaactg

SEQ ID NO: 17058 - DNA, 30 bp, Artificial Sequence
  Description of Artificial Sequence: Synthetic oligonucleotide
cacggaatgtgaaggcccactcacaaactg

SEQ ID NO: 17059 - DNA, 31 bp, Artificial Sequence
  Description of Artificial Sequence: Synthetic oligonucleotide
acggaatgtgaaggcccactcacaaactgac

SEQ ID NO: 17060 - DNA, 30 bp, Artificial Sequence
  Description of Artificial Sequence: Synthetic oligonucleotide
cggaatgtgaaggcccactcacaaactgac

SEQ ID NO: 17061 - DNA, 30 bp, Artificial Sequence
  Description of Artificial Sequence: Synthetic oligonucleotide
ggaatgtgaaggcccactcacaaactgacc

SEQ ID NO: 17062 - DNA, 30 bp, Artificial Sequence
  Description of Artificial Sequence: Synthetic oligonucleotide
gaatgtgaaggcccactcacaaactgaccg

SEQ ID NO: 17063 - DNA, 31 bp, Artificial Sequence
  Description of Artificial Sequence: Synthetic oligonucleotide
aatgtgaaggcccactcacaaactgaccgag

SEQ ID NO: 17064 - DNA, 30 bp, Artificial Sequence
  Description of Artificial Sequence: Synthetic oligonucleotide
atgtgaaggcccactcacaaactgaccgag

SEQ ID NO: 17065 - DNA, 29 bp, Artificial Sequence
  Description of Artificial Sequence: Synthetic oligonucleotide
tgtgaaggcccactcacaaactgaccgag

SEQ ID NO: 17066 - DNA, 28 bp, Artificial Sequence
  Description of Artificial Sequence: Synthetic oligonucleotide
gtgaaggcccactcacaaactgaccgag

SEQ ID NO: 17067 - DNA, 28 bp, Artificial Sequence
  Description of Artificial Sequence: Synthetic oligonucleotide
tgaaggcccactcacaaactgaccgagc

SEQ ID NO: 17068 - DNA, 27 bp, Artificial Sequence
  Description of Artificial Sequence: Synthetic oligonucleotide
gaaggcccactcacaaactgaccgagc

SEQ ID NO: 17069 - DNA, 27 bp, Artificial Sequence
  Description of Artificial Sequence: Synthetic oligonucleotide
aaggcccactcacaaactgaccgagcg

SEQ ID NO: 17070 - DNA, 27 bp, Artificial Sequence
  Description of Artificial Sequence: Synthetic oligonucleotide
aggcccactcacaaactgaccgagcga

SEQ ID NO: 17071 - DNA, 27 bp, Artificial Sequence
  Description of Artificial Sequence: Synthetic oligonucleotide
ggcccactcacaaactgaccgagcgaa

SEQ ID NO: 17072 - DNA, 27 bp, Artificial Sequence
  Description of Artificial Sequence: Synthetic oligonucleotide
gcccactcacaaactgaccgagcgaac

SEQ ID NO: 17073 - DNA, 27 bp, Artificial Sequence
  Description of Artificial Sequence: Synthetic oligonucleotide
cccactcacaaactgaccgagcgaacc

SEQ ID NO: 17074 - DNA, 28 bp, Artificial Sequence
  Description of Artificial Sequence: Synthetic oligonucleotide
ccactcacaaactgaccgagcgaacctg

SEQ ID NO: 17075 - DNA, 28 bp, Artificial Sequence
  Description of Artificial Sequence: Synthetic oligonucleotide
cactcacaaactgaccgagcgaacctgg

SEQ ID NO: 17076 - DNA, 28 bp, Artificial Sequence
  Description of Artificial Sequence: Synthetic oligonucleotide
actcacaaactgaccgagcgaacctggg

SEQ ID NO: 17077 - DNA, 27 bp, Artificial Sequence
  Description of Artificial Sequence: Synthetic oligonucleotide
ctcacaaactgaccgagcgaacctggg

SEQ ID NO: 17078 - DNA, 27 bp, Artificial Sequence
  Description of Artificial Sequence: Synthetic oligonucleotide
tcacaaactgaccgagcgaacctgggg

SEQ ID NO: 17079 - DNA, 27 bp, Artificial Sequence
  Description of Artificial Sequence: Synthetic oligonucleotide
cacaaactgaccgagcgaacctgggga

SEQ ID NO: 17080 - DNA, 27 bp, Artificial Sequence
  Description of Artificial Sequence: Synthetic oligonucleotide
acaaactgaccgagcgaacctggggac

SEQ ID NO: 17081 - DNA, 26 bp, Artificial Sequence
  Description of Artificial Sequence: Synthetic oligonucleotide
caaactgaccgagcgaacctggggac

SEQ ID NO: 17082 - DNA, 26 bp, Artificial Sequence
  Description of Artificial Sequence: Synthetic oligonucleotide
aaactgaccgagcgaacctggggacc

SEQ ID NO: 17083 - DNA, 25 bp, Artificial Sequence
  Description of Artificial Sequence: Synthetic oligonucleotide
aactgaccgagcgaacctggggacc

SEQ ID NO: 17084 - DNA, 24 bp, Artificial Sequence
  Description of Artificial Sequence: Synthetic oligonucleotide
gcggacatggcggctcagatcacg

SEQ ID NO: 17085 - DNA, 25 bp, Artificial Sequence
  Description of Artificial Sequence: Synthetic oligonucleotide
cggacatggcggctcagatcacgca

SEQ ID NO: 17086 - DNA, 25 bp, Artificial Sequence
  Description of Artificial Sequence: Synthetic oligonucleotide
ggacatggcggctcagatcacgcag

SEQ ID NO: 17087 - DNA, 25 bp, Artificial Sequence
  Description of Artificial Sequence: Synthetic oligonucleotide
gacatggcggctcagatcacgcagc

SEQ ID NO: 17088 - DNA, 25 bp, Artificial Sequence
  Description of Artificial Sequence: Synthetic oligonucleotide
acatggcggctcagatcacgcagcg

SEQ ID NO: 17089 - DNA, 24 bp, Artificial Sequence
  Description of Artificial Sequence: Synthetic oligonucleotide
catggcggctcagatcacgcagcg

SEQ ID NO: 17090 - DNA, 26 bp, Artificial Sequence
  Description of Artificial Sequence: Synthetic oligonucleotide
atggcggctcagatcacgcagcgcaa

SEQ ID NO: 17091 - DNA, 25 bp, Artificial Sequence
  Description of Artificial Sequence: Synthetic oligonucleotide
tggcggctcagatcacgcagcgcaa

SEQ ID NO: 17092 - DNA, 24 bp, Artificial Sequence
  Description of Artificial Sequence: Synthetic oligonucleotide
ggcggctcagatcacgcagcgcaa

SEQ ID NO: 17093 - DNA, 25 bp, Artificial Sequence
  Description of Artificial Sequence: Synthetic oligonucleotide
gcggctcagatcacgcagcgcaagt

SEQ ID NO: 17094 - DNA, 25 bp, Artificial Sequence
  Description of Artificial Sequence: Synthetic oligonucleotide
cggctcagatcacgcagcgcaagtg

SEQ ID NO: 17095 - DNA, 25 bp, Artificial Sequence
  Description of Artificial Sequence: Synthetic oligonucleotide
ggctcagatcacgcagcgcaagtgg

SEQ ID NO: 17096 - DNA, 26 bp, Artificial Sequence
  Description of Artificial Sequence: Synthetic oligonucleotide
gctcagatcacgcagcgcaagtggga

SEQ ID NO: 17097 - DNA, 27 bp, Artificial Sequence
  Description of Artificial Sequence: Synthetic oligonucleotide
ctcagatcacgcagcgcaagtgggaga

SEQ ID NO: 17098 - DNA, 27 bp, Artificial Sequence
  Description of Artificial Sequence: Synthetic oligonucleotide
tcagatcacgcagcgcaagtgggagac

SEQ ID NO: 17099 - DNA, 26 bp, Artificial Sequence
  Description of Artificial Sequence: Synthetic oligonucleotide
cagatcacgcagcgcaagtgggagac

SEQ ID NO: 17100 - DNA, 26 bp, Artificial Sequence
  Description of Artificial Sequence: Synthetic oligonucleotide
agatcacgcagcgcaagtgggagacg

SEQ ID NO: 17101 - DNA, 25 bp, Artificial Sequence
  Description of Artificial Sequence: Synthetic oligonucleotide
gatcacgcagcgcaagtgggagacg

SEQ ID NO: 17102 - DNA, 25 bp, Artificial Sequence
  Description of Artificial Sequence: Synthetic oligonucleotide
atcacgcagcgcaagtgggagacgg

SEQ ID NO: 17103 - DNA, 24 bp, Artificial Sequence
  Description of Artificial Sequence: Synthetic oligonucleotide
tcacgcagcgcaagtgggagacgg

SEQ ID NO: 17104 - DNA, 23 bp, Artificial Sequence
  Description of Artificial Sequence: Synthetic oligonucleotide
cacgcagcgcaagtgggagacgg

SEQ ID NO: 17105 - DNA, 23 bp, Artificial Sequence
  Description of Artificial Sequence: Synthetic oligonucleotide
acgcagcgcaagtgggagacggc

SEQ ID NO: 17106 - DNA, 22 bp, Artificial Sequence
  Description of Artificial Sequence: Synthetic oligonucleotide
cgcagcgcaagtgggagacggc

SEQ ID NO: 17107 - DNA, 22 bp, Artificial Sequence
  Description of Artificial Sequence: Synthetic oligonucleotide
gcagcgcaagtgggagacggcc

SEQ ID NO: 17108 - DNA, 22 bp, Artificial Sequence
  Description of Artificial Sequence: Synthetic oligonucleotide
ccagcgcaagtgggagacggcg

SEQ ID NO: 17109 - DNA, 24 bp, Artificial Sequence
  Description of Artificial Sequence: Synthetic oligonucleotide
cagcgcaagtgggagacggcgcat

SEQ ID NO: 17110 - DNA, 25 bp, Artificial Sequence
  Description of Artificial Sequence: Synthetic oligonucleotide
agcgcaagtgggagacggcgcatga

SEQ ID NO: 17111 - DNA, 24 bp, Artificial Sequence
  Description of Artificial Sequence: Synthetic oligonucleotide
gcgcaagtgggagacggcgcatga

SEQ ID NO: 17112 - DNA, 24 bp, Artificial Sequence
  Description of Artificial Sequence: Synthetic oligonucleotide
cgcaagtgggagacggcgcatgag

SEQ ID NO: 17113 - DNA, 24 bp, Artificial Sequence
  Description of Artificial Sequence: Synthetic oligonucleotide
gcaagtgggagacggcgcatgagg

SEQ ID NO: 17114 - DNA, 24 bp, Artificial Sequence
  Description of Artificial Sequence: Synthetic oligonucleotide
caagtgggagacggcgcatgaggc

SEQ ID NO: 17115 - DNA, 24 bp, Artificial Sequence
  Description of Artificial Sequence: Synthetic oligonucleotide
aagtgggagacggcgcatgaggcg

SEQ ID NO: 17116 - DNA, 23 bp, Artificial Sequence
  Description of Artificial Sequence: Synthetic oligonucleotide
agtgggagacggcgcatgaggcg

SEQ ID NO: 17117 - DNA, 22 bp, Artificial Sequence
  Description of Artificial Sequence: Synthetic oligonucleotide
gtgggagacggcgcatgaggcg

SEQ ID NO: 17118 - DNA, 23 bp, Artificial Sequence
  Description of Artificial Sequence: Synthetic oligonucleotide
tgggagacggcgcatgaggcgga

SEQ ID NO: 17119 - DNA, 22 bp, Artificial Sequence
  Description of Artificial Sequence: Synthetic oligonucleotide
gggagacggcgcatgaggcgga

SEQ ID NO: 17120 - DNA, 22 bp, Artificial Sequence
  Description of Artificial Sequence: Synthetic oligonucleotide
ggagacggcgcatgaggcggag

SEQ ID NO: 17121 - DNA, 23 bp, Artificial Sequence
  Description of Artificial Sequence: Synthetic oligonucleotide
gagacggcgcatgaggcggagca

SEQ ID NO: 17122 - DNA, 24 bp, Artificial Sequence
  Description of Artificial Sequence: Synthetic oligonucleotide
agacggcgcatgaggcggagcagt

SEQ ID NO: 17123 - DNA, 23 bp, Artificial Sequence
  Description of Artificial Sequence: Synthetic oligonucleotide
gacggcgcatgaggcggagcagt

SEQ ID NO: 17124 - DNA, 23 bp, Artificial Sequence
  Description of Artificial Sequence: Synthetic oligonucleotide
acggcgcatgaggcggagcagtg

SEQ ID NO: 17125 - DNA, 22 bp, Artificial Sequence
  Description of Artificial Sequence: Synthetic oligonucleotide
cggcgcatgaggcggagcagtg

SEQ ID NO: 17126 - DNA, 23 bp, Artificial Sequence
  Description of Artificial Sequence: Synthetic oligonucleotide
ggcgcatgaggcggagcagtgga

SEQ ID NO: 17127 - DNA, 24 bp, Artificial Sequence
  Description of Artificial Sequence: Synthetic oligonucleotide
gcgcatgaggcggagcagtggaga

SEQ ID NO: 17128 - DNA, 24 bp, Artificial Sequence
  Description of Artificial Sequence: Synthetic oligonucleotide
cgcatgaggcggagcagtggagag

SEQ ID NO: 17129 - DNA, 24 bp, Artificial Sequence
  Description of Artificial Sequence: Synthetic oligonucleotide
gcatgaggcggagcagtggagagc

SEQ ID NO: 17130 - DNA, 23 bp, Artificial Sequence
  Description of Artificial Sequence: Synthetic oligonucleotide
cgcgggcgccgtggatagagcaa

SEQ ID NO: 17131 - DNA, 24 bp, Artificial Sequence
  Description of Artificial Sequence: Synthetic oligonucleotide
gcgggcgccgtggatagagcaaga

SEQ ID NO: 17132 - DNA, 24 bp, Artificial Sequence
  Description of Artificial Sequence: Synthetic oligonucleotide
cgggcgccgtggatagagcaagag

SEQ ID NO: 17133 - DNA, 24 bp, Artificial Sequence
  Description of Artificial Sequence: Synthetic oligonucleotide
gggcgccgtggatagagcaagagg

SEQ ID NO: 17134 - DNA, 24 bp, Artificial Sequence
  Description of Artificial Sequence: Synthetic oligonucleotide
ggcgccgtggatagagcaagaggg

SEQ ID NO: 17135 - DNA, 24 bp, Artificial Sequence
  Description of Artificial Sequence: Synthetic oligonucleotide
gcgccgtggatagagcaagagggg

SEQ ID NO: 17136 - DNA, 24 bp, Artificial Sequence
  Description of Artificial Sequence: Synthetic oligonucleotide
cgccgtggatagagcaagaggggc

SEQ ID NO: 17137 - DNA, 24 bp, Artificial Sequence
  Description of Artificial Sequence: Synthetic oligonucleotide
gccgtggatagagcaagaggggcc

SEQ ID NO: 17138 - DNA, 24 bp, Artificial Sequence
  Description of Artificial Sequence: Synthetic oligonucleotide
ccgtggatagagcaagaggggccg

SEQ ID NO: 17139 - DNA, 25 bp, Artificial Sequence
  Description of Artificial Sequence: Synthetic oligonucleotide
cgtggatagagcaagaggggccgga

SEQ ID NO: 17140 - DNA, 27 bp, Artificial Sequence
  Description of Artificial Sequence: Synthetic oligonucleotide
gtggatagagcaagaggggccggagta

SEQ ID NO: 17141 - DNA, 29 bp, Artificial Sequence
  Description of Artificial Sequence: Synthetic oligonucleotide
tggatagagcaagaggggccggagtattg

SEQ ID NO: 17142 - DNA, 28 bp, Artificial Sequence
  Description of Artificial Sequence: Synthetic oligonucleotide
ggatagagcaagaggggccggagtattg

SEQ ID NO: 17143 - DNA, 28 bp, Artificial Sequence
  Description of Artificial Sequence: Synthetic oligonucleotide
gatagagcaagaggggccggagtattgg

SEQ ID NO: 17144 - DNA, 28 bp, Artificial Sequence
  Description of Artificial Sequence: Synthetic oligonucleotide
atagagcaagaggggccggagtattggg

SEQ ID NO: 17145 - DNA, 27 bp, Artificial Sequence
  Description of Artificial Sequence: Synthetic oligonucleotide
tagagcaagaggggccggagtattggg

SEQ ID NO: 17146 - DNA, 27 bp, Artificial Sequence
  Description of Artificial Sequence: Synthetic oligonucleotide
agagcaagaggggccggagtattggga

SEQ ID NO: 17147 - DNA, 26 bp, Artificial Sequence
  Description of Artificial Sequence: Synthetic oligonucleotide
gagcaagaggggccggagtattggga

SEQ ID NO: 17148 - DNA, 26 bp, Artificial Sequence
  Description of Artificial Sequence: Synthetic oligonucleotide
agcaagaggggccggagtattgggac

SEQ ID NO: 17149 - DNA, 25 bp, Artificial Sequence
  Description of Artificial Sequence: Synthetic oligonucleotide
gcaagaggggccggagtattgggac

SEQ ID NO: 17150 - DNA, 25 bp, Artificial Sequence
  Description of Artificial Sequence: Synthetic oligonucleotide
caagaggggccggagtattgggacc

SEQ ID NO: 17151 - DNA, 25 bp, Artificial Sequence
  Description of Artificial Sequence: Synthetic oligonucleotide
aagaggggccggagtattgggaccg

SEQ ID NO: 17152 - DNA, 24 bp, Artificial Sequence
  Description of Artificial Sequence: Synthetic oligonucleotide
agaggggccggagtattgggaccg

SEQ ID NO: 17153 - DNA, 25 bp, Artificial Sequence
  Description of Artificial Sequence: Synthetic oligonucleotide
gcttcctccgcgggtaccagcagaa

SEQ ID NO: 17154 - DNA, 25 bp, Artificial Sequence
  Description of Artificial Sequence: Synthetic oligonucleotide
cttcctccgcgggtaccagcagaac

SEQ ID NO: 17155 - DNA, 25 bp, Artificial Sequence
  Description of Artificial Sequence: Synthetic oligonucleotide
ttcctccgcgggtaccagcagaacg

SEQ ID NO: 17156 - DNA, 24 bp, Artificial Sequence
  Description of Artificial Sequence: Synthetic oligonucleotide
tcctccgcgggtaccagcagaacg

SEQ ID NO: 17157 - DNA, 23 bp, Artificial Sequence
  Description of Artificial Sequence: Synthetic oligonucleotide
cctccgcgggtaccagcagaacg

SEQ ID NO: 17158 - DNA, 26 bp, Artificial Sequence
  Description of Artificial Sequence: Synthetic oligonucleotide
ctccgcgggtaccagcagaacgctta

SEQ ID NO: 17159 - DNA, 26 bp, Artificial Sequence
  Description of Artificial Sequence: Synthetic oligonucleotide
tccgcgggtaccagcagaacgcttac

SEQ ID NO: 17160 - DNA, 25 bp, Artificial Sequence
  Description of Artificial Sequence: Synthetic oligonucleotide
ccgcgggtaccagcagaacgcttac

SEQ ID NO: 17161 - DNA, 26 bp, Artificial Sequence
  Description of Artificial Sequence: Synthetic oligonucleotide
cgcgggtaccagcagaacgcttacga

SEQ ID NO: 17162 - DNA, 26 bp, Artificial Sequence
  Description of Artificial Sequence: Synthetic oligonucleotide
gcgggtaccagcagaacgcttacgac

SEQ ID NO: 17163 - DNA, 26 bp, Artificial Sequence
  Description of Artificial Sequence: Synthetic oligonucleotide
cgggtaccagcagaacgcttacgacg

SEQ ID NO: 17164 - DNA, 26 bp, Artificial Sequence
  Description of Artificial Sequence: Synthetic oligonucleotide
gggtaccagcagaacgcttacgacgg

SEQ ID NO: 17165 - DNA, 27 bp, Artificial Sequence
  Description of Artificial Sequence: Synthetic oligonucleotide
ggtaccagcagaacgcttacgacggca

SEQ ID NO: 17166 - DNA, 28 bp, Artificial Sequence
  Description of Artificial Sequence: Synthetic oligonucleotide
gtaccagcagaacgcttacgacggcaag

SEQ ID NO: 17167 - DNA, 28 bp, Artificial Sequence
  Description of Artificial Sequence: Synthetic oligonucleotide
taccagcagaacgcttacgacggcaagg

SEQ ID NO: 17168 - DNA, 27 bp, Artificial Sequence
  Description of Artificial Sequence: Synthetic oligonucleotide
accagcagaacgcttacgacggcaagg

SEQ ID NO: 17169 - DNA, 27 bp, Artificial Sequence
  Description of Artificial Sequence: Synthetic oligonucleotide
ccagcagaacgcttacgacggcaagga

SEQ ID NO: 17170 - DNA, 30 bp, Artificial Sequence
  Description of Artificial Sequence: Synthetic oligonucleotide
cagcagaacgcttacgacggcaaggattac

SEQ ID NO: 17171 - DNA, 32 bp, Artificial Sequence
  Description of Artificial Sequence: Synthetic oligonucleotide
agcagaacgcttacgacggcaaggattacatc

SEQ ID NO: 17172 - DNA, 31 bp, Artificial Sequence
  Description of Artificial Sequence: Synthetic oligonucleotide
gcagaacgcttacgacggcaaggattacatc

SEQ ID NO: 17173 - DNA, 31 bp, Artificial Sequence
  Description of Artificial Sequence: Synthetic oligonucleotide
cagaacgcttacgacggcaaggattacatcg

SEQ ID NO: 17174 - DNA, 31 bp, Artificial Sequence
  Description of Artificial Sequence: Synthetic oligonucleotide
agaacgcttacgacggcaaggattacatcgc

SEQ ID NO: 17175 - DNA, 30 bp, Artificial Sequence
  Description of Artificial Sequence: Synthetic oligonucleotide
gaacgcttacgacggcaaggattacatcgc

SEQ ID NO: 17176 - DNA, 30 bp, Artificial Sequence
  Description of Artificial Sequence: Synthetic oligonucleotide
aacgcttacgacggcaaggattacatcgcc

SEQ ID NO: 17177 - DNA, 31 bp, Artificial Sequence
  Description of Artificial Sequence: Synthetic oligonucleotide
cctcccactccatgaggtatttctacacctc

SEQ ID NO: 17178 - DNA, 25 bp, Artificial Sequence
  Description of Artificial Sequence: Synthetic oligonucleotide
agtggagagcctacctggagggcct

SEQ ID NO: 17179 - DNA, 24 bp, Artificial Sequence
  Description of Artificial Sequence: Synthetic oligonucleotide
gtggagagcctacctggagggcct

SEQ ID NO: 17180 - DNA, 25 bp, Artificial Sequence
  Description of Artificial Sequence: Synthetic oligonucleotide
tggagagcctacctggagggcctgt

SEQ ID NO: 17181 - DNA, 24 bp, Artificial Sequence
  Description of Artificial Sequence: Synthetic oligonucleotide
ggagagcctacctggagggcctgt

SEQ ID NO: 17182 - DNA, 25 bp, Artificial Sequence
  Description of Artificial Sequence: Synthetic oligonucleotide
tacctggagggcctgtgcgtggagt

SEQ ID NO: 17183 - DNA, 24 bp, Artificial Sequence
  Description of Artificial Sequence: Synthetic oligonucleotide
acctggagggcctgtgcgtggagt

SEQ ID NO: 17184 - DNA, 23 bp, Artificial Sequence
  Description of Artificial Sequence: Synthetic oligonucleotide
cctggagggcctgtgcgtggagt

SEQ ID NO: 17185 - DNA, 23 bp, Artificial Sequence
  Description of Artificial Sequence: Synthetic oligonucleotide
ctggagggcctgtgcgtggagtg

SEQ ID NO: 17186 - DNA, 23 bp, Artificial Sequence
  Description of Artificial Sequence: Synthetic oligonucleotide
tggagggcctgtgcgtggagtgg

SEQ ID NO: 17187 - DNA, 22 bp, Artificial Sequence
  Description of Artificial Sequence: Synthetic oligonucleotide
ggagggcctgtgcgtggagtgg

SEQ ID NO: 17188 - DNA, 23 bp, Artificial Sequence
  Description of Artificial Sequence: Synthetic oligonucleotide
gagggcctgtgcgtggagtggct

SEQ ID NO: 17189 - DNA, 23 bp, Artificial Sequence
  Description of Artificial Sequence: Synthetic oligonucleotide
agggcctgtgcgtggagtggctc

SEQ ID NO: 17190 - DNA, 22 bp, Artificial Sequence
  Description of Artificial Sequence: Synthetic oligonucleotide
gggcctgtgcgtggagtggctc

SEQ ID NO: 17191 - DNA, 22 bp, Artificial Sequence
  Description of Artificial Sequence: Synthetic oligonucleotide
ggcctgtgcgtggagtggctcc

SEQ ID NO: 17192 - DNA, 22 bp, Artificial Sequence
  Description of Artificial Sequence: Synthetic oligonucleotide
gcctgtgcgtggagtggctccg

SEQ ID NO: 17193 - DNA, 23 bp, Artificial Sequence
  Description of Artificial Sequence: Synthetic oligonucleotide
cctgtgcgtggagtggctccgca

SEQ ID NO: 17194 - DNA, 26 bp, Artificial Sequence
  Description of Artificial Sequence: Synthetic oligonucleotide
ctgtgcgtggagtggctccgcagata

SEQ ID NO: 17195 - DNA, 26 bp, Artificial Sequence
  Description of Artificial Sequence: Synthetic oligonucleotide
tgtgcgtggagtggctccgcagatac

SEQ ID NO: 17196 - DNA, 22 bp, Artificial Sequence
  Description of Artificial Sequence: Synthetic oligonucleotide
cgcttcctccgcgggtaccagc

SEQ ID NO: 17197 - DNA, 22 bp, Artificial Sequence
  Description of Artificial Sequence: Synthetic oligonucleotide
gcttcctccgcgggtaccagcg

SEQ ID NO: 17198 - DNA, 22 bp, Artificial Sequence
  Description of Artificial Sequence: Synthetic oligonucleotide
cttcctccgcgggtaccagcgg

SEQ ID NO: 17199 - DNA, 23 bp, Artificial Sequence
  Description of Artificial Sequence: Synthetic oligonucleotide
ttcctccgcgggtaccagcggga

SEQ ID NO: 17200 - DNA, 22 bp, Artificial Sequence
  Description of Artificial Sequence: Synthetic oligonucleotide
tcctccgcgggtaccagcggga

SEQ ID NO: 17201 - DNA, 21 bp, Artificial Sequence
  Description of Artificial Sequence: Synthetic oligonucleotide
cctccgcgggtaccagcggga

SEQ ID NO: 17202 - DNA, 21 bp, Artificial Sequence
  Description of Artificial Sequence: Synthetic oligonucleotide
ctccgcgggtaccagcgggac

SEQ ID NO: 17203 - DNA, 21 bp, Artificial Sequence
  Description of Artificial Sequence: Synthetic oligonucleotide
tccgcgggtaccagcgggacg

SEQ ID NO: 17204 - DNA, 20 bp, Artificial Sequence
  Description of Artificial Sequence: Synthetic oligonucleotide
ccgcgggtaccagcgggacg

SEQ ID NO: 17205 - DNA, 23 bp, Artificial Sequence
  Description of Artificial Sequence: Synthetic oligonucleotide
cgcgggtaccagcgggacgctta

SEQ ID NO: 17206 - DNA, 23 bp, Artificial Sequence
  Description of Artificial Sequence: Synthetic oligonucleotide
gcgggtaccagcgggacgcttac

SEQ ID NO: 17207 - DNA, 24 bp, Artificial Sequence
  Description of Artificial Sequence: Synthetic oligonucleotide
cgggtaccagcgggacgcttacga

SEQ ID NO: 17208 - DNA, 24 bp, Artificial Sequence
  Description of Artificial Sequence: Synthetic oligonucleotide
gggtaccagcgggacgcttacgac

SEQ ID NO: 17209 - DNA, 24 bp, Artificial Sequence
  Description of Artificial Sequence: Synthetic oligonucleotide
ggtaccagcgggacgcttacgacg

SEQ ID NO: 17210 - DNA, 24 bp, Artificial Sequence
  Description of Artificial Sequence: Synthetic oligonucleotide
gtaccagcgggacgcttacgacgg

SEQ ID NO: 17211 - DNA, 26 bp, Artificial Sequence
  Description of Artificial Sequence: Synthetic oligonucleotide
taccagcgggacgcttacgacggcaa

SEQ ID NO: 17212 - DNA, 25 bp, Artificial Sequence
  Description of Artificial Sequence: Synthetic oligonucleotide
accagcgggacgcttacgacggcaa

SEQ ID NO: 17213 - DNA, 24 bp, Artificial Sequence
  Description of Artificial Sequence: Synthetic oligonucleotide
ccagcgggacgcttacgacggcaa

SEQ ID NO: 17214 - DNA, 24 bp, Artificial Sequence
  Description of Artificial Sequence: Synthetic oligonucleotide
cagcgggacgcttacgacggcaag

SEQ ID NO: 17215 - DNA, 27 bp, Artificial Sequence
  Description of Artificial Sequence: Synthetic oligonucleotide
agcgggacgcttacgacggcaaggatt

SEQ ID NO: 17216 - DNA, 27 bp, Artificial Sequence
  Description of Artificial Sequence: Synthetic oligonucleotide
gcgggacgcttacgacggcaaggatta

SEQ ID NO: 17217 - DNA, 27 bp, Artificial Sequence
  Description of Artificial Sequence: Synthetic oligonucleotide
cgggacgcttacgacggcaaggattac

SEQ ID NO: 17218 - DNA, 29 bp, Artificial Sequence
  Description of Artificial Sequence: Synthetic oligonucleotide
gggacgcttacgacggcaaggattacatc

SEQ ID NO: 17219 - DNA, 32 bp, Artificial Sequence
  Description of Artificial Sequence: Synthetic oligonucleotide
ttacgacggcaaggattacatcgccctgaaag

SEQ ID NO: 17220 - DNA, 27 bp, Artificial Sequence
  Description of Artificial Sequence: Synthetic oligonucleotide
cagatcacccagcgcaagtgggagact

SEQ ID NO: 17221 - DNA, 27 bp, Artificial Sequence
  Description of Artificial Sequence: Synthetic oligonucleotide
agatcacccagcgcaagtgggagactc

SEQ ID NO: 17222 - DNA, 26 bp, Artificial Sequence
  Description of Artificial Sequence: Synthetic oligonucleotide
gatcacccagcgcaagtgggagactc

SEQ ID NO: 17223 - DNA, 26 bp, Artificial Sequence
  Description of Artificial Sequence: Synthetic oligonucleotide
atcacccagcgcaagtgggagactcc

SEQ ID NO: 17224 - DNA, 25 bp, Artificial Sequence
  Description of Artificial Sequence: Synthetic oligonucleotide
tcacccagcgcaagtgggagactcc

SEQ ID NO: 17225 - DNA, 24 bp, Artificial Sequence
  Description of Artificial Sequence: Synthetic oligonucleotide
cacccagcgcaagtgggagactcc

SEQ ID NO: 17226 - DNA, 24 bp, Artificial Sequence
  Description of Artificial Sequence: Synthetic oligonucleotide
acccagcgcaagtgggagactccg

SEQ ID NO: 17227 - DNA, 23 bp, Artificial Sequence
  Description of Artificial Sequence: Synthetic oligonucleotide
cccagcgcaagtgggagactccg

SEQ ID NO: 17228 - DNA, 23 bp, Artificial Sequence
  Description of Artificial Sequence: Synthetic oligonucleotide
ccagcgcaagtgggagactccgc

SEQ ID NO: 17229 - DNA, 23 bp, Artificial Sequence
  Description of Artificial Sequence: Synthetic oligonucleotide
cagcgcaagtgggagactccgcc

SEQ ID NO: 17230 - DNA, 25 bp, Artificial Sequence
  Description of Artificial Sequence: Synthetic oligonucleotide
agcgcaagtgggagactccgcccat

SEQ ID NO: 17231 - DNA, 24 bp, Artificial Sequence
  Description of Artificial Sequence: Synthetic oligonucleotide
gcgcaagtgggagactccgcccat

SEQ ID NO: 17232 - DNA, 25 bp, Artificial Sequence
  Description of Artificial Sequence: Synthetic oligonucleotide
cgcaagtgggagactccgcccatga

SEQ ID NO: 17233 - DNA, 25 bp, Artificial Sequence
  Description of Artificial Sequence: Synthetic oligonucleotide
gcaagtgggagactccgcccatgag

SEQ ID NO: 17234 - DNA, 25 bp, Artificial Sequence
  Description of Artificial Sequence: Synthetic oligonucleotide
caagtgggagactccgcccatgagg

SEQ ID NO: 17235 - DNA, 25 bp, Artificial Sequence
  Description of Artificial Sequence: Synthetic oligonucleotide
aagtgggagactccgcccatgaggc

SEQ ID NO: 17236 - DNA, 24 bp, Artificial Sequence
  Description of Artificial Sequence: Synthetic oligonucleotide
agtgggagactccgcccatgaggc

SEQ ID NO: 17237 - DNA, 23 bp, Artificial Sequence
  Description of Artificial Sequence: Synthetic oligonucleotide
gtgggagactccgcccatgaggc

SEQ ID NO: 17238 - DNA, 23 bp, Artificial Sequence
  Description of Artificial Sequence: Synthetic oligonucleotide
tgggagactccgcccatgaggcg

SEQ ID NO: 17239 - DNA, 22 bp, Artificial Sequence
  Description of Artificial Sequence: Synthetic oligonucleotide
gggagactccgcccatgaggcg

SEQ ID NO: 17240 - DNA, 23 bp, Artificial Sequence
  Description of Artificial Sequence: Synthetic oligonucleotide
ggagactccgcccatgaggcgga

SEQ ID NO: 17241 - DNA, 23 bp, Artificial Sequence
  Description of Artificial Sequence: Synthetic oligonucleotide
gagactccgcccatgaggcggag

SEQ ID NO: 17242 - DNA, 24 bp, Artificial Sequence
  Description of Artificial Sequence: Synthetic oligonucleotide
agactccgcccatgaggcggagca

SEQ ID NO: 17243 - DNA, 23 bp, Artificial Sequence
  Description of Artificial Sequence: Synthetic oligonucleotide
gactccgcccatgaggcggagca

SEQ ID NO: 17244 - DNA, 24 bp, Artificial Sequence
  Description of Artificial Sequence: Synthetic oligonucleotide
actccgcccatgaggcggagcagt

SEQ ID NO: 17245 - DNA, 23 bp, Artificial Sequence
  Description of Artificial Sequence: Synthetic oligonucleotide
ctccgcccatgaggcggagcagt

SEQ ID NO: 17246 - DNA, 23 bp, Artificial Sequence
  Description of Artificial Sequence: Synthetic oligonucleotide
tccgcccatgaggcggagcagtg

SEQ ID NO: 17247 - DNA, 22 bp, Artificial Sequence
  Description of Artificial Sequence: Synthetic oligonucleotide
ccgcccatgaggcggagcagtg

SEQ ID NO: 17248 - DNA, 23 bp, Artificial Sequence
  Description of Artificial Sequence: Synthetic oligonucleotide
cgcccatgaggcggagcagtgga

SEQ ID NO: 17249 - DNA, 24 bp, Artificial Sequence
  Description of Artificial Sequence: Synthetic oligonucleotide
agacggcccatgtggcggagcagt

SEQ ID NO: 17250 - DNA, 23 bp, Artificial Sequence
  Description of Artificial Sequence: Synthetic oligonucleotide
gacggcccatgtggcggagcagt

SEQ ID NO: 17251 - DNA, 23 bp, Artificial Sequence
  Description of Artificial Sequence: Synthetic oligonucleotide
acggcccatgtggcggagcagtg

SEQ ID NO: 17252 - DNA, 26 bp, Artificial Sequence
  Description of Artificial Sequence: Synthetic oligonucleotide
tggacgacacgcagttcgtgcggttg

SEQ ID NO: 17253 - DNA, 25 bp, Artificial Sequence
  Description of Artificial Sequence: Synthetic oligonucleotide
ggacgacacgcagttcgtgcggttg

SEQ ID NO: 17254 - DNA, 26 bp, Artificial Sequence
  Description of Artificial Sequence: Synthetic oligonucleotide
gacgacacgcagttcgtgcggttgga

SEQ ID NO: 17255 - DNA, 27 bp, Artificial Sequence
  Description of Artificial Sequence: Synthetic oligonucleotide
acgacacgcagttcgtgcggttggaca

SEQ ID NO: 17256 - DNA, 26 bp, Artificial Sequence
  Description of Artificial Sequence: Synthetic oligonucleotide
cgacacgcagttcgtgcggttggaca

SEQ ID NO: 17257 - DNA, 26 bp, Artificial Sequence
  Description of Artificial Sequence: Synthetic oligonucleotide
gacacgcagttcgtgcggttggacag

SEQ ID NO: 17258 - DNA, 26 bp, Artificial Sequence
  Description of Artificial Sequence: Synthetic oligonucleotide
acacgcagttcgtgcggttggacagc

SEQ ID NO: 17259 - DNA, 25 bp, Artificial Sequence
  Description of Artificial Sequence: Synthetic oligonucleotide
cacgcagttcgtgcggttggacagc

SEQ ID NO: 17260 - DNA, 26 bp, Artificial Sequence
  Description of Artificial Sequence: Synthetic oligonucleotide
acgcagttcgtgcggttggacagcga

SEQ ID NO: 17261 - DNA, 25 bp, Artificial Sequence
  Description of Artificial Sequence: Synthetic oligonucleotide
cgcagttcgtgcggttggacagcga

SEQ ID NO: 17262 - DNA, 25 bp, Artificial Sequence
  Description of Artificial Sequence: Synthetic oligonucleotide
gcagttcgtgcggttggacagcgac

SEQ ID NO: 17263 - DNA, 25 bp, Artificial Sequence
  Description of Artificial Sequence: Synthetic oligonucleotide
cagttcgtgcggttggacagcgacg

SEQ ID NO: 17264 - DNA, 25 bp, Artificial Sequence
  Description of Artificial Sequence: Synthetic oligonucleotide
agttcgtgcggttggacagcgacgc

SEQ ID NO: 17265 - DNA, 24 bp, Artificial Sequence
  Description of Artificial Sequence: Synthetic oligonucleotide
gttcgtgcggttggacagcgacgc

SEQ ID NO: 17266 - DNA, 24 bp, Artificial Sequence
  Description of Artificial Sequence: Synthetic oligonucleotide
ttcgtgcggttggacagcgacgcc

SEQ ID NO: 17267 - DNA, 23 bp, Artificial Sequence
  Description of Artificial Sequence: Synthetic oligonucleotide
tcgtgcggttggacagcgacgcc

SEQ ID NO: 17268 - DNA, 22 bp, Artificial Sequence
  Description of Artificial Sequence: Synthetic oligonucleotide
cgtgcggttggacagcgacgcc

SEQ ID NO: 17269 - DNA, 22 bp, Artificial Sequence
  Description of Artificial Sequence: Synthetic oligonucleotide
gtgcggttggacagcgacgccg

SEQ ID NO: 17270 - DNA, 22 bp, Artificial Sequence
  Description of Artificial Sequence: Synthetic oligonucleotide
tgcggttggacagcgacgccgc

SEQ ID NO: 17271 - DNA, 21 bp, Artificial Sequence
  Description of Artificial Sequence: Synthetic oligonucleotide
gcggttggacagcgacgccgc

SEQ ID NO: 17272 - DNA, 22 bp, Artificial Sequence
  Description of Artificial Sequence: Synthetic oligonucleotide
cggttggacagcgacgccgcga

SEQ ID NO: 17273 - DNA, 22 bp, Artificial Sequence
  Description of Artificial Sequence: Synthetic oligonucleotide
ggttggacagcgacgccgcgag

SEQ ID NO: 17274 - DNA, 22 bp, Artificial Sequence
  Description of Artificial Sequence: Synthetic oligonucleotide
gttggacagcgacgccgcgagc

SEQ ID NO: 17275 - DNA, 23 bp, Artificial Sequence
  Description of Artificial Sequence: Synthetic oligonucleotide
ttggacagcgacgccgcgagcca

SEQ ID NO: 17276 - DNA, 22 bp, Artificial Sequence
  Description of Artificial Sequence: Synthetic oligonucleotide
tggacagcgacgccgcgagcca

SEQ ID NO: 17277 - DNA, 21 bp, Artificial Sequence
  Description of Artificial Sequence: Synthetic oligonucleotide
ggacagcgacgccgcgagcca

SEQ ID NO: 17278 - DNA, 28 bp, Artificial Sequence
  Description of Artificial Sequence: Synthetic oligonucleotide
gctactacaaccagagcgaggacggtac

SEQ ID NO: 17279 - DNA, 29 bp, Artificial Sequence
  Description of Artificial Sequence: Synthetic oligonucleotide
ctactacaaccagagcgaggacggtactc

SEQ ID NO: 17280 - DNA, 30 bp, Artificial Sequence
  Description of Artificial Sequence: Synthetic oligonucleotide
tactacaaccagagcgaggacggtactcac

SEQ ID NO: 17281 - DNA, 29 bp, Artificial Sequence
  Description of Artificial Sequence: Synthetic oligonucleotide
actacaaccagagcgaggacggtactcac

SEQ ID NO: 17282 - DNA, 28 bp, Artificial Sequence
  Description of Artificial Sequence: Synthetic oligonucleotide
ctacaaccagagcgaggacggtactcac

SEQ ID NO: 17283 - DNA, 29 bp, Artificial Sequence
  Description of Artificial Sequence: Synthetic oligonucleotide
tacaaccagagcgaggacggtactcacac

SEQ ID NO: 17284 - DNA, 28 bp, Artificial Sequence
  Description of Artificial Sequence: Synthetic oligonucleotide
acaaccagagcgaggacggtactcacac

SEQ ID NO: 17285 - DNA, 27 bp, Artificial Sequence
  Description of Artificial Sequence: Synthetic oligonucleotide
caaccagagcgaggacggtactcacac

SEQ ID NO: 17286 - DNA, 27 bp, Artificial Sequence
  Description of Artificial Sequence: Synthetic oligonucleotide
aaccagagcgaggacggtactcacacc

SEQ ID NO: 17287 - DNA, 27 bp, Artificial Sequence
  Description of Artificial Sequence: Synthetic oligonucleotide
accagagcgaggacggtactcacacca

SEQ ID NO: 17288 - DNA, 27 bp, Artificial Sequence
  Description of Artificial Sequence: Synthetic oligonucleotide
ccagagcgaggacggtactcacaccat

SEQ ID NO: 17289 - DNA, 27 bp, Artificial Sequence
  Description of Artificial Sequence: Synthetic oligonucleotide
cagagcgaggacggtactcacaccatc

SEQ ID NO: 17290 - DNA, 27 bp, Artificial Sequence
  Description of Artificial Sequence: Synthetic oligonucleotide
agagcgaggacggtactcacaccatcc

SEQ ID NO: 17291 - DNA, 27 bp, Artificial Sequence
  Description of Artificial Sequence: Synthetic oligonucleotide
gagcgaggacggtactcacaccatcca

SEQ ID NO: 17292 - DNA, 27 bp, Artificial Sequence
  Description of Artificial Sequence: Synthetic oligonucleotide
agcgaggacggtactcacaccatccag

SEQ ID NO: 17293 - DNA, 27 bp, Artificial Sequence
  Description of Artificial Sequence: Synthetic oligonucleotide
gcgaggacggtactcacaccatccaga

SEQ ID NO: 17294 - DNA, 27 bp, Artificial Sequence
  Description of Artificial Sequence: Synthetic oligonucleotide
cgaggacggtactcacaccatccagag

SEQ ID NO: 17295 - DNA, 27 bp, Artificial Sequence
  Description of Artificial Sequence: Synthetic oligonucleotide
gaggacggtactcacaccatccagagg

SEQ ID NO: 17296 - DNA, 29 bp, Artificial Sequence
  Description of Artificial Sequence: Synthetic oligonucleotide
aggacggtactcacaccatccagaggatg

SEQ ID NO: 17297 - DNA, 28 bp, Artificial Sequence
  Description of Artificial Sequence: Synthetic oligonucleotide
ggacggtactcacaccatccagaggatg

SEQ ID NO: 17298 - DNA, 31 bp, Artificial Sequence
  Description of Artificial Sequence: Synthetic oligonucleotide
gacggtactcacaccatccagaggatgtatg

SEQ ID NO: 17299 - DNA, 31 bp, Artificial Sequence
  Description of Artificial Sequence: Synthetic oligonucleotide
acggtactcacaccatccagaggatgtatgg

SEQ ID NO: 17300 - DNA, 30 bp, Artificial Sequence
  Description of Artificial Sequence: Synthetic oligonucleotide
cggtactcacaccatccagaggatgtatgg

SEQ ID NO: 17301 - DNA, 30 bp, Artificial Sequence
  Description of Artificial Sequence: Synthetic oligonucleotide
ggtactcacaccatccagaggatgtatggc

SEQ ID NO: 17302 - DNA, 31 bp, Artificial Sequence
  Description of Artificial Sequence: Synthetic oligonucleotide
gtactcacaccatccagaggatgtatggctg

SEQ ID NO: 17303 - DNA, 31 bp, Artificial Sequence
  Description of Artificial Sequence: Synthetic oligonucleotide
tactcacaccatccagaggatgtatggctgc

SEQ ID NO: 17304 - DNA, 30 bp, Artificial Sequence
  Description of Artificial Sequence: Synthetic oligonucleotide
actcacaccatccagaggatgtatggctgc

SEQ ID NO: 17305 - DNA, 27 bp, Artificial Sequence
  Description of Artificial Sequence: Synthetic oligonucleotide
cgtggagtggctccgcagatacctgaa

SEQ ID NO: 17306 - DNA, 27 bp, Artificial Sequence
  Description of Artificial Sequence: Synthetic oligonucleotide
gtggagtggctccgcagatacctgaag

SEQ ID NO: 17307 - DNA, 29 bp, Artificial Sequence
  Description of Artificial Sequence: Synthetic oligonucleotide
tggagtggctccgcagatacctgaagaac

SEQ ID NO: 17308 - DNA, 28 bp, Artificial Sequence
  Description of Artificial Sequence: Synthetic oligonucleotide
ggagtggctccgcagatacctgaagaac

SEQ ID NO: 17309 - DNA, 28 bp, Artificial Sequence
  Description of Artificial Sequence: Synthetic oligonucleotide
gagtggctccgcagatacctgaagaacg

SEQ ID NO: 17310 - DNA, 28 bp, Artificial Sequence
  Description of Artificial Sequence: Synthetic oligonucleotide
agtggctccgcagatacctgaagaacgg

SEQ ID NO: 17311 - DNA, 27 bp, Artificial Sequence
  Description of Artificial Sequence: Synthetic oligonucleotide
gtggctccgcagatacctgaagaacgg

SEQ ID NO: 17312 - DNA, 27 bp, Artificial Sequence
  Description of Artificial Sequence: Synthetic oligonucleotide
tggctccgcagatacctgaagaacggg

SEQ ID NO: 17313 - DNA, 27 bp, Artificial Sequence
  Description of Artificial Sequence: Synthetic oligonucleotide
ggctccgcagatacctgaagaacggga

SEQ ID NO: 17314 - DNA, 28 bp, Artificial Sequence
  Description of Artificial Sequence: Synthetic oligonucleotide
gctccgcagatacctgaagaacgggaag

SEQ ID NO: 17315 - DNA, 28 bp, Artificial Sequence
  Description of Artificial Sequence: Synthetic oligonucleotide
ctccgcagatacctgaagaacgggaagg

SEQ ID NO: 17316 - DNA, 29 bp, Artificial Sequence
  Description of Artificial Sequence: Synthetic oligonucleotide
tccgcagatacctgaagaacgggaaggag

SEQ ID NO: 17317 - DNA, 28 bp, Artificial Sequence
  Description of Artificial Sequence: Synthetic oligonucleotide
ccgcagatacctgaagaacgggaaggag

SEQ ID NO: 17318 - DNA, 29 bp, Artificial Sequence
  Description of Artificial Sequence: Synthetic oligonucleotide
cgcagatacctgaagaacgggaaggagac

SEQ ID NO: 17319 - DNA, 29 bp, Artificial Sequence
  Description of Artificial Sequence: Synthetic oligonucleotide
gcagatacctgaagaacgggaaggagacg

SEQ ID NO: 17320 - DNA, 29 bp, Artificial Sequence
  Description of Artificial Sequence: Synthetic oligonucleotide
cagatacctgaagaacgggaaggagacgc

SEQ ID NO: 17321 - DNA, 30 bp, Artificial Sequence
  Description of Artificial Sequence: Synthetic oligonucleotide
agatacctgaagaacgggaaggagacgctg

SEQ ID NO: 17322 - DNA, 29 bp, Artificial Sequence
  Description of Artificial Sequence: Synthetic oligonucleotide
gatacctgaagaacgggaaggagacgctg

SEQ ID NO: 17323 - DNA, 29 bp, Artificial Sequence
  Description of Artificial Sequence: Synthetic oligonucleotide
atacctgaagaacgggaaggagacgctgc

SEQ ID NO: 17324 - DNA, 28 bp, Artificial Sequence
  Description of Artificial Sequence: Synthetic oligonucleotide
tacctgaagaacgggaaggagacgctgc

SEQ ID NO: 17325 - DNA, 27 bp, Artificial Sequence
  Description of Artificial Sequence: Synthetic oligonucleotide
acctgaagaacgggaaggagacgctgc

SEQ ID NO: 17326 - DNA, 27 bp, Artificial Sequence
  Description of Artificial Sequence: Synthetic oligonucleotide
cctgaagaacgggaaggagacgctgca

SEQ ID NO: 17327 - DNA, 27 bp, Artificial Sequence
  Description of Artificial Sequence: Synthetic oligonucleotide
ctgaagaacgggaaggagacgctgcag

SEQ ID NO: 17328 - DNA, 27 bp, Artificial Sequence
  Description of Artificial Sequence: Synthetic oligonucleotide
tgaagaacgggaaggagacgctgcagc

SEQ ID NO: 17329 - DNA, 26 bp, Artificial Sequence
  Description of Artificial Sequence: Synthetic oligonucleotide
gaagaacgggaaggagacgctgcagc

SEQ ID NO: 17330 - DNA, 26 bp, Artificial Sequence
  Description of Artificial Sequence: Synthetic oligonucleotide
aagaacgggaaggagacgctgcagcg

SEQ ID NO: 17331 - DNA, 21 bp, Artificial Sequence
  Description of Artificial Sequence: Synthetic oligonucleotide
ctgcgacgtggggccggacga

SEQ ID NO: 17332 - DNA, 21 bp, Artificial Sequence
  Description of Artificial Sequence: Synthetic oligonucleotide
tgcgacgtggggccggacgag

SEQ ID NO: 17333 - DNA, 20 bp, Artificial Sequence
  Description of Artificial Sequence: Synthetic oligonucleotide
gcgacgtggggccggacgag

SEQ ID NO: 17334 - DNA, 20 bp, Artificial Sequence
  Description of Artificial Sequence: Synthetic oligonucleotide
cgacgtggggccggacgagc

SEQ ID NO: 17335 - DNA, 20 bp, Artificial Sequence
  Description of Artificial Sequence: Synthetic oligonucleotide
gacgtggggccggacgagcg

SEQ ID NO: 17336 - DNA, 22 bp, Artificial Sequence
  Description of Artificial Sequence: Synthetic oligonucleotide
acgtggggccggacgagcgctt

SEQ ID NO: 17337 - DNA, 21 bp, Artificial Sequence
  Description of Artificial Sequence: Synthetic oligonucleotide
cgtggggccggacgagcgctt

SEQ ID NO: 17338 - DNA, 21 bp, Artificial Sequence
  Description of Artificial Sequence: Synthetic oligonucleotide
gtggggccggacgagcgcttc

SEQ ID NO: 17339 - DNA, 22 bp, Artificial Sequence
  Description of Artificial Sequence: Synthetic oligonucleotide
tggggccggacgagcgcttcct

SEQ ID NO: 17340 - DNA, 21 bp, Artificial Sequence
  Description of Artificial Sequence: Synthetic oligonucleotide
ggggccggacgagcgcttcct

SEQ ID NO: 17341 - DNA, 21 bp, Artificial Sequence
  Description of Artificial Sequence: Synthetic oligonucleotide
gggccggacgagcgcttcctc

SEQ ID NO: 17342 - DNA, 21 bp, Artificial Sequence
  Description of Artificial Sequence: Synthetic oligonucleotide
ggccggacgagcgcttcctcc

SEQ ID NO: 17343 - DNA, 21 bp, Artificial Sequence
  Description of Artificial Sequence: Synthetic oligonucleotide
gccggacgagcgcttcctccg

SEQ ID NO: 17344 - DNA, 21 bp, Artificial Sequence
  Description of Artificial Sequence: Synthetic oligonucleotide
ccggacgagcgcttcctccgc

SEQ ID NO: 17345 - DNA, 21 bp, Artificial Sequence
  Description of Artificial Sequence: Synthetic oligonucleotide
cggacgagcgcttcctccgcg

SEQ ID NO: 17346 - DNA, 21 bp, Artificial Sequence
  Description of Artificial Sequence: Synthetic oligonucleotide
ggacgagcgcttcctccgcgg

SEQ ID NO: 17347 - DNA, 23 bp, Artificial Sequence
  Description of Artificial Sequence: Synthetic oligonucleotide
gacgagcgcttcctccgcgggta

SEQ ID NO: 17348 - DNA, 23 bp, Artificial Sequence
  Description of Artificial Sequence: Synthetic oligonucleotide
acgagcgcttcctccgcgggtac

SEQ ID NO: 17349 - DNA, 22 bp, Artificial Sequence
  Description of Artificial Sequence: Synthetic oligonucleotide
cgagcgcttcctccgcgggtac

SEQ ID NO: 17350 - DNA, 23 bp, Artificial Sequence
  Description of Artificial Sequence: Synthetic oligonucleotide
gagcgcttcctccgcgggtacca

SEQ ID NO: 17351 - DNA, 23 bp, Artificial Sequence
  Description of Artificial Sequence: Synthetic oligonucleotide
agcgcttcctccgcgggtaccag

SEQ ID NO: 17352 - DNA, 26 bp, Artificial Sequence
  Description of Artificial Sequence: Synthetic oligonucleotide
ccggaacacacggaatgtgaaggccc

SEQ ID NO: 17353 - DNA, 27 bp, Artificial Sequence
  Description of Artificial Sequence: Synthetic oligonucleotide
cggaacacacggaatgtgaaggcccca

SEQ ID NO: 17354 - DNA, 27 bp, Artificial Sequence
  Description of Artificial Sequence: Synthetic oligonucleotide
ggaacacacggaatgtgaaggccccac

SEQ ID NO: 17355 - DNA, 28 bp, Artificial Sequence
  Description of Artificial Sequence: Synthetic oligonucleotide
gaacacacggaatgtgaaggccccactc

SEQ ID NO: 17356 - DNA, 29 bp, Artificial Sequence
  Description of Artificial Sequence: Synthetic oligonucleotide
aacacacggaatgtgaaggccccactcac

SEQ ID NO: 17357 - DNA, 28 bp, Artificial Sequence
  Description of Artificial Sequence: Synthetic oligonucleotide
acacacggaatgtgaaggccccactcac

SEQ ID NO: 17358 - DNA, 27 bp, Artificial Sequence
  Description of Artificial Sequence: Synthetic oligonucleotide
cacacggaatgtgaaggccccactcac

SEQ ID NO: 17359 - DNA, 28 bp, Artificial Sequence
  Description of Artificial Sequence: Synthetic oligonucleotide
acacggaatgtgaaggccccactcacag

SEQ ID NO: 17360 - DNA, 27 bp, Artificial Sequence
  Description of Artificial Sequence: Synthetic oligonucleotide
cacggaatgtgaaggccccactcacag

SEQ ID NO: 17361 - DNA, 28 bp, Artificial Sequence
  Description of Artificial Sequence: Synthetic oligonucleotide
acggaatgtgaaggccccactcacagac

SEQ ID NO: 17362 - DNA, 27 bp, Artificial Sequence
  Description of Artificial Sequence: Synthetic oligonucleotide
cggaatgtgaaggccccactcacagac

SEQ ID NO: 17363 - DNA, 28 bp, Artificial Sequence
  Description of Artificial Sequence: Synthetic oligonucleotide
ggaatgtgaaggccccactcacagactg

SEQ ID NO: 17364 - DNA, 29 bp, Artificial Sequence
  Description of Artificial Sequence: Synthetic oligonucleotide
gaatgtgaaggccccactcacagactgac

SEQ ID NO: 17365 - DNA, 29 bp, Artificial Sequence
  Description of Artificial Sequence: Synthetic oligonucleotide
aatgtgaaggccccactcacagactgacc

SEQ ID NO: 17366 - DNA, 28 bp, Artificial Sequence
  Description of Artificial Sequence: Synthetic oligonucleotide
atgtgaaggccccactcacagactgacc

SEQ ID NO: 17367 - DNA, 27 bp, Artificial Sequence
  Description of Artificial Sequence: Synthetic oligonucleotide
tgtgaaggccccactcacagactgacc

SEQ ID NO: 17368 - DNA, 26 bp, Artificial Sequence
  Description of Artificial Sequence: Synthetic oligonucleotide
gtgaaggccccactcacagactgacc

SEQ ID NO: 17369 - DNA, 27 bp, Artificial Sequence
  Description of Artificial Sequence: Synthetic oligonucleotide
tgaaggccccactcacagactgaccga

SEQ ID NO: 17370 - DNA, 26 bp, Artificial Sequence
  Description of Artificial Sequence: Synthetic oligonucleotide
gaaggccccactcacagactgaccga

SEQ ID NO: 17371 - DNA, 26 bp, Artificial Sequence
  Description of Artificial Sequence: Synthetic oligonucleotide
aaggccccactcacagactgaccgag

SEQ ID NO: 17372 - DNA, 25 bp, Artificial Sequence
  Description of Artificial Sequence: Synthetic oligonucleotide
aggccccactcacagactgaccgag

SEQ ID NO: 17373 - DNA, 24 bp, Artificial Sequence
  Description of Artificial Sequence: Synthetic oligonucleotide
ggccccactcacagactgaccgag

SEQ ID NO: 17374 - DNA, 24 bp, Artificial Sequence
  Description of Artificial Sequence: Synthetic oligonucleotide
gccccactcacagactgaccgagc

SEQ ID NO: 17375 - DNA, 26 bp, Artificial Sequence
  Description of Artificial Sequence: Synthetic oligonucleotide
ccccactcacagactgaccgagcgaa

SEQ ID NO: 17376 - DNA, 26 bp, Artificial Sequence
  Description of Artificial Sequence: Synthetic oligonucleotide
acacggagctcgtggagaccaggctt

SEQ ID NO: 17377 - DNA, 25 bp, Artificial Sequence
  Description of Artificial Sequence: Synthetic oligonucleotide
cacggagctcgtggagaccaggctt

SEQ ID NO: 17378 - DNA, 25 bp, Artificial Sequence
  Description of Artificial Sequence: Synthetic oligonucleotide
acggagctcgtggagaccaggcttg

SEQ ID NO: 17379 - DNA, 24 bp, Artificial Sequence
  Description of Artificial Sequence: Synthetic oligonucleotide
cggagctcgtggagaccaggcttg

SEQ ID NO: 17380 - DNA, 25 bp, Artificial Sequence
  Description of Artificial Sequence: Synthetic oligonucleotide
ggagctcgtggagaccaggcttgca

SEQ ID NO: 17381 - DNA, 25 bp, Artificial Sequence
  Description of Artificial Sequence: Synthetic oligonucleotide
gagctcgtggagaccaggcttgcag

SEQ ID NO: 17382 - DNA, 25 bp, Artificial Sequence
  Description of Artificial Sequence: Synthetic oligonucleotide
agctcgtggagaccaggcttgcagg

SEQ ID NO: 17383 - DNA, 24 bp, Artificial Sequence
  Description of Artificial Sequence: Synthetic oligonucleotide
gctcgtggagaccaggcttgcagg

SEQ ID NO: 17384 - DNA, 24 bp, Artificial Sequence
  Description of Artificial Sequence: Synthetic oligonucleotide
ctcgtggagaccaggcttgcaggg

SEQ ID NO: 17385 - DNA, 26 bp, Artificial Sequence
  Description of Artificial Sequence: Synthetic oligonucleotide
tcgtggagaccaggcttgcaggggat

SEQ ID NO: 17386 - DNA, 25 bp, Artificial Sequence
  Description of Artificial Sequence: Synthetic oligonucleotide
cgtggagaccaggcttgcaggggat

SEQ ID NO: 17387 - DNA, 25 bp, Artificial Sequence
  Description of Artificial Sequence: Synthetic oligonucleotide
gtggagaccaggcttgcaggggatg

SEQ ID NO: 17388 - DNA, 25 bp, Artificial Sequence
  Description of Artificial Sequence: Synthetic oligonucleotide
tggagaccaggcttgcaggggatgg

SEQ ID NO: 17389 - DNA, 24 bp, Artificial Sequence
  Description of Artificial Sequence: Synthetic oligonucleotide
ggagaccaggcttgcaggggatgg

SEQ ID NO: 17390 - DNA, 25 bp, Artificial Sequence
  Description of Artificial Sequence: Synthetic oligonucleotide
gagaccaggcttgcaggggatggga

SEQ ID NO: 17391 - DNA, 25 bp, Artificial Sequence
  Description of Artificial Sequence: Synthetic oligonucleotide
agaccaggcttgcaggggatgggac

SEQ ID NO: 17392 - DNA, 24 bp, Artificial Sequence
  Description of Artificial Sequence: Synthetic oligonucleotide
gaccaggcttgcaggggatgggac

SEQ ID NO: 17393 - DNA, 26 bp, Artificial Sequence
  Description of Artificial Sequence: Synthetic oligonucleotide
accaggcttgcaggggatgggacctt

SEQ ID NO: 17394 - DNA, 25 bp, Artificial Sequence
  Description of Artificial Sequence: Synthetic oligonucleotide
ccaggcttgcaggggatgggacctt

SEQ ID NO: 17395 - DNA, 25 bp, Artificial Sequence
  Description of Artificial Sequence: Synthetic oligonucleotide
caggcttgcaggggatgggaccttc

SEQ ID NO: 17396 - DNA, 26 bp, Artificial Sequence
  Description of Artificial Sequence: Synthetic oligonucleotide
aggcttgcaggggatgggaccttcca

SEQ ID NO: 17397 - DNA, 25 bp, Artificial Sequence
  Description of Artificial Sequence: Synthetic oligonucleotide
ggcttgcaggggatgggaccttcca

SEQ ID NO: 17398 - DNA, 27 bp, Artificial Sequence
  Description of Artificial Sequence: Synthetic oligonucleotide
gcttgcaggggatgggaccttccagaa

SEQ ID NO: 17399 - DNA, 27 bp, Artificial Sequence
  Description of Artificial Sequence: Synthetic oligonucleotide
cttgcaggggatgggaccttccagaag

SEQ ID NO: 17400 - DNA, 28 bp, Artificial Sequence
  Description of Artificial Sequence: Synthetic oligonucleotide
ttgcaggggatgggaccttccagaagtg

SEQ ID NO: 17401 - DNA, 25 bp, Artificial Sequence
  Description of Artificial Sequence: Synthetic oligonucleotide
ggcccatgaggcggagcagtggaaa

SEQ ID NO: 17402 - DNA, 25 bp, Artificial Sequence
  Description of Artificial Sequence: Synthetic oligonucleotide
gcccatgaggcggagcagtggaaag

SEQ ID NO: 17403 - DNA, 25 bp, Artificial Sequence
  Description of Artificial Sequence: Synthetic oligonucleotide
cccatgaggcggagcagtggaaagc

SEQ ID NO: 17404 - DNA, 27 bp, Artificial Sequence
  Description of Artificial Sequence: Synthetic oligonucleotide
ccatgaggcggagcagtggaaagccta

SEQ ID NO: 17405 - DNA, 27 bp, Artificial Sequence
  Description of Artificial Sequence: Synthetic oligonucleotide
catgaggcggagcagtggaaagcctac

SEQ ID NO: 17406 - DNA, 27 bp, Artificial Sequence
  Description of Artificial Sequence: Synthetic oligonucleotide
atgaggcggagcagtggaaagcctacc

SEQ ID NO: 17407 - DNA, 27 bp, Artificial Sequence
  Description of Artificial Sequence: Synthetic oligonucleotide
tgaggcggagcagtggaaagcctacct

SEQ ID NO: 17408 - DNA, 26 bp, Artificial Sequence
  Description of Artificial Sequence: Synthetic oligonucleotide
gaggcggagcagtggaaagcctacct

SEQ ID NO: 17409 - DNA, 26 bp, Artificial Sequence
  Description of Artificial Sequence: Synthetic oligonucleotide
aggcggagcagtggaaagcctacctg

SEQ ID NO: 17410 - DNA, 25 bp, Artificial Sequence
  Description of Artificial Sequence: Synthetic oligonucleotide
ggcggagcagtggaaagcctacctg

SEQ ID NO: 17411 - DNA, 26 bp, Artificial Sequence
  Description of Artificial Sequence: Synthetic oligonucleotide
gcggagcagtggaaagcctacctgga

SEQ ID NO: 17412 - DNA, 26 bp, Artificial Sequence
  Description of Artificial Sequence: Synthetic oligonucleotide
cggagcagtggaaagcctacctggag

SEQ ID NO: 17413 - DNA, 26 bp, Artificial Sequence
  Description of Artificial Sequence: Synthetic oligonucleotide
ggagcagtggaaagcctacctggagg

SEQ ID NO: 17414 - DNA, 26 bp, Artificial Sequence
  Description of Artificial Sequence: Synthetic oligonucleotide
gagcagtggaaagcctacctggaggg

SEQ ID NO: 17415 - DNA, 26 bp, Artificial Sequence
  Description of Artificial Sequence: Synthetic oligonucleotide
agcagtggaaagcctacctggagggc

SEQ ID NO: 17416 - DNA, 25 bp, Artificial Sequence
  Description of Artificial Sequence: Synthetic oligonucleotide
gcagtggaaagcctacctggagggc

SEQ ID NO: 17417 - DNA, 25 bp, Artificial Sequence
  Description of Artificial Sequence: Synthetic oligonucleotide
cagtggaaagcctacctggagggcc

SEQ ID NO: 17418 - DNA, 25 bp, Artificial Sequence
  Description of Artificial Sequence: Synthetic oligonucleotide
agtggaaagcctacctggagggccg

SEQ ID NO: 17419 - DNA, 24 bp, Artificial Sequence
  Description of Artificial Sequence: Synthetic oligonucleotide
gtggaaagcctacctggagggccg

SEQ ID NO: 17420 - DNA, 25 bp, Artificial Sequence
  Description of Artificial Sequence: Synthetic oligonucleotide
tggaaagcctacctggagggccggt

SEQ ID NO: 17421 - DNA, 24 bp, Artificial Sequence
  Description of Artificial Sequence: Synthetic oligonucleotide
ggaaagcctacctggagggccggt

SEQ ID NO: 17422 - DNA, 24 bp, Artificial Sequence
  Description of Artificial Sequence: Synthetic oligonucleotide
gaaagcctacctggagggccggtg

SEQ ID NO: 17423 - DNA, 24 bp, Artificial Sequence
  Description of Artificial Sequence: Synthetic oligonucleotide
aaagcctacctggagggccggtgc

SEQ ID NO: 17424 - DNA, 23 bp, Artificial Sequence
  Description of Artificial Sequence: Synthetic oligonucleotide
aagcctacctggagggccggtgc

SEQ ID NO: 17425 - DNA, 21 bp, Artificial Sequence
  Description of Artificial Sequence: Synthetic oligonucleotide
cggcccgtgaggcggagcagt

SEQ ID NO: 17426 - DNA, 21 bp, Artificial Sequence
  Description of Artificial Sequence: Synthetic oligonucleotide
ggcccgtgaggcggagcagtg

SEQ ID NO: 17427 - DNA, 22 bp, Artificial Sequence
  Description of Artificial Sequence: Synthetic oligonucleotide
gcccgtgaggcggagcagtgga

SEQ ID NO: 17428 - DNA, 23 bp, Artificial Sequence
  Description of Artificial Sequence: Synthetic oligonucleotide
cccgtgaggcggagcagtggaga

SEQ ID NO: 17429 - DNA, 23 bp, Artificial Sequence
  Description of Artificial Sequence: Synthetic oligonucleotide
ccgtgaggcggagcagtggagag

SEQ ID NO: 17430 - DNA, 23 bp, Artificial Sequence
  Description of Artificial Sequence: Synthetic oligonucleotide
cgtgaggcggagcagtggagagc

SEQ ID NO: 17431 - DNA, 25 bp, Artificial Sequence
  Description of Artificial Sequence: Synthetic oligonucleotide
gtgaggcggagcagtggagagccta

SEQ ID NO: 17432 - DNA, 25 bp, Artificial Sequence
  Description of Artificial Sequence: Synthetic oligonucleotide
aggggccggagtattgggacccgaa

SEQ ID NO: 17433 - DNA, 24 bp, Artificial Sequence
  Description of Artificial Sequence: Synthetic oligonucleotide
ggggccggagtattgggacccgaa

SEQ ID NO: 17434 - DNA, 25 bp, Artificial Sequence
  Description of Artificial Sequence: Synthetic oligonucleotide
gggccggagtattgggacccgaaca

SEQ ID NO: 17435 - DNA, 26 bp, Artificial Sequence
  Description of Artificial Sequence: Synthetic oligonucleotide
ggccggagtattgggacccgaacaca

SEQ ID NO: 17436 - DNA, 26 bp, Artificial Sequence
  Description of Artificial Sequence: Synthetic oligonucleotide
gccggagtattgggacccgaacacac

SEQ ID NO: 17437 - DNA, 26 bp, Artificial Sequence
  Description of Artificial Sequence: Synthetic oligonucleotide
ccggagtattgggacccgaacacacg

SEQ ID NO: 17438 - DNA, 27 bp, Artificial Sequence
  Description of Artificial Sequence: Synthetic oligonucleotide
cggagtattgggacccgaacacacgga

SEQ ID NO: 17439 - DNA, 29 bp, Artificial Sequence
  Description of Artificial Sequence: Synthetic oligonucleotide
ggagtattgggacccgaacacacggaatg

SEQ ID NO: 17440 - DNA, 30 bp, Artificial Sequence
  Description of Artificial Sequence: Synthetic oligonucleotide
gagtattgggacccgaacacacggaatgtg

SEQ ID NO: 17441 - DNA, 32 bp, Artificial Sequence
  Description of Artificial Sequence: Synthetic oligonucleotide
agtattgggacccgaacacacggaatgtgaag

SEQ ID NO: 17442 - DNA, 31 bp, Artificial Sequence
  Description of Artificial Sequence: Synthetic oligonucleotide
gtattgggacccgaacacacggaatgtgaag

SEQ ID NO: 17443 - DNA, 31 bp, Artificial Sequence
  Description of Artificial Sequence: Synthetic oligonucleotide
tattgggacccgaacacacggaatgtgaagg

SEQ ID NO: 17444 - DNA, 30 bp, Artificial Sequence
  Description of Artificial Sequence: Synthetic oligonucleotide
attgggacccgaacacacggaatgtgaagg

SEQ ID NO: 17445 - DNA, 29 bp, Artificial Sequence
  Description of Artificial Sequence: Synthetic oligonucleotide
ttgggacccgaacacacggaatgtgaagg

SEQ ID NO: 17446 - DNA, 28 bp, Artificial Sequence
  Description of Artificial Sequence: Synthetic oligonucleotide
tgggacccgaacacacggaatgtgaagg

SEQ ID NO: 17447 - DNA, 27 bp, Artificial Sequence
  Description of Artificial Sequence: Synthetic oligonucleotide
gggacccgaacacacggaatgtgaagg

SEQ ID NO: 17448 - DNA, 27 bp, Artificial Sequence
  Description of Artificial Sequence: Synthetic oligonucleotide
ggacccgaacacacggaatgtgaaggc

SEQ ID NO: 17449 - DNA, 27 bp, Artificial Sequence
  Description of Artificial Sequence: Synthetic oligonucleotide
gacccgaacacacggaatgtgaaggcc

SEQ ID NO: 17450 - DNA, 27 bp, Artificial Sequence
  Description of Artificial Sequence: Synthetic oligonucleotide
acccgaacacacggaatgtgaaggccc

SEQ ID NO: 17451 - DNA, 27 bp, Artificial Sequence
  Description of Artificial Sequence: Synthetic oligonucleotide
cccgaacacacggaatgtgaaggccca

SEQ ID NO: 17452 - DNA, 27 bp, Artificial Sequence
  Description of Artificial Sequence: Synthetic oligonucleotide
ccgaacacacggaatgtgaaggcccac

SEQ ID NO: 17453 - DNA, 28 bp, Artificial Sequence
  Description of Artificial Sequence: Synthetic oligonucleotide
cgaacacacggaatgtgaaggcccactc

SEQ ID NO: 17454 - DNA, 27 bp, Artificial Sequence
  Description of Artificial Sequence: Synthetic oligonucleotide
cagagcgaggacggttctcacaccatg

SEQ ID NO: 17455 - DNA, 27 bp, Artificial Sequence
  Description of Artificial Sequence: Synthetic oligonucleotide
agagcgaggacggttctcacaccatgc

SEQ ID NO: 17456 - DNA, 27 bp, Artificial Sequence
  Description of Artificial Sequence: Synthetic oligonucleotide
gagcgaggacggttctcacaccatgca

SEQ ID NO: 17457 - DNA, 27 bp, Artificial Sequence
  Description of Artificial Sequence: Synthetic oligonucleotide
agcgaggacggttctcacaccatgcag

SEQ ID NO: 17458 - DNA, 26 bp, Artificial Sequence
  Description of Artificial Sequence: Synthetic oligonucleotide
gcgaggacggttctcacaccatgcag

SEQ ID NO: 17459 - DNA, 27 bp, Artificial Sequence
  Description of Artificial Sequence: Synthetic oligonucleotide
cgaggacggttctcacaccatgcaggt

SEQ ID NO: 17460 - DNA, 27 bp, Artificial Sequence
  Description of Artificial Sequence: Synthetic oligonucleotide
gaggacggttctcacaccatgcaggtg

SEQ ID NO: 17461 - DNA, 29 bp, Artificial Sequence
  Description of Artificial Sequence: Synthetic oligonucleotide
aggacggttctcacaccatgcaggtgatg

SEQ ID NO: 17462 - DNA, 28 bp, Artificial Sequence
  Description of Artificial Sequence: Synthetic oligonucleotide
ggacggttctcacaccatgcaggtgatg

SEQ ID NO: 17463 - DNA, 31 bp, Artificial Sequence
  Description of Artificial Sequence: Synthetic oligonucleotide
gacggttctcacaccatgcaggtgatgtatg

SEQ ID NO: 17464 - DNA, 31 bp, Artificial Sequence
  Description of Artificial Sequence: Synthetic oligonucleotide
acggttctcacaccatgcaggtgatgtatgg

SEQ ID NO: 17465 - DNA, 30 bp, Artificial Sequence
  Description of Artificial Sequence: Synthetic oligonucleotide
cggttctcacaccatgcaggtgatgtatgg

SEQ ID NO: 17466 - DNA, 30 bp, Artificial Sequence
  Description of Artificial Sequence: Synthetic oligonucleotide
ggttctcacaccatgcaggtgatgtatggc

SEQ ID NO: 17467 - DNA, 31 bp, Artificial Sequence
  Description of Artificial Sequence: Synthetic oligonucleotide
gttctcacaccatgcaggtgatgtatggctg

SEQ ID NO: 17468 - DNA, 31 bp, Artificial Sequence
  Description of Artificial Sequence: Synthetic oligonucleotide
ttctcacaccatgcaggtgatgtatggctgc

SEQ ID NO: 17469 - DNA, 30 bp, Artificial Sequence
  Description of Artificial Sequence: Synthetic oligonucleotide
tctcacaccatgcaggtgatgtatggctgc

SEQ ID NO: 17470 - DNA, 29 bp, Artificial Sequence
  Description of Artificial Sequence: Synthetic oligonucleotide
ctcacaccatgcaggtgatgtatggctgc

SEQ ID NO: 17471 - DNA, 29 bp, Artificial Sequence
  Description of Artificial Sequence: Synthetic oligonucleotide
tcacaccatgcaggtgatgtatggctgcg

SEQ ID NO: 17472 - DNA, 28 bp, Artificial Sequence
  Description of Artificial Sequence: Synthetic oligonucleotide
cacaccatgcaggtgatgtatggctgcg

SEQ ID NO: 17473 - DNA, 29 bp, Artificial Sequence
  Description of Artificial Sequence: Synthetic oligonucleotide
acaccatgcaggtgatgtatggctgcgac

SEQ ID NO: 17474 - DNA, 28 bp, Artificial Sequence
  Description of Artificial Sequence: Synthetic oligonucleotide
caccatgcaggtgatgtatggctgcgac

SEQ ID NO: 17475 - DNA, 28 bp, Artificial Sequence
  Description of Artificial Sequence: Synthetic oligonucleotide
accatgcaggtgatgtatggctgcgacg

SEQ ID NO: 17476 - DNA, 27 bp, Artificial Sequence
  Description of Artificial Sequence: Synthetic oligonucleotide
ccatgcaggtgatgtatggctgcgacg

SEQ ID NO: 17477 - DNA, 28 bp, Artificial Sequence
  Description of Artificial Sequence: Synthetic oligonucleotide
catgcaggtgatgtatggctgcgacgtg

SEQ ID NO: 17478 - DNA, 28 bp, Artificial Sequence
  Description of Artificial Sequence: Synthetic oligonucleotide
atgcaggtgatgtatggctgcgacgtgg

SEQ ID NO: 17479 - DNA, 27 bp, Artificial Sequence
  Description of Artificial Sequence: Synthetic oligonucleotide
tgcaggtgatgtatggctgcgacgtgg

SEQ ID NO: 17480 - DNA, 26 bp, Artificial Sequence
  Description of Artificial Sequence: Synthetic oligonucleotide
gcaggtgatgtatggctgcgacgtgg

SEQ ID NO: 17481 - DNA, 26 bp, Artificial Sequence
  Description of Artificial Sequence: Synthetic oligonucleotide
caggtgatgtatggctgcgacgtggg

SEQ ID NO: 17482 - DNA, 26 bp, Artificial Sequence
  Description of Artificial Sequence: Synthetic oligonucleotide
aggtgatgtatggctgcgacgtgggg

SEQ ID NO: 17483 - DNA, 25 bp, Artificial Sequence
  Description of Artificial Sequence: Synthetic oligonucleotide
ggtgatgtatggctgcgacgtgggg

SEQ ID NO: 17484 - DNA, 25 bp, Artificial Sequence
  Description of Artificial Sequence: Synthetic oligonucleotide
gtgatgtatggctgcgacgtggggc

SEQ ID NO: 17485 - DNA, 31 bp, Artificial Sequence
  Description of Artificial Sequence: Synthetic oligonucleotide
acacggaatgtgaaggcccagtcacagattc

SEQ ID NO: 17486 - DNA, 30 bp, Artificial Sequence
  Description of Artificial Sequence: Synthetic oligonucleotide
cacggaatgtgaaggcccagtcacagattc

SEQ ID NO: 17487 - DNA, 31 bp, Artificial Sequence
  Description of Artificial Sequence: Synthetic oligonucleotide
acggaatgtgaaggcccagtcacagattcac

SEQ ID NO: 17488 - DNA, 30 bp, Artificial Sequence
  Description of Artificial Sequence: Synthetic oligonucleotide
cggaatgtgaaggcccagtcacagattcac

SEQ ID NO: 17489 - DNA, 30 bp, Artificial Sequence
  Description of Artificial Sequence: Synthetic oligonucleotide
ggaatgtgaaggcccagtcacagattcacc

SEQ ID NO: 17490 - DNA, 30 bp, Artificial Sequence
  Description of Artificial Sequence: Synthetic oligonucleotide
gaatgtgaaggcccagtcacagattcaccg

SEQ ID NO: 17491 - DNA, 31 bp, Artificial Sequence
  Description of Artificial Sequence: Synthetic oligonucleotide
aatgtgaaggcccagtcacagattcaccgag

SEQ ID NO: 17492 - DNA, 30 bp, Artificial Sequence
  Description of Artificial Sequence: Synthetic oligonucleotide
atgtgaaggcccagtcacagattcaccgag

SEQ ID NO: 17493 - DNA, 29 bp, Artificial Sequence
  Description of Artificial Sequence: Synthetic oligonucleotide
tgtgaaggcccagtcacagattcaccgag

SEQ ID NO: 17494 - DNA, 28 bp, Artificial Sequence
  Description of Artificial Sequence: Synthetic oligonucleotide
gtgaaggcccagtcacagattcaccgag

SEQ ID NO: 17495 - DNA, 28 bp, Artificial Sequence
  Description of Artificial Sequence: Synthetic oligonucleotide
tgaaggcccagtcacagattcaccgagc

SEQ ID NO: 17496 - DNA, 27 bp, Artificial Sequence
  Description of Artificial Sequence: Synthetic oligonucleotide
gaaggcccagtcacagattcaccgagc

SEQ ID NO: 17497 - DNA, 27 bp, Artificial Sequence
  Description of Artificial Sequence: Synthetic oligonucleotide
aaggcccagtcacagattcaccgagcg

SEQ ID NO: 17498 - DNA, 27 bp, Artificial Sequence
  Description of Artificial Sequence: Synthetic oligonucleotide
aggcccagtcacagattcaccgagcga

SEQ ID NO: 17499 - DNA, 27 bp, Artificial Sequence
  Description of Artificial Sequence: Synthetic oligonucleotide
ggcccagtcacagattcaccgagcgaa

SEQ ID NO: 17500 - DNA, 27 bp, Artificial Sequence
  Description of Artificial Sequence: Synthetic oligonucleotide
gcccagtcacagattcaccgagcgaac

SEQ ID NO: 17501 - DNA, 27 bp, Artificial Sequence
  Description of Artificial Sequence: Synthetic oligonucleotide
cccagtcacagattcaccgagcgaacc

SEQ ID NO: 17502 - DNA, 28 bp, Artificial Sequence
  Description of Artificial Sequence: Synthetic oligonucleotide
ccagtcacagattcaccgagcgaacctg

SEQ ID NO: 17503 - DNA, 28 bp, Artificial Sequence
  Description of Artificial Sequence: Synthetic oligonucleotide
cagtcacagattcaccgagcgaacctgg

SEQ ID NO: 17504 - DNA, 28 bp, Artificial Sequence
  Description of Artificial Sequence: Synthetic oligonucleotide
agtcacagattcaccgagcgaacctggg

SEQ ID NO: 17505 - DNA, 27 bp, Artificial Sequence
  Description of Artificial Sequence: Synthetic oligonucleotide
gtcacagattcaccgagcgaacctggg

SEQ ID NO: 17506 - DNA, 27 bp, Artificial Sequence
  Description of Artificial Sequence: Synthetic oligonucleotide
tcacagattcaccgagcgaacctgggg

SEQ ID NO: 17507 - DNA, 27 bp, Artificial Sequence
  Description of Artificial Sequence: Synthetic oligonucleotide
cacagattcaccgagcgaacctgggga

SEQ ID NO: 17508 - DNA, 27 bp, Artificial Sequence
  Description of Artificial Sequence: Synthetic oligonucleotide
acagattcaccgagcgaacctggggac

SEQ ID NO: 17509 - DNA, 26 bp, Artificial Sequence
  Description of Artificial Sequence: Synthetic oligonucleotide
cagattcaccgagcgaacctggggac

SEQ ID NO: 17510 - DNA, 26 bp, Artificial Sequence
  Description of Artificial Sequence: Synthetic oligonucleotide
agattcaccgagcgaacctggggacc

SEQ ID NO: 17511 - DNA, 25 bp, Artificial Sequence
  Description of Artificial Sequence: Synthetic oligonucleotide
gattcaccgagcgaacctggggacc

SEQ ID NO: 17512 - DNA, 26 bp, Artificial Sequence
  Description of Artificial Sequence: Synthetic oligonucleotide
attcaccgagcgaacctggggaccct

SEQ ID NO: 17513 - DNA, 25 bp, Artificial Sequence
  Description of Artificial Sequence: Synthetic oligonucleotide
ttcaccgagcgaacctggggaccct

SEQ ID NO: 17514 - DNA, 24 bp, Artificial Sequence
  Description of Artificial Sequence: Synthetic oligonucleotide
tcaccgagcgaacctggggaccct

SEQ ID NO: 17515 - DNA, 23 bp, Artificial Sequence
  Description of Artificial Sequence: Synthetic oligonucleotide
caccgagcgaacctggggaccct

SEQ ID NO: 17516 - DNA, 25 bp, Artificial Sequence
  Description of Artificial Sequence: Synthetic oligonucleotide
cagtggagagcctacctggagggct

SEQ ID NO: 17517 - DNA, 25 bp, Artificial Sequence
  Description of Artificial Sequence: Synthetic oligonucleotide
agtggagagcctacctggagggctg

SEQ ID NO: 17518 - DNA, 24 bp, Artificial Sequence
  Description of Artificial Sequence: Synthetic oligonucleotide
gtggagagcctacctggagggctg

SEQ ID NO: 17519 - DNA, 25 bp, Artificial Sequence
  Description of Artificial Sequence: Synthetic oligonucleotide
tggagagcctacctggagggctggt

SEQ ID NO: 17520 - DNA, 24 bp, Artificial Sequence
  Description of Artificial Sequence: Synthetic oligonucleotide
ggagagcctacctggagggctggt

SEQ ID NO: 17521 - DNA, 24 bp, Artificial Sequence
  Description of Artificial Sequence: Synthetic oligonucleotide
gagagcctacctggagggctggtg

SEQ ID NO: 17522 - DNA, 24 bp, Artificial Sequence
  Description of Artificial Sequence: Synthetic oligonucleotide
agagcctacctggagggctggtgc

SEQ ID NO: 17523 - DNA, 23 bp, Artificial Sequence
  Description of Artificial Sequence: Synthetic oligonucleotide
gagcctacctggagggctggtgc

SEQ ID NO: 17524 - DNA, 24 bp, Artificial Sequence
  Description of Artificial Sequence: Synthetic oligonucleotide
agcctacctggagggctggtgcgt

SEQ ID NO: 17525 - DNA, 23 bp, Artificial Sequence
  Description of Artificial Sequence: Synthetic oligonucleotide
gcctacctggagggctggtgcgt

SEQ ID NO: 17526 - DNA, 23 bp, Artificial Sequence
  Description of Artificial Sequence: Synthetic oligonucleotide
cctacctggagggctggtgcgtg

SEQ ID NO: 17527 - DNA, 25 bp, Artificial Sequence
  Description of Artificial Sequence: Synthetic oligonucleotide
tacctggagggctggtgcgtggagt

SEQ ID NO: 17528 - DNA, 24 bp, Artificial Sequence
  Description of Artificial Sequence: Synthetic oligonucleotide
acctggagggctggtgcgtggagt

SEQ ID NO: 17529 - DNA, 23 bp, Artificial Sequence
  Description of Artificial Sequence: Synthetic oligonucleotide
cctggagggctggtgcgtggagt

SEQ ID NO: 17530 - DNA, 23 bp, Artificial Sequence
  Description of Artificial Sequence: Synthetic oligonucleotide
ctggagggctggtgcgtggagtg

SEQ ID NO: 17531 - DNA, 23 bp, Artificial Sequence
  Description of Artificial Sequence: Synthetic oligonucleotide
tggagggctggtgcgtggagtgg

SEQ ID NO: 17532 - DNA, 22 bp, Artificial Sequence
  Description of Artificial Sequence: Synthetic oligonucleotide
ggagggctggtgcgtggagtgg

SEQ ID NO: 17533 - DNA, 23 bp, Artificial Sequence
  Description of Artificial Sequence: Synthetic oligonucleotide
gagggctggtgcgtggagtggct

SEQ ID NO: 17534 - DNA, 23 bp, Artificial Sequence
  Description of Artificial Sequence: Synthetic oligonucleotide
agggctggtgcgtggagtggctc

SEQ ID NO: 17535 - DNA, 22 bp, Artificial Sequence
  Description of Artificial Sequence: Synthetic oligonucleotide
gggctggtgcgtggagtggctc

SEQ ID NO: 17536 - DNA, 22 bp, Artificial Sequence
  Description of Artificial Sequence: Synthetic oligonucleotide
ggctggtgcgtggagtggctcc

SEQ ID NO: 17537 - DNA, 22 bp, Artificial Sequence
  Description of Artificial Sequence: Synthetic oligonucleotide
gctggtgcgtggagtggctccg

SEQ ID NO: 17538 - DNA, 23 bp, Artificial Sequence
  Description of Artificial Sequence: Synthetic oligonucleotide
ctggtgcgtggagtggctccgca

SEQ ID NO: 17539 - DNA, 26 bp, Artificial Sequence
  Description of Artificial Sequence: Synthetic oligonucleotide
tggtgcgtggagtggctccgcagata

SEQ ID NO: 17540 - DNA, 31 bp, Artificial Sequence
  Description of Artificial Sequence: Synthetic oligonucleotide
gctcccactccatgaggtatttctacaccac

SEQ ID NO: 17541 - DNA, 31 bp, Artificial Sequence
  Description of Artificial Sequence: Synthetic oligonucleotide
ctcccactccatgaggtatttctacaccacc

SEQ ID NO: 17542 - DNA, 33 bp, Artificial Sequence
  Description of Artificial Sequence: Synthetic oligonucleotide
tcccactccatgaggtatttctacaccaccatg

SEQ ID NO: 17543 - DNA, 32 bp, Artificial Sequence
  Description of Artificial Sequence: Synthetic oligonucleotide
cccactccatgaggtatttctacaccaccatg

SEQ ID NO: 17544 - DNA, 33 bp, Artificial Sequence
  Description of Artificial Sequence: Synthetic oligonucleotide
ccactccatgaggtatttctacaccaccatgtc

SEQ ID NO: 17545 - DNA, 33 bp, Artificial Sequence
  Description of Artificial Sequence: Synthetic oligonucleotide
cactccatgaggtatttctacaccaccatgtcc

SEQ ID NO: 17546 - DNA, 33 bp, Artificial Sequence
  Description of Artificial Sequence: Synthetic oligonucleotide
actccatgaggtatttctacaccaccatgtccc

SEQ ID NO: 17547 - DNA, 32 bp, Artificial Sequence
  Description of Artificial Sequence: Synthetic oligonucleotide
ctccatgaggtatttctacaccaccatgtccc

SEQ ID NO: 17548 - DNA, 32 bp, Artificial Sequence
  Description of Artificial Sequence: Synthetic oligonucleotide
tccatgaggtatttctacaccaccatgtcccg

SEQ ID NO: 17549 - DNA, 31 bp, Artificial Sequence
  Description of Artificial Sequence: Synthetic oligonucleotide
ccatgaggtatttctacaccaccatgtcccg

SEQ ID NO: 17550 - DNA, 31 bp, Artificial Sequence
  Description of Artificial Sequence: Synthetic oligonucleotide
catgaggtatttctacaccaccatgtcccgg

SEQ ID NO: 17551 - DNA, 31 bp, Artificial Sequence
  Description of Artificial Sequence: Synthetic oligonucleotide
atgaggtatttctacaccaccatgtcccggc

SEQ ID NO: 17552 - DNA, 30 bp, Artificial Sequence
  Description of Artificial Sequence: Synthetic oligonucleotide
tgaggtatttctacaccaccatgtcccggc

SEQ ID NO: 17553 - DNA, 29 bp, Artificial Sequence
  Description of Artificial Sequence: Synthetic oligonucleotide
gaggtatttctacaccaccatgtcccggc

SEQ ID NO: 17554 - DNA, 29 bp, Artificial Sequence
  Description of Artificial Sequence: Synthetic oligonucleotide
aggtatttctacaccaccatgtcccggcc

SEQ ID NO: 17555 - DNA, 28 bp, Artificial Sequence
  Description of Artificial Sequence: Synthetic oligonucleotide
ggtatttctacaccaccatgtcccggcc

SEQ ID NO: 17556 - DNA, 28 bp, Artificial Sequence
  Description of Artificial Sequence: Synthetic oligonucleotide
gtatttctacaccaccatgtcccggccc

SEQ ID NO: 17557 - DNA, 28 bp, Artificial Sequence
  Description of Artificial Sequence: Synthetic oligonucleotide
tatttctacaccaccatgtcccggcccg

SEQ ID NO: 17558 - DNA, 27 bp, Artificial Sequence
  Description of Artificial Sequence: Synthetic oligonucleotide
atttctacaccaccatgtcccggcccg

SEQ ID NO: 17559 - DNA, 26 bp, Artificial Sequence
  Description of Artificial Sequence: Synthetic oligonucleotide
tttctacaccaccatgtcccggcccg

SEQ ID NO: 17560 - DNA, 25 bp, Artificial Sequence
  Description of Artificial Sequence: Synthetic oligonucleotide
ttctacaccaccatgtcccggcccg

SEQ ID NO: 17561 - DNA, 24 bp, Artificial Sequence
  Description of Artificial Sequence: Synthetic oligonucleotide
tctacaccaccatgtcccggcccg

SEQ ID NO: 17562 - DNA, 23 bp, Artificial Sequence
  Description of Artificial Sequence: Synthetic oligonucleotide
ctacaccaccatgtcccggcccg

SEQ ID NO: 17563 - DNA, 23 bp, Artificial Sequence
  Description of Artificial Sequence: Synthetic oligonucleotide
tacaccaccatgtcccggcccgg

SEQ ID NO: 17564 - DNA, 22 bp, Artificial Sequence
  Description of Artificial Sequence: Synthetic oligonucleotide
acaccaccatgtcccggcccgg

SEQ ID NO: 17565 - DNA, 21 bp, Artificial Sequence
  Description of Artificial Sequence: Synthetic oligonucleotide
caccaccatgtcccggcccgg

SEQ ID NO: 17566 - DNA, 21 bp, Artificial Sequence
  Description of Artificial Sequence: Synthetic oligonucleotide
accaccatgtcccggcccggc

SEQ ID NO: 17567 - DNA, 20 bp, Artificial Sequence
  Description of Artificial Sequence: Synthetic oligonucleotide
ccaccatgtcccggcccggc

SEQ ID NO: 17568 - DNA, 20 bp, Artificial Sequence
  Description of Artificial Sequence: Synthetic oligonucleotide
caccatgtcccggcccggcc

SEQ ID NO: 17569 - DNA, 20 bp, Artificial Sequence
  Description of Artificial Sequence: Synthetic oligonucleotide
accatgtcccggcccggccg

SEQ ID NO: 17570 - DNA, 26 bp, Artificial Sequence
  Description of Artificial Sequence: Synthetic oligonucleotide
gaaggcccactcacagactcaccgag

SEQ ID NO: 17571 - DNA, 26 bp, Artificial Sequence
  Description of Artificial Sequence: Synthetic oligonucleotide
aaggcccactcacagactcaccgagc

SEQ ID NO: 17572 - DNA, 25 bp, Artificial Sequence
  Description of Artificial Sequence: Synthetic oligonucleotide
aggcccactcacagactcaccgagc

SEQ ID NO: 17573 - DNA, 24 bp, Artificial Sequence
  Description of Artificial Sequence: Synthetic oligonucleotide
ggcccactcacagactcaccgagc

SEQ ID NO: 17574 - DNA, 26 bp, Artificial Sequence
  Description of Artificial Sequence: Synthetic oligonucleotide
gcccactcacagactcaccgagcgaa

SEQ ID NO: 17575 - DNA, 26 bp, Artificial Sequence
  Description of Artificial Sequence: Synthetic oligonucleotide
cccactcacagactcaccgagcgaac

SEQ ID NO: 17576 - DNA, 27 bp, Artificial Sequence
  Description of Artificial Sequence: Synthetic oligonucleotide
ccactcacagactcaccgagcgaacct

SEQ ID NO: 17577 - DNA, 27 bp, Artificial Sequence
  Description of Artificial Sequence: Synthetic oligonucleotide
cactcacagactcaccgagcgaacctg

SEQ ID NO: 17578 - DNA, 27 bp, Artificial Sequence
  Description of Artificial Sequence: Synthetic oligonucleotide
actcacagactcaccgagcgaacctgg

SEQ ID NO: 17579 - DNA, 26 bp, Artificial Sequence
  Description of Artificial Sequence: Synthetic oligonucleotide
ctcacagactcaccgagcgaacctgg

SEQ ID NO: 17580 - DNA, 26 bp, Artificial Sequence
  Description of Artificial Sequence: Synthetic oligonucleotide
tcacagactcaccgagcgaacctggg

SEQ ID NO: 17581 - DNA, 25 bp, Artificial Sequence
  Description of Artificial Sequence: Synthetic oligonucleotide
cacagactcaccgagcgaacctggg

SEQ ID NO: 17582 - DNA, 26 bp, Artificial Sequence
  Description of Artificial Sequence: Synthetic oligonucleotide
acagactcaccgagcgaacctgggga

SEQ ID NO: 17583 - DNA, 25 bp, Artificial Sequence
  Description of Artificial Sequence: Synthetic oligonucleotide
cagactcaccgagcgaacctgggga

SEQ ID NO: 17584 - DNA, 25 bp, Artificial Sequence
  Description of Artificial Sequence: Synthetic oligonucleotide
agactcaccgagcgaacctggggac

SEQ ID NO: 17585 - DNA, 24 bp, Artificial Sequence
  Description of Artificial Sequence: Synthetic oligonucleotide
gactcaccgagcgaacctggggac

SEQ ID NO: 17586 - DNA, 24 bp, Artificial Sequence
  Description of Artificial Sequence: Synthetic oligonucleotide
actcaccgagcgaacctggggacc

SEQ ID NO: 17587 - DNA, 23 bp, Artificial Sequence
  Description of Artificial Sequence: Synthetic oligonucleotide
ctcaccgagcgaacctggggacc

SEQ ID NO: 17588 - DNA, 26 bp, Artificial Sequence
  Description of Artificial Sequence: Synthetic oligonucleotide
acacgcagttcgtgcggttcgacagg

SEQ ID NO: 17589 - DNA, 25 bp, Artificial Sequence
  Description of Artificial Sequence: Synthetic oligonucleotide
cacgcagttcgtgcggttcgacagg

SEQ ID NO: 17590 - DNA, 26 bp, Artificial Sequence
  Description of Artificial Sequence: Synthetic oligonucleotide
acgcagttcgtgcggttcgacaggga

SEQ ID NO: 17591 - DNA, 25 bp, Artificial Sequence
  Description of Artificial Sequence: Synthetic oligonucleotide
cgcagttcgtgcggttcgacaggga

SEQ ID NO: 17592 - DNA, 25 bp, Artificial Sequence
  Description of Artificial Sequence: Synthetic oligonucleotide
gcagttcgtgcggttcgacagggac

SEQ ID NO: 17593 - DNA, 25 bp, Artificial Sequence
  Description of Artificial Sequence: Synthetic oligonucleotide
cagttcgtgcggttcgacagggacg

SEQ ID NO: 17594 - DNA, 25 bp, Artificial Sequence
  Description of Artificial Sequence: Synthetic oligonucleotide
agttcgtgcggttcgacagggacgc

SEQ ID NO: 17595 - DNA, 24 bp, Artificial Sequence
  Description of Artificial Sequence: Synthetic oligonucleotide
gttcgtgcggttcgacagggacgc

SEQ ID NO: 17596 - DNA, 24 bp, Artificial Sequence
  Description of Artificial Sequence: Synthetic oligonucleotide
ttcgtgcggttcgacagggacgcc

SEQ ID NO: 17597 - DNA, 23 bp, Artificial Sequence
  Description of Artificial Sequence: Synthetic oligonucleotide
tcgtgcggttcgacagggacgcc

SEQ ID NO: 17598 - DNA, 22 bp, Artificial Sequence
  Description of Artificial Sequence: Synthetic oligonucleotide
cgtgcggttcgacagggacgcc

SEQ ID NO: 17599 - DNA, 22 bp, Artificial Sequence
  Description of Artificial Sequence: Synthetic oligonucleotide
gtgcggttcgacagggacgccg

SEQ ID NO: 17600 - DNA, 22 bp, Artificial Sequence
  Description of Artificial Sequence: Synthetic oligonucleotide
tgcggttcgacagggacgccgc

SEQ ID NO: 17601 - DNA, 21 bp, Artificial Sequence
  Description of Artificial Sequence: Synthetic oligonucleotide
gcggttcgacagggacgccgc

SEQ ID NO: 17602 - DNA, 22 bp, Artificial Sequence
  Description of Artificial Sequence: Synthetic oligonucleotide
cggttcgacagggacgccgcga

SEQ ID NO: 17603 - DNA, 22 bp, Artificial Sequence
  Description of Artificial Sequence: Synthetic oligonucleotide
ggttcgacagggacgccgcgag

SEQ ID NO: 17604 - DNA, 22 bp, Artificial Sequence
  Description of Artificial Sequence: Synthetic oligonucleotide
gttcgacagggacgccgcgagc

SEQ ID NO: 17605 - DNA, 23 bp, Artificial Sequence
  Description of Artificial Sequence: Synthetic oligonucleotide
ttcgacagggacgccgcgagcca

SEQ ID NO: 17606 - DNA, 22 bp, Artificial Sequence
  Description of Artificial Sequence: Synthetic oligonucleotide
tcgacagggacgccgcgagcca

SEQ ID NO: 17607 - DNA, 21 bp, Artificial Sequence
  Description of Artificial Sequence: Synthetic oligonucleotide
cgacagggacgccgcgagcca

SEQ ID NO: 17608 - DNA, 22 bp, Artificial Sequence
  Description of Artificial Sequence: Synthetic oligonucleotide
gacagggacgccgcgagccaga

SEQ ID NO: 17609 - DNA, 22 bp, Artificial Sequence
  Description of Artificial Sequence: Synthetic oligonucleotide
acagggacgccgcgagccagag

SEQ ID NO: 17610 - DNA, 21 bp, Artificial Sequence
  Description of Artificial Sequence: Synthetic oligonucleotide
cagggacgccgcgagccagag

SEQ ID NO: 17611 - DNA, 23 bp, Artificial Sequence
  Description of Artificial Sequence: Synthetic oligonucleotide
agggacgccgcgagccagaggat

SEQ ID NO: 17612 - DNA, 22 bp, Artificial Sequence
  Description of Artificial Sequence: Synthetic oligonucleotide
gggacgccgcgagccagaggat

SEQ ID NO: 17613 - DNA, 22 bp, Artificial Sequence
  Description of Artificial Sequence: Synthetic oligonucleotide
ggacgccgcgagccagaggatg

SEQ ID NO: 17614 - DNA, 20 bp, Artificial Sequence
  Description of Artificial Sequence: Synthetic oligonucleotide
ctgcgacgtggggccggacc

SEQ ID NO: 17615 - DNA, 20 bp, Artificial Sequence
  Description of Artificial Sequence: Synthetic oligonucleotide
tgcgacgtggggccggaccg

SEQ ID NO: 17616 - DNA, 20 bp, Artificial Sequence
  Description of Artificial Sequence: Synthetic oligonucleotide
gcgacgtggggccggaccgt

SEQ ID NO: 17617 - DNA, 20 bp, Artificial Sequence
  Description of Artificial Sequence: Synthetic oligonucleotide
cgacgtggggccggaccggt

SEQ ID NO: 17618 - DNA, 20 bp, Artificial Sequence
  Description of Artificial Sequence: Synthetic oligonucleotide
gacgtggggccggaccggct

SEQ ID NO: 17619 - DNA, 20 bp, Artificial Sequence
  Description of Artificial Sequence: Synthetic oligonucleotide
acgtggggccggaccggcgt

SEQ ID NO: 17620 - DNA, 20 bp, Artificial Sequence
  Description of Artificial Sequence: Synthetic oligonucleotide
cgtggggccggaccggcgtt

SEQ ID NO: 17621 - DNA, 20 bp, Artificial Sequence
  Description of Artificial Sequence: Synthetic oligonucleotide
gtggggccggaccggcgctt

SEQ ID NO: 17622 - DNA, 20 bp, Artificial Sequence
  Description of Artificial Sequence: Synthetic oligonucleotide
tggggccggaccggcgcttc

SEQ ID NO: 17623 - DNA, 20 bp, Artificial Sequence
  Description of Artificial Sequence: Synthetic oligonucleotide
ggggccggaccggcgcttct

SEQ ID NO: 17624 - DNA, 20 bp, Artificial Sequence
  Description of Artificial Sequence: Synthetic oligonucleotide
gggccggaccggcgcttcct

SEQ ID NO: 17625 - DNA, 20 bp, Artificial Sequence
  Description of Artificial Sequence: Synthetic oligonucleotide
ggccggaccggcgcttcctc

SEQ ID NO: 17626 - DNA, 20 bp, Artificial Sequence
  Description of Artificial Sequence: Synthetic oligonucleotide
gccggaccggcgcttcctcc

SEQ ID NO: 17627 - DNA, 20 bp, Artificial Sequence
  Description of Artificial Sequence: Synthetic oligonucleotide
ccggaccggcgcttcctccg

SEQ ID NO: 17628 - DNA, 20 bp, Artificial Sequence
  Description of Artificial Sequence: Synthetic oligonucleotide
cggaccggcgcttcctccgc

SEQ ID NO: 17629 - DNA, 20 bp, Artificial Sequence
  Description of Artificial Sequence: Synthetic oligonucleotide
ggaccggcgcttcctccgcg

SEQ ID NO: 17630 - DNA, 20 bp, Artificial Sequence
  Description of Artificial Sequence: Synthetic oligonucleotide
gaccggcgcttcctccgcgg

SEQ ID NO: 17631 - DNA, 22 bp, Artificial Sequence
  Description of Artificial Sequence: Synthetic oligonucleotide
accggcgcttcctccgcgggta

SEQ ID NO: 17632 - DNA, 21 bp, Artificial Sequence
  Description of Artificial Sequence: Synthetic oligonucleotide
ccggcgcttcctccgcgggta

SEQ ID NO: 17633 - DNA, 21 bp, Artificial Sequence
  Description of Artificial Sequence: Synthetic oligonucleotide
cggcgcttcctccgcgggtac

SEQ ID NO: 17634 - DNA, 22 bp, Artificial Sequence
  Description of Artificial Sequence: Synthetic oligonucleotide
acgggcgcttcctccgcgggtt

SEQ ID NO: 17635 - DNA, 21 bp, Artificial Sequence
  Description of Artificial Sequence: Synthetic oligonucleotide
cgggcgcttcctccgcgggtt

SEQ ID NO: 17636 - DNA, 21 bp, Artificial Sequence
  Description of Artificial Sequence: Synthetic oligonucleotide
gggcgcttcctccgcgggttc

SEQ ID NO: 17637 - DNA, 22 bp, Artificial Sequence
  Description of Artificial Sequence: Synthetic oligonucleotide
ggcgcttcctccgcgggttcca

SEQ ID NO: 17638 - DNA, 22 bp, Artificial Sequence
  Description of Artificial Sequence: Synthetic oligonucleotide
gcgcttcctccgcgggttccag

SEQ ID NO: 17639 - DNA, 23 bp, Artificial Sequence
  Description of Artificial Sequence: Synthetic oligonucleotide
cgcttcctccgcgggttccagca

SEQ ID NO: 17640 - DNA, 23 bp, Artificial Sequence
  Description of Artificial Sequence: Synthetic oligonucleotide
gcttcctccgcgggttccagcag

SEQ ID NO: 17641 - DNA, 24 bp, Artificial Sequence
  Description of Artificial Sequence: Synthetic oligonucleotide
cttcctccgcgggttccagcagga

SEQ ID NO: 17642 - DNA, 24 bp, Artificial Sequence
  Description of Artificial Sequence: Synthetic oligonucleotide
ttcctccgcgggttccagcaggac

SEQ ID NO: 17643 - DNA, 23 bp, Artificial Sequence
  Description of Artificial Sequence: Synthetic oligonucleotide
tcctccgcgggttccagcaggac

SEQ ID NO: 17644 - DNA, 22 bp, Artificial Sequence
  Description of Artificial Sequence: Synthetic oligonucleotide
cctccgcgggttccagcaggac

SEQ ID NO: 17645 - DNA, 22 bp, Artificial Sequence
  Description of Artificial Sequence: Synthetic oligonucleotide
ctccgcgggttccagcaggacg

SEQ ID NO: 17646 - DNA, 25 bp, Artificial Sequence
  Description of Artificial Sequence: Synthetic oligonucleotide
tccgcgggttccagcaggacgctta

SEQ ID NO: 17647 - DNA, 24 bp, Artificial Sequence
  Description of Artificial Sequence: Synthetic oligonucleotide
ccgcgggttccagcaggacgctta

SEQ ID NO: 17648 - DNA, 24 bp, Artificial Sequence
  Description of Artificial Sequence: Synthetic oligonucleotide
cgcgggttccagcaggacgcttac

SEQ ID NO: 17649 - DNA, 25 bp, Artificial Sequence
  Description of Artificial Sequence: Synthetic oligonucleotide
gcgggttccagcaggacgcttacga

SEQ ID NO: 17650 - DNA, 25 bp, Artificial Sequence
  Description of Artificial Sequence: Synthetic oligonucleotide
cgggttccagcaggacgcttacgac

SEQ ID NO: 17651 - DNA, 25 bp, Artificial Sequence
  Description of Artificial Sequence: Synthetic oligonucleotide
gggttccagcaggacgcttacgacg

SEQ ID NO: 17652 - DNA, 25 bp, Artificial Sequence
  Description of Artificial Sequence: Synthetic oligonucleotide
ggttccagcaggacgcttacgacgg

SEQ ID NO: 17653 - DNA, 27 bp, Artificial Sequence
  Description of Artificial Sequence: Synthetic oligonucleotide
gttccagcaggacgcttacgacggcaa

SEQ ID NO: 17654 - DNA, 27 bp, Artificial Sequence
  Description of Artificial Sequence: Synthetic oligonucleotide
ttccagcaggacgcttacgacggcaag

SEQ ID NO: 17655 - DNA, 26 bp, Artificial Sequence
  Description of Artificial Sequence: Synthetic oligonucleotide
tccagcaggacgcttacgacggcaag

SEQ ID NO: 17656 - DNA, 20 bp, Artificial Sequence
  Description of Artificial Sequence: Synthetic oligonucleotide
gacgtggggccggacgggca

SEQ ID NO: 17657 - DNA, 22 bp, Artificial Sequence
  Description of Artificial Sequence: Synthetic oligonucleotide
acgtggggccggacgggcactt

SEQ ID NO: 17658 - DNA, 21 bp, Artificial Sequence
  Description of Artificial Sequence: Synthetic oligonucleotide
cgtggggccggacgggcactt

SEQ ID NO: 17659 - DNA, 21 bp, Artificial Sequence
  Description of Artificial Sequence: Synthetic oligonucleotide
gtggggccggacgggcacttc

SEQ ID NO: 17660 - DNA, 22 bp, Artificial Sequence
  Description of Artificial Sequence: Synthetic oligonucleotide
tggggccggacgggcacttcct

SEQ ID NO: 17661 - DNA, 21 bp, Artificial Sequence
  Description of Artificial Sequence: Synthetic oligonucleotide
ggggccggacgggcacttcct

SEQ ID NO: 17662 - DNA, 21 bp, Artificial Sequence
  Description of Artificial Sequence: Synthetic oligonucleotide
gggccggacgggcacttcctc

SEQ ID NO: 17663 - DNA, 21 bp, Artificial Sequence
  Description of Artificial Sequence: Synthetic oligonucleotide
ggccggacgggcacttcctcc

SEQ ID NO: 17664 - DNA, 21 bp, Artificial Sequence
  Description of Artificial Sequence: Synthetic oligonucleotide
gccggacgggcacttcctccg

SEQ ID NO: 17665 - DNA, 21 bp, Artificial Sequence
  Description of Artificial Sequence: Synthetic oligonucleotide
ccggacgggcacttcctccgc

SEQ ID NO: 17666 - DNA, 21 bp, Artificial Sequence
  Description of Artificial Sequence: Synthetic oligonucleotide
cggacgggcacttcctccgcg

SEQ ID NO: 17667 - DNA, 21 bp, Artificial Sequence
  Description of Artificial Sequence: Synthetic oligonucleotide
ggacgggcacttcctccgcgg

SEQ ID NO: 17668 - DNA, 23 bp, Artificial Sequence
  Description of Artificial Sequence: Synthetic oligonucleotide
gacgggcacttcctccgcgggta

SEQ ID NO: 17669 - DNA, 23 bp, Artificial Sequence
  Description of Artificial Sequence: Synthetic oligonucleotide
acgggcacttcctccgcgggtac

SEQ ID NO: 17670 - DNA, 22 bp, Artificial Sequence
  Description of Artificial Sequence: Synthetic oligonucleotide
cgggcacttcctccgcgggtac

SEQ ID NO: 17671 - DNA, 23 bp, Artificial Sequence
  Description of Artificial Sequence: Synthetic oligonucleotide
gggcacttcctccgcgggtacca

SEQ ID NO: 17672 - DNA, 23 bp, Artificial Sequence
  Description of Artificial Sequence: Synthetic oligonucleotide
ggcacttcctccgcgggtaccag

SEQ ID NO: 17673 - DNA, 24 bp, Artificial Sequence
  Description of Artificial Sequence: Synthetic oligonucleotide
gcacttcctccgcgggtaccagca

SEQ ID NO: 17674 - DNA, 24 bp, Artificial Sequence
  Description of Artificial Sequence: Synthetic oligonucleotide
cacttcctccgcgggtaccagcag

SEQ ID NO: 17675 - DNA, 25 bp, Artificial Sequence
  Description of Artificial Sequence: Synthetic oligonucleotide
acttcctccgcgggtaccagcagga

SEQ ID NO: 17676 - DNA, 25 bp, Artificial Sequence
  Description of Artificial Sequence: Synthetic oligonucleotide
agcgacgccgcgagccagaggattt

SEQ ID NO: 17677 - DNA, 24 bp, Artificial Sequence
  Description of Artificial Sequence: Synthetic oligonucleotide
gcgacgccgcgagccagaggattt

SEQ ID NO: 17678 - DNA, 24 bp, Artificial Sequence
  Description of Artificial Sequence: Synthetic oligonucleotide
cgacgccgcgagccagaggatttg

SEQ ID NO: 17679 - DNA, 24 bp, Artificial Sequence
  Description of Artificial Sequence: Synthetic oligonucleotide
gacgccgcgagccagaggatttgg

SEQ ID NO: 17680 - DNA, 24 bp, Artificial Sequence
  Description of Artificial Sequence: Synthetic oligonucleotide
acgccgcgagccagaggatttggc

SEQ ID NO: 17681 - DNA, 23 bp, Artificial Sequence
  Description of Artificial Sequence: Synthetic oligonucleotide
cgccgcgagccagaggatttggc

SEQ ID NO: 17682 - DNA, 23 bp, Artificial Sequence
  Description of Artificial Sequence: Synthetic oligonucleotide
gccgcgagccagaggatttggcc

SEQ ID NO: 17683 - DNA, 23 bp, Artificial Sequence
  Description of Artificial Sequence: Synthetic oligonucleotide
ccgcgagccagaggatttggccg

SEQ ID NO: 17684 - DNA, 23 bp, Artificial Sequence
  Description of Artificial Sequence: Synthetic oligonucleotide
cgcgagccagaggatttggccgc

SEQ ID NO: 17685 - DNA, 23 bp, Artificial Sequence
  Description of Artificial Sequence: Synthetic oligonucleotide
gcgagccagaggatttggccgcg

SEQ ID NO: 17686 - DNA, 23 bp, Artificial Sequence
  Description of Artificial Sequence: Synthetic oligonucleotide
cgagccagaggatttggccgcgg

SEQ ID NO: 17687 - DNA, 23 bp, Artificial Sequence
  Description of Artificial Sequence: Synthetic oligonucleotide
gagccagaggatttggccgcggg

SEQ ID NO: 17688 - DNA, 23 bp, Artificial Sequence
  Description of Artificial Sequence: Synthetic oligonucleotide
agccagaggatttggccgcgggc

SEQ ID NO: 17689 - DNA, 22 bp, Artificial Sequence
  Description of Artificial Sequence: Synthetic oligonucleotide
gccagaggatttggccgcgggc

SEQ ID NO: 17690 - DNA, 22 bp, Artificial Sequence
  Description of Artificial Sequence: Synthetic oligonucleotide
ccagaggatttggccgcgggcg

SEQ ID NO: 17691 - DNA, 22 bp, Artificial Sequence
  Description of Artificial Sequence: Synthetic oligonucleotide
cagaggatttggccgcgggcgc

SEQ ID NO: 17692 - DNA, 22 bp, Artificial Sequence
  Description of Artificial Sequence: Synthetic oligonucleotide
agaggatttggccgcgggcgcc

SEQ ID NO: 17693 - DNA, 21 bp, Artificial Sequence
  Description of Artificial Sequence: Synthetic oligonucleotide
gaggatttggccgcgggcgcc

SEQ ID NO: 17694 - DNA, 22 bp, Artificial Sequence
  Description of Artificial Sequence: Synthetic oligonucleotide
aggatttggccgcgggcgccgt

SEQ ID NO: 17695 - DNA, 21 bp, Artificial Sequence
  Description of Artificial Sequence: Synthetic oligonucleotide
ggatttggccgcgggcgccgt

SEQ ID NO: 17696 - DNA, 21 bp, Artificial Sequence
  Description of Artificial Sequence: Synthetic oligonucleotide
gatttggccgcgggcgccgtg

SEQ ID NO: 17697 - DNA, 24 bp, Artificial Sequence
  Description of Artificial Sequence: Synthetic oligonucleotide
atttggccgcgggcgccgtggata

SEQ ID NO: 17698 - DNA, 23 bp, Artificial Sequence
  Description of Artificial Sequence: Synthetic oligonucleotide
tttggccgcgggcgccgtggata

SEQ ID NO: 17699 - DNA, 22 bp, Artificial Sequence
  Description of Artificial Sequence: Synthetic oligonucleotide
ttggccgcgggcgccgtggata

SEQ ID NO: 17700 - DNA, 21 bp, Artificial Sequence
  Description of Artificial Sequence: Synthetic oligonucleotide
tggccgcgggcgccgtggata

SEQ ID NO: 17701 - DNA, 20 bp, Artificial Sequence
  Description of Artificial Sequence: Synthetic oligonucleotide
ggccgcgggcgccgtggata

SEQ ID NO: 17702 - DNA, 20 bp, Artificial Sequence
  Description of Artificial Sequence: Synthetic oligonucleotide
gcgggcgccgtggatggagc

SEQ ID NO: 17703 - DNA, 20 bp, Artificial Sequence
  Description of Artificial Sequence: Synthetic oligonucleotide
cgggcgccgtggatggagcg

SEQ ID NO: 17704 - DNA, 20 bp, Artificial Sequence
  Description of Artificial Sequence: Synthetic oligonucleotide
gggcgccgtggatggagcgg

SEQ ID NO: 17705 - DNA, 21 bp, Artificial Sequence
  Description of Artificial Sequence: Synthetic oligonucleotide
ggcgccgtggatggagcggga

SEQ ID NO: 17706 - DNA, 21 bp, Artificial Sequence
  Description of Artificial Sequence: Synthetic oligonucleotide
gcgccgtggatggagcgggag

SEQ ID NO: 17707 - DNA, 21 bp, Artificial Sequence
  Description of Artificial Sequence: Synthetic oligonucleotide
cgccgtggatggagcgggagg

SEQ ID NO: 17708 - DNA, 21 bp, Artificial Sequence
  Description of Artificial Sequence: Synthetic oligonucleotide
gccgtggatggagcgggaggg

SEQ ID NO: 17709 - DNA, 21 bp, Artificial Sequence
  Description of Artificial Sequence: Synthetic oligonucleotide
ccgtggatggagcgggagggg

SEQ ID NO: 17710 - DNA, 21 bp, Artificial Sequence
  Description of Artificial Sequence: Synthetic oligonucleotide
cgtggatggagcgggaggggc

SEQ ID NO: 17711 - DNA, 21 bp, Artificial Sequence
  Description of Artificial Sequence: Synthetic oligonucleotide
gtggatggagcgggaggggcc

SEQ ID NO: 17712 - DNA, 21 bp, Artificial Sequence
  Description of Artificial Sequence: Synthetic oligonucleotide
tggatggagcgggaggggccg

SEQ ID NO: 17713 - DNA, 20 bp, Artificial Sequence
  Description of Artificial Sequence: Synthetic oligonucleotide
ggatggagcgggaggggccg

SEQ ID NO: 17714 - DNA, 21 bp, Artificial Sequence
  Description of Artificial Sequence: Synthetic oligonucleotide
gatggagcgggaggggccgga

SEQ ID NO: 17715 - DNA, 25 bp, Artificial Sequence
  Description of Artificial Sequence: Synthetic oligonucleotide
atggagcgggaggggccggagtatt

SEQ ID NO: 17716 - DNA, 24 bp, Artificial Sequence
  Description of Artificial Sequence: Synthetic oligonucleotide
tggagcgggaggggccggagtatt

SEQ ID NO: 17717 - DNA, 23 bp, Artificial Sequence
  Description of Artificial Sequence: Synthetic oligonucleotide
ggagcgggaggggccggagtatt

SEQ ID NO: 17718 - DNA, 23 bp, Artificial Sequence
  Description of Artificial Sequence: Synthetic oligonucleotide
gagcgggaggggccggagtattg

SEQ ID NO: 17719 - DNA, 23 bp, Artificial Sequence
  Description of Artificial Sequence: Synthetic oligonucleotide
agcgggaggggccggagtattgg

SEQ ID NO: 17720 - DNA, 22 bp, Artificial Sequence
  Description of Artificial Sequence: Synthetic oligonucleotide
gcgggaggggccggagtattgg

SEQ ID NO: 17721 - DNA, 23 bp, Artificial Sequence
  Description of Artificial Sequence: Synthetic oligonucleotide
cgggaggggccggagtattggga

SEQ ID NO: 17722 - DNA, 23 bp, Artificial Sequence
  Description of Artificial Sequence: Synthetic oligonucleotide
gggaggggccggagtattgggac

SEQ ID NO: 17723 - DNA, 23 bp, Artificial Sequence
  Description of Artificial Sequence: Synthetic oligonucleotide
gcggcggacatggcggctcacat

SEQ ID NO: 17724 - DNA, 24 bp, Artificial Sequence
  Description of Artificial Sequence: Synthetic oligonucleotide
cggcggacatggcggctcacatca

SEQ ID NO: 17725 - DNA, 24 bp, Artificial Sequence
  Description of Artificial Sequence: Synthetic oligonucleotide
ggcggacatggcggctcacatcac

SEQ ID NO: 17726 - DNA, 24 bp, Artificial Sequence
  Description of Artificial Sequence: Synthetic oligonucleotide
gcggacatggcggctcacatcacc

SEQ ID NO: 17727 - DNA, 25 bp, Artificial Sequence
  Description of Artificial Sequence: Synthetic oligonucleotide
cggacatggcggctcacatcaccca

SEQ ID NO: 17728 - DNA, 25 bp, Artificial Sequence
  Description of Artificial Sequence: Synthetic oligonucleotide
ggacatggcggctcacatcacccag

SEQ ID NO: 17729 - DNA, 25 bp, Artificial Sequence
  Description of Artificial Sequence: Synthetic oligonucleotide
gacatggcggctcacatcacccagc

SEQ ID NO: 17730 - DNA, 25 bp, Artificial Sequence
  Description of Artificial Sequence: Synthetic oligonucleotide
acatggcggctcacatcacccagcg

SEQ ID NO: 17731 - DNA, 24 bp, Artificial Sequence
  Description of Artificial Sequence: Synthetic oligonucleotide
catggcggctcacatcacccagcg

SEQ ID NO: 17732 - DNA, 26 bp, Artificial Sequence
  Description of Artificial Sequence: Synthetic oligonucleotide
atggcggctcacatcacccagcgcaa

SEQ ID NO: 17733 - DNA, 25 bp, Artificial Sequence
  Description of Artificial Sequence: Synthetic oligonucleotide
tggcggctcacatcacccagcgcaa

SEQ ID NO: 17734 - DNA, 24 bp, Artificial Sequence
  Description of Artificial Sequence: Synthetic oligonucleotide
ggcggctcacatcacccagcgcaa

SEQ ID NO: 17735 - DNA, 25 bp, Artificial Sequence
  Description of Artificial Sequence: Synthetic oligonucleotide
gcggctcacatcacccagcgcaagt

SEQ ID NO: 17736 - DNA, 25 bp, Artificial Sequence
  Description of Artificial Sequence: Synthetic oligonucleotide
cggctcacatcacccagcgcaagtg

SEQ ID NO: 17737 - DNA, 25 bp, Artificial Sequence
  Description of Artificial Sequence: Synthetic oligonucleotide
ggctcacatcacccagcgcaagtgg

SEQ ID NO: 17738 - DNA, 26 bp, Artificial Sequence
  Description of Artificial Sequence: Synthetic oligonucleotide
gctcacatcacccagcgcaagtggga

SEQ ID NO: 17739 - DNA, 27 bp, Artificial Sequence
  Description of Artificial Sequence: Synthetic oligonucleotide
ctcacatcacccagcgcaagtgggaga

SEQ ID NO: 17740 - DNA, 27 bp, Artificial Sequence
  Description of Artificial Sequence: Synthetic oligonucleotide
tcacatcacccagcgcaagtgggagac

SEQ ID NO: 17741 - DNA, 26 bp, Artificial Sequence
  Description of Artificial Sequence: Synthetic oligonucleotide
cacatcacccagcgcaagtgggagac

SEQ ID NO: 17742 - DNA, 26 bp, Artificial Sequence
  Description of Artificial Sequence: Synthetic oligonucleotide
acatcacccagcgcaagtgggagacg

SEQ ID NO: 17743 - DNA, 25 bp, Artificial Sequence
  Description of Artificial Sequence: Synthetic oligonucleotide
catcacccagcgcaagtgggagacg

SEQ ID NO: 17744 - DNA, 29 bp, Artificial Sequence
  Description of Artificial Sequence: Synthetic oligonucleotide
ggagtattgggaccggaacacacggaaag

SEQ ID NO: 17745 - DNA, 30 bp, Artificial Sequence
  Description of Artificial Sequence: Synthetic oligonucleotide
gagtattgggaccggaacacacggaaagtg

SEQ ID NO: 17746 - DNA, 32 bp, Artificial Sequence
  Description of Artificial Sequence: Synthetic oligonucleotide
agtattgggaccggaacacacggaaagtgaag

SEQ ID NO: 17747 - DNA, 31 bp, Artificial Sequence
  Description of Artificial Sequence: Synthetic oligonucleotide
gtattgggaccggaacacacggaaagtgaag

SEQ ID NO: 17748 - DNA, 31 bp, Artificial Sequence
  Description of Artificial Sequence: Synthetic oligonucleotide
tattgggaccggaacacacggaaagtgaagg

SEQ ID NO: 17749 - DNA, 30 bp, Artificial Sequence
  Description of Artificial Sequence: Synthetic oligonucleotide
attgggaccggaacacacggaaagtgaagg

SEQ ID NO: 17750 - DNA, 29 bp, Artificial Sequence
  Description of Artificial Sequence: Synthetic oligonucleotide
ttgggaccggaacacacggaaagtgaagg

SEQ ID NO: 17751 - DNA, 28 bp, Artificial Sequence
  Description of Artificial Sequence: Synthetic oligonucleotide
tgggaccggaacacacggaaagtgaagg

SEQ ID NO: 17752 - DNA, 27 bp, Artificial Sequence
  Description of Artificial Sequence: Synthetic oligonucleotide
gggaccggaacacacggaaagtgaagg

SEQ ID NO: 17753 - DNA, 27 bp, Artificial Sequence
  Description of Artificial Sequence: Synthetic oligonucleotide
ggaccggaacacacggaaagtgaaggc

SEQ ID NO: 17754 - DNA, 27 bp, Artificial Sequence
  Description of Artificial Sequence: Synthetic oligonucleotide
gaccggaacacacggaaagtgaaggcc

SEQ ID NO: 17755 - DNA, 27 bp, Artificial Sequence
  Description of Artificial Sequence: Synthetic oligonucleotide
accggaacacacggaaagtgaaggccc

SEQ ID NO: 17756 - DNA, 27 bp, Artificial Sequence
  Description of Artificial Sequence: Synthetic oligonucleotide
ccggaacacacggaaagtgaaggccca

SEQ ID NO: 17757 - DNA, 27 bp, Artificial Sequence
  Description of Artificial Sequence: Synthetic oligonucleotide
cggaacacacggaaagtgaaggcccac

SEQ ID NO: 17758 - DNA, 28 bp, Artificial Sequence
  Description of Artificial Sequence: Synthetic oligonucleotide
ggaacacacggaaagtgaaggcccactc

SEQ ID NO: 17759 - DNA, 29 bp, Artificial Sequence
  Description of Artificial Sequence: Synthetic oligonucleotide
gaacacacggaaagtgaaggcccactcac

SEQ ID NO: 17760 - DNA, 30 bp, Artificial Sequence
  Description of Artificial Sequence: Synthetic oligonucleotide
aacacacggaaagtgaaggcccactcacag

SEQ ID NO: 17761 - DNA, 29 bp, Artificial Sequence
  Description of Artificial Sequence: Synthetic oligonucleotide
acacacggaaagtgaaggcccactcacag

SEQ ID NO: 17762 - DNA, 28 bp, Artificial Sequence
  Description of Artificial Sequence: Synthetic oligonucleotide
cacacggaaagtgaaggcccactcacag

SEQ ID NO: 17763 - DNA, 29 bp, Artificial Sequence
  Description of Artificial Sequence: Synthetic oligonucleotide
tacaaccagagcgaggacggttctcacag

SEQ ID NO: 17764 - DNA, 28 bp, Artificial Sequence
  Description of Artificial Sequence: Synthetic oligonucleotide
acaaccagagcgaggacggttctcacag

SEQ ID NO: 17765 - DNA, 27 bp, Artificial Sequence
  Description of Artificial Sequence: Synthetic oligonucleotide
caaccagagcgaggacggttctcacag

SEQ ID NO: 17766 - DNA, 27 bp, Artificial Sequence
  Description of Artificial Sequence: Synthetic oligonucleotide
aaccagagcgaggacggttctcacagc

SEQ ID NO: 17767 - DNA, 27 bp, Artificial Sequence
  Description of Artificial Sequence: Synthetic oligonucleotide
accagagcgaggacggttctcacagca

SEQ ID NO: 17768 - DNA, 27 bp, Artificial Sequence
  Description of Artificial Sequence: Synthetic oligonucleotide
ccagagcgaggacggttctcacagcat

SEQ ID NO: 17769 - DNA, 27 bp, Artificial Sequence
  Description of Artificial Sequence: Synthetic oligonucleotide
cagagcgaggacggttctcacagcatc

SEQ ID NO: 17770 - DNA, 27 bp, Artificial Sequence
  Description of Artificial Sequence: Synthetic oligonucleotide
agagcgaggacggttctcacagcatcc

SEQ ID NO: 17771 - DNA, 27 bp, Artificial Sequence
  Description of Artificial Sequence: Synthetic oligonucleotide
gagcgaggacggttctcacagcatcca

SEQ ID NO: 17772 - DNA, 27 bp, Artificial Sequence
  Description of Artificial Sequence: Synthetic oligonucleotide
agcgaggacggttctcacagcatccag

SEQ ID NO: 17773 - DNA, 27 bp, Artificial Sequence
  Description of Artificial Sequence: Synthetic oligonucleotide
gcgaggacggttctcacagcatccaga

SEQ ID NO: 17774 - DNA, 27 bp, Artificial Sequence
  Description of Artificial Sequence: Synthetic oligonucleotide
cgaggacggttctcacagcatccagag

SEQ ID NO: 17775 - DNA, 27 bp, Artificial Sequence
  Description of Artificial Sequence: Synthetic oligonucleotide
gaggacggttctcacagcatccagagg

SEQ ID NO: 17776 - DNA, 29 bp, Artificial Sequence
  Description of Artificial Sequence: Synthetic oligonucleotide
aggacggttctcacagcatccagaggatg

SEQ ID NO: 17777 - DNA, 28 bp, Artificial Sequence
  Description of Artificial Sequence: Synthetic oligonucleotide
ggacggttctcacagcatccagaggatg

SEQ ID NO: 17778 - DNA, 31 bp, Artificial Sequence
  Description of Artificial Sequence: Synthetic oligonucleotide
gacggttctcacagcatccagaggatgtatg

SEQ ID NO: 17779 - DNA, 31 bp, Artificial Sequence
  Description of Artificial Sequence: Synthetic oligonucleotide
acggttctcacagcatccagaggatgtatgg

SEQ ID NO: 17780 - DNA, 30 bp, Artificial Sequence
  Description of Artificial Sequence: Synthetic oligonucleotide
cggttctcacagcatccagaggatgtatgg

SEQ ID NO: 17781 - DNA, 30 bp, Artificial Sequence
  Description of Artificial Sequence: Synthetic oligonucleotide
ggttctcacagcatccagaggatgtatggc

SEQ ID NO: 17782 - DNA, 31 bp, Artificial Sequence
  Description of Artificial Sequence: Synthetic oligonucleotide
gttctcacagcatccagaggatgtatggctg

SEQ ID NO: 17783 - DNA, 31 bp, Artificial Sequence
  Description of Artificial Sequence: Synthetic oligonucleotide
ttctcacagcatccagaggatgtatggctgc

SEQ ID NO: 17784 - DNA, 30 bp, Artificial Sequence
  Description of Artificial Sequence: Synthetic oligonucleotide
tctcacagcatccagaggatgtatggctgc

SEQ ID NO: 17785 - DNA, 29 bp, Artificial Sequence
  Description of Artificial Sequence: Synthetic oligonucleotide
ctcacagcatccagaggatgtatggctgc

SEQ ID NO: 17786 - DNA, 29 bp, Artificial Sequence
  Description of Artificial Sequence: Synthetic oligonucleotide
tcacagcatccagaggatgtatggctgcg

SEQ ID NO: 17787 - DNA, 28 bp, Artificial Sequence
  Description of Artificial Sequence: Synthetic oligonucleotide
cacagcatccagaggatgtatggctgcg

SEQ ID NO: 17788 - DNA, 29 bp, Artificial Sequence
  Description of Artificial Sequence: Synthetic oligonucleotide
acagcatccagaggatgtatggctgcgac

SEQ ID NO: 17789 - DNA, 28 bp, Artificial Sequence
  Description of Artificial Sequence: Synthetic oligonucleotide
cagcatccagaggatgtatggctgcgac

SEQ ID NO: 17790 - DNA, 28 bp, Artificial Sequence
  Description of Artificial Sequence: Synthetic oligonucleotide
agcatccagaggatgtatggctgcgacg

SEQ ID NO: 17791 - DNA, 27 bp, Artificial Sequence
  Description of Artificial Sequence: Synthetic oligonucleotide
gcatccagaggatgtatggctgcgacg

SEQ ID NO: 17792 - DNA, 26 bp, Artificial Sequence
  Description of Artificial Sequence: Synthetic oligonucleotide
ccccgaaccctcctcctgctactctt

SEQ ID NO: 17793 - DNA, 26 bp, Artificial Sequence
  Description of Artificial Sequence: Synthetic oligonucleotide
cccgaaccctcctcctgctactcttg

SEQ ID NO: 17794 - DNA, 26 bp, Artificial Sequence
  Description of Artificial Sequence: Synthetic oligonucleotide
ccgaaccctcctcctgctactcttgg

SEQ ID NO: 17795 - DNA, 26 bp, Artificial Sequence
  Description of Artificial Sequence: Synthetic oligonucleotide
cgaaccctcctcctgctactcttggg

SEQ ID NO: 17796 - DNA, 26 bp, Artificial Sequence
  Description of Artificial Sequence: Synthetic oligonucleotide
gaaccctcctcctgctactcttgggg

SEQ ID NO: 17797 - DNA, 26 bp, Artificial Sequence
  Description of Artificial Sequence: Synthetic oligonucleotide
aaccctcctcctgctactcttggggg

SEQ ID NO: 17798 - DNA, 25 bp, Artificial Sequence
  Description of Artificial Sequence: Synthetic oligonucleotide
accctcctcctgctactcttggggg

SEQ ID NO: 17799 - DNA, 24 bp, Artificial Sequence
  Description of Artificial Sequence: Synthetic oligonucleotide
ccctcctcctgctactcttggggg

SEQ ID NO: 17800 - DNA, 24 bp, Artificial Sequence
  Description of Artificial Sequence: Synthetic oligonucleotide
cctcctcctgctactcttgggggc

SEQ ID NO: 17801 - DNA, 24 bp, Artificial Sequence
  Description of Artificial Sequence: Synthetic oligonucleotide
ctcctcctgctactcttgggggcc

SEQ ID NO: 17802 - DNA, 25 bp, Artificial Sequence
  Description of Artificial Sequence: Synthetic oligonucleotide
tcctcctgctactcttgggggccct

SEQ ID NO: 17803 - DNA, 24 bp, Artificial Sequence
  Description of Artificial Sequence: Synthetic oligonucleotide
cctcctgctactcttgggggccct

SEQ ID NO: 17804 - DNA, 24 bp, Artificial Sequence
  Description of Artificial Sequence: Synthetic oligonucleotide
ctcctgctactcttgggggccctg

SEQ ID NO: 17805 - DNA, 24 bp, Artificial Sequence
  Description of Artificial Sequence: Synthetic oligonucleotide
tcctgctactcttgggggccctgg

SEQ ID NO: 17806 - DNA, 23 bp, Artificial Sequence
  Description of Artificial Sequence: Synthetic oligonucleotide
cctgctactcttgggggccctgg

SEQ ID NO: 17807 - DNA, 23 bp, Artificial Sequence
  Description of Artificial Sequence: Synthetic oligonucleotide
ctgctactcttgggggccctggc

SEQ ID NO: 17808 - DNA, 23 bp, Artificial Sequence
  Description of Artificial Sequence: Synthetic oligonucleotide
tgctactcttgggggccctggcc

SEQ ID NO: 17809 - DNA, 22 bp, Artificial Sequence
  Description of Artificial Sequence: Synthetic oligonucleotide
gctactcttgggggccctggcc

SEQ ID NO: 17810 - DNA, 23 bp, Artificial Sequence
  Description of Artificial Sequence: Synthetic oligonucleotide
ctactcttgggggccctggccct

SEQ ID NO: 17811 - DNA, 24 bp, Artificial Sequence
  Description of Artificial Sequence: Synthetic oligonucleotide
tactcttgggggccctggccctga

SEQ ID NO: 17812 - DNA, 23 bp, Artificial Sequence
  Description of Artificial Sequence: Synthetic oligonucleotide
actcttgggggccctggccctga

SEQ ID NO: 17813 - DNA, 22 bp, Artificial Sequence
  Description of Artificial Sequence: Synthetic oligonucleotide
ctcttgggggccctggccctga

SEQ ID NO: 17814 - DNA, 22 bp, Artificial Sequence
  Description of Artificial Sequence: Synthetic oligonucleotide
tcttgggggccctggccctgac

SEQ ID NO: 17815 - DNA, 21 bp, Artificial Sequence
  Description of Artificial Sequence: Synthetic oligonucleotide
cttgggggccctggccctgac

SEQ ID NO: 17816 - DNA, 21 bp, Artificial Sequence
  Description of Artificial Sequence: Synthetic oligonucleotide
ttgggggccctggccctgacc

SEQ ID NO: 17817 - DNA, 20 bp, Artificial Sequence
  Description of Artificial Sequence: Synthetic oligonucleotide
tgggggccctggccctgacc

SEQ ID NO: 17818 - DNA, 28 bp, Artificial Sequence
  Description of Artificial Sequence: Synthetic oligonucleotide
cgggctcccactccatgaggtatttcac

SEQ ID NO: 17819 - DNA, 28 bp, Artificial Sequence
  Description of Artificial Sequence: Synthetic oligonucleotide
gggctcccactccatgaggtatttcacc

SEQ ID NO: 17820 - DNA, 29 bp, Artificial Sequence
  Description of Artificial Sequence: Synthetic oligonucleotide
ggctcccactccatgaggtatttcaccac

SEQ ID NO: 17821 - DNA, 27 bp, Artificial Sequence
  Description of Artificial Sequence: Synthetic oligonucleotide
gtggacgacacgcagttcgtgcggttt

SEQ ID NO: 17822 - DNA, 27 bp, Artificial Sequence
  Description of Artificial Sequence: Synthetic oligonucleotide
tggacgacacgcagttcgtgcggtttg

SEQ ID NO: 17823 - DNA, 27 bp, Artificial Sequence
  Description of Artificial Sequence: Synthetic oligonucleotide
ggacgacacgcagttcgtgcggtttga

SEQ ID NO: 17824 - DNA, 27 bp, Artificial Sequence
  Description of Artificial Sequence: Synthetic oligonucleotide
gacgacacgcagttcgtgcggtttgac

SEQ ID NO: 17825 - DNA, 28 bp, Artificial Sequence
  Description of Artificial Sequence: Synthetic oligonucleotide
acgacacgcagttcgtgcggtttgacag

SEQ ID NO: 17826 - DNA, 27 bp, Artificial Sequence
  Description of Artificial Sequence: Synthetic oligonucleotide
cgacacgcagttcgtgcggtttgacag

SEQ ID NO: 17827 - DNA, 27 bp, Artificial Sequence
  Description of Artificial Sequence: Synthetic oligonucleotide
gacacgcagttcgtgcggtttgacagc

SEQ ID NO: 17828 - DNA, 27 bp, Artificial Sequence
  Description of Artificial Sequence: Synthetic oligonucleotide
acacgcagttcgtgcggtttgacagcg

SEQ ID NO: 17829 - DNA, 27 bp, Artificial Sequence
  Description of Artificial Sequence: Synthetic oligonucleotide
cacgcagttcgtgcggtttgacagcga

SEQ ID NO: 17830 - DNA, 27 bp, Artificial Sequence
  Description of Artificial Sequence: Synthetic oligonucleotide
acgcagttcgtgcggtttgacagcgac

SEQ ID NO: 17831 - DNA, 26 bp, Artificial Sequence
  Description of Artificial Sequence: Synthetic oligonucleotide
cgcagttcgtgcggtttgacagcgac

SEQ ID NO: 17832 - DNA, 26 bp, Artificial Sequence
  Description of Artificial Sequence: Synthetic oligonucleotide
gcagttcgtgcggtttgacagcgacg

SEQ ID NO: 17833 - DNA, 26 bp, Artificial Sequence
  Description of Artificial Sequence: Synthetic oligonucleotide
cagttcgtgcggtttgacagcgacgc

SEQ ID NO: 17834 - DNA, 26 bp, Artificial Sequence
  Description of Artificial Sequence: Synthetic oligonucleotide
agttcgtgcggtttgacagcgacgcc

SEQ ID NO: 17835 - DNA, 25 bp, Artificial Sequence
  Description of Artificial Sequence: Synthetic oligonucleotide
gttcgtgcggtttgacagcgacgcc

SEQ ID NO: 17836 - DNA, 25 bp, Artificial Sequence
  Description of Artificial Sequence: Synthetic oligonucleotide
ttcgtgcggtttgacagcgacgccg

SEQ ID NO: 17837 - DNA, 24 bp, Artificial Sequence
  Description of Artificial Sequence: Synthetic oligonucleotide
tcgtgcggtttgacagcgacgccg

SEQ ID NO: 17838 - DNA, 23 bp, Artificial Sequence
  Description of Artificial Sequence: Synthetic oligonucleotide
cgtgcggtttgacagcgacgccg

SEQ ID NO: 17839 - DNA, 23 bp, Artificial Sequence
  Description of Artificial Sequence: Synthetic oligonucleotide
gtgcggtttgacagcgacgccgc

SEQ ID NO: 17840 - DNA, 24 bp, Artificial Sequence
  Description of Artificial Sequence: Synthetic oligonucleotide
tgcggtttgacagcgacgccgcga

SEQ ID NO: 17841 - DNA, 23 bp, Artificial Sequence
  Description of Artificial Sequence: Synthetic oligonucleotide
gcggtttgacagcgacgccgcga

SEQ ID NO: 17842 - DNA, 23 bp, Artificial Sequence
  Description of Artificial Sequence: Synthetic oligonucleotide
cggtttgacagcgacgccgcgag

SEQ ID NO: 17843 - DNA, 23 bp, Artificial Sequence
  Description of Artificial Sequence: Synthetic oligonucleotide
ggtttgacagcgacgccgcgagc

SEQ ID NO: 17844 - DNA, 24 bp, Artificial Sequence
  Description of Artificial Sequence: Synthetic oligonucleotide
gtttgacagcgacgccgcgagcca

SEQ ID NO: 17845 - DNA, 25 bp, Artificial Sequence
  Description of Artificial Sequence: Synthetic oligonucleotide
tttgacagcgacgccgcgagccaga

SEQ ID NO: 17846 - DNA, 24 bp, Artificial Sequence
  Description of Artificial Sequence: Synthetic oligonucleotide
ttgacagcgacgccgcgagccaga

SEQ ID NO: 17847 - DNA, 23 bp, Artificial Sequence
  Description of Artificial Sequence: Synthetic oligonucleotide
tgacagcgacgccgcgagccaga

SEQ ID NO: 17848 - DNA, 22 bp, Artificial Sequence
  Description of Artificial Sequence: Synthetic oligonucleotide
ccagaggatggagccgcgggca

SEQ ID NO: 17849 - DNA, 22 bp, Artificial Sequence
  Description of Artificial Sequence: Synthetic oligonucleotide
cagaggatggagccgcgggcac

SEQ ID NO: 17850 - DNA, 22 bp, Artificial Sequence
  Description of Artificial Sequence: Synthetic oligonucleotide
agaggatggagccgcgggcacc

SEQ ID NO: 17851 - DNA, 21 bp, Artificial Sequence
  Description of Artificial Sequence: Synthetic oligonucleotide
gaggatggagccgcgggcacc

SEQ ID NO: 17852 - DNA, 22 bp, Artificial Sequence
  Description of Artificial Sequence: Synthetic oligonucleotide
aggatggagccgcgggcaccgt

SEQ ID NO: 17853 - DNA, 21 bp, Artificial Sequence
  Description of Artificial Sequence: Synthetic oligonucleotide
ggatggagccgcgggcaccgt

SEQ ID NO: 17854 - DNA, 21 bp, Artificial Sequence
  Description of Artificial Sequence: Synthetic oligonucleotide
gatggagccgcgggcaccgtg

SEQ ID NO: 17855 - DNA, 24 bp, Artificial Sequence
  Description of Artificial Sequence: Synthetic oligonucleotide
atggagccgcgggcaccgtggata

SEQ ID NO: 17856 - DNA, 23 bp, Artificial Sequence
  Description of Artificial Sequence: Synthetic oligonucleotide
tggagccgcgggcaccgtggata

SEQ ID NO: 17857 - DNA, 22 bp, Artificial Sequence
  Description of Artificial Sequence: Synthetic oligonucleotide
ggagccgcgggcaccgtggata

SEQ ID NO: 17858 - DNA, 23 bp, Artificial Sequence
  Description of Artificial Sequence: Synthetic oligonucleotide
gagccgcgggcaccgtggataga

SEQ ID NO: 17859 - DNA, 23 bp, Artificial Sequence
  Description of Artificial Sequence: Synthetic oligonucleotide
agccgcgggcaccgtggatagag

SEQ ID NO: 17860 - DNA, 22 bp, Artificial Sequence
  Description of Artificial Sequence: Synthetic oligonucleotide
gccgcgggcaccgtggatagag

SEQ ID NO: 17861 - DNA, 23 bp, Artificial Sequence
  Description of Artificial Sequence: Synthetic oligonucleotide
ccgcgggcaccgtggatagagca

SEQ ID NO: 17862 - DNA, 23 bp, Artificial Sequence
  Description of Artificial Sequence: Synthetic oligonucleotide
cgcgggcaccgtggatagagcag

SEQ ID NO: 17863 - DNA, 24 bp, Artificial Sequence
  Description of Artificial Sequence: Synthetic oligonucleotide
gcgggcaccgtggatagagcagga

SEQ ID NO: 17864 - DNA, 24 bp, Artificial Sequence
  Description of Artificial Sequence: Synthetic oligonucleotide
cgggcaccgtggatagagcaggag

SEQ ID NO: 17865 - DNA, 24 bp, Artificial Sequence
  Description of Artificial Sequence: Synthetic oligonucleotide
gggcaccgtggatagagcaggagg

SEQ ID NO: 17866 - DNA, 24 bp, Artificial Sequence
  Description of Artificial Sequence: Synthetic oligonucleotide
ggcaccgtggatagagcaggaggg

SEQ ID NO: 17867 - DNA, 24 bp, Artificial Sequence
  Description of Artificial Sequence: Synthetic oligonucleotide
gcaccgtggatagagcaggagggg

SEQ ID NO: 17868 - DNA, 24 bp, Artificial Sequence
  Description of Artificial Sequence: Synthetic oligonucleotide
caccgtggatagagcaggaggggc

SEQ ID NO: 17869 - DNA, 24 bp, Artificial Sequence
  Description of Artificial Sequence: Synthetic oligonucleotide
accgtggatagagcaggaggggcc

SEQ ID NO: 17870 - DNA, 32 bp, Artificial Sequence
  Description of Artificial Sequence: Synthetic oligonucleotide
ttctcacaccatccagatgatgtatggctgcc

SEQ ID NO: 17871 - DNA, 31 bp, Artificial Sequence
  Description of Artificial Sequence: Synthetic oligonucleotide
tctcacaccatccagatgatgtatggctgcc

SEQ ID NO: 17872 - DNA, 30 bp, Artificial Sequence
  Description of Artificial Sequence: Synthetic oligonucleotide
ctcacaccatccagatgatgtatggctgcc

SEQ ID NO: 17873 - DNA, 31 bp, Artificial Sequence
  Description of Artificial Sequence: Synthetic oligonucleotide
tcacaccatccagatgatgtatggctgccac

SEQ ID NO: 17874 - DNA, 30 bp, Artificial Sequence
  Description of Artificial Sequence: Synthetic oligonucleotide
cacaccatccagatgatgtatggctgccac

SEQ ID NO: 17875 - DNA, 30 bp, Artificial Sequence
  Description of Artificial Sequence: Synthetic oligonucleotide
acaccatccagatgatgtatggctgccacg

SEQ ID NO: 17876 - DNA, 29 bp, Artificial Sequence
  Description of Artificial Sequence: Synthetic oligonucleotide
caccatccagatgatgtatggctgccacg

SEQ ID NO: 17877 - DNA, 30 bp, Artificial Sequence
  Description of Artificial Sequence: Synthetic oligonucleotide
accatccagatgatgtatggctgccacgtg

SEQ ID NO: 17878 - DNA, 29 bp, Artificial Sequence
  Description of Artificial Sequence: Synthetic oligonucleotide
ccatccagatgatgtatggctgccacgtg

SEQ ID NO: 17879 - DNA, 29 bp, Artificial Sequence
  Description of Artificial Sequence: Synthetic oligonucleotide
catccagatgatgtatggctgccacgtgg

SEQ ID NO: 17880 - DNA, 29 bp, Artificial Sequence
  Description of Artificial Sequence: Synthetic oligonucleotide
atccagatgatgtatggctgccacgtggg

SEQ ID NO: 17881 - DNA, 28 bp, Artificial Sequence
  Description of Artificial Sequence: Synthetic oligonucleotide
tccagatgatgtatggctgccacgtggg

SEQ ID NO: 17882 - DNA, 27 bp, Artificial Sequence
  Description of Artificial Sequence: Synthetic oligonucleotide
ccagatgatgtatggctgccacgtggg

SEQ ID NO: 17883 - DNA, 27 bp, Artificial Sequence
  Description of Artificial Sequence: Synthetic oligonucleotide
cagatgatgtatggctgccacgtgggg

SEQ ID NO: 17884 - DNA, 28 bp, Artificial Sequence
  Description of Artificial Sequence: Synthetic oligonucleotide
agatgatgtatggctgccacgtggggtc

SEQ ID NO: 17885 - DNA, 27 bp, Artificial Sequence
  Description of Artificial Sequence: Synthetic oligonucleotide
gatgatgtatggctgccacgtggggtc

SEQ ID NO: 17886 - DNA, 27 bp, Artificial Sequence
  Description of Artificial Sequence: Synthetic oligonucleotide
atgatgtatggctgccacgtggggtcg

SEQ ID NO: 17887 - DNA, 26 bp, Artificial Sequence
  Description of Artificial Sequence: Synthetic oligonucleotide
tgatgtatggctgccacgtggggtcg

SEQ ID NO: 17888 - DNA, 24 bp, Artificial Sequence
  Description of Artificial Sequence: Synthetic oligonucleotide
tatggctgccacgtggggtcggac

SEQ ID NO: 17889 - DNA, 23 bp, Artificial Sequence
  Description of Artificial Sequence: Synthetic oligonucleotide
atggctgccacgtggggtcggac

SEQ ID NO: 17890 - DNA, 22 bp, Artificial Sequence
  Description of Artificial Sequence: Synthetic oligonucleotide
tggctgccacgtggggtcggac

SEQ ID NO: 17891 - DNA, 21 bp, Artificial Sequence
  Description of Artificial Sequence: Synthetic oligonucleotide
ggctgccacgtggggtcggac

SEQ ID NO: 17892 - DNA, 21 bp, Artificial Sequence
  Description of Artificial Sequence: Synthetic oligonucleotide
gctgccacgtggggtcggacg

SEQ ID NO: 17893 - DNA, 21 bp, Artificial Sequence
  Description of Artificial Sequence: Synthetic oligonucleotide
ctgccacgtggggtcggacgg

SEQ ID NO: 17894 - DNA, 21 bp, Artificial Sequence
  Description of Artificial Sequence: Synthetic oligonucleotide
tgccacgtggggtcggacggg

SEQ ID NO: 17895 - DNA, 20 bp, Artificial Sequence
  Description of Artificial Sequence: Synthetic oligonucleotide
gccacgtggggtcggacggg

SEQ ID NO: 17896 - DNA, 20 bp, Artificial Sequence
  Description of Artificial Sequence: Synthetic oligonucleotide
ccacgtggggtcggacgggc

SEQ ID NO: 17897 - DNA, 20 bp, Artificial Sequence
  Description of Artificial Sequence: Synthetic oligonucleotide
cacgtggggtcggacgggcg

SEQ ID NO: 17898 - DNA, 32 bp, Artificial Sequence
  Description of Artificial Sequence: Synthetic oligonucleotide
catcattgctggcctagttctctttggagctg

SEQ ID NO: 17899 - DNA, 33 bp, Artificial Sequence
  Description of Artificial Sequence: Synthetic oligonucleotide
atcattgctggcctagttctctttggagctgtg

SEQ ID NO: 17900 - DNA, 32 bp, Artificial Sequence
  Description of Artificial Sequence: Synthetic oligonucleotide
tcattgctggcctagttctctttggagctgtg

SEQ ID NO: 17901 - DNA, 31 bp, Artificial Sequence
  Description of Artificial Sequence: Synthetic oligonucleotide
cattgctggcctagttctctttggagctgtg

SEQ ID NO: 17902 - DNA, 33 bp, Artificial Sequence
  Description of Artificial Sequence: Synthetic oligonucleotide
attgctggcctagttctctttggagctgtgttc

SEQ ID NO: 17903 - DNA, 32 bp, Artificial Sequence
  Description of Artificial Sequence: Synthetic oligonucleotide
ttgctggcctagttctctttggagctgtgttc

SEQ ID NO: 17904 - DNA, 31 bp, Artificial Sequence
  Description of Artificial Sequence: Synthetic oligonucleotide
tgctggcctagttctctttggagctgtgttc

SEQ ID NO: 17905 - DNA, 30 bp, Artificial Sequence
  Description of Artificial Sequence: Synthetic oligonucleotide
gctggcctagttctctttggagctgtgttc

SEQ ID NO: 17906 - DNA, 30 bp, Artificial Sequence
  Description of Artificial Sequence: Synthetic oligonucleotide
ctggcctagttctctttggagctgtgttcg

SEQ ID NO: 17907 - DNA, 30 bp, Artificial Sequence
  Description of Artificial Sequence: Synthetic oligonucleotide
tggcctagttctctttggagctgtgttcgc

SEQ ID NO: 17908 - DNA, 29 bp, Artificial Sequence
  Description of Artificial Sequence: Synthetic oligonucleotide
ggcctagttctctttggagctgtgttcgc

SEQ ID NO: 17909 - DNA, 30 bp, Artificial Sequence
  Description of Artificial Sequence: Synthetic oligonucleotide
gcctagttctctttggagctgtgttcgctg

SEQ ID NO: 17910 - DNA, 30 bp, Artificial Sequence
  Description of Artificial Sequence: Synthetic oligonucleotide
cctagttctctttggagctgtgttcgctgg

SEQ ID NO: 17911 - DNA, 31 bp, Artificial Sequence
  Description of Artificial Sequence: Synthetic oligonucleotide
ctagttctctttggagctgtgttcgctggag

SEQ ID NO: 17912 - DNA, 31 bp, Artificial Sequence
  Description of Artificial Sequence: Synthetic oligonucleotide
tagttctctttggagctgtgttcgctggagc

SEQ ID NO: 17913 - DNA, 30 bp, Artificial Sequence
  Description of Artificial Sequence: Synthetic oligonucleotide
agttctctttggagctgtgttcgctggagc

SEQ ID NO: 17914 - DNA, 29 bp, Artificial Sequence
  Description of Artificial Sequence: Synthetic oligonucleotide
gttctctttggagctgtgttcgctggagc

SEQ ID NO: 17915 - DNA, 30 bp, Artificial Sequence
  Description of Artificial Sequence: Synthetic oligonucleotide
ttctctttggagctgtgttcgctggagctg

SEQ ID NO: 17916 - DNA, 29 bp, Artificial Sequence
  Description of Artificial Sequence: Synthetic oligonucleotide
tctctttggagctgtgttcgctggagctg

SEQ ID NO: 17917 - DNA, 28 bp, Artificial Sequence
  Description of Artificial Sequence: Synthetic oligonucleotide
ctctttggagctgtgttcgctggagctg

SEQ ID NO: 17918 - DNA, 29 bp, Artificial Sequence
  Description of Artificial Sequence: Synthetic oligonucleotide
tctttggagctgtgttcgctggagctgtg

SEQ ID NO: 17919 - DNA, 28 bp, Artificial Sequence
  Description of Artificial Sequence: Synthetic oligonucleotide
ctttggagctgtgttcgctggagctgtg

SEQ ID NO: 17920 - DNA, 28 bp, Artificial Sequence
  Description of Artificial Sequence: Synthetic oligonucleotide
tttggagctgtgttcgctggagctgtgg

SEQ ID NO: 17921 - DNA, 27 bp, Artificial Sequence
  Description of Artificial Sequence: Synthetic oligonucleotide
ttggagctgtgttcgctggagctgtgg

SEQ ID NO: 17922 - DNA, 27 bp, Artificial Sequence
  Description of Artificial Sequence: Synthetic oligonucleotide
tggagctgtgttcgctggagctgtggt

SEQ ID NO: 17923 - DNA, 26 bp, Artificial Sequence
  Description of Artificial Sequence: Synthetic oligonucleotide
ggagctgtgttcgctggagctgtggt

SEQ ID NO: 17924 - DNA, 26 bp, Artificial Sequence
  Description of Artificial Sequence: Synthetic oligonucleotide
gagctgtgttcgctggagctgtggtc

SEQ ID NO: 17925 - DNA, 26 bp, Artificial Sequence
  Description of Artificial Sequence: Synthetic oligonucleotide
agctgtgttcgctggagctgtggtcg

SEQ ID NO: 17926 - DNA, 25 bp, Artificial Sequence
  Description of Artificial Sequence: Synthetic oligonucleotide
gctgtgttcgctggagctgtggtcg

SEQ ID NO: 17927 - DNA, 26 bp, Artificial Sequence
  Description of Artificial Sequence: Synthetic oligonucleotide
ctgtgttcgctggagctgtggtcgct

SEQ ID NO: 17928 - DNA, 26 bp, Artificial Sequence
  Description of Artificial Sequence: Synthetic oligonucleotide
tgtgttcgctggagctgtggtcgctg

SEQ ID NO: 17929 - DNA, 25 bp, Artificial Sequence
  Description of Artificial Sequence: Synthetic oligonucleotide
gtgttcgctggagctgtggtcgctg

SEQ ID NO: 17930 - DNA, 27 bp, Artificial Sequence
  Description of Artificial Sequence: Synthetic oligonucleotide
ccaagcccctcaccctgagatgggtta

SEQ ID NO: 17931 - DNA, 28 bp, Artificial Sequence
  Description of Artificial Sequence: Synthetic oligonucleotide
caagcccctcaccctgagatgggttaag

SEQ ID NO: 17932 - DNA, 28 bp, Artificial Sequence
  Description of Artificial Sequence: Synthetic oligonucleotide
aagcccctcaccctgagatgggttaagg

SEQ ID NO: 17933 - DNA, 27 bp, Artificial Sequence
  Description of Artificial Sequence: Synthetic oligonucleotide
agcccctcaccctgagatgggttaagg

SEQ ID NO: 17934 - DNA, 27 bp, Artificial Sequence
  Description of Artificial Sequence: Synthetic oligonucleotide
gcccctcaccctgagatgggttaagga

SEQ ID NO: 17935 - DNA, 27 bp, Artificial Sequence
  Description of Artificial Sequence: Synthetic oligonucleotide
cccctcaccctgagatgggttaaggag

SEQ ID NO: 17936 - DNA, 27 bp, Artificial Sequence
  Description of Artificial Sequence: Synthetic oligonucleotide
ccctcaccctgagatgggttaaggagg

SEQ ID NO: 17937 - DNA, 27 bp, Artificial Sequence
  Description of Artificial Sequence: Synthetic oligonucleotide
cctcaccctgagatgggttaaggaggg

SEQ ID NO: 17938 - DNA, 28 bp, Artificial Sequence
  Description of Artificial Sequence: Synthetic oligonucleotide
ctcaccctgagatgggttaaggagggag

SEQ ID NO: 17939 - DNA, 30 bp, Artificial Sequence
  Description of Artificial Sequence: Synthetic oligonucleotide
tcaccctgagatgggttaaggagggagatg

SEQ ID NO: 17940 - DNA, 29 bp, Artificial Sequence
  Description of Artificial Sequence: Synthetic oligonucleotide
caccctgagatgggttaaggagggagatg

SEQ ID NO: 17941 - DNA, 29 bp, Artificial Sequence
  Description of Artificial Sequence: Synthetic oligonucleotide
accctgagatgggttaaggagggagatgg

SEQ ID NO: 17942 - DNA, 28 bp, Artificial Sequence
  Description of Artificial Sequence: Synthetic oligonucleotide
ccctgagatgggttaaggagggagatgg

SEQ ID NO: 17943 - DNA, 28 bp, Artificial Sequence
  Description of Artificial Sequence: Synthetic oligonucleotide
cctgagatgggttaaggagggagatggg

SEQ ID NO: 17944 - DNA, 28 bp, Artificial Sequence
  Description of Artificial Sequence: Synthetic oligonucleotide
ctgagatgggttaaggagggagatgggg

SEQ ID NO: 17945 - DNA, 28 bp, Artificial Sequence
  Description of Artificial Sequence: Synthetic oligonucleotide
tgagatgggttaaggagggagatggggg

SEQ ID NO: 17946 - DNA, 27 bp, Artificial Sequence
  Description of Artificial Sequence: Synthetic oligonucleotide
gagatgggttaaggagggagatggggg

SEQ ID NO: 17947 - DNA, 28 bp, Artificial Sequence
  Description of Artificial Sequence: Synthetic oligonucleotide
agatgggttaaggagggagatgggggtg

SEQ ID NO: 17948 - DNA, 27 bp, Artificial Sequence
  Description of Artificial Sequence: Synthetic oligonucleotide
gatgggttaaggagggagatgggggtg

SEQ ID NO: 17949 - DNA, 28 bp, Artificial Sequence
  Description of Artificial Sequence: Synthetic oligonucleotide
atgggttaaggagggagatgggggtgtc

SEQ ID NO: 17950 - DNA, 27 bp, Artificial Sequence
  Description of Artificial Sequence: Synthetic oligonucleotide
tgggttaaggagggagatgggggtgtc

SEQ ID NO: 17951 - DNA, 27 bp, Artificial Sequence
  Description of Artificial Sequence: Synthetic oligonucleotide
gggttaaggagggagatgggggtgtca

SEQ ID NO: 17952 - DNA, 28 bp, Artificial Sequence
  Description of Artificial Sequence: Synthetic oligonucleotide
ggttaaggagggagatgggggtgtcatg

SEQ ID NO: 17953 - DNA, 29 bp, Artificial Sequence
  Description of Artificial Sequence: Synthetic oligonucleotide
gttaaggagggagatgggggtgtcatgtc

SEQ ID NO: 17954 - DNA, 34 bp, Artificial Sequence
  Description of Artificial Sequence: Synthetic oligonucleotide
ttaaggagggagatgggggtgtcatgtcttttag

SEQ ID NO: 17955 - DNA, 33 bp, Artificial Sequence
  Description of Artificial Sequence: Synthetic oligonucleotide
taaggagggagatgggggtgtcatgtcttttag

SEQ ID NO: 17956 - DNA, 32 bp, Artificial Sequence
  Description of Artificial Sequence: Synthetic oligonucleotide
aaggagggagatgggggtgtcatgtcttttag

SEQ ID NO: 17957 - DNA, 31 bp, Artificial Sequence
  Description of Artificial Sequence: Synthetic oligonucleotide
aggagggagatgggggtgtcatgtcttttag

SEQ ID NO: 17958 - DNA, 30 bp, Artificial Sequence
  Description of Artificial Sequence: Synthetic oligonucleotide
ggagggagatgggggtgtcatgtcttttag

SEQ ID NO: 17959 - DNA, 30 bp, Artificial Sequence
  Description of Artificial Sequence: Synthetic oligonucleotide
gagggagatgggggtgtcatgtcttttagg

SEQ ID NO: 17960 - DNA, 30 bp, Artificial Sequence
  Description of Artificial Sequence: Synthetic oligonucleotide
agggagatgggggtgtcatgtcttttaggg

SEQ ID NO: 17961 - DNA, 29 bp, Artificial Sequence
  Description of Artificial Sequence: Synthetic oligonucleotide
gggagatgggggtgtcatgtcttttaggg

SEQ ID NO: 17962 - DNA, 32 bp, Artificial Sequence
  Description of Artificial Sequence: Synthetic oligonucleotide
ggagatgggggtgtcatgtcttttagggaaag

SEQ ID NO: 17963 - DNA, 32 bp, Artificial Sequence
  Description of Artificial Sequence: Synthetic oligonucleotide
gagatgggggtgtcatgtcttttagggaaagc

SEQ ID NO: 17964 - DNA, 33 bp, Artificial Sequence
  Description of Artificial Sequence: Synthetic oligonucleotide
agatgggggtgtcatgtcttttagggaaagcag

SEQ ID NO: 17965 - DNA, 32 bp, Artificial Sequence
  Description of Artificial Sequence: Synthetic oligonucleotide
gatgggggtgtcatgtcttttagggaaagcag

SEQ ID NO: 17966 - DNA, 32 bp, Artificial Sequence
  Description of Artificial Sequence: Synthetic oligonucleotide
atgggggtgtcatgtcttttagggaaagcagg

SEQ ID NO: 17967 - DNA, 31 bp, Artificial Sequence
  Description of Artificial Sequence: Synthetic oligonucleotide
tgggggtgtcatgtcttttagggaaagcagg

SEQ ID NO: 17968 - DNA, 30 bp, Artificial Sequence
  Description of Artificial Sequence: Synthetic oligonucleotide
gggggtgtcatgtcttttagggaaagcagg

SEQ ID NO: 17969 - DNA, 31 bp, Artificial Sequence
  Description of Artificial Sequence: Synthetic oligonucleotide
ggggtgtcatgtcttttagggaaagcaggag

SEQ ID NO: 17970 - DNA, 31 bp, Artificial Sequence
  Description of Artificial Sequence: Synthetic oligonucleotide
gggtgtcatgtcttttagggaaagcaggagc

SEQ ID NO: 17971 - DNA, 31 bp, Artificial Sequence
  Description of Artificial Sequence: Synthetic oligonucleotide
ggtgtcatgtcttttagggaaagcaggagcc

SEQ ID NO: 17972 - DNA, 32 bp, Artificial Sequence
  Description of Artificial Sequence: Synthetic oligonucleotide
gtgtcatgtcttttagggaaagcaggagcctc

SEQ ID NO: 17973 - DNA, 33 bp, Artificial Sequence
  Description of Artificial Sequence: Synthetic oligonucleotide
tgtcatgtcttttagggaaagcaggagcctctc

SEQ ID NO: 17974 - DNA, 32 bp, Artificial Sequence
  Description of Artificial Sequence: Synthetic oligonucleotide
gtcatgtcttttagggaaagcaggagcctctc

SEQ ID NO: 17975 - DNA, 33 bp, Artificial Sequence
  Description of Artificial Sequence: Synthetic oligonucleotide
tcatgtcttttagggaaagcaggagcctctctg

SEQ ID NO: 17976 - DNA, 32 bp, Artificial Sequence
  Description of Artificial Sequence: Synthetic oligonucleotide
catgtcttttagggaaagcaggagcctctctg

SEQ ID NO: 17977 - DNA, 33 bp, Artificial Sequence
  Description of Artificial Sequence: Synthetic oligonucleotide
atgtcttttagggaaagcaggagcctctctgac

SEQ ID NO: 17978 - DNA, 32 bp, Artificial Sequence
  Description of Artificial Sequence: Synthetic oligonucleotide
tgtcttttagggaaagcaggagcctctctgac

SEQ ID NO: 17979 - DNA, 31 bp, Artificial Sequence
  Description of Artificial Sequence: Synthetic oligonucleotide
gtcttttagggaaagcaggagcctctctgac

SEQ ID NO: 17980 - DNA, 31 bp, Artificial Sequence
  Description of Artificial Sequence: Synthetic oligonucleotide
tcttttagggaaagcaggagcctctctgacc

SEQ ID NO: 17981 - DNA, 30 bp, Artificial Sequence
  Description of Artificial Sequence: Synthetic oligonucleotide
cttttagggaaagcaggagcctctctgacc

SEQ ID NO: 17982 - DNA, 34 bp, Artificial Sequence
  Description of Artificial Sequence: Synthetic oligonucleotide
ttttagggaaagcaggagcctctctgacctttag

SEQ ID NO: 17983 - DNA, 33 bp, Artificial Sequence
  Description of Artificial Sequence: Synthetic oligonucleotide
tttagggaaagcaggagcctctctgacctttag

SEQ ID NO: 17984 - DNA, 32 bp, Artificial Sequence
  Description of Artificial Sequence: Synthetic oligonucleotide
ttagggaaagcaggagcctctctgacctttag

SEQ ID NO: 17985 - DNA, 31 bp, Artificial Sequence
  Description of Artificial Sequence: Synthetic oligonucleotide
tagggaaagcaggagcctctctgacctttag

SEQ ID NO: 17986 - DNA, 30 bp, Artificial Sequence
  Description of Artificial Sequence: Synthetic oligonucleotide
agggaaagcaggagcctctctgacctttag

SEQ ID NO: 17987 - DNA, 29 bp, Artificial Sequence
  Description of Artificial Sequence: Synthetic oligonucleotide
gggaaagcaggagcctctctgacctttag

SEQ ID NO: 17988 - DNA, 30 bp, Artificial Sequence
  Description of Artificial Sequence: Synthetic oligonucleotide
ggaaagcaggagcctctctgacctttagag

SEQ ID NO: 17989 - DNA, 30 bp, Artificial Sequence
  Description of Artificial Sequence: Synthetic oligonucleotide
gaaagcaggagcctctctgacctttagagc

SEQ ID NO: 17990 - DNA, 30 bp, Artificial Sequence
  Description of Artificial Sequence: Synthetic oligonucleotide
aaagcaggagcctctctgacctttagagcc

SEQ ID NO: 17991 - DNA, 29 bp, Artificial Sequence
  Description of Artificial Sequence: Synthetic oligonucleotide
aagcaggagcctctctgacctttagagcc

SEQ ID NO: 17992 - DNA, 28 bp, Artificial Sequence
  Description of Artificial Sequence: Synthetic oligonucleotide
agcaggagcctctctgacctttagagcc

SEQ ID NO: 17993 - DNA, 27 bp, Artificial Sequence
  Description of Artificial Sequence: Synthetic oligonucleotide
gcaggagcctctctgacctttagagcc

SEQ ID NO: 17994 - DNA, 27 bp, Artificial Sequence
  Description of Artificial Sequence: Synthetic oligonucleotide
caggagcctctctgacctttagagccg

SEQ ID NO: 17995 - DNA, 28 bp, Artificial Sequence
  Description of Artificial Sequence: Synthetic oligonucleotide
aggagcctctctgacctttagagccgtc

SEQ ID NO: 17996 - DNA, 27 bp, Artificial Sequence
  Description of Artificial Sequence: Synthetic oligonucleotide
ggagcctctctgacctttagagccgtc

SEQ ID NO: 17997 - DNA, 29 bp, Artificial Sequence
  Description of Artificial Sequence: Synthetic oligonucleotide
gagcctctctgacctttagagccgtcttc

SEQ ID NO: 17998 - DNA, 29 bp, Artificial Sequence
  Description of Artificial Sequence: Synthetic oligonucleotide
agcctctctgacctttagagccgtcttcc

SEQ ID NO: 17999 - DNA, 28 bp, Artificial Sequence
  Description of Artificial Sequence: Synthetic oligonucleotide
gcctctctgacctttagagccgtcttcc

SEQ ID NO: 18000 - DNA, 28 bp, Artificial Sequence
  Description of Artificial Sequence: Synthetic oligonucleotide
cctctctgacctttagagccgtcttccc

SEQ ID NO: 18001 - DNA, 29 bp, Artificial Sequence
  Description of Artificial Sequence: Synthetic oligonucleotide
ctctctgacctttagagccgtcttcccag

SEQ ID NO: 18002 - DNA, 29 bp, Artificial Sequence
  Description of Artificial Sequence: Synthetic oligonucleotide
tctctgacctttagagccgtcttcccagc

SEQ ID NO: 18003 - DNA, 28 bp, Artificial Sequence
  Description of Artificial Sequence: Synthetic oligonucleotide
ctctgacctttagagccgtcttcccagc

SEQ ID NO: 18004 - DNA, 28 bp, Artificial Sequence
  Description of Artificial Sequence: Synthetic oligonucleotide
tctgacctttagagccgtcttcccagcc

SEQ ID NO: 18005 - DNA, 27 bp, Artificial Sequence
  Description of Artificial Sequence: Synthetic oligonucleotide
ctgacctttagagccgtcttcccagcc

SEQ ID NO: 18006 - DNA, 27 bp, Artificial Sequence
  Description of Artificial Sequence: Synthetic oligonucleotide
tgacctttagagccgtcttcccagccc

SEQ ID NO: 18007 - DNA, 27 bp, Artificial Sequence
  Description of Artificial Sequence: Synthetic oligonucleotide
gacctttagagccgtcttcccagccca

SEQ ID NO: 18008 - DNA, 27 bp, Artificial Sequence
  Description of Artificial Sequence: Synthetic oligonucleotide
acctttagagccgtcttcccagcccac

SEQ ID NO: 18009 - DNA, 26 bp, Artificial Sequence
  Description of Artificial Sequence: Synthetic oligonucleotide
cctttagagccgtcttcccagcccac

SEQ ID NO: 18010 - DNA, 27 bp, Artificial Sequence
  Description of Artificial Sequence: Synthetic oligonucleotide
ctttagagccgtcttcccagcccacca

SEQ ID NO: 18011 - DNA, 28 bp, Artificial Sequence
  Description of Artificial Sequence: Synthetic oligonucleotide
tttagagccgtcttcccagcccaccatc

SEQ ID NO: 18012 - DNA, 27 bp, Artificial Sequence
  Description of Artificial Sequence: Synthetic oligonucleotide
ttagagccgtcttcccagcccaccatc

SEQ ID NO: 18013 - DNA, 26 bp, Artificial Sequence
  Description of Artificial Sequence: Synthetic oligonucleotide
tagagccgtcttcccagcccaccatc

SEQ ID NO: 18014 - DNA, 25 bp, Artificial Sequence
  Description of Artificial Sequence: Synthetic oligonucleotide
agagccgtcttcccagcccaccatc

SEQ ID NO: 18015 - DNA, 27 bp, Artificial Sequence
  Description of Artificial Sequence: Synthetic oligonucleotide
agttgagagcctacctggagggcacct

SEQ ID NO: 18016 - DNA, 26 bp, Artificial Sequence
  Description of Artificial Sequence: Synthetic oligonucleotide
gttgagagcctacctggagggcacct

SEQ ID NO: 18017 - DNA, 26 bp, Artificial Sequence
  Description of Artificial Sequence: Synthetic oligonucleotide
ttgagagcctacctggagggcacctg

SEQ ID NO: 18018 - DNA, 25 bp, Artificial Sequence
  Description of Artificial Sequence: Synthetic oligonucleotide
tgagagcctacctggagggcacctg

SEQ ID NO: 18019 - DNA, 24 bp, Artificial Sequence
  Description of Artificial Sequence: Synthetic oligonucleotide
gagagcctacctggagggcacctg

SEQ ID NO: 18020 - DNA, 24 bp, Artificial Sequence
  Description of Artificial Sequence: Synthetic oligonucleotide
agagcctacctggagggcacctgc

SEQ ID NO: 18021 - DNA, 23 bp, Artificial Sequence
  Description of Artificial Sequence: Synthetic oligonucleotide
gagcctacctggagggcacctgc

SEQ ID NO: 18022 - DNA, 24 bp, Artificial Sequence
  Description of Artificial Sequence: Synthetic oligonucleotide
agcctacctggagggcacctgcgt

SEQ ID NO: 18023 - DNA, 23 bp, Artificial Sequence
  Description of Artificial Sequence: Synthetic oligonucleotide
gcctacctggagggcacctgcgt

SEQ ID NO: 18024 - DNA, 23 bp, Artificial Sequence
  Description of Artificial Sequence: Synthetic oligonucleotide
cctacctggagggcacctgcgtg

SEQ ID NO: 18025 - DNA, 24 bp, Artificial Sequence
  Description of Artificial Sequence: Synthetic oligonucleotide
ctacctggagggcacctgcgtgga

SEQ ID NO: 18026 - DNA, 25 bp, Artificial Sequence
  Description of Artificial Sequence: Synthetic oligonucleotide
tacctggagggcacctgcgtggagt

SEQ ID NO: 18027 - DNA, 24 bp, Artificial Sequence
  Description of Artificial Sequence: Synthetic oligonucleotide
acctggagggcacctgcgtggagt

SEQ ID NO: 18028 - DNA, 23 bp, Artificial Sequence
  Description of Artificial Sequence: Synthetic oligonucleotide
cctggagggcacctgcgtggagt

SEQ ID NO: 18029 - DNA, 23 bp, Artificial Sequence
  Description of Artificial Sequence: Synthetic oligonucleotide
ctggagggcacctgcgtggagtg

SEQ ID NO: 18030 - DNA, 23 bp, Artificial Sequence
  Description of Artificial Sequence: Synthetic oligonucleotide
tggagggcacctgcgtggagtgg

SEQ ID NO: 18031 - DNA, 22 bp, Artificial Sequence
  Description of Artificial Sequence: Synthetic oligonucleotide
ggagggcacctgcgtggagtgg

SEQ ID NO: 18032 - DNA, 23 bp, Artificial Sequence
  Description of Artificial Sequence: Synthetic oligonucleotide
gagggcacctgcgtggagtggct

SEQ ID NO: 18033 - DNA, 23 bp, Artificial Sequence
  Description of Artificial Sequence: Synthetic oligonucleotide
agggcacctgcgtggagtggctc

SEQ ID NO: 18034 - DNA, 22 bp, Artificial Sequence
  Description of Artificial Sequence: Synthetic oligonucleotide
gggcacctgcgtggagtggctc

SEQ ID NO: 18035 - DNA, 22 bp, Artificial Sequence
  Description of Artificial Sequence: Synthetic oligonucleotide
ggcacctgcgtggagtggctcc

SEQ ID NO: 18036 - DNA, 22 bp, Artificial Sequence
  Description of Artificial Sequence: Synthetic oligonucleotide
gcacctgcgtggagtggctccg

SEQ ID NO: 18037 - DNA, 23 bp, Artificial Sequence
  Description of Artificial Sequence: Synthetic oligonucleotide
cacctgcgtggagtggctccgca

SEQ ID NO: 18038 - DNA, 26 bp, Artificial Sequence
  Description of Artificial Sequence: Synthetic oligonucleotide
acctgcgtggagtggctccgcagata

SEQ ID NO: 18039 - DNA, 25 bp, Artificial Sequence
  Description of Artificial Sequence: Synthetic oligonucleotide
cctgcgtggagtggctccgcagata

SEQ ID NO: 18040 - DNA, 31 bp, Artificial Sequence
  Description of Artificial Sequence: Synthetic oligonucleotide
ccactccatgaggtatttcaccacatccgtc

SEQ ID NO: 18041 - DNA, 32 bp, Artificial Sequence
  Description of Artificial Sequence: Synthetic oligonucleotide
cactccatgaggtatttcaccacatccgtctc

SEQ ID NO: 18042 - DNA, 32 bp, Artificial Sequence
  Description of Artificial Sequence: Synthetic oligonucleotide
actccatgaggtatttcaccacatccgtctcc

SEQ ID NO: 18043 - DNA, 31 bp, Artificial Sequence
  Description of Artificial Sequence: Synthetic oligonucleotide
ctccatgaggtatttcaccacatccgtctcc

SEQ ID NO: 18044 - DNA, 31 bp, Artificial Sequence
  Description of Artificial Sequence: Synthetic oligonucleotide
tccatgaggtatttcaccacatccgtctccc

SEQ ID NO: 18045 - DNA, 30 bp, Artificial Sequence
  Description of Artificial Sequence: Synthetic oligonucleotide
ccatgaggtatttcaccacatccgtctccc

SEQ ID NO: 18046 - DNA, 30 bp, Artificial Sequence
  Description of Artificial Sequence: Synthetic oligonucleotide
catgaggtatttcaccacatccgtctcccg

SEQ ID NO: 18047 - DNA, 30 bp, Artificial Sequence
  Description of Artificial Sequence: Synthetic oligonucleotide
atgaggtatttcaccacatccgtctcccgg

SEQ ID NO: 18048 - DNA, 29 bp, Artificial Sequence
  Description of Artificial Sequence: Synthetic oligonucleotide
tgaggtatttcaccacatccgtctcccgg

SEQ ID NO: 18049 - DNA, 28 bp, Artificial Sequence
  Description of Artificial Sequence: Synthetic oligonucleotide
gaggtatttcaccacatccgtctcccgg

SEQ ID NO: 18050 - DNA, 28 bp, Artificial Sequence
  Description of Artificial Sequence: Synthetic oligonucleotide
aggtatttcaccacatccgtctcccggc

SEQ ID NO: 18051 - DNA, 27 bp, Artificial Sequence
  Description of Artificial Sequence: Synthetic oligonucleotide
ggtatttcaccacatccgtctcccggc

SEQ ID NO: 18052 - DNA, 27 bp, Artificial Sequence
  Description of Artificial Sequence: Synthetic oligonucleotide
gtatttcaccacatccgtctcccggcc

SEQ ID NO: 18053 - DNA, 27 bp, Artificial Sequence
  Description of Artificial Sequence: Synthetic oligonucleotide
tatttcaccacatccgtctcccggccc

SEQ ID NO: 18054 - DNA, 26 bp, Artificial Sequence
  Description of Artificial Sequence: Synthetic oligonucleotide
atttcaccacatccgtctcccggccc

SEQ ID NO: 18055 - DNA, 25 bp, Artificial Sequence
  Description of Artificial Sequence: Synthetic oligonucleotide
tttcaccacatccgtctcccggccc

SEQ ID NO: 18056 - DNA, 24 bp, Artificial Sequence
  Description of Artificial Sequence: Synthetic oligonucleotide
ttcaccacatccgtctcccggccc

SEQ ID NO: 18057 - DNA, 23 bp, Artificial Sequence
  Description of Artificial Sequence: Synthetic oligonucleotide
tcaccacatccgtctcccggccc

SEQ ID NO: 18058 - DNA, 22 bp, Artificial Sequence
  Description of Artificial Sequence: Synthetic oligonucleotide
caccacatccgtctcccggccc

SEQ ID NO: 18059 - DNA, 22 bp, Artificial Sequence
  Description of Artificial Sequence: Synthetic oligonucleotide
accacatccgtctcccggcccg

SEQ ID NO: 18060 - DNA, 21 bp, Artificial Sequence
  Description of Artificial Sequence: Synthetic oligonucleotide
ccacatccgtctcccggcccg

SEQ ID NO: 18061 - DNA, 21 bp, Artificial Sequence
  Description of Artificial Sequence: Synthetic oligonucleotide
cacatccgtctcccggcccgg

SEQ ID NO: 18062 - DNA, 21 bp, Artificial Sequence
  Description of Artificial Sequence: Synthetic oligonucleotide
acatccgtctcccggcccggc

SEQ ID NO: 18063 - DNA, 20 bp, Artificial Sequence
  Description of Artificial Sequence: Synthetic oligonucleotide
catccgtctcccggcccggc

SEQ ID NO: 18064 - DNA, 20 bp, Artificial Sequence
  Description of Artificial Sequence: Synthetic oligonucleotide
atccgtctcccggcccggcc

SEQ ID NO: 18065 - DNA, 20 bp, Artificial Sequence
  Description of Artificial Sequence: Synthetic oligonucleotide
tccgtctcccggcccggcct

SEQ ID NO: 18066 - DNA, 20 bp, Artificial Sequence
  Description of Artificial Sequence: Synthetic oligonucleotide
ccgtctcccggcccggcctt

SEQ ID NO: 18067 - DNA, 20 bp, Artificial Sequence
  Description of Artificial Sequence: Synthetic oligonucleotide
cgtctcccggcccggccgtt

SEQ ID NO: 18068 - DNA, 20 bp, Artificial Sequence
  Description of Artificial Sequence: Synthetic oligonucleotide
gtctcccggcccggccgctt

SEQ ID NO: 18069 - DNA, 20 bp, Artificial Sequence
  Description of Artificial Sequence: Synthetic oligonucleotide
tctcccggcccggccgcgtt

SEQ ID NO: 18070 - DNA, 20 bp, Artificial Sequence
  Description of Artificial Sequence: Synthetic oligonucleotide
ctcccggcccggccgcgttt

SEQ ID NO: 18071 - DNA, 30 bp, Artificial Sequence
  Description of Artificial Sequence: Synthetic oligonucleotide
gccggttctcacaccatccagatgatgtac

SEQ ID NO: 18072 - DNA, 30 bp, Artificial Sequence
  Description of Artificial Sequence: Synthetic oligonucleotide
ccggttctcacaccatccagatgatgtacg

SEQ ID NO: 18073 - DNA, 30 bp, Artificial Sequence
  Description of Artificial Sequence: Synthetic oligonucleotide
cggttctcacaccatccagatgatgtacgg

SEQ ID NO: 18074 - DNA, 30 bp, Artificial Sequence
  Description of Artificial Sequence: Synthetic oligonucleotide
ggttctcacaccatccagatgatgtacggc

SEQ ID NO: 18075 - DNA, 31 bp, Artificial Sequence
  Description of Artificial Sequence: Synthetic oligonucleotide
gttctcacaccatccagatgatgtacggctg

SEQ ID NO: 18076 - DNA, 31 bp, Artificial Sequence
  Description of Artificial Sequence: Synthetic oligonucleotide
ttctcacaccatccagatgatgtacggctgc

SEQ ID NO: 18077 - DNA, 30 bp, Artificial Sequence
  Description of Artificial Sequence: Synthetic oligonucleotide
tctcacaccatccagatgatgtacggctgc

SEQ ID NO: 18078 - DNA, 29 bp, Artificial Sequence
  Description of Artificial Sequence: Synthetic oligonucleotide
ctcacaccatccagatgatgtacggctgc

SEQ ID NO: 18079 - DNA, 29 bp, Artificial Sequence
  Description of Artificial Sequence: Synthetic oligonucleotide
tcacaccatccagatgatgtacggctgcg

SEQ ID NO: 18080 - DNA, 28 bp, Artificial Sequence
  Description of Artificial Sequence: Synthetic oligonucleotide
cacaccatccagatgatgtacggctgcg

SEQ ID NO: 18081 - DNA, 29 bp, Artificial Sequence
  Description of Artificial Sequence: Synthetic oligonucleotide
acaccatccagatgatgtacggctgcgac

SEQ ID NO: 18082 - DNA, 28 bp, Artificial Sequence
  Description of Artificial Sequence: Synthetic oligonucleotide
caccatccagatgatgtacggctgcgac

SEQ ID NO: 18083 - DNA, 28 bp, Artificial Sequence
  Description of Artificial Sequence: Synthetic oligonucleotide
accatccagatgatgtacggctgcgacg

SEQ ID NO: 18084 - DNA, 27 bp, Artificial Sequence
  Description of Artificial Sequence: Synthetic oligonucleotide
ccatccagatgatgtacggctgcgacg

SEQ ID NO: 18085 - DNA, 28 bp, Artificial Sequence
  Description of Artificial Sequence: Synthetic oligonucleotide
catccagatgatgtacggctgcgacgtg

SEQ ID NO: 18086 - DNA, 28 bp, Artificial Sequence
  Description of Artificial Sequence: Synthetic oligonucleotide
atccagatgatgtacggctgcgacgtgg

SEQ ID NO: 18087 - DNA, 27 bp, Artificial Sequence
  Description of Artificial Sequence: Synthetic oligonucleotide
tccagatgatgtacggctgcgacgtgg

SEQ ID NO: 18088 - DNA, 26 bp, Artificial Sequence
  Description of Artificial Sequence: Synthetic oligonucleotide
ccagatgatgtacggctgcgacgtgg

SEQ ID NO: 18089 - DNA, 26 bp, Artificial Sequence
  Description of Artificial Sequence: Synthetic oligonucleotide
cagatgatgtacggctgcgacgtggg

SEQ ID NO: 18090 - DNA, 27 bp, Artificial Sequence
  Description of Artificial Sequence: Synthetic oligonucleotide
agatgatgtacggctgcgacgtggggt

SEQ ID NO: 18091 - DNA, 26 bp, Artificial Sequence
  Description of Artificial Sequence: Synthetic oligonucleotide
gatgatgtacggctgcgacgtggggt

SEQ ID NO: 18092 - DNA, 26 bp, Artificial Sequence
  Description of Artificial Sequence: Synthetic oligonucleotide
atgatgtacggctgcgacgtggggtc

SEQ ID NO: 18093 - DNA, 25 bp, Artificial Sequence
  Description of Artificial Sequence: Synthetic oligonucleotide
tgatgtacggctgcgacgtggggtc

SEQ ID NO: 18094 - DNA, 24 bp, Artificial Sequence
  Description of Artificial Sequence: Synthetic oligonucleotide
gatgtacggctgcgacgtggggtc

SEQ ID NO: 18095 - DNA, 24 bp, Artificial Sequence
  Description of Artificial Sequence: Synthetic oligonucleotide
atgtacggctgcgacgtggggtcg

SEQ ID NO: 18096 - DNA, 23 bp, Artificial Sequence
  Description of Artificial Sequence: Synthetic oligonucleotide
tgtacggctgcgacgtggggtcg

SEQ ID NO: 18097 - DNA, 22 bp, Artificial Sequence
  Description of Artificial Sequence: Synthetic oligonucleotide
gtacggctgcgacgtggggtcg

SEQ ID NO: 18098 - DNA, 23 bp, Artificial Sequence
  Description of Artificial Sequence: Synthetic oligonucleotide
tacggctgcgacgtggggtcgga

SEQ ID NO: 18099 - DNA, 22 bp, Artificial Sequence
  Description of Artificial Sequence: Synthetic oligonucleotide
acggctgcgacgtggggtcgga

SEQ ID NO: 18100 - DNA, 21 bp, Artificial Sequence
  Description of Artificial Sequence: Synthetic oligonucleotide
cggctgcgacgtggggtcgga

SEQ ID NO: 18101 - DNA, 26 bp, Artificial Sequence
  Description of Artificial Sequence: Synthetic oligonucleotide
cggagtattgggacctgcagacacgg

SEQ ID NO: 18102 - DNA, 27 bp, Artificial Sequence
  Description of Artificial Sequence: Synthetic oligonucleotide
ggagtattgggacctgcagacacggca

SEQ ID NO: 18103 - DNA, 28 bp, Artificial Sequence
  Description of Artificial Sequence: Synthetic oligonucleotide
gagtattgggacctgcagacacggcatg

SEQ ID NO: 18104 - DNA, 29 bp, Artificial Sequence
  Description of Artificial Sequence: Synthetic oligonucleotide
agtattgggacctgcagacacggcatgtg

SEQ ID NO: 18105 - DNA, 28 bp, Artificial Sequence
  Description of Artificial Sequence: Synthetic oligonucleotide
gtattgggacctgcagacacggcatgtg

SEQ ID NO: 18106 - DNA, 30 bp, Artificial Sequence
  Description of Artificial Sequence: Synthetic oligonucleotide
tattgggacctgcagacacggcatgtgaag

SEQ ID NO: 18107 - DNA, 29 bp, Artificial Sequence
  Description of Artificial Sequence: Synthetic oligonucleotide
attgggacctgcagacacggcatgtgaag

SEQ ID NO: 18108 - DNA, 28 bp, Artificial Sequence
  Description of Artificial Sequence: Synthetic oligonucleotide
ttgggacctgcagacacggcatgtgaag

SEQ ID NO: 18109 - DNA, 27 bp, Artificial Sequence
  Description of Artificial Sequence: Synthetic oligonucleotide
tgggacctgcagacacggcatgtgaag

SEQ ID NO: 18110 - DNA, 26 bp, Artificial Sequence
  Description of Artificial Sequence: Synthetic oligonucleotide
gggacctgcagacacggcatgtgaag

SEQ ID NO: 18111 - DNA, 26 bp, Artificial Sequence
  Description of Artificial Sequence: Synthetic oligonucleotide
ggacctgcagacacggcatgtgaagg

SEQ ID NO: 18112 - DNA, 26 bp, Artificial Sequence
  Description of Artificial Sequence: Synthetic oligonucleotide
gacctgcagacacggcatgtgaaggc

SEQ ID NO: 18113 - DNA, 26 bp, Artificial Sequence
  Description of Artificial Sequence: Synthetic oligonucleotide
acctgcagacacggcatgtgaaggcc

SEQ ID NO: 18114 - DNA, 25 bp, Artificial Sequence
  Description of Artificial Sequence: Synthetic oligonucleotide
cctgcagacacggcatgtgaaggcc

SEQ ID NO: 18115 - DNA, 26 bp, Artificial Sequence
  Description of Artificial Sequence: Synthetic oligonucleotide
ctgcagacacggcatgtgaaggccca

SEQ ID NO: 18116 - DNA, 27 bp, Artificial Sequence
  Description of Artificial Sequence: Synthetic oligonucleotide
tgcagacacggcatgtgaaggcccagt

SEQ ID NO: 18117 - DNA, 26 bp, Artificial Sequence
  Description of Artificial Sequence: Synthetic oligonucleotide
gcagacacggcatgtgaaggcccagt

SEQ ID NO: 18118 - DNA, 27 bp, Artificial Sequence
  Description of Artificial Sequence: Synthetic oligonucleotide
cagacacggcatgtgaaggcccagtca

SEQ ID NO: 18119 - DNA, 27 bp, Artificial Sequence
  Description of Artificial Sequence: Synthetic oligonucleotide
agacacggcatgtgaaggcccagtcac

SEQ ID NO: 18120 - DNA, 27 bp, Artificial Sequence
  Description of Artificial Sequence: Synthetic oligonucleotide
gacacggcatgtgaaggcccagtcaca

SEQ ID NO: 18121 - DNA, 27 bp, Artificial Sequence
  Description of Artificial Sequence: Synthetic oligonucleotide
acacggcatgtgaaggcccagtcacag

SEQ ID NO: 18122 - DNA, 27 bp, Artificial Sequence
  Description of Artificial Sequence: Synthetic oligonucleotide
cacggcatgtgaaggcccagtcacaga

SEQ ID NO: 18123 - DNA, 27 bp, Artificial Sequence
  Description of Artificial Sequence: Synthetic oligonucleotide
acggcatgtgaaggcccagtcacagac

SEQ ID NO: 18124 - DNA, 27 bp, Artificial Sequence
  Description of Artificial Sequence: Synthetic oligonucleotide
cggcatgtgaaggcccagtcacagact

SEQ ID NO: 18125 - DNA, 27 bp, Artificial Sequence
  Description of Artificial Sequence: Synthetic oligonucleotide
ggcatgtgaaggcccagtcacagactg

SEQ ID NO: 18126 - DNA, 28 bp, Artificial Sequence
  Description of Artificial Sequence: Synthetic oligonucleotide
gcatgtgaaggcccagtcacagactgac

SEQ ID NO: 18127 - DNA, 28 bp, Artificial Sequence
  Description of Artificial Sequence: Synthetic oligonucleotide
catgtgaaggcccagtcacagactgacc

SEQ ID NO: 18128 - DNA, 23 bp, Artificial Sequence
  Description of Artificial Sequence: Synthetic oligonucleotide
aggatggagccgcgggcaccgta

SEQ ID NO: 18129 - DNA, 22 bp, Artificial Sequence
  Description of Artificial Sequence: Synthetic oligonucleotide
ggatggagccgcgggcaccgta

SEQ ID NO: 18130 - DNA, 25 bp, Artificial Sequence
  Description of Artificial Sequence: Synthetic oligonucleotide
gatggagccgcgggcaccgtagata

SEQ ID NO: 18131 - DNA, 26 bp, Artificial Sequence
  Description of Artificial Sequence: Synthetic oligonucleotide
atggagccgcgggcaccgtagataga

SEQ ID NO: 18132 - DNA, 25 bp, Artificial Sequence
  Description of Artificial Sequence: Synthetic oligonucleotide
tggagccgcgggcaccgtagataga

SEQ ID NO: 18133 - DNA, 24 bp, Artificial Sequence
  Description of Artificial Sequence: Synthetic oligonucleotide
ggagccgcgggcaccgtagataga

SEQ ID NO: 18134 - DNA, 24 bp, Artificial Sequence
  Description of Artificial Sequence: Synthetic oligonucleotide
gagccgcgggcaccgtagatagag

SEQ ID NO: 18135 - DNA, 25 bp, Artificial Sequence
  Description of Artificial Sequence: Synthetic oligonucleotide
agccgcgggcaccgtagatagagca

SEQ ID NO: 18136 - DNA, 24 bp, Artificial Sequence
  Description of Artificial Sequence: Synthetic oligonucleotide
gccgcgggcaccgtagatagagca

SEQ ID NO: 18137 - DNA, 24 bp, Artificial Sequence
  Description of Artificial Sequence: Synthetic oligonucleotide
ccgcgggcaccgtagatagagcag

SEQ ID NO: 18138 - DNA, 25 bp, Artificial Sequence
  Description of Artificial Sequence: Synthetic oligonucleotide
cgcgggcaccgtagatagagcagga

SEQ ID NO: 18139 - DNA, 25 bp, Artificial Sequence
  Description of Artificial Sequence: Synthetic oligonucleotide
gcgggcaccgtagatagagcaggag

SEQ ID NO: 18140 - DNA, 25 bp, Artificial Sequence
  Description of Artificial Sequence: Synthetic oligonucleotide
cgggcaccgtagatagagcaggagg

SEQ ID NO: 18141 - DNA, 25 bp, Artificial Sequence
  Description of Artificial Sequence: Synthetic oligonucleotide
gggcaccgtagatagagcaggaggg

SEQ ID NO: 18142 - DNA, 25 bp, Artificial Sequence
  Description of Artificial Sequence: Synthetic oligonucleotide
ggcaccgtagatagagcaggagggg

SEQ ID NO: 18143 - DNA, 25 bp, Artificial Sequence
  Description of Artificial Sequence: Synthetic oligonucleotide
gcaccgtagatagagcaggaggggc

SEQ ID NO: 18144 - DNA, 25 bp, Artificial Sequence
  Description of Artificial Sequence: Synthetic oligonucleotide
caccgtagatagagcaggaggggcc

SEQ ID NO: 18145 - DNA, 25 bp, Artificial Sequence
  Description of Artificial Sequence: Synthetic oligonucleotide
accgtagatagagcaggaggggccg

SEQ ID NO: 18146 - DNA, 24 bp, Artificial Sequence
  Description of Artificial Sequence: Synthetic oligonucleotide
ccgtagatagagcaggaggggccg

SEQ ID NO: 18147 - DNA, 25 bp, Artificial Sequence
  Description of Artificial Sequence: Synthetic oligonucleotide
cgtagatagagcaggaggggccgga

SEQ ID NO: 18148 - DNA, 27 bp, Artificial Sequence
  Description of Artificial Sequence: Synthetic oligonucleotide
gtagatagagcaggaggggccggagta

SEQ ID NO: 18149 - DNA, 29 bp, Artificial Sequence
  Description of Artificial Sequence: Synthetic oligonucleotide
tagatagagcaggaggggccggagtattg

SEQ ID NO: 18150 - DNA, 28 bp, Artificial Sequence
  Description of Artificial Sequence: Synthetic oligonucleotide
agatagagcaggaggggccggagtattg

SEQ ID NO: 18151 - DNA, 29 bp, Artificial Sequence
  Description of Artificial Sequence: Synthetic oligonucleotide
tccgcagatacctggagaacgggaagaag

SEQ ID NO: 18152 - DNA, 28 bp, Artificial Sequence
  Description of Artificial Sequence: Synthetic oligonucleotide
ccgcagatacctggagaacgggaagaag

SEQ ID NO: 18153 - DNA, 29 bp, Artificial Sequence
  Description of Artificial Sequence: Synthetic oligonucleotide
cgcagatacctggagaacgggaagaagac

SEQ ID NO: 18154 - DNA, 29 bp, Artificial Sequence
  Description of Artificial Sequence: Synthetic oligonucleotide
gcagatacctggagaacgggaagaagacg

SEQ ID NO: 18155 - DNA, 29 bp, Artificial Sequence
  Description of Artificial Sequence: Synthetic oligonucleotide
cagatacctggagaacgggaagaagacgc

SEQ ID NO: 18156 - DNA, 30 bp, Artificial Sequence
  Description of Artificial Sequence: Synthetic oligonucleotide
agatacctggagaacgggaagaagacgctg

SEQ ID NO: 18157 - DNA, 29 bp, Artificial Sequence
  Description of Artificial Sequence: Synthetic oligonucleotide
gatacctggagaacgggaagaagacgctg

SEQ ID NO: 18158 - DNA, 29 bp, Artificial Sequence
  Description of Artificial Sequence: Synthetic oligonucleotide
atacctggagaacgggaagaagacgctgc

SEQ ID NO: 18159 - DNA, 28 bp, Artificial Sequence
  Description of Artificial Sequence: Synthetic oligonucleotide
tacctggagaacgggaagaagacgctgc

SEQ ID NO: 18160 - DNA, 27 bp, Artificial Sequence
  Description of Artificial Sequence: Synthetic oligonucleotide
acctggagaacgggaagaagacgctgc

SEQ ID NO: 18161 - DNA, 27 bp, Artificial Sequence
  Description of Artificial Sequence: Synthetic oligonucleotide
cctggagaacgggaagaagacgctgca

SEQ ID NO: 18162 - DNA, 27 bp, Artificial Sequence
  Description of Artificial Sequence: Synthetic oligonucleotide
ctggagaacgggaagaagacgctgcag

SEQ ID NO: 18163 - DNA, 27 bp, Artificial Sequence
  Description of Artificial Sequence: Synthetic oligonucleotide
tggagaacgggaagaagacgctgcagc

SEQ ID NO: 18164 - DNA, 26 bp, Artificial Sequence
  Description of Artificial Sequence: Synthetic oligonucleotide
ggagaacgggaagaagacgctgcagc

SEQ ID NO: 18165 - DNA, 26 bp, Artificial Sequence
  Description of Artificial Sequence: Synthetic oligonucleotide
gagaacgggaagaagacgctgcagcg

SEQ ID NO: 18166 - DNA, 27 bp, Artificial Sequence
  Description of Artificial Sequence: Synthetic oligonucleotide
agaacgggaagaagacgctgcagcgca

SEQ ID NO: 18167 - DNA, 26 bp, Artificial Sequence
  Description of Artificial Sequence: Synthetic oligonucleotide
gaacgggaagaagacgctgcagcgca

SEQ ID NO: 18168 - DNA, 26 bp, Artificial Sequence
  Description of Artificial Sequence: Synthetic oligonucleotide
aacgggaagaagacgctgcagcgcac

SEQ ID NO: 18169 - DNA, 25 bp, Artificial Sequence
  Description of Artificial Sequence: Synthetic oligonucleotide
acgggaagaagacgctgcagcgcac

SEQ ID NO: 18170 - DNA, 24 bp, Artificial Sequence
  Description of Artificial Sequence: Synthetic oligonucleotide
cgggaagaagacgctgcagcgcac

SEQ ID NO: 18171 - DNA, 24 bp, Artificial Sequence
  Description of Artificial Sequence: Synthetic oligonucleotide
gggaagaagacgctgcagcgcacg

SEQ ID NO: 18172 - DNA, 24 bp, Artificial Sequence
  Description of Artificial Sequence: Synthetic oligonucleotide
ggaagaagacgctgcagcgcacgg

SEQ ID NO: 18173 - DNA, 20 bp, Artificial Sequence
  Description of Artificial Sequence: Synthetic oligonucleotide
cgcggcggacatggcggctc

SEQ ID NO: 18174 - DNA, 20 bp, Artificial Sequence
  Description of Artificial Sequence: Synthetic oligonucleotide
gcggcggacatggcggctcc

SEQ ID NO: 18175 - DNA, 22 bp, Artificial Sequence
  Description of Artificial Sequence: Synthetic oligonucleotide
cggcggacatggcggctccgat

SEQ ID NO: 18176 - DNA, 23 bp, Artificial Sequence
  Description of Artificial Sequence: Synthetic oligonucleotide
ggcggacatggcggctccgatca

SEQ ID NO: 18177 - DNA, 23 bp, Artificial Sequence
  Description of Artificial Sequence: Synthetic oligonucleotide
gcggacatggcggctccgatcac

SEQ ID NO: 18178 - DNA, 23 bp, Artificial Sequence
  Description of Artificial Sequence: Synthetic oligonucleotide
cggacatggcggctccgatcacc

SEQ ID NO: 18179 - DNA, 24 bp, Artificial Sequence
  Description of Artificial Sequence: Synthetic oligonucleotide
ggacatggcggctccgatcaccca

SEQ ID NO: 18180 - DNA, 24 bp, Artificial Sequence
  Description of Artificial Sequence: Synthetic oligonucleotide
gacatggcggctccgatcacccag

SEQ ID NO: 18181 - DNA, 24 bp, Artificial Sequence
  Description of Artificial Sequence: Synthetic oligonucleotide
acatggcggctccgatcacccagc

SEQ ID NO: 18182 - DNA, 23 bp, Artificial Sequence
  Description of Artificial Sequence: Synthetic oligonucleotide
catggcggctccgatcacccagc

SEQ ID NO: 18183 - DNA, 23 bp, Artificial Sequence
  Description of Artificial Sequence: Synthetic oligonucleotide
atggcggctccgatcacccagcg

SEQ ID NO: 18184 - DNA, 22 bp, Artificial Sequence
  Description of Artificial Sequence: Synthetic oligonucleotide
tggcggctccgatcacccagcg

SEQ ID NO: 18185 - DNA, 21 bp, Artificial Sequence
  Description of Artificial Sequence: Synthetic oligonucleotide
ggcggctccgatcacccagcg

SEQ ID NO: 18186 - DNA, 23 bp, Artificial Sequence
  Description of Artificial Sequence: Synthetic oligonucleotide
gcggctccgatcacccagcgcaa

SEQ ID NO: 18187 - DNA, 24 bp, Artificial Sequence
  Description of Artificial Sequence: Synthetic oligonucleotide
cggctccgatcacccagcgcaagt

SEQ ID NO: 18188 - DNA, 24 bp, Artificial Sequence
  Description of Artificial Sequence: Synthetic oligonucleotide
ggctccgatcacccagcgcaagtg

SEQ ID NO: 18189 - DNA, 24 bp, Artificial Sequence
  Description of Artificial Sequence: Synthetic oligonucleotide
gctccgatcacccagcgcaagtgg

SEQ ID NO: 18190 - DNA, 25 bp, Artificial Sequence
  Description of Artificial Sequence: Synthetic oligonucleotide
ctccgatcacccagcgcaagtggga

SEQ ID NO: 18191 - DNA, 25 bp, Artificial Sequence
  Description of Artificial Sequence: Synthetic oligonucleotide
tccgatcacccagcgcaagtgggag

SEQ ID NO: 18192 - DNA, 24 bp, Artificial Sequence
  Description of Artificial Sequence: Synthetic oligonucleotide
ccgatcacccagcgcaagtgggag

SEQ ID NO: 18193 - DNA, 24 bp, Artificial Sequence
  Description of Artificial Sequence: Synthetic oligonucleotide
cgatcacccagcgcaagtgggagg

SEQ ID NO: 18194 - DNA, 23 bp, Artificial Sequence
  Description of Artificial Sequence: Synthetic oligonucleotide
cagaggatggagccgcgggcact

SEQ ID NO: 18195 - DNA, 24 bp, Artificial Sequence
  Description of Artificial Sequence: Synthetic oligonucleotide
agaggatggagccgcgggcactgt

SEQ ID NO: 18196 - DNA, 23 bp, Artificial Sequence
  Description of Artificial Sequence: Synthetic oligonucleotide
gaggatggagccgcgggcactgt

SEQ ID NO: 18197 - DNA, 23 bp, Artificial Sequence
  Description of Artificial Sequence: Synthetic oligonucleotide
aggatggagccgcgggcactgtg

SEQ ID NO: 18198 - DNA, 22 bp, Artificial Sequence
  Description of Artificial Sequence: Synthetic oligonucleotide
ggatggagccgcgggcactgtg

SEQ ID NO: 18199 - DNA, 25 bp, Artificial Sequence
  Description of Artificial Sequence: Synthetic oligonucleotide
gatggagccgcgggcactgtggata

SEQ ID NO: 18200 - DNA, 26 bp, Artificial Sequence
  Description of Artificial Sequence: Synthetic oligonucleotide
atggagccgcgggcactgtggataga

SEQ ID NO: 18201 - DNA, 25 bp, Artificial Sequence
  Description of Artificial Sequence: Synthetic oligonucleotide
tggagccgcgggcactgtggataga

SEQ ID NO: 18202 - DNA, 24 bp, Artificial Sequence
  Description of Artificial Sequence: Synthetic oligonucleotide
ggagccgcgggcactgtggataga

SEQ ID NO: 18203 - DNA, 24 bp, Artificial Sequence
  Description of Artificial Sequence: Synthetic oligonucleotide
gagccgcgggcactgtggatagag

SEQ ID NO: 18204 - DNA, 25 bp, Artificial Sequence
  Description of Artificial Sequence: Synthetic oligonucleotide
agccgcgggcactgtggatagagca

SEQ ID NO: 18205 - DNA, 24 bp, Artificial Sequence
  Description of Artificial Sequence: Synthetic oligonucleotide
gccgcgggcactgtggatagagca

SEQ ID NO: 18206 - DNA, 24 bp, Artificial Sequence
  Description of Artificial Sequence: Synthetic oligonucleotide
ccgcgggcactgtggatagagcag

SEQ ID NO: 18207 - DNA, 25 bp, Artificial Sequence
  Description of Artificial Sequence: Synthetic oligonucleotide
cgcgggcactgtggatagagcagga

SEQ ID NO: 18208 - DNA, 25 bp, Artificial Sequence
  Description of Artificial Sequence: Synthetic oligonucleotide
gcgggcactgtggatagagcaggag

SEQ ID NO: 18209 - DNA, 25 bp, Artificial Sequence
  Description of Artificial Sequence: Synthetic oligonucleotide
cgggcactgtggatagagcaggagg

SEQ ID NO: 18210 - DNA, 25 bp, Artificial Sequence
  Description of Artificial Sequence: Synthetic oligonucleotide
gggcactgtggatagagcaggaggg

SEQ ID NO: 18211 - DNA, 25 bp, Artificial Sequence
  Description of Artificial Sequence: Synthetic oligonucleotide
ggcactgtggatagagcaggagggg

SEQ ID NO: 18212 - DNA, 25 bp, Artificial Sequence
  Description of Artificial Sequence: Synthetic oligonucleotide
gcactgtggatagagcaggaggggc

SEQ ID NO: 18213 - DNA, 25 bp, Artificial Sequence
  Description of Artificial Sequence: Synthetic oligonucleotide
cactgtggatagagcaggaggggcc

SEQ ID NO: 18214 - DNA, 25 bp, Artificial Sequence
  Description of Artificial Sequence: Synthetic oligonucleotide
actgtggatagagcaggaggggccg

SEQ ID NO: 18215 - DNA, 25 bp, Artificial Sequence
  Description of Artificial Sequence: Synthetic oligonucleotide
cgggcaccgtggatagagcaggaga

SEQ ID NO: 18216 - DNA, 25 bp, Artificial Sequence
  Description of Artificial Sequence: Synthetic oligonucleotide
gggcaccgtggatagagcaggagag

SEQ ID NO: 18217 - DNA, 25 bp, Artificial Sequence
  Description of Artificial Sequence: Synthetic oligonucleotide
ggcaccgtggatagagcaggagagg

SEQ ID NO: 18218 - DNA, 25 bp, Artificial Sequence
  Description of Artificial Sequence: Synthetic oligonucleotide
gcaccgtggatagagcaggagaggc

SEQ ID NO: 18219 - DNA, 26 bp, Artificial Sequence
  Description of Artificial Sequence: Synthetic oligonucleotide
caccgtggatagagcaggagaggcct

SEQ ID NO: 18220 - DNA, 27 bp, Artificial Sequence
  Description of Artificial Sequence: Synthetic oligonucleotide
accgtggatagagcaggagaggcctga

SEQ ID NO: 18221 - DNA, 21 bp, Artificial Sequence
  Description of Artificial Sequence: Synthetic oligonucleotide
ttggaccgcggcggacgtggc

SEQ ID NO: 18222 - DNA, 20 bp, Artificial Sequence
  Description of Artificial Sequence: Synthetic oligonucleotide
tggaccgcggcggacgtggc

SEQ ID NO: 18223 - DNA, 20 bp, Artificial Sequence
  Description of Artificial Sequence: Synthetic oligonucleotide
ggaccgcggcggacgtggct

SEQ ID NO: 18224 - DNA, 20 bp, Artificial Sequence
  Description of Artificial Sequence: Synthetic oligonucleotide
gaccgcggcggacgtggcgt

SEQ ID NO: 18225 - DNA, 20 bp, Artificial Sequence
  Description of Artificial Sequence: Synthetic oligonucleotide
accgcggcggacgtggcggt

SEQ ID NO: 18226 - DNA, 20 bp, Artificial Sequence
  Description of Artificial Sequence: Synthetic oligonucleotide
ccgcggcggacgtggcggtt

SEQ ID NO: 18227 - DNA, 20 bp, Artificial Sequence
  Description of Artificial Sequence: Synthetic oligonucleotide
cgcggcggacgtggcggctt

SEQ ID NO: 18228 - DNA, 20 bp, Artificial Sequence
  Description of Artificial Sequence: Synthetic oligonucleotide
gcggcggacgtggcggctca

SEQ ID NO: 18229 - DNA, 22 bp, Artificial Sequence
  Description of Artificial Sequence: Synthetic oligonucleotide
cggcggacgtggcggctcagat

SEQ ID NO: 18230 - DNA, 23 bp, Artificial Sequence
  Description of Artificial Sequence: Synthetic oligonucleotide
ggcggacgtggcggctcagatca

SEQ ID NO: 18231 - DNA, 23 bp, Artificial Sequence
  Description of Artificial Sequence: Synthetic oligonucleotide
gcggacgtggcggctcagatcac

SEQ ID NO: 18232 - DNA, 23 bp, Artificial Sequence
  Description of Artificial Sequence: Synthetic oligonucleotide
cggacgtggcggctcagatcacc

SEQ ID NO: 18233 - DNA, 24 bp, Artificial Sequence
  Description of Artificial Sequence: Synthetic oligonucleotide
ggacgtggcggctcagatcaccca

SEQ ID NO: 18234 - DNA, 24 bp, Artificial Sequence
  Description of Artificial Sequence: Synthetic oligonucleotide
gacgtggcggctcagatcacccag

SEQ ID NO: 18235 - DNA, 24 bp, Artificial Sequence
  Description of Artificial Sequence: Synthetic oligonucleotide
acgtggcggctcagatcacccagc

SEQ ID NO: 18236 - DNA, 23 bp, Artificial Sequence
  Description of Artificial Sequence: Synthetic oligonucleotide
cgtggcggctcagatcacccagc

SEQ ID NO: 18237 - DNA, 23 bp, Artificial Sequence
  Description of Artificial Sequence: Synthetic oligonucleotide
gtggcggctcagatcacccagcg

SEQ ID NO: 18238 - DNA, 31 bp, Artificial Sequence
  Description of Artificial Sequence: Synthetic oligonucleotide
tacgacggcaaggattacatcgccttgaacc

SEQ ID NO: 18239 - DNA, 30 bp, Artificial Sequence
  Description of Artificial Sequence: Synthetic oligonucleotide
acgacggcaaggattacatcgccttgaacc

SEQ ID NO: 18240 - DNA, 29 bp, Artificial Sequence
  Description of Artificial Sequence: Synthetic oligonucleotide
cgacggcaaggattacatcgccttgaacc

SEQ ID NO: 18241 - DNA, 30 bp, Artificial Sequence
  Description of Artificial Sequence: Synthetic oligonucleotide
gacggcaaggattacatcgccttgaaccag

SEQ ID NO: 18242 - DNA, 30 bp, Artificial Sequence
  Description of Artificial Sequence: Synthetic oligonucleotide
acggcaaggattacatcgccttgaaccagg

SEQ ID NO: 18243 - DNA, 29 bp, Artificial Sequence
  Description of Artificial Sequence: Synthetic oligonucleotide
cggcaaggattacatcgccttgaaccagg

SEQ ID NO: 18244 - DNA, 30 bp, Artificial Sequence
  Description of Artificial Sequence: Synthetic oligonucleotide
ggcaaggattacatcgccttgaaccaggac

SEQ ID NO: 18245 - DNA, 30 bp, Artificial Sequence
  Description of Artificial Sequence: Synthetic oligonucleotide
gcaaggattacatcgccttgaaccaggacc

SEQ ID NO: 18246 - DNA, 31 bp, Artificial Sequence
  Description of Artificial Sequence: Synthetic oligonucleotide
caaggattacatcgccttgaaccaggacctg

SEQ ID NO: 18247 - DNA, 31 bp, Artificial Sequence
  Description of Artificial Sequence: Synthetic oligonucleotide
aaggattacatcgccttgaaccaggacctgc

SEQ ID NO: 18248 - DNA, 30 bp, Artificial Sequence
  Description of Artificial Sequence: Synthetic oligonucleotide
aggattacatcgccttgaaccaggacctgc

SEQ ID NO: 18249 - DNA, 29 bp, Artificial Sequence
  Description of Artificial Sequence: Synthetic oligonucleotide
ggattacatcgccttgaaccaggacctgc

SEQ ID NO: 18250 - DNA, 29 bp, Artificial Sequence
  Description of Artificial Sequence: Synthetic oligonucleotide
gattacatcgccttgaaccaggacctgcg

SEQ ID NO: 18251 - DNA, 29 bp, Artificial Sequence
  Description of Artificial Sequence: Synthetic oligonucleotide
attacatcgccttgaaccaggacctgcgc

SEQ ID NO: 18252 - DNA, 28 bp, Artificial Sequence
  Description of Artificial Sequence: Synthetic oligonucleotide
ttacatcgccttgaaccaggacctgcgc

SEQ ID NO: 18253 - DNA, 27 bp, Artificial Sequence
  Description of Artificial Sequence: Synthetic oligonucleotide
tacatcgccttgaaccaggacctgcgc

SEQ ID NO: 18254 - DNA, 27 bp, Artificial Sequence
  Description of Artificial Sequence: Synthetic oligonucleotide
acatcgccttgaaccaggacctgcgct

SEQ ID NO: 18255 - DNA, 26 bp, Artificial Sequence
  Description of Artificial Sequence: Synthetic oligonucleotide
catcgccttgaaccaggacctgcgct

SEQ ID NO: 18256 - DNA, 27 bp, Artificial Sequence
  Description of Artificial Sequence: Synthetic oligonucleotide
atcgccttgaaccaggacctgcgctct

SEQ ID NO: 18257 - DNA, 27 bp, Artificial Sequence
  Description of Artificial Sequence: Synthetic oligonucleotide
tcgccttgaaccaggacctgcgctctt

SEQ ID NO: 18258 - DNA, 26 bp, Artificial Sequence
  Description of Artificial Sequence: Synthetic oligonucleotide
cgccttgaaccaggacctgcgctctt

SEQ ID NO: 18259 - DNA, 26 bp, Artificial Sequence
  Description of Artificial Sequence: Synthetic oligonucleotide
gccttgaaccaggacctgcgctcttg

SEQ ID NO: 18260 - DNA, 27 bp, Artificial Sequence
  Description of Artificial Sequence: Synthetic oligonucleotide
ccttgaaccaggacctgcgctcttgga

SEQ ID NO: 18261 - DNA, 27 bp, Artificial Sequence
  Description of Artificial Sequence: Synthetic oligonucleotide
cttgaaccaggacctgcgctcttggac

SEQ ID NO: 18262 - DNA, 27 bp, Artificial Sequence
  Description of Artificial Sequence: Synthetic oligonucleotide
ttgaaccaggacctgcgctcttggacc

SEQ ID NO: 18263 - DNA, 20 bp, Artificial Sequence
  Description of Artificial Sequence: Synthetic oligonucleotide
ggcccggccgcggggagatt

SEQ ID NO: 18264 - DNA, 20 bp, Artificial Sequence
  Description of Artificial Sequence: Synthetic oligonucleotide
gcccggccgcggggagactt

SEQ ID NO: 18265 - DNA, 20 bp, Artificial Sequence
  Description of Artificial Sequence: Synthetic oligonucleotide
cccggccgcggggagacctt

SEQ ID NO: 18266 - DNA, 20 bp, Artificial Sequence
  Description of Artificial Sequence: Synthetic oligonucleotide
ccggccgcggggagaccctt

SEQ ID NO: 18267 - DNA, 20 bp, Artificial Sequence
  Description of Artificial Sequence: Synthetic oligonucleotide
cggccgcggggagacccgtt

SEQ ID NO: 18268 - DNA, 20 bp, Artificial Sequence
  Description of Artificial Sequence: Synthetic oligonucleotide
ggccgcggggagacccgctt

SEQ ID NO: 18269 - DNA, 22 bp, Artificial Sequence
  Description of Artificial Sequence: Synthetic oligonucleotide
gccgcggggagacccgcttcat

SEQ ID NO: 18270 - DNA, 22 bp, Artificial Sequence
  Description of Artificial Sequence: Synthetic oligonucleotide
ccgcggggagacccgcttcatc

SEQ ID NO: 18271 - DNA, 22 bp, Artificial Sequence
  Description of Artificial Sequence: Synthetic oligonucleotide
cgcggggagacccgcttcatcg

SEQ ID NO: 18272 - DNA, 22 bp, Artificial Sequence
  Description of Artificial Sequence: Synthetic oligonucleotide
gcggggagacccgcttcatcgc

SEQ ID NO: 18273 - DNA, 22 bp, Artificial Sequence
  Description of Artificial Sequence: Synthetic oligonucleotide
cggggagacccgcttcatcgcc

SEQ ID NO: 18274 - DNA, 23 bp, Artificial Sequence
  Description of Artificial Sequence: Synthetic oligonucleotide
ggggagacccgcttcatcgccgt

SEQ ID NO: 18275 - DNA, 23 bp, Artificial Sequence
  Description of Artificial Sequence: Synthetic oligonucleotide
gggagacccgcttcatcgccgtg

SEQ ID NO: 18276 - DNA, 23 bp, Artificial Sequence
  Description of Artificial Sequence: Synthetic oligonucleotide
ggagacccgcttcatcgccgtgg

SEQ ID NO: 18277 - DNA, 23 bp, Artificial Sequence
  Description of Artificial Sequence: Synthetic oligonucleotide
gagacccgcttcatcgccgtggg

SEQ ID NO: 18278 - DNA, 25 bp, Artificial Sequence
  Description of Artificial Sequence: Synthetic oligonucleotide
agacccgcttcatcgccgtgggcta

SEQ ID NO: 18279 - DNA, 24 bp, Artificial Sequence
  Description of Artificial Sequence: Synthetic oligonucleotide
gacccgcttcatcgccgtgggcta

SEQ ID NO: 18280 - DNA, 24 bp, Artificial Sequence
  Description of Artificial Sequence: Synthetic oligonucleotide
acccgcttcatcgccgtgggctac

SEQ ID NO: 18281 - DNA, 27 bp, Artificial Sequence
  Description of Artificial Sequence: Synthetic oligonucleotide
ctgcagacacggaatgtgaaggcccac

SEQ ID NO: 18282 - DNA, 28 bp, Artificial Sequence
  Description of Artificial Sequence: Synthetic oligonucleotide
tgcagacacggaatgtgaaggcccactc

SEQ ID NO: 18283 - DNA, 27 bp, Artificial Sequence
  Description of Artificial Sequence: Synthetic oligonucleotide
gcagacacggaatgtgaaggcccactc

SEQ ID NO: 18284 - DNA, 28 bp, Artificial Sequence
  Description of Artificial Sequence: Synthetic oligonucleotide
cagacacggaatgtgaaggcccactcac

SEQ ID NO: 18285 - DNA, 20 bp, Artificial Sequence
  Description of Artificial Sequence: Synthetic oligonucleotide
ggccgcggggagcccctctt

SEQ ID NO: 18286 - DNA, 22 bp, Artificial Sequence
  Description of Artificial Sequence: Synthetic oligonucleotide
gccgcggggagcccctcttcat

SEQ ID NO: 18287 - DNA, 22 bp, Artificial Sequence
  Description of Artificial Sequence: Synthetic oligonucleotide
ccgcggggagcccctcttcatc

SEQ ID NO: 18288 - DNA, 22 bp, Artificial Sequence
  Description of Artificial Sequence: Synthetic oligonucleotide
cgcggggagcccctcttcatcg

SEQ ID NO: 18289 - DNA, 22 bp, Artificial Sequence
  Description of Artificial Sequence: Synthetic oligonucleotide
gcggggagcccctcttcatcgc

SEQ ID NO: 18290 - DNA, 22 bp, Artificial Sequence
  Description of Artificial Sequence: Synthetic oligonucleotide
cggggagcccctcttcatcgcc

SEQ ID NO: 18291 - DNA, 23 bp, Artificial Sequence
  Description of Artificial Sequence: Synthetic oligonucleotide
ggggagcccctcttcatcgccgt

SEQ ID NO: 18292 - DNA, 23 bp, Artificial Sequence
  Description of Artificial Sequence: Synthetic oligonucleotide
gggagcccctcttcatcgccgtg

SEQ ID NO: 18293 - DNA, 23 bp, Artificial Sequence
  Description of Artificial Sequence: Synthetic oligonucleotide
ggagcccctcttcatcgccgtgg

SEQ ID NO: 18294 - DNA, 23 bp, Artificial Sequence
  Description of Artificial Sequence: Synthetic oligonucleotide
gagcccctcttcatcgccgtggg

SEQ ID NO: 18295 - DNA, 25 bp, Artificial Sequence
  Description of Artificial Sequence: Synthetic oligonucleotide
agcccctcttcatcgccgtgggcta

SEQ ID NO: 18296 - DNA, 24 bp, Artificial Sequence
  Description of Artificial Sequence: Synthetic oligonucleotide
gcccctcttcatcgccgtgggcta

SEQ ID NO: 18297 - DNA, 24 bp, Artificial Sequence
  Description of Artificial Sequence: Synthetic oligonucleotide
cccctcttcatcgccgtgggctac

SEQ ID NO: 18298 - DNA, 25 bp, Artificial Sequence
  Description of Artificial Sequence: Synthetic oligonucleotide
ccctcttcatcgccgtgggctacgt

SEQ ID NO: 18299 - DNA, 25 bp, Artificial Sequence
  Description of Artificial Sequence: Synthetic oligonucleotide
cctcttcatcgccgtgggctacgtg

SEQ ID NO: 18300 - DNA, 26 bp, Artificial Sequence
  Description of Artificial Sequence: Synthetic oligonucleotide
ctcttcatcgccgtgggctacgtgga

SEQ ID NO: 18301 - DNA, 26 bp, Artificial Sequence
  Description of Artificial Sequence: Synthetic oligonucleotide
tcttcatcgccgtgggctacgtggac

SEQ ID NO: 18302 - DNA, 22 bp, Artificial Sequence
  Description of Artificial Sequence: Synthetic oligonucleotide
cgcaagtgggaggcggcccgtt

SEQ ID NO: 18303 - DNA, 22 bp, Artificial Sequence
  Description of Artificial Sequence: Synthetic oligonucleotide
gcaagtgggaggcggcccgttg

SEQ ID NO: 18304 - DNA, 22 bp, Artificial Sequence
  Description of Artificial Sequence: Synthetic oligonucleotide
caagtgggaggcggcccgttgg

SEQ ID NO: 18305 - DNA, 22 bp, Artificial Sequence
  Description of Artificial Sequence: Synthetic oligonucleotide
aagtgggaggcggcccgttggg

SEQ ID NO: 18306 - DNA, 21 bp, Artificial Sequence
  Description of Artificial Sequence: Synthetic oligonucleotide
agtgggaggcggcccgttggg

SEQ ID NO: 18307 - DNA, 20 bp, Artificial Sequence
  Description of Artificial Sequence: Synthetic oligonucleotide
gtgggaggcggcccgttggg

SEQ ID NO: 18308 - DNA, 20 bp, Artificial Sequence
  Description of Artificial Sequence: Synthetic oligonucleotide
tgggaggcggcccgttgggc

SEQ ID NO: 18309 - DNA, 20 bp, Artificial Sequence
  Description of Artificial Sequence: Synthetic oligonucleotide
gggaggcggcccgttgggct

SEQ ID NO: 18310 - DNA, 20 bp, Artificial Sequence
  Description of Artificial Sequence: Synthetic oligonucleotide
ggaggcggcccgttgggcgt

SEQ ID NO: 18311 - DNA, 20 bp, Artificial Sequence
  Description of Artificial Sequence: Synthetic oligonucleotide
gaggcggcccgttgggcgga

SEQ ID NO: 18312 - DNA, 20 bp, Artificial Sequence
  Description of Artificial Sequence: Synthetic oligonucleotide
aggcggcccgttgggcggag

SEQ ID NO: 18313 - DNA, 20 bp, Artificial Sequence
  Description of Artificial Sequence: Synthetic oligonucleotide
ggcggcccgttgggcggagt

SEQ ID NO: 18314 - DNA, 20 bp, Artificial Sequence
  Description of Artificial Sequence: Synthetic oligonucleotide
gcggcccgttgggcggagca

SEQ ID NO: 18315 - DNA, 22 bp, Artificial Sequence
  Description of Artificial Sequence: Synthetic oligonucleotide
cggcccgttgggcggagcagtt

SEQ ID NO: 18316 - DNA, 23 bp, Artificial Sequence
  Description of Artificial Sequence: Synthetic oligonucleotide
ggcccgttgggcggagcagttga

SEQ ID NO: 18317 - DNA, 24 bp, Artificial Sequence
  Description of Artificial Sequence: Synthetic oligonucleotide
gcccgttgggcggagcagttgaga

SEQ ID NO: 18318 - DNA, 24 bp, Artificial Sequence
  Description of Artificial Sequence: Synthetic oligonucleotide
cccgttgggcggagcagttgagag

SEQ ID NO: 18319 - DNA, 24 bp, Artificial Sequence
  Description of Artificial Sequence: Synthetic oligonucleotide
ccgttgggcggagcagttgagagc

SEQ ID NO: 18320 - DNA, 26 bp, Artificial Sequence
  Description of Artificial Sequence: Synthetic oligonucleotide
cgttgggcggagcagttgagagccta

SEQ ID NO: 18321 - DNA, 26 bp, Artificial Sequence
  Description of Artificial Sequence: Synthetic oligonucleotide
gttgggcggagcagttgagagcctac

SEQ ID NO: 18322 - DNA, 27 bp, Artificial Sequence
  Description of Artificial Sequence: Synthetic oligonucleotide
ttgggcggagcagttgagagcctacct

SEQ ID NO: 18323 - DNA, 26 bp, Artificial Sequence
  Description of Artificial Sequence: Synthetic oligonucleotide
tgggcggagcagttgagagcctacct

SEQ ID NO: 18324 - DNA, 25 bp, Artificial Sequence
  Description of Artificial Sequence: Synthetic oligonucleotide
gggcggagcagttgagagcctacct

SEQ ID NO: 18325 - DNA, 29 bp, Artificial Sequence
  Description of Artificial Sequence: Synthetic oligonucleotide
tgggcttctaccctgcggagatcacattg

SEQ ID NO: 18326 - DNA, 28 bp, Artificial Sequence
  Description of Artificial Sequence: Synthetic oligonucleotide
gggcttctaccctgcggagatcacattg

SEQ ID NO: 18327 - DNA, 29 bp, Artificial Sequence
  Description of Artificial Sequence: Synthetic oligonucleotide
ggcttctaccctgcggagatcacattgac

SEQ ID NO: 18328 - DNA, 29 bp, Artificial Sequence
  Description of Artificial Sequence: Synthetic oligonucleotide
gcttctaccctgcggagatcacattgacc

SEQ ID NO: 18329 - DNA, 30 bp, Artificial Sequence
  Description of Artificial Sequence: Synthetic oligonucleotide
cttctaccctgcggagatcacattgacctg

SEQ ID NO: 18330 - DNA, 30 bp, Artificial Sequence
  Description of Artificial Sequence: Synthetic oligonucleotide
ttctaccctgcggagatcacattgacctgg

SEQ ID NO: 18331 - DNA, 29 bp, Artificial Sequence
  Description of Artificial Sequence: Synthetic oligonucleotide
tctaccctgcggagatcacattgacctgg

SEQ ID NO: 18332 - DNA, 28 bp, Artificial Sequence
  Description of Artificial Sequence: Synthetic oligonucleotide
ctaccctgcggagatcacattgacctgg

SEQ ID NO: 18333 - DNA, 28 bp, Artificial Sequence
  Description of Artificial Sequence: Synthetic oligonucleotide
taccctgcggagatcacattgacctggc

SEQ ID NO: 18334 - DNA, 27 bp, Artificial Sequence
  Description of Artificial Sequence: Synthetic oligonucleotide
accctgcggagatcacattgacctggc

SEQ ID NO: 18335 - DNA, 27 bp, Artificial Sequence
  Description of Artificial Sequence: Synthetic oligonucleotide
ccctgcggagatcacattgacctggca

SEQ ID NO: 18336 - DNA, 27 bp, Artificial Sequence
  Description of Artificial Sequence: Synthetic oligonucleotide
cctgcggagatcacattgacctggcag

SEQ ID NO: 18337 - DNA, 27 bp, Artificial Sequence
  Description of Artificial Sequence: Synthetic oligonucleotide
ctgcggagatcacattgacctggcagc

SEQ ID NO: 18338 - DNA, 27 bp, Artificial Sequence
  Description of Artificial Sequence: Synthetic oligonucleotide
tgcggagatcacattgacctggcagcg

SEQ ID NO: 18339 - DNA, 26 bp, Artificial Sequence
  Description of Artificial Sequence: Synthetic oligonucleotide
gcggagatcacattgacctggcagcg

SEQ ID NO: 18340 - DNA, 26 bp, Artificial Sequence
  Description of Artificial Sequence: Synthetic oligonucleotide
cggagatcacattgacctggcagcgg

SEQ ID NO: 18341 - DNA, 27 bp, Artificial Sequence
  Description of Artificial Sequence: Synthetic oligonucleotide
ggagatcacattgacctggcagcggga

SEQ ID NO: 18342 - DNA, 28 bp, Artificial Sequence
  Description of Artificial Sequence: Synthetic oligonucleotide
gagatcacattgacctggcagcgggatg

SEQ ID NO: 18343 - DNA, 28 bp, Artificial Sequence
  Description of Artificial Sequence: Synthetic oligonucleotide
agatcacattgacctggcagcgggatgg

SEQ ID NO: 18344 - DNA, 27 bp, Artificial Sequence
  Description of Artificial Sequence: Synthetic oligonucleotide
gatcacattgacctggcagcgggatgg

SEQ ID NO: 18345 - DNA, 27 bp, Artificial Sequence
  Description of Artificial Sequence: Synthetic oligonucleotide
atcacattgacctggcagcgggatggg

SEQ ID NO: 18346 - DNA, 26 bp, Artificial Sequence
  Description of Artificial Sequence: Synthetic oligonucleotide
tcacattgacctggcagcgggatggg

SEQ ID NO: 18347 - DNA, 25 bp, Artificial Sequence
  Description of Artificial Sequence: Synthetic oligonucleotide
cacattgacctggcagcgggatggg

SEQ ID NO: 18348 - DNA, 26 bp, Artificial Sequence
  Description of Artificial Sequence: Synthetic oligonucleotide
acattgacctggcagcgggatgggga

SEQ ID NO: 18349 - DNA, 25 bp, Artificial Sequence
  Description of Artificial Sequence: Synthetic oligonucleotide
cattgacctggcagcgggatgggga

SEQ ID NO: 18350 - DNA, 25 bp, Artificial Sequence
  Description of Artificial Sequence: Synthetic oligonucleotide
attgacctggcagcgggatggggag

SEQ ID NO: 18351 - DNA, 24 bp, Artificial Sequence
  Description of Artificial Sequence: Synthetic oligonucleotide
ttgacctggcagcgggatggggag

SEQ ID NO: 18352 - DNA, 24 bp, Artificial Sequence
  Description of Artificial Sequence: Synthetic oligonucleotide
gggaaggagacgctgcagcgcaca

SEQ ID NO: 18353 - DNA, 24 bp, Artificial Sequence
  Description of Artificial Sequence: Synthetic oligonucleotide
ggaaggagacgctgcagcgcacag

SEQ ID NO: 18354 - DNA, 21 bp, Artificial Sequence
  Description of Artificial Sequence: Synthetic oligonucleotide
ggcccgtcgggcggagcagtt

SEQ ID NO: 18355 - DNA, 22 bp, Artificial Sequence
  Description of Artificial Sequence: Synthetic oligonucleotide
gcccgtcgggcggagcagttga

SEQ ID NO: 18356 - DNA, 23 bp, Artificial Sequence
  Description of Artificial Sequence: Synthetic oligonucleotide
cccgtcgggcggagcagttgaga

SEQ ID NO: 18357 - DNA, 23 bp, Artificial Sequence
  Description of Artificial Sequence: Synthetic oligonucleotide
ccgtcgggcggagcagttgagag

SEQ ID NO: 18358 - DNA, 23 bp, Artificial Sequence
  Description of Artificial Sequence: Synthetic oligonucleotide
cgtcgggcggagcagttgagagc

SEQ ID NO: 18359 - DNA, 25 bp, Artificial Sequence
  Description of Artificial Sequence: Synthetic oligonucleotide
gtcgggcggagcagttgagagccta

SEQ ID NO: 18360 - DNA, 25 bp, Artificial Sequence
  Description of Artificial Sequence: Synthetic oligonucleotide
tcgggcggagcagttgagagcctac

SEQ ID NO: 18361 - DNA, 24 bp, Artificial Sequence
  Description of Artificial Sequence: Synthetic oligonucleotide
cgggcggagcagttgagagcctac

SEQ ID NO: 18362 - DNA, 26 bp, Artificial Sequence
  Description of Artificial Sequence: Synthetic oligonucleotide
accagacccaggacacggagctcgtt

SEQ ID NO: 18363 - DNA, 25 bp, Artificial Sequence
  Description of Artificial Sequence: Synthetic oligonucleotide
ccagacccaggacacggagctcgtt

SEQ ID NO: 18364 - DNA, 26 bp, Artificial Sequence
  Description of Artificial Sequence: Synthetic oligonucleotide
cagacccaggacacggagctcgttga

SEQ ID NO: 18365 - DNA, 27 bp, Artificial Sequence
  Description of Artificial Sequence: Synthetic oligonucleotide
agacccaggacacggagctcgttgaga

SEQ ID NO: 18366 - DNA, 26 bp, Artificial Sequence
  Description of Artificial Sequence: Synthetic oligonucleotide
gacccaggacacggagctcgttgaga

SEQ ID NO: 18367 - DNA, 26 bp, Artificial Sequence
  Description of Artificial Sequence: Synthetic oligonucleotide
acccaggacacggagctcgttgagac

SEQ ID NO: 18368 - DNA, 25 bp, Artificial Sequence
  Description of Artificial Sequence: Synthetic oligonucleotide
cccaggacacggagctcgttgagac

SEQ ID NO: 18369 - DNA, 26 bp, Artificial Sequence
  Description of Artificial Sequence: Synthetic oligonucleotide
ccaggacacggagctcgttgagacca

SEQ ID NO: 18370 - DNA, 26 bp, Artificial Sequence
  Description of Artificial Sequence: Synthetic oligonucleotide
caggacacggagctcgttgagaccag

SEQ ID NO: 18371 - DNA, 26 bp, Artificial Sequence
  Description of Artificial Sequence: Synthetic oligonucleotide
aggacacggagctcgttgagaccagg

SEQ ID NO: 18372 - DNA, 25 bp, Artificial Sequence
  Description of Artificial Sequence: Synthetic oligonucleotide
ggacacggagctcgttgagaccagg

SEQ ID NO: 18373 - DNA, 25 bp, Artificial Sequence
  Description of Artificial Sequence: Synthetic oligonucleotide
gacacggagctcgttgagaccaggc

SEQ ID NO: 18374 - DNA, 26 bp, Artificial Sequence
  Description of Artificial Sequence: Synthetic oligonucleotide
acacggagctcgttgagaccaggcct

SEQ ID NO: 18375 - DNA, 25 bp, Artificial Sequence
  Description of Artificial Sequence: Synthetic oligonucleotide
cacggagctcgttgagaccaggcct

SEQ ID NO: 18376 - DNA, 25 bp, Artificial Sequence
  Description of Artificial Sequence: Synthetic oligonucleotide
acggagctcgttgagaccaggcctg

SEQ ID NO: 18377 - DNA, 24 bp, Artificial Sequence
  Description of Artificial Sequence: Synthetic oligonucleotide
cggagctcgttgagaccaggcctg

SEQ ID NO: 18378 - DNA, 25 bp, Artificial Sequence
  Description of Artificial Sequence: Synthetic oligonucleotide
ggagctcgttgagaccaggcctgca

SEQ ID NO: 18379 - DNA, 25 bp, Artificial Sequence
  Description of Artificial Sequence: Synthetic oligonucleotide
gagctcgttgagaccaggcctgcag

SEQ ID NO: 18380 - DNA, 25 bp, Artificial Sequence
  Description of Artificial Sequence: Synthetic oligonucleotide
agctcgttgagaccaggcctgcagg

SEQ ID NO: 18381 - DNA, 24 bp, Artificial Sequence
  Description of Artificial Sequence: Synthetic oligonucleotide
gctcgttgagaccaggcctgcagg

SEQ ID NO: 18382 - DNA, 24 bp, Artificial Sequence
  Description of Artificial Sequence: Synthetic oligonucleotide
ctcgttgagaccaggcctgcaggg

SEQ ID NO: 18383 - DNA, 26 bp, Artificial Sequence
  Description of Artificial Sequence: Synthetic oligonucleotide
tcgttgagaccaggcctgcaggggat

SEQ ID NO: 18384 - DNA, 25 bp, Artificial Sequence
  Description of Artificial Sequence: Synthetic oligonucleotide
cgttgagaccaggcctgcaggggat

SEQ ID NO: 18385 - DNA, 25 bp, Artificial Sequence
  Description of Artificial Sequence: Synthetic oligonucleotide
gttgagaccaggcctgcaggggatg

SEQ ID NO: 18386 - DNA, 27 bp, Artificial Sequence
  Description of Artificial Sequence: Synthetic oligonucleotide
ttgagaccaggcctgcaggggatggaa

SEQ ID NO: 18387 - DNA, 26 bp, Artificial Sequence
  Description of Artificial Sequence: Synthetic oligonucleotide
tgagaccaggcctgcaggggatggaa

SEQ ID NO: 18388 - DNA, 25 bp, Artificial Sequence
  Description of Artificial Sequence: Synthetic oligonucleotide
gccgtggatagagcaggagaggcca

SEQ ID NO: 18389 - DNA, 26 bp, Artificial Sequence
  Description of Artificial Sequence: Synthetic oligonucleotide
ccgtggatagagcaggagaggccaga

SEQ ID NO: 18390 - DNA, 27 bp, Artificial Sequence
  Description of Artificial Sequence: Synthetic oligonucleotide
cgtggatagagcaggagaggccagagt

SEQ ID NO: 18391 - DNA, 30 bp, Artificial Sequence
  Description of Artificial Sequence: Synthetic oligonucleotide
gtggatagagcaggagaggccagagtattg

SEQ ID NO: 18392 - DNA, 30 bp, Artificial Sequence
  Description of Artificial Sequence: Synthetic oligonucleotide
tggatagagcaggagaggccagagtattgg

SEQ ID NO: 18393 - DNA, 29 bp, Artificial Sequence
  Description of Artificial Sequence: Synthetic oligonucleotide
ggatagagcaggagaggccagagtattgg

SEQ ID NO: 18394 - DNA, 29 bp, Artificial Sequence
  Description of Artificial Sequence: Synthetic oligonucleotide
gatagagcaggagaggccagagtattggg

SEQ ID NO: 18395 - DNA, 30 bp, Artificial Sequence
  Description of Artificial Sequence: Synthetic oligonucleotide
atagagcaggagaggccagagtattgggac

SEQ ID NO: 18396 - DNA, 29 bp, Artificial Sequence
  Description of Artificial Sequence: Synthetic oligonucleotide
tagagcaggagaggccagagtattgggac

SEQ ID NO: 18397 - DNA, 28 bp, Artificial Sequence
  Description of Artificial Sequence: Synthetic oligonucleotide
agagcaggagaggccagagtattgggac

SEQ ID NO: 18398 - DNA, 27 bp, Artificial Sequence
  Description of Artificial Sequence: Synthetic oligonucleotide
gagcaggagaggccagagtattgggac

SEQ ID NO: 18399 - DNA, 27 bp, Artificial Sequence
  Description of Artificial Sequence: Synthetic oligonucleotide
agcaggagaggccagagtattgggacc

SEQ ID NO: 18400 - DNA, 27 bp, Artificial Sequence
  Description of Artificial Sequence: Synthetic oligonucleotide
gcaggagaggccagagtattgggacca

SEQ ID NO: 18401 - DNA, 27 bp, Artificial Sequence
  Description of Artificial Sequence: Synthetic oligonucleotide
caggagaggccagagtattgggaccag

SEQ ID NO: 18402 - DNA, 27 bp, Artificial Sequence
  Description of Artificial Sequence: Synthetic oligonucleotide
aggagaggccagagtattgggaccagg

SEQ ID NO: 18403 - DNA, 27 bp, Artificial Sequence
  Description of Artificial Sequence: Synthetic oligonucleotide
ggagaggccagagtattgggaccagga

SEQ ID NO: 18404 - DNA, 27 bp, Artificial Sequence
  Description of Artificial Sequence: Synthetic oligonucleotide
gagaggccagagtattgggaccaggag

SEQ ID NO: 18405 - DNA, 28 bp, Artificial Sequence
  Description of Artificial Sequence: Synthetic oligonucleotide
agaggccagagtattgggaccaggagac

SEQ ID NO: 18406 - DNA, 27 bp, Artificial Sequence
  Description of Artificial Sequence: Synthetic oligonucleotide
gaggccagagtattgggaccaggagac

SEQ ID NO: 18407 - DNA, 28 bp, Artificial Sequence
  Description of Artificial Sequence: Synthetic oligonucleotide
aggccagagtattgggaccaggagacac

SEQ ID NO: 18408 - DNA, 27 bp, Artificial Sequence
  Description of Artificial Sequence: Synthetic oligonucleotide
ggccagagtattgggaccaggagacac

SEQ ID NO: 18409 - DNA, 27 bp, Artificial Sequence
  Description of Artificial Sequence: Synthetic oligonucleotide
gccagagtattgggaccaggagacacg

SEQ ID NO: 18410 - DNA, 27 bp, Artificial Sequence
  Description of Artificial Sequence: Synthetic oligonucleotide
ccagagtattgggaccaggagacacgg

SEQ ID NO: 18411 - DNA, 30 bp, Artificial Sequence
  Description of Artificial Sequence: Synthetic oligonucleotide
cagagtattgggaccaggagacacggaatg

SEQ ID NO: 18412 - DNA, 31 bp, Artificial Sequence
  Description of Artificial Sequence: Synthetic oligonucleotide
agagtattgggaccaggagacacggaatgtg

SEQ ID NO: 18413 - DNA, 24 bp, Artificial Sequence
  Description of Artificial Sequence: Synthetic oligonucleotide
gacgggcgcttcctccgcggttat

SEQ ID NO: 18414 - DNA, 26 bp, Artificial Sequence
  Description of Artificial Sequence: Synthetic oligonucleotide
acgggcgcttcctccgcggttatgaa

SEQ ID NO: 18415 - DNA, 25 bp, Artificial Sequence
  Description of Artificial Sequence: Synthetic oligonucleotide
cgggcgcttcctccgcggttatgaa

SEQ ID NO: 18416 - DNA, 26 bp, Artificial Sequence
  Description of Artificial Sequence: Synthetic oligonucleotide
gggcgcttcctccgcggttatgaaca

SEQ ID NO: 18417 - DNA, 26 bp, Artificial Sequence
  Description of Artificial Sequence: Synthetic oligonucleotide
ggcgcttcctccgcggttatgaacag

SEQ ID NO: 18418 - DNA, 27 bp, Artificial Sequence
  Description of Artificial Sequence: Synthetic oligonucleotide
gcgcttcctccgcggttatgaacagca

SEQ ID NO: 18419 - DNA, 27 bp, Artificial Sequence
  Description of Artificial Sequence: Synthetic oligonucleotide
cgcttcctccgcggttatgaacagcac

SEQ ID NO: 18420 - DNA, 27 bp, Artificial Sequence
  Description of Artificial Sequence: Synthetic oligonucleotide
gcttcctccgcggttatgaacagcacg

SEQ ID NO: 18421 - DNA, 27 bp, Artificial Sequence
  Description of Artificial Sequence: Synthetic oligonucleotide
cttcctccgcggttatgaacagcacgc

SEQ ID NO: 18422 - DNA, 27 bp, Artificial Sequence
  Description of Artificial Sequence: Synthetic oligonucleotide
ttcctccgcggttatgaacagcacgcc

SEQ ID NO: 18423 - DNA, 27 bp, Artificial Sequence
  Description of Artificial Sequence: Synthetic oligonucleotide
tcctccgcggttatgaacagcacgcct

SEQ ID NO: 18424 - DNA, 27 bp, Artificial Sequence
  Description of Artificial Sequence: Synthetic oligonucleotide
cctccgcggttatgaacagcacgccta

SEQ ID NO: 18425 - DNA, 27 bp, Artificial Sequence
  Description of Artificial Sequence: Synthetic oligonucleotide
ctccgcggttatgaacagcacgcctac

SEQ ID NO: 18426 - DNA, 27 bp, Artificial Sequence
  Description of Artificial Sequence: Synthetic oligonucleotide
tccgcggttatgaacagcacgcctacg

SEQ ID NO: 18427 - DNA, 27 bp, Artificial Sequence
  Description of Artificial Sequence: Synthetic oligonucleotide
ccgcggttatgaacagcacgcctacga

SEQ ID NO: 18428 - DNA, 27 bp, Artificial Sequence
  Description of Artificial Sequence: Synthetic oligonucleotide
cgcggttatgaacagcacgcctacgac

SEQ ID NO: 18429 - DNA, 27 bp, Artificial Sequence
  Description of Artificial Sequence: Synthetic oligonucleotide
gcggttatgaacagcacgcctacgacg

SEQ ID NO: 18430 - DNA, 27 bp, Artificial Sequence
  Description of Artificial Sequence: Synthetic oligonucleotide
cggttatgaacagcacgcctacgacgg

SEQ ID NO: 18431 - DNA, 27 bp, Artificial Sequence
  Description of Artificial Sequence: Synthetic oligonucleotide
ggttatgaacagcacgcctacgacggc

SEQ ID NO: 18432 - DNA, 29 bp, Artificial Sequence
  Description of Artificial Sequence: Synthetic oligonucleotide
gttatgaacagcacgcctacgacggcaag

SEQ ID NO: 18433 - DNA, 29 bp, Artificial Sequence
  Description of Artificial Sequence: Synthetic oligonucleotide
ttatgaacagcacgcctacgacggcaagg

SEQ ID NO: 18434 - DNA, 21 bp, Artificial Sequence
  Description of Artificial Sequence: Synthetic oligonucleotide
cccgtcgggcggagcagctga

SEQ ID NO: 18435 - DNA, 22 bp, Artificial Sequence
  Description of Artificial Sequence: Synthetic oligonucleotide
ccgtcgggcggagcagctgaga

SEQ ID NO: 18436 - DNA, 22 bp, Artificial Sequence
  Description of Artificial Sequence: Synthetic oligonucleotide
cgtcgggcggagcagctgagag

SEQ ID NO: 18437 - DNA, 22 bp, Artificial Sequence
  Description of Artificial Sequence: Synthetic oligonucleotide
gtcgggcggagcagctgagagc

SEQ ID NO: 18438 - DNA, 24 bp, Artificial Sequence
  Description of Artificial Sequence: Synthetic oligonucleotide
tcgggcggagcagctgagagccta

SEQ ID NO: 18439 - DNA, 23 bp, Artificial Sequence
  Description of Artificial Sequence: Synthetic oligonucleotide
cgggcggagcagctgagagccta

SEQ ID NO: 18440 - DNA, 23 bp, Artificial Sequence
  Description of Artificial Sequence: Synthetic oligonucleotide
gggcggagcagctgagagcctac

SEQ ID NO: 18441 - DNA, 26 bp, Artificial Sequence
  Description of Artificial Sequence: Synthetic oligonucleotide
gtggtgccttctggagaggagcagag

SEQ ID NO: 18442 - DNA, 26 bp, Artificial Sequence
  Description of Artificial Sequence: Synthetic oligonucleotide
tcatcgcagtgggctacgtggacgac

SEQ ID NO: 18443 - DNA, 25 bp, Artificial Sequence
  Description of Artificial Sequence: Synthetic oligonucleotide
catcgcagtgggctacgtggacgac

SEQ ID NO: 18444 - DNA, 25 bp, Artificial Sequence
  Description of Artificial Sequence: Synthetic oligonucleotide
atcgcagtgggctacgtggacgacg

SEQ ID NO: 18445 - DNA, 24 bp, Artificial Sequence
  Description of Artificial Sequence: Synthetic oligonucleotide
tcgcagtgggctacgtggacgacg

SEQ ID NO: 18446 - DNA, 23 bp, Artificial Sequence
  Description of Artificial Sequence: Synthetic oligonucleotide
cgcagtgggctacgtggacgacg

SEQ ID NO: 18447 - DNA, 23 bp, Artificial Sequence
  Description of Artificial Sequence: Synthetic oligonucleotide
gcagtgggctacgtggacgacgc

SEQ ID NO: 18448 - DNA, 23 bp, Artificial Sequence
  Description of Artificial Sequence: Synthetic oligonucleotide
cagtgggctacgtggacgacgcg

SEQ ID NO: 18449 - DNA, 24 bp, Artificial Sequence
  Description of Artificial Sequence: Synthetic oligonucleotide
agtgggctacgtggacgacgcgca

SEQ ID NO: 18450 - DNA, 23 bp, Artificial Sequence
  Description of Artificial Sequence: Synthetic oligonucleotide
gtgggctacgtggacgacgcgca

SEQ ID NO: 18451 - DNA, 25 bp, Artificial Sequence
  Description of Artificial Sequence: Synthetic oligonucleotide
tgggctacgtggacgacgcgcagtt

SEQ ID NO: 18452 - DNA, 24 bp, Artificial Sequence
  Description of Artificial Sequence: Synthetic oligonucleotide
gggctacgtggacgacgcgcagtt

SEQ ID NO: 18453 - DNA, 24 bp, Artificial Sequence
  Description of Artificial Sequence: Synthetic oligonucleotide
ggctacgtggacgacgcgcagttc

SEQ ID NO: 18454 - DNA, 25 bp, Artificial Sequence
  Description of Artificial Sequence: Synthetic oligonucleotide
gctacgtggacgacgcgcagttcgt

SEQ ID NO: 18455 - DNA, 25 bp, Artificial Sequence
  Description of Artificial Sequence: Synthetic oligonucleotide
ctacgtggacgacgcgcagttcgtg

SEQ ID NO: 18456 - DNA, 25 bp, Artificial Sequence
  Description of Artificial Sequence: Synthetic oligonucleotide
tacgtggacgacgcgcagttcgtgc

SEQ ID NO: 18457 - DNA, 24 bp, Artificial Sequence
  Description of Artificial Sequence: Synthetic oligonucleotide
acgtggacgacgcgcagttcgtgc

SEQ ID NO: 18458 - DNA, 23 bp, Artificial Sequence
  Description of Artificial Sequence: Synthetic oligonucleotide
cgtggacgacgcgcagttcgtgc

SEQ ID NO: 18459 - DNA, 23 bp, Artificial Sequence
  Description of Artificial Sequence: Synthetic oligonucleotide
gtggacgacgcgcagttcgtgcg

SEQ ID NO: 18460 - DNA, 25 bp, Artificial Sequence
  Description of Artificial Sequence: Synthetic oligonucleotide
tggacgacgcgcagttcgtgcggtt

SEQ ID NO: 18461 - DNA, 24 bp, Artificial Sequence
  Description of Artificial Sequence: Synthetic oligonucleotide
ggacgacgcgcagttcgtgcggtt

SEQ ID NO: 18462 - DNA, 24 bp, Artificial Sequence
  Description of Artificial Sequence: Synthetic oligonucleotide
gacgacgcgcagttcgtgcggttc

SEQ ID NO: 18463 - DNA, 25 bp, Artificial Sequence
  Description of Artificial Sequence: Synthetic oligonucleotide
acgacgcgcagttcgtgcggttcga

SEQ ID NO: 18464 - DNA, 24 bp, Artificial Sequence
  Description of Artificial Sequence: Synthetic oligonucleotide
cgacgcgcagttcgtgcggttcga

SEQ ID NO: 18465 - DNA, 25 bp, Artificial Sequence
  Description of Artificial Sequence: Synthetic oligonucleotide
gacgcgcagttcgtgcggttcgaca

SEQ ID NO: 18466 - DNA, 25 bp, Artificial Sequence
  Description of Artificial Sequence: Synthetic oligonucleotide
acgcgcagttcgtgcggttcgacag

SEQ ID NO: 18467 - DNA, 24 bp, Artificial Sequence
  Description of Artificial Sequence: Synthetic oligonucleotide
cgcgcagttcgtgcggttcgacag

SEQ ID NO: 18468 - DNA, 24 bp, Artificial Sequence
  Description of Artificial Sequence: Synthetic oligonucleotide
gcgcagttcgtgcggttcgacagc

SEQ ID NO: 18469 - DNA, 20 bp, Artificial Sequence
  Description of Artificial Sequence: Synthetic oligonucleotide
ctccgtgtcccggcccggca

SEQ ID NO: 18470 - DNA, 30 bp, Artificial Sequence
  Description of Artificial Sequence: Synthetic oligonucleotide
aggccggttctcacaccatccagataatgc

SEQ ID NO: 18471 - DNA, 29 bp, Artificial Sequence
  Description of Artificial Sequence: Synthetic oligonucleotide
ggccggttctcacaccatccagataatgc

SEQ ID NO: 18472 - DNA, 31 bp, Artificial Sequence
  Description of Artificial Sequence: Synthetic oligonucleotide
gccggttctcacaccatccagataatgcatg

SEQ ID NO: 18473 - DNA, 31 bp, Artificial Sequence
  Description of Artificial Sequence: Synthetic oligonucleotide
ccggttctcacaccatccagataatgcatgg

SEQ ID NO: 18474 - DNA, 31 bp, Artificial Sequence
  Description of Artificial Sequence: Synthetic oligonucleotide
cggttctcacaccatccagataatgcatggc

SEQ ID NO: 18475 - DNA, 32 bp, Artificial Sequence
  Description of Artificial Sequence: Synthetic oligonucleotide
ggttctcacaccatccagataatgcatggctg

SEQ ID NO: 18476 - DNA, 32 bp, Artificial Sequence
  Description of Artificial Sequence: Synthetic oligonucleotide
gttctcacaccatccagataatgcatggctgc

SEQ ID NO: 18477 - DNA, 32 bp, Artificial Sequence
  Description of Artificial Sequence: Synthetic oligonucleotide
ttctcacaccatccagataatgcatggctgcg

SEQ ID NO: 18478 - DNA, 31 bp, Artificial Sequence
  Description of Artificial Sequence: Synthetic oligonucleotide
tctcacaccatccagataatgcatggctgcg

SEQ ID NO: 18479 - DNA, 30 bp, Artificial Sequence
  Description of Artificial Sequence: Synthetic oligonucleotide
ctcacaccatccagataatgcatggctgcg

SEQ ID NO: 18480 - DNA, 31 bp, Artificial Sequence
  Description of Artificial Sequence: Synthetic oligonucleotide
tcacaccatccagataatgcatggctgcgac

SEQ ID NO: 18481 - DNA, 30 bp, Artificial Sequence
  Description of Artificial Sequence: Synthetic oligonucleotide
cacaccatccagataatgcatggctgcgac

SEQ ID NO: 18482 - DNA, 30 bp, Artificial Sequence
  Description of Artificial Sequence: Synthetic oligonucleotide
acaccatccagataatgcatggctgcgacg

SEQ ID NO: 18483 - DNA, 29 bp, Artificial Sequence
  Description of Artificial Sequence: Synthetic oligonucleotide
caccatccagataatgcatggctgcgacg

SEQ ID NO: 18484 - DNA, 30 bp, Artificial Sequence
  Description of Artificial Sequence: Synthetic oligonucleotide
accatccagataatgcatggctgcgacgtg

SEQ ID NO: 18485 - DNA, 29 bp, Artificial Sequence
  Description of Artificial Sequence: Synthetic oligonucleotide
ccatccagataatgcatggctgcgacgtg

SEQ ID NO: 18486 - DNA, 29 bp, Artificial Sequence
  Description of Artificial Sequence: Synthetic oligonucleotide
catccagataatgcatggctgcgacgtgg

SEQ ID NO: 18487 - DNA, 29 bp, Artificial Sequence
  Description of Artificial Sequence: Synthetic oligonucleotide
atccagataatgcatggctgcgacgtggg

SEQ ID NO: 18488 - DNA, 28 bp, Artificial Sequence
  Description of Artificial Sequence: Synthetic oligonucleotide
tccagataatgcatggctgcgacgtggg

SEQ ID NO: 18489 - DNA, 27 bp, Artificial Sequence
  Description of Artificial Sequence: Synthetic oligonucleotide
ccagataatgcatggctgcgacgtggg

SEQ ID NO: 18490 - DNA, 27 bp, Artificial Sequence
  Description of Artificial Sequence: Synthetic oligonucleotide
cagataatgcatggctgcgacgtgggg

SEQ ID NO: 18491 - DNA, 28 bp, Artificial Sequence
  Description of Artificial Sequence: Synthetic oligonucleotide
agataatgcatggctgcgacgtggggtc

SEQ ID NO: 18492 - DNA, 27 bp, Artificial Sequence
  Description of Artificial Sequence: Synthetic oligonucleotide
gataatgcatggctgcgacgtggggtc

SEQ ID NO: 18493 - DNA, 27 bp, Artificial Sequence
  Description of Artificial Sequence: Synthetic oligonucleotide
ataatgcatggctgcgacgtggggtcg

SEQ ID NO: 18494 - DNA, 26 bp, Artificial Sequence
  Description of Artificial Sequence: Synthetic oligonucleotide
taatgcatggctgcgacgtggggtcg

SEQ ID NO: 18495 - DNA, 25 bp, Artificial Sequence
  Description of Artificial Sequence: Synthetic oligonucleotide
aatgcatggctgcgacgtggggtcg

SEQ ID NO: 18496 - DNA, 24 bp, Artificial Sequence
  Description of Artificial Sequence: Synthetic oligonucleotide
atgcatggctgcgacgtggggtcg

SEQ ID NO: 18497 - DNA, 23 bp, Artificial Sequence
  Description of Artificial Sequence: Synthetic oligonucleotide
tgcatggctgcgacgtggggtcg

SEQ ID NO: 18498 - DNA, 22 bp, Artificial Sequence
  Description of Artificial Sequence: Synthetic oligonucleotide
gcatggctgcgacgtggggtcg

SEQ ID NO: 18499 - DNA, 23 bp, Artificial Sequence
  Description of Artificial Sequence: Synthetic oligonucleotide
catggctgcgacgtggggtcgga

SEQ ID NO: 18500 - DNA, 24 bp, Artificial Sequence
  Description of Artificial Sequence: Synthetic oligonucleotide
ccgtggatagagcaggaggggcct

SEQ ID NO: 18501 - DNA, 25 bp, Artificial Sequence
  Description of Artificial Sequence: Synthetic oligonucleotide
cgtggatagagcaggaggggcctga

SEQ ID NO: 18502 - DNA, 27 bp, Artificial Sequence
  Description of Artificial Sequence: Synthetic oligonucleotide
gtggatagagcaggaggggcctgagta

SEQ ID NO: 18503 - DNA, 29 bp, Artificial Sequence
  Description of Artificial Sequence: Synthetic oligonucleotide
tggatagagcaggaggggcctgagtattg

SEQ ID NO: 18504 - DNA, 28 bp, Artificial Sequence
  Description of Artificial Sequence: Synthetic oligonucleotide
ggatagagcaggaggggcctgagtattg

SEQ ID NO: 18505 - DNA, 28 bp, Artificial Sequence
  Description of Artificial Sequence: Synthetic oligonucleotide
gatagagcaggaggggcctgagtattgg

SEQ ID NO: 18506 - DNA, 28 bp, Artificial Sequence
  Description of Artificial Sequence: Synthetic oligonucleotide
atagagcaggaggggcctgagtattggg

SEQ ID NO: 18507 - DNA, 27 bp, Artificial Sequence
  Description of Artificial Sequence: Synthetic oligonucleotide
tagagcaggaggggcctgagtattggg

SEQ ID NO: 18508 - DNA, 27 bp, Artificial Sequence
  Description of Artificial Sequence: Synthetic oligonucleotide
agagcaggaggggcctgagtattggga

SEQ ID NO: 18509 - DNA, 26 bp, Artificial Sequence
  Description of Artificial Sequence: Synthetic oligonucleotide
gagcaggaggggcctgagtattggga

SEQ ID NO: 18510 - DNA, 26 bp, Artificial Sequence
  Description of Artificial Sequence: Synthetic oligonucleotide
agcaggaggggcctgagtattgggac

SEQ ID NO: 18511 - DNA, 25 bp, Artificial Sequence
  Description of Artificial Sequence: Synthetic oligonucleotide
gcaggaggggcctgagtattgggac

SEQ ID NO: 18512 - DNA, 26 bp, Artificial Sequence
  Description of Artificial Sequence: Synthetic oligonucleotide
caggaggggcctgagtattgggacca

SEQ ID NO: 18513 - DNA, 26 bp, Artificial Sequence
  Description of Artificial Sequence: Synthetic oligonucleotide
aggaggggcctgagtattgggaccag

SEQ ID NO: 18514 - DNA, 25 bp, Artificial Sequence
  Description of Artificial Sequence: Synthetic oligonucleotide
ggaggggcctgagtattgggaccag

SEQ ID NO: 18515 - DNA, 26 bp, Artificial Sequence
  Description of Artificial Sequence: Synthetic oligonucleotide
gaggggcctgagtattgggaccagga

SEQ ID NO: 18516 - DNA, 27 bp, Artificial Sequence
  Description of Artificial Sequence: Synthetic oligonucleotide
aggggcctgagtattgggaccaggaga

SEQ ID NO: 18517 - DNA, 26 bp, Artificial Sequence
  Description of Artificial Sequence: Synthetic oligonucleotide
ggggcctgagtattgggaccaggaga

SEQ ID NO: 18518 - DNA, 27 bp, Artificial Sequence
  Description of Artificial Sequence: Synthetic oligonucleotide
gggcctgagtattgggaccaggagaca

SEQ ID NO: 18519 - DNA, 26 bp, Artificial Sequence
  Description of Artificial Sequence: Synthetic oligonucleotide
ttgagagcctacctggagggcacgtc

SEQ ID NO: 18520 - DNA, 25 bp, Artificial Sequence
  Description of Artificial Sequence: Synthetic oligonucleotide
tgagagcctacctggagggcacgtc

SEQ ID NO: 18521 - DNA, 24 bp, Artificial Sequence
  Description of Artificial Sequence: Synthetic oligonucleotide
gagagcctacctggagggcacgtc

SEQ ID NO: 18522 - DNA, 24 bp, Artificial Sequence
  Description of Artificial Sequence: Synthetic oligonucleotide
agagcctacctggagggcacgtcc

SEQ ID NO: 18523 - DNA, 23 bp, Artificial Sequence
  Description of Artificial Sequence: Synthetic oligonucleotide
gagcctacctggagggcacgtcc

SEQ ID NO: 18524 - DNA, 24 bp, Artificial Sequence
  Description of Artificial Sequence: Synthetic oligonucleotide
agcctacctggagggcacgtccgt

SEQ ID NO: 18525 - DNA, 23 bp, Artificial Sequence
  Description of Artificial Sequence: Synthetic oligonucleotide
gcctacctggagggcacgtccgt

SEQ ID NO: 18526 - DNA, 23 bp, Artificial Sequence
  Description of Artificial Sequence: Synthetic oligonucleotide
cctacctggagggcacgtccgtg

SEQ ID NO: 18527 - DNA, 24 bp, Artificial Sequence
  Description of Artificial Sequence: Synthetic oligonucleotide
ctacctggagggcacgtccgtgga

SEQ ID NO: 18528 - DNA, 25 bp, Artificial Sequence
  Description of Artificial Sequence: Synthetic oligonucleotide
tacctggagggcacgtccgtggagt

SEQ ID NO: 18529 - DNA, 24 bp, Artificial Sequence
  Description of Artificial Sequence: Synthetic oligonucleotide
acctggagggcacgtccgtggagt

SEQ ID NO: 18530 - DNA, 23 bp, Artificial Sequence
  Description of Artificial Sequence: Synthetic oligonucleotide
cctggagggcacgtccgtggagt

SEQ ID NO: 18531 - DNA, 23 bp, Artificial Sequence
  Description of Artificial Sequence: Synthetic oligonucleotide
ctggagggcacgtccgtggagtg

SEQ ID NO: 18532 - DNA, 23 bp, Artificial Sequence
  Description of Artificial Sequence: Synthetic oligonucleotide
tggagggcacgtccgtggagtgg

SEQ ID NO: 18533 - DNA, 22 bp, Artificial Sequence
  Description of Artificial Sequence: Synthetic oligonucleotide
ggagggcacgtccgtggagtgg

SEQ ID NO: 18534 - DNA, 23 bp, Artificial Sequence
  Description of Artificial Sequence: Synthetic oligonucleotide
gagggcacgtccgtggagtggct

SEQ ID NO: 18535 - DNA, 23 bp, Artificial Sequence
  Description of Artificial Sequence: Synthetic oligonucleotide
agggcacgtccgtggagtggctc

SEQ ID NO: 18536 - DNA, 22 bp, Artificial Sequence
  Description of Artificial Sequence: Synthetic oligonucleotide
gggcacgtccgtggagtggctc

SEQ ID NO: 18537 - DNA, 22 bp, Artificial Sequence
  Description of Artificial Sequence: Synthetic oligonucleotide
ggcacgtccgtggagtggctcc

SEQ ID NO: 18538 - DNA, 22 bp, Artificial Sequence
  Description of Artificial Sequence: Synthetic oligonucleotide
gcacgtccgtggagtggctccg

SEQ ID NO: 18539 - DNA, 23 bp, Artificial Sequence
  Description of Artificial Sequence: Synthetic oligonucleotide
cacgtccgtggagtggctccgca

SEQ ID NO: 18540 - DNA, 26 bp, Artificial Sequence
  Description of Artificial Sequence: Synthetic oligonucleotide
acgtccgtggagtggctccgcagata

SEQ ID NO: 18541 - DNA, 25 bp, Artificial Sequence
  Description of Artificial Sequence: Synthetic oligonucleotide
cgtccgtggagtggctccgcagata

SEQ ID NO: 18542 - DNA, 25 bp, Artificial Sequence
  Description of Artificial Sequence: Synthetic oligonucleotide
gtccgtggagtggctccgcagatac

SEQ ID NO: 18543 - DNA, 26 bp, Artificial Sequence
  Description of Artificial Sequence: Synthetic oligonucleotide
tccgtggagtggctccgcagatacct

SEQ ID NO: 18544 - DNA, 25 bp, Artificial Sequence
  Description of Artificial Sequence: Synthetic oligonucleotide
ccgtggagtggctccgcagatacct

SEQ ID NO: 18545 - DNA, 26 bp, Artificial Sequence
  Description of Artificial Sequence: Synthetic oligonucleotide
tgcgtggagtggctccgcagatacgt

SEQ ID NO: 18546 - DNA, 25 bp, Artificial Sequence
  Description of Artificial Sequence: Synthetic oligonucleotide
gcgtggagtggctccgcagatacgt

SEQ ID NO: 18547 - DNA, 25 bp, Artificial Sequence
  Description of Artificial Sequence: Synthetic oligonucleotide
cgtggagtggctccgcagatacgtg

SEQ ID NO: 18548 - DNA, 26 bp, Artificial Sequence
  Description of Artificial Sequence: Synthetic oligonucleotide
gtggagtggctccgcagatacgtgga

SEQ ID NO: 18549 - DNA, 27 bp, Artificial Sequence
  Description of Artificial Sequence: Synthetic oligonucleotide
tggagtggctccgcagatacgtggaga

SEQ ID NO: 18550 - DNA, 27 bp, Artificial Sequence
  Description of Artificial Sequence: Synthetic oligonucleotide
ggagtggctccgcagatacgtggagaa

SEQ ID NO: 18551 - DNA, 27 bp, Artificial Sequence
  Description of Artificial Sequence: Synthetic oligonucleotide
gagtggctccgcagatacgtggagaac

SEQ ID NO: 18552 - DNA, 27 bp, Artificial Sequence
  Description of Artificial Sequence: Synthetic oligonucleotide
agtggctccgcagatacgtggagaacg

SEQ ID NO: 18553 - DNA, 26 bp, Artificial Sequence
  Description of Artificial Sequence: Synthetic oligonucleotide
gtggctccgcagatacgtggagaacg

SEQ ID NO: 18554 - DNA, 26 bp, Artificial Sequence
  Description of Artificial Sequence: Synthetic oligonucleotide
tggctccgcagatacgtggagaacgg

SEQ ID NO: 18555 - DNA, 25 bp, Artificial Sequence
  Description of Artificial Sequence: Synthetic oligonucleotide
ggctccgcagatacgtggagaacgg

SEQ ID NO: 18556 - DNA, 27 bp, Artificial Sequence
  Description of Artificial Sequence: Synthetic oligonucleotide
gctccgcagatacgtggagaacgggaa

SEQ ID NO: 18557 - DNA, 27 bp, Artificial Sequence
  Description of Artificial Sequence: Synthetic oligonucleotide
ctccgcagatacgtggagaacgggaag

SEQ ID NO: 18558 - DNA, 27 bp, Artificial Sequence
  Description of Artificial Sequence: Synthetic oligonucleotide
tccgcagatacgtggagaacgggaagg

SEQ ID NO: 18559 - DNA, 27 bp, Artificial Sequence
  Description of Artificial Sequence: Synthetic oligonucleotide
ccgcagatacgtggagaacgggaagga

SEQ ID NO: 18560 - DNA, 27 bp, Artificial Sequence
  Description of Artificial Sequence: Synthetic oligonucleotide
cgcagatacgtggagaacgggaaggag

SEQ ID NO: 18561 - DNA, 28 bp, Artificial Sequence
  Description of Artificial Sequence: Synthetic oligonucleotide
gcagatacgtggagaacgggaaggagac

SEQ ID NO: 18562 - DNA, 28 bp, Artificial Sequence
  Description of Artificial Sequence: Synthetic oligonucleotide
cagatacgtggagaacgggaaggagacg

SEQ ID NO: 18563 - DNA, 28 bp, Artificial Sequence
  Description of Artificial Sequence: Synthetic oligonucleotide
agatacgtggagaacgggaaggagacgc

SEQ ID NO: 18564 - DNA, 27 bp, Artificial Sequence
  Description of Artificial Sequence: Synthetic oligonucleotide
gatacgtggagaacgggaaggagacgc

SEQ ID NO: 18565 - DNA, 28 bp, Artificial Sequence
  Description of Artificial Sequence: Synthetic oligonucleotide
atacgtggagaacgggaaggagacgctg

SEQ ID NO: 18566 - DNA, 27 bp, Artificial Sequence
  Description of Artificial Sequence: Synthetic oligonucleotide
tacgtggagaacgggaaggagacgctg

SEQ ID NO: 18567 - DNA, 26 bp, Artificial Sequence
  Description of Artificial Sequence: Synthetic oligonucleotide
acgtggagaacgggaaggagacgctg

SEQ ID NO: 18568 - DNA, 25 bp, Artificial Sequence
  Description of Artificial Sequence: Synthetic oligonucleotide
cgtggagaacgggaaggagacgctg

SEQ ID NO: 18569 - DNA, 26 bp, Artificial Sequence
  Description of Artificial Sequence: Synthetic oligonucleotide
gtggagaacgggaaggagacgctgca

SEQ ID NO: 18570 - DNA, 21 bp, Artificial Sequence
  Description of Artificial Sequence: Synthetic oligonucleotide
ctggggaccctgcgcggctac

SEQ ID NO: 18571 - DNA, 22 bp, Artificial Sequence
  Description of Artificial Sequence: Synthetic oligonucleotide
tggggaccctgcgcggctacca

SEQ ID NO: 18572 - DNA, 21 bp, Artificial Sequence
  Description of Artificial Sequence: Synthetic oligonucleotide
ggggaccctgcgcggctacca

SEQ ID NO: 18573 - DNA, 23 bp, Artificial Sequence
  Description of Artificial Sequence: Synthetic oligonucleotide
gggaccctgcgcggctaccacaa

SEQ ID NO: 18574 - DNA, 23 bp, Artificial Sequence
  Description of Artificial Sequence: Synthetic oligonucleotide
ggaccctgcgcggctaccacaac

SEQ ID NO: 18575 - DNA, 24 bp, Artificial Sequence
  Description of Artificial Sequence: Synthetic oligonucleotide
gaccctgcgcggctaccacaacca

SEQ ID NO: 18576 - DNA, 25 bp, Artificial Sequence
  Description of Artificial Sequence: Synthetic oligonucleotide
accctgcgcggctaccacaaccaga

SEQ ID NO: 18577 - DNA, 24 bp, Artificial Sequence
  Description of Artificial Sequence: Synthetic oligonucleotide
ccctgcgcggctaccacaaccaga

SEQ ID NO: 18578 - DNA, 24 bp, Artificial Sequence
  Description of Artificial Sequence: Synthetic oligonucleotide
cctgcgcggctaccacaaccagag

SEQ ID NO: 18579 - DNA, 24 bp, Artificial Sequence
  Description of Artificial Sequence: Synthetic oligonucleotide
ctgcgcggctaccacaaccagagc

SEQ ID NO: 18580 - DNA, 25 bp, Artificial Sequence
  Description of Artificial Sequence: Synthetic oligonucleotide
tgcgcggctaccacaaccagagcga

SEQ ID NO: 18581 - DNA, 24 bp, Artificial Sequence
  Description of Artificial Sequence: Synthetic oligonucleotide
gcgcggctaccacaaccagagcga

SEQ ID NO: 18582 - DNA, 24 bp, Artificial Sequence
  Description of Artificial Sequence: Synthetic oligonucleotide
cgcggctaccacaaccagagcgag

SEQ ID NO: 18583 - DNA, 24 bp, Artificial Sequence
  Description of Artificial Sequence: Synthetic oligonucleotide
gcggctaccacaaccagagcgagg

SEQ ID NO: 18584 - DNA, 24 bp, Artificial Sequence
  Description of Artificial Sequence: Synthetic oligonucleotide
cggctaccacaaccagagcgaggc

SEQ ID NO: 18585 - DNA, 24 bp, Artificial Sequence
  Description of Artificial Sequence: Synthetic oligonucleotide
ggctaccacaaccagagcgaggcc

SEQ ID NO: 18586 - DNA, 24 bp, Artificial Sequence
  Description of Artificial Sequence: Synthetic oligonucleotide
gctaccacaaccagagcgaggccg

SEQ ID NO: 18587 - DNA, 26 bp, Artificial Sequence
  Description of Artificial Sequence: Synthetic oligonucleotide
ctaccacaaccagagcgaggccggtt

SEQ ID NO: 18588 - DNA, 27 bp, Artificial Sequence
  Description of Artificial Sequence: Synthetic oligonucleotide
taccacaaccagagcgaggccggttct

SEQ ID NO: 18589 - DNA, 26 bp, Artificial Sequence
  Description of Artificial Sequence: Synthetic oligonucleotide
accacaaccagagcgaggccggttct

SEQ ID NO: 18590 - DNA, 25 bp, Artificial Sequence
  Description of Artificial Sequence: Synthetic oligonucleotide
ccacaaccagagcgaggccggttct

SEQ ID NO: 18591 - DNA, 26 bp, Artificial Sequence
  Description of Artificial Sequence: Synthetic oligonucleotide
cacaaccagagcgaggccggttctca

SEQ ID NO: 18592 - DNA, 30 bp, Artificial Sequence
  Description of Artificial Sequence: Synthetic oligonucleotide
ggaatgtgaaggcccagtcacagactgaac

SEQ ID NO: 18593 - DNA, 30 bp, Artificial Sequence
  Description of Artificial Sequence: Synthetic oligonucleotide
gaatgtgaaggcccagtcacagactgaacg

SEQ ID NO: 18594 - DNA, 31 bp, Artificial Sequence
  Description of Artificial Sequence: Synthetic oligonucleotide
aatgtgaaggcccagtcacagactgaacgag

SEQ ID NO: 18595 - DNA, 30 bp, Artificial Sequence
  Description of Artificial Sequence: Synthetic oligonucleotide
atgtgaaggcccagtcacagactgaacgag

SEQ ID NO: 18596 - DNA, 29 bp, Artificial Sequence
  Description of Artificial Sequence: Synthetic oligonucleotide
tgtgaaggcccagtcacagactgaacgag

SEQ ID NO: 18597 - DNA, 28 bp, Artificial Sequence
  Description of Artificial Sequence: Synthetic oligonucleotide
gtgaaggcccagtcacagactgaacgag

SEQ ID NO: 18598 - DNA, 29 bp, Artificial Sequence
  Description of Artificial Sequence: Synthetic oligonucleotide
tgaaggcccagtcacagactgaacgagtg

SEQ ID NO: 18599 - DNA, 28 bp, Artificial Sequence
  Description of Artificial Sequence: Synthetic oligonucleotide
gaaggcccagtcacagactgaacgagtg

SEQ ID NO: 18600 - DNA, 28 bp, Artificial Sequence
  Description of Artificial Sequence: Synthetic oligonucleotide
aaggcccagtcacagactgaacgagtgg

SEQ ID NO: 18601 - DNA, 27 bp, Artificial Sequence
  Description of Artificial Sequence: Synthetic oligonucleotide
aggcccagtcacagactgaacgagtgg

SEQ ID NO: 18602 - DNA, 27 bp, Artificial Sequence
  Description of Artificial Sequence: Synthetic oligonucleotide
ggcccagtcacagactgaacgagtgga

SEQ ID NO: 18603 - DNA, 27 bp, Artificial Sequence
  Description of Artificial Sequence: Synthetic oligonucleotide
gcccagtcacagactgaacgagtggac

SEQ ID NO: 18604 - DNA, 27 bp, Artificial Sequence
  Description of Artificial Sequence: Synthetic oligonucleotide
cccagtcacagactgaacgagtggacc

SEQ ID NO: 18605 - DNA, 28 bp, Artificial Sequence
  Description of Artificial Sequence: Synthetic oligonucleotide
ccagtcacagactgaacgagtggacctg

SEQ ID NO: 18606 - DNA, 28 bp, Artificial Sequence
  Description of Artificial Sequence: Synthetic oligonucleotide
cagtcacagactgaacgagtggacctgg

SEQ ID NO: 18607 - DNA, 28 bp, Artificial Sequence
  Description of Artificial Sequence: Synthetic oligonucleotide
agtcacagactgaacgagtggacctggg

SEQ ID NO: 18608 - DNA, 27 bp, Artificial Sequence
  Description of Artificial Sequence: Synthetic oligonucleotide
gtcacagactgaacgagtggacctggg

SEQ ID NO: 18609 - DNA, 27 bp, Artificial Sequence
  Description of Artificial Sequence: Synthetic oligonucleotide
tcacagactgaacgagtggacctgggg

SEQ ID NO: 18610 - DNA, 27 bp, Artificial Sequence
  Description of Artificial Sequence: Synthetic oligonucleotide
cacagactgaacgagtggacctgggga

SEQ ID NO: 18611 - DNA, 27 bp, Artificial Sequence
  Description of Artificial Sequence: Synthetic oligonucleotide
acagactgaacgagtggacctggggac

SEQ ID NO: 18612 - DNA, 26 bp, Artificial Sequence
  Description of Artificial Sequence: Synthetic oligonucleotide
cagactgaacgagtggacctggggac

SEQ ID NO: 18613 - DNA, 26 bp, Artificial Sequence
  Description of Artificial Sequence: Synthetic oligonucleotide
agactgaacgagtggacctggggacc

SEQ ID NO: 18614 - DNA, 25 bp, Artificial Sequence
  Description of Artificial Sequence: Synthetic oligonucleotide
gactgaacgagtggacctggggacc

SEQ ID NO: 18615 - DNA, 26 bp, Artificial Sequence
  Description of Artificial Sequence: Synthetic oligonucleotide
actgaacgagtggacctggggaccct

SEQ ID NO: 18616 - DNA, 25 bp, Artificial Sequence
  Description of Artificial Sequence: Synthetic oligonucleotide
ctgaacgagtggacctggggaccct

SEQ ID NO: 18617 - DNA, 25 bp, Artificial Sequence
  Description of Artificial Sequence: Synthetic oligonucleotide
tgaacgagtggacctggggaccctg

SEQ ID NO: 18618 - DNA, 24 bp, Artificial Sequence
  Description of Artificial Sequence: Synthetic oligonucleotide
gaacgagtggacctggggaccctg

SEQ ID NO: 18619 - DNA, 24 bp, Artificial Sequence
  Description of Artificial Sequence: Synthetic oligonucleotide
aacgagtggacctggggaccctgc

SEQ ID NO: 18620 - DNA, 23 bp, Artificial Sequence
  Description of Artificial Sequence: Synthetic oligonucleotide
acgagtggacctggggaccctgc

SEQ ID NO: 18621 - DNA, 23 bp, Artificial Sequence
  Description of Artificial Sequence: Synthetic oligonucleotide
aagtgggaggcggcccgttggga

SEQ ID NO: 18622 - DNA, 22 bp, Artificial Sequence
  Description of Artificial Sequence: Synthetic oligonucleotide
agtgggaggcggcccgttggga

SEQ ID NO: 18623 - DNA, 21 bp, Artificial Sequence
  Description of Artificial Sequence: Synthetic oligonucleotide
gtgggaggcggcccgttggga

SEQ ID NO: 18624 - DNA, 21 bp, Artificial Sequence
  Description of Artificial Sequence: Synthetic oligonucleotide
tgggaggcggcccgttgggag

SEQ ID NO: 18625 - DNA, 20 bp, Artificial Sequence
  Description of Artificial Sequence: Synthetic oligonucleotide
gggaggcggcccgttgggag

SEQ ID NO: 18626 - DNA, 21 bp, Artificial Sequence
  Description of Artificial Sequence: Synthetic oligonucleotide
ggaggcggcccgttgggagga

SEQ ID NO: 18627 - DNA, 21 bp, Artificial Sequence
  Description of Artificial Sequence: Synthetic oligonucleotide
gaggcggcccgttgggaggag

SEQ ID NO: 18628 - DNA, 22 bp, Artificial Sequence
  Description of Artificial Sequence: Synthetic oligonucleotide
aggcggcccgttgggaggagca

SEQ ID NO: 18629 - DNA, 21 bp, Artificial Sequence
  Description of Artificial Sequence: Synthetic oligonucleotide
ggcggcccgttgggaggagca

SEQ ID NO: 18630 - DNA, 23 bp, Artificial Sequence
  Description of Artificial Sequence: Synthetic oligonucleotide
gcggcccgttgggaggagcagtt

SEQ ID NO: 18631 - DNA, 24 bp, Artificial Sequence
  Description of Artificial Sequence: Synthetic oligonucleotide
cggcccgttgggaggagcagttga

SEQ ID NO: 18632 - DNA, 25 bp, Artificial Sequence
  Description of Artificial Sequence: Synthetic oligonucleotide
ggcccgttgggaggagcagttgaga

SEQ ID NO: 18633 - DNA, 25 bp, Artificial Sequence
  Description of Artificial Sequence: Synthetic oligonucleotide
gcccgttgggaggagcagttgagag

SEQ ID NO: 18634 - DNA, 25 bp, Artificial Sequence
  Description of Artificial Sequence: Synthetic oligonucleotide
cccgttgggaggagcagttgagagc

SEQ ID NO: 18635 - DNA, 27 bp, Artificial Sequence
  Description of Artificial Sequence: Synthetic oligonucleotide
ccgttgggaggagcagttgagagccta

SEQ ID NO: 18636 - DNA, 27 bp, Artificial Sequence
  Description of Artificial Sequence: Synthetic oligonucleotide
cgttgggaggagcagttgagagcctac

SEQ ID NO: 18637 - DNA, 27 bp, Artificial Sequence
  Description of Artificial Sequence: Synthetic oligonucleotide
gttgggaggagcagttgagagcctacc

SEQ ID NO: 18638 - DNA, 28 bp, Artificial Sequence
  Description of Artificial Sequence: Synthetic oligonucleotide
ttgggaggagcagttgagagcctacctg

SEQ ID NO: 18639 - DNA, 27 bp, Artificial Sequence
  Description of Artificial Sequence: Synthetic oligonucleotide
tgggaggagcagttgagagcctacctg

SEQ ID NO: 18640 - DNA, 26 bp, Artificial Sequence
  Description of Artificial Sequence: Synthetic oligonucleotide
gggaggagcagttgagagcctacctg

SEQ ID NO: 18641 - DNA, 27 bp, Artificial Sequence
  Description of Artificial Sequence: Synthetic oligonucleotide
ggaggagcagttgagagcctacctgga

SEQ ID NO: 18642 - DNA, 27 bp, Artificial Sequence
  Description of Artificial Sequence: Synthetic oligonucleotide
gaggagcagttgagagcctacctggag

SEQ ID NO: 18643 - DNA, 27 bp, Artificial Sequence
  Description of Artificial Sequence: Synthetic oligonucleotide
aggagcagttgagagcctacctggagg

SEQ ID NO: 18644 - DNA, 26 bp, Artificial Sequence
  Description of Artificial Sequence: Synthetic oligonucleotide
cgcacggacccccccaagacagatat

SEQ ID NO: 18645 - DNA, 27 bp, Artificial Sequence
  Description of Artificial Sequence: Synthetic oligonucleotide
gcacggacccccccaagacagatatga

SEQ ID NO: 18646 - DNA, 27 bp, Artificial Sequence
  Description of Artificial Sequence: Synthetic oligonucleotide
cacggacccccccaagacagatatgac

SEQ ID NO: 18647 - DNA, 27 bp, Artificial Sequence
  Description of Artificial Sequence: Synthetic oligonucleotide
acggacccccccaagacagatatgacc

SEQ ID NO: 18648 - DNA, 26 bp, Artificial Sequence
  Description of Artificial Sequence: Synthetic oligonucleotide
cggacccccccaagacagatatgacc

SEQ ID NO: 18649 - DNA, 27 bp, Artificial Sequence
  Description of Artificial Sequence: Synthetic oligonucleotide
ggacccccccaagacagatatgaccca

SEQ ID NO: 18650 - DNA, 27 bp, Artificial Sequence
  Description of Artificial Sequence: Synthetic oligonucleotide
gacccccccaagacagatatgacccac

SEQ ID NO: 18651 - DNA, 27 bp, Artificial Sequence
  Description of Artificial Sequence: Synthetic oligonucleotide
acccccccaagacagatatgacccacc

SEQ ID NO: 18652 - DNA, 27 bp, Artificial Sequence
  Description of Artificial Sequence: Synthetic oligonucleotide
cccccccaagacagatatgacccacca

SEQ ID NO: 18653 - DNA, 27 bp, Artificial Sequence
  Description of Artificial Sequence: Synthetic oligonucleotide
ccccccaagacagatatgacccaccac

SEQ ID NO: 18654 - DNA, 27 bp, Artificial Sequence
  Description of Artificial Sequence: Synthetic oligonucleotide
cccccaagacagatatgacccaccacc

SEQ ID NO: 18655 - DNA, 27 bp, Artificial Sequence
  Description of Artificial Sequence: Synthetic oligonucleotide
ccccaagacagatatgacccaccaccc

SEQ ID NO: 18656 - DNA, 27 bp, Artificial Sequence
  Description of Artificial Sequence: Synthetic oligonucleotide
cccaagacagatatgacccaccacccc

SEQ ID NO: 18657 - DNA, 29 bp, Artificial Sequence
  Description of Artificial Sequence: Synthetic oligonucleotide
ccaagacagatatgacccaccaccccatc

SEQ ID NO: 18658 - DNA, 30 bp, Artificial Sequence
  Description of Artificial Sequence: Synthetic oligonucleotide
caagacagatatgacccaccaccccatctc

SEQ ID NO: 18659 - DNA, 31 bp, Artificial Sequence
  Description of Artificial Sequence: Synthetic oligonucleotide
aagacagatatgacccaccaccccatctctg

SEQ ID NO: 18660 - DNA, 30 bp, Artificial Sequence
  Description of Artificial Sequence: Synthetic oligonucleotide
agacagatatgacccaccaccccatctctg

SEQ ID NO: 18661 - DNA, 29 bp, Artificial Sequence
  Description of Artificial Sequence: Synthetic oligonucleotide
gacagatatgacccaccaccccatctctg

SEQ ID NO: 18662 - DNA, 30 bp, Artificial Sequence
  Description of Artificial Sequence: Synthetic oligonucleotide
acagatatgacccaccaccccatctctgac

SEQ ID NO: 18663 - DNA, 29 bp, Artificial Sequence
  Description of Artificial Sequence: Synthetic oligonucleotide
cagatatgacccaccaccccatctctgac

SEQ ID NO: 18664 - DNA, 29 bp, Artificial Sequence
  Description of Artificial Sequence: Synthetic oligonucleotide
agatatgacccaccaccccatctctgacc

SEQ ID NO: 18665 - DNA, 28 bp, Artificial Sequence
  Description of Artificial Sequence: Synthetic oligonucleotide
gatatgacccaccaccccatctctgacc

SEQ ID NO: 18666 - DNA, 28 bp, Artificial Sequence
  Description of Artificial Sequence: Synthetic oligonucleotide
cagtcacagactgaccgagagaacctgg

SEQ ID NO: 18667 - DNA, 28 bp, Artificial Sequence
  Description of Artificial Sequence: Synthetic oligonucleotide
agtcacagactgaccgagagaacctggg

SEQ ID NO: 18668 - DNA, 27 bp, Artificial Sequence
  Description of Artificial Sequence: Synthetic oligonucleotide
gtcacagactgaccgagagaacctggg

SEQ ID NO: 18669 - DNA, 20 bp, Artificial Sequence
  Description of Artificial Sequence: Synthetic oligonucleotide
gcggcccgtcgggcggagta

SEQ ID NO: 18670 - DNA, 22 bp, Artificial Sequence
  Description of Artificial Sequence: Synthetic oligonucleotide
cggcccgtcgggcggagtagtt

SEQ ID NO: 18671 - DNA, 23 bp, Artificial Sequence
  Description of Artificial Sequence: Synthetic oligonucleotide
ggcccgtcgggcggagtagttga

SEQ ID NO: 18672 - DNA, 24 bp, Artificial Sequence
  Description of Artificial Sequence: Synthetic oligonucleotide
gcccgtcgggcggagtagttgaga

SEQ ID NO: 18673 - DNA, 24 bp, Artificial Sequence
  Description of Artificial Sequence: Synthetic oligonucleotide
cccgtcgggcggagtagttgagag

SEQ ID NO: 18674 - DNA, 24 bp, Artificial Sequence
  Description of Artificial Sequence: Synthetic oligonucleotide
ccgtcgggcggagtagttgagagc

SEQ ID NO: 18675 - DNA, 26 bp, Artificial Sequence
  Description of Artificial Sequence: Synthetic oligonucleotide
cgtcgggcggagtagttgagagccta

SEQ ID NO: 18676 - DNA, 26 bp, Artificial Sequence
  Description of Artificial Sequence: Synthetic oligonucleotide
gtcgggcggagtagttgagagcctac

SEQ ID NO: 18677 - DNA, 27 bp, Artificial Sequence
  Description of Artificial Sequence: Synthetic oligonucleotide
tcgggcggagtagttgagagcctacct

SEQ ID NO: 18678 - DNA, 26 bp, Artificial Sequence
  Description of Artificial Sequence: Synthetic oligonucleotide
cgggcggagtagttgagagcctacct

SEQ ID NO: 18679 - DNA, 26 bp, Artificial Sequence
  Description of Artificial Sequence: Synthetic oligonucleotide
gggcggagtagttgagagcctacctg

SEQ ID NO: 18680 - DNA, 27 bp, Artificial Sequence
  Description of Artificial Sequence: Synthetic oligonucleotide
ggcggagtagttgagagcctacctgga

SEQ ID NO: 18681 - DNA, 27 bp, Artificial Sequence
  Description of Artificial Sequence: Synthetic oligonucleotide
gcggagtagttgagagcctacctggag

SEQ ID NO: 18682 - DNA, 27 bp, Artificial Sequence
  Description of Artificial Sequence: Synthetic oligonucleotide
cggagtagttgagagcctacctggagg

SEQ ID NO: 18683 - DNA, 27 bp, Artificial Sequence
  Description of Artificial Sequence: Synthetic oligonucleotide
ggagtagttgagagcctacctggaggg

SEQ ID NO: 18684 - DNA, 27 bp, Artificial Sequence
  Description of Artificial Sequence: Synthetic oligonucleotide
gagtagttgagagcctacctggagggc

SEQ ID NO: 18685 - DNA, 28 bp, Artificial Sequence
  Description of Artificial Sequence: Synthetic oligonucleotide
agtagttgagagcctacctggagggcac

SEQ ID NO: 18686 - DNA, 27 bp, Artificial Sequence
  Description of Artificial Sequence: Synthetic oligonucleotide
gtagttgagagcctacctggagggcac

SEQ ID NO: 18687 - DNA, 27 bp, Artificial Sequence
  Description of Artificial Sequence: Synthetic oligonucleotide
tagttgagagcctacctggagggcacg

SEQ ID NO: 18688 - DNA, 25 bp, Artificial Sequence
  Description of Artificial Sequence: Synthetic oligonucleotide
cgaggccggttctcacaccatccag

SEQ ID NO: 18689 - DNA, 27 bp, Artificial Sequence
  Description of Artificial Sequence: Synthetic oligonucleotide
gaggccggttctcacaccatccaggta

SEQ ID NO: 18690 - DNA, 29 bp, Artificial Sequence
  Description of Artificial Sequence: Synthetic oligonucleotide
aggccggttctcacaccatccaggtaatg

SEQ ID NO: 18691 - DNA, 28 bp, Artificial Sequence
  Description of Artificial Sequence: Synthetic oligonucleotide
ggccggttctcacaccatccaggtaatg

SEQ ID NO: 18692 - DNA, 31 bp, Artificial Sequence
  Description of Artificial Sequence: Synthetic oligonucleotide
gccggttctcacaccatccaggtaatgtatg

SEQ ID NO: 18693 - DNA, 31 bp, Artificial Sequence
  Description of Artificial Sequence: Synthetic oligonucleotide
ccggttctcacaccatccaggtaatgtatgg

SEQ ID NO: 18694 - DNA, 31 bp, Artificial Sequence
  Description of Artificial Sequence: Synthetic oligonucleotide
cggttctcacaccatccaggtaatgtatggc

SEQ ID NO: 18695 - DNA, 32 bp, Artificial Sequence
  Description of Artificial Sequence: Synthetic oligonucleotide
ggttctcacaccatccaggtaatgtatggctg

SEQ ID NO: 18696 - DNA, 32 bp, Artificial Sequence
  Description of Artificial Sequence: Synthetic oligonucleotide
gttctcacaccatccaggtaatgtatggctgc

SEQ ID NO: 18697 - DNA, 32 bp, Artificial Sequence
  Description of Artificial Sequence: Synthetic oligonucleotide
ttctcacaccatccaggtaatgtatggctgcg

SEQ ID NO: 18698 - DNA, 31 bp, Artificial Sequence
  Description of Artificial Sequence: Synthetic oligonucleotide
tctcacaccatccaggtaatgtatggctgcg

SEQ ID NO: 18699 - DNA, 30 bp, Artificial Sequence
  Description of Artificial Sequence: Synthetic oligonucleotide
ctcacaccatccaggtaatgtatggctgcg

SEQ ID NO: 18700 - DNA, 31 bp, Artificial Sequence
  Description of Artificial Sequence: Synthetic oligonucleotide
tcacaccatccaggtaatgtatggctgcgac

SEQ ID NO: 18701 - DNA, 30 bp, Artificial Sequence
  Description of Artificial Sequence: Synthetic oligonucleotide
cacaccatccaggtaatgtatggctgcgac

SEQ ID NO: 18702 - DNA, 30 bp, Artificial Sequence
  Description of Artificial Sequence: Synthetic oligonucleotide
acaccatccaggtaatgtatggctgcgacg

SEQ ID NO: 18703 - DNA, 29 bp, Artificial Sequence
  Description of Artificial Sequence: Synthetic oligonucleotide
caccatccaggtaatgtatggctgcgacg

SEQ ID NO: 18704 - DNA, 30 bp, Artificial Sequence
  Description of Artificial Sequence: Synthetic oligonucleotide
accatccaggtaatgtatggctgcgacgtg

SEQ ID NO: 18705 - DNA, 29 bp, Artificial Sequence
  Description of Artificial Sequence: Synthetic oligonucleotide
ccatccaggtaatgtatggctgcgacgtg

SEQ ID NO: 18706 - DNA, 29 bp, Artificial Sequence
  Description of Artificial Sequence: Synthetic oligonucleotide
catccaggtaatgtatggctgcgacgtgg

SEQ ID NO: 18707 - DNA, 29 bp, Artificial Sequence
  Description of Artificial Sequence: Synthetic oligonucleotide
atccaggtaatgtatggctgcgacgtggg

SEQ ID NO: 18708 - DNA, 28 bp, Artificial Sequence
  Description of Artificial Sequence: Synthetic oligonucleotide
tccaggtaatgtatggctgcgacgtggg

SEQ ID NO: 18709 - DNA, 27 bp, Artificial Sequence
  Description of Artificial Sequence: Synthetic oligonucleotide
ccaggtaatgtatggctgcgacgtggg

SEQ ID NO: 18710 - DNA, 27 bp, Artificial Sequence
  Description of Artificial Sequence: Synthetic oligonucleotide
caggtaatgtatggctgcgacgtgggg

SEQ ID NO: 18711 - DNA, 28 bp, Artificial Sequence
  Description of Artificial Sequence: Synthetic oligonucleotide
aggtaatgtatggctgcgacgtggggtc

SEQ ID NO: 18712 - DNA, 27 bp, Artificial Sequence
  Description of Artificial Sequence: Synthetic oligonucleotide
ggtaatgtatggctgcgacgtggggtc

SEQ ID NO: 18713 - DNA, 27 bp, Artificial Sequence
  Description of Artificial Sequence: Synthetic oligonucleotide
gtaatgtatggctgcgacgtggggtcg

SEQ ID NO: 18714 - DNA, 23 bp, Artificial Sequence
  Description of Artificial Sequence: Synthetic oligonucleotide
ctggagggcacgtgcgtggagtc

SEQ ID NO: 18715 - DNA, 23 bp, Artificial Sequence
  Description of Artificial Sequence: Synthetic oligonucleotide
tggagggcacgtgcgtggagtcg

SEQ ID NO: 18716 - DNA, 22 bp, Artificial Sequence
  Description of Artificial Sequence: Synthetic oligonucleotide
ggagggcacgtgcgtggagtcg

SEQ ID NO: 18717 - DNA, 23 bp, Artificial Sequence
  Description of Artificial Sequence: Synthetic oligonucleotide
gagggcacgtgcgtggagtcgct

SEQ ID NO: 18718 - DNA, 23 bp, Artificial Sequence
  Description of Artificial Sequence: Synthetic oligonucleotide
agggcacgtgcgtggagtcgctc

SEQ ID NO: 18719 - DNA, 22 bp, Artificial Sequence
  Description of Artificial Sequence: Synthetic oligonucleotide
gggcacgtgcgtggagtcgctc

SEQ ID NO: 18720 - DNA, 22 bp, Artificial Sequence
  Description of Artificial Sequence: Synthetic oligonucleotide
ggcacgtgcgtggagtcgctcc

SEQ ID NO: 18721 - DNA, 22 bp, Artificial Sequence
  Description of Artificial Sequence: Synthetic oligonucleotide
gcacgtgcgtggagtcgctccg

SEQ ID NO: 18722 - DNA, 23 bp, Artificial Sequence
  Description of Artificial Sequence: Synthetic oligonucleotide
cacgtgcgtggagtcgctccgca

SEQ ID NO: 18723 - DNA, 26 bp, Artificial Sequence
  Description of Artificial Sequence: Synthetic oligonucleotide
acgtgcgtggagtcgctccgcagata

SEQ ID NO: 18724 - DNA, 25 bp, Artificial Sequence
  Description of Artificial Sequence: Synthetic oligonucleotide
cgtgcgtggagtcgctccgcagata

SEQ ID NO: 18725 - DNA, 25 bp, Artificial Sequence
  Description of Artificial Sequence: Synthetic oligonucleotide
gtgcgtggagtcgctccgcagatac

SEQ ID NO: 18726 - DNA, 26 bp, Artificial Sequence
  Description of Artificial Sequence: Synthetic oligonucleotide
tgcgtggagtcgctccgcagatacct

SEQ ID NO: 18727 - DNA, 25 bp, Artificial Sequence
  Description of Artificial Sequence: Synthetic oligonucleotide
gcgtggagtcgctccgcagatacct

SEQ ID NO: 18728 - DNA, 25 bp, Artificial Sequence
  Description of Artificial Sequence: Synthetic oligonucleotide
cgtggagtcgctccgcagatacctg

SEQ ID NO: 18729 - DNA, 26 bp, Artificial Sequence
  Description of Artificial Sequence: Synthetic oligonucleotide
gtggagtcgctccgcagatacctgga

SEQ ID NO: 18730 - DNA, 27 bp, Artificial Sequence
  Description of Artificial Sequence: Synthetic oligonucleotide
tggagtcgctccgcagatacctggaga

SEQ ID NO: 18731 - DNA, 27 bp, Artificial Sequence
  Description of Artificial Sequence: Synthetic oligonucleotide
ggagtcgctccgcagatacctggagaa

SEQ ID NO: 18732 - DNA, 27 bp, Artificial Sequence
  Description of Artificial Sequence: Synthetic oligonucleotide
gagtcgctccgcagatacctggagaac

SEQ ID NO: 18733 - DNA, 27 bp, Artificial Sequence
  Description of Artificial Sequence: Synthetic oligonucleotide
agtcgctccgcagatacctggagaacg

SEQ ID NO: 18734 - DNA, 26 bp, Artificial Sequence
  Description of Artificial Sequence: Synthetic oligonucleotide
gtcgctccgcagatacctggagaacg

SEQ ID NO: 18735 - DNA, 26 bp, Artificial Sequence
  Description of Artificial Sequence: Synthetic oligonucleotide
tcgctccgcagatacctggagaacgg

SEQ ID NO: 18736 - DNA, 25 bp, Artificial Sequence
  Description of Artificial Sequence: Synthetic oligonucleotide
cgctccgcagatacctggagaacgg

SEQ ID NO: 18737 - DNA, 21 bp, Artificial Sequence
  Description of Artificial Sequence: Synthetic oligonucleotide
gggcgcttcctccgcgggtgt

SEQ ID NO: 18738 - DNA, 23 bp, Artificial Sequence
  Description of Artificial Sequence: Synthetic oligonucleotide
ggcgcttcctccgcgggtgtgaa

SEQ ID NO: 18739 - DNA, 24 bp, Artificial Sequence
  Description of Artificial Sequence: Synthetic oligonucleotide
gcgcttcctccgcgggtgtgaaca

SEQ ID NO: 18740 - DNA, 24 bp, Artificial Sequence
  Description of Artificial Sequence: Synthetic oligonucleotide
cgcttcctccgcgggtgtgaacag

SEQ ID NO: 18741 - DNA, 25 bp, Artificial Sequence
  Description of Artificial Sequence: Synthetic oligonucleotide
gcttcctccgcgggtgtgaacagca

SEQ ID NO: 18742 - DNA, 25 bp, Artificial Sequence
  Description of Artificial Sequence: Synthetic oligonucleotide
cttcctccgcgggtgtgaacagcac

SEQ ID NO: 18743 - DNA, 25 bp, Artificial Sequence
  Description of Artificial Sequence: Synthetic oligonucleotide
ttcctccgcgggtgtgaacagcacg

SEQ ID NO: 18744 - DNA, 24 bp, Artificial Sequence
  Description of Artificial Sequence: Synthetic oligonucleotide
tcctccgcgggtgtgaacagcacg

SEQ ID NO: 18745 - DNA, 23 bp, Artificial Sequence
  Description of Artificial Sequence: Synthetic oligonucleotide
cctccgcgggtgtgaacagcacg

SEQ ID NO: 18746 - DNA, 23 bp, Artificial Sequence
  Description of Artificial Sequence: Synthetic oligonucleotide
ctccgcgggtgtgaacagcacgc

SEQ ID NO: 18747 - DNA, 25 bp, Artificial Sequence
  Description of Artificial Sequence: Synthetic oligonucleotide
tccgcgggtgtgaacagcacgccta

SEQ ID NO: 18748 - DNA, 24 bp, Artificial Sequence
  Description of Artificial Sequence: Synthetic oligonucleotide
ccgcgggtgtgaacagcacgccta

SEQ ID NO: 18749 - DNA, 24 bp, Artificial Sequence
  Description of Artificial Sequence: Synthetic oligonucleotide
cgcgggtgtgaacagcacgcctac

SEQ ID NO: 18750 - DNA, 25 bp, Artificial Sequence
  Description of Artificial Sequence: Synthetic oligonucleotide
gcgggtgtgaacagcacgcctacga

SEQ ID NO: 18751 - DNA, 25 bp, Artificial Sequence
  Description of Artificial Sequence: Synthetic oligonucleotide
cgggtgtgaacagcacgcctacgac

SEQ ID NO: 18752 - DNA, 25 bp, Artificial Sequence
  Description of Artificial Sequence: Synthetic oligonucleotide
gggtgtgaacagcacgcctacgacg

SEQ ID NO: 18753 - DNA, 25 bp, Artificial Sequence
  Description of Artificial Sequence: Synthetic oligonucleotide
ggtgtgaacagcacgcctacgacgg

SEQ ID NO: 18754 - DNA, 27 bp, Artificial Sequence
  Description of Artificial Sequence: Synthetic oligonucleotide
gtgtgaacagcacgcctacgacggcaa

SEQ ID NO: 18755 - DNA, 27 bp, Artificial Sequence
  Description of Artificial Sequence: Synthetic oligonucleotide
tgtgaacagcacgcctacgacggcaag

SEQ ID NO: 18756 - DNA, 26 bp, Artificial Sequence
  Description of Artificial Sequence: Synthetic oligonucleotide
gtgaacagcacgcctacgacggcaag

SEQ ID NO: 18757 - DNA, 26 bp, Artificial Sequence
  Description of Artificial Sequence: Synthetic oligonucleotide
caggagacacggaatgtgaaggcccg

SEQ ID NO: 18758 - DNA, 27 bp, Artificial Sequence
  Description of Artificial Sequence: Synthetic oligonucleotide
aggagacacggaatgtgaaggcccggt

SEQ ID NO: 18759 - DNA, 26 bp, Artificial Sequence
  Description of Artificial Sequence: Synthetic oligonucleotide
ggagacacggaatgtgaaggcccggt

SEQ ID NO: 18760 - DNA, 27 bp, Artificial Sequence
  Description of Artificial Sequence: Synthetic oligonucleotide
gagacacggaatgtgaaggcccggtca

SEQ ID NO: 18761 - DNA, 27 bp, Artificial Sequence
  Description of Artificial Sequence: Synthetic oligonucleotide
agacacggaatgtgaaggcccggtcac

SEQ ID NO: 18762 - DNA, 27 bp, Artificial Sequence
  Description of Artificial Sequence: Synthetic oligonucleotide
gacacggaatgtgaaggcccggtcaca

SEQ ID NO: 18763 - DNA, 27 bp, Artificial Sequence
  Description of Artificial Sequence: Synthetic oligonucleotide
acacggaatgtgaaggcccggtcacag

SEQ ID NO: 18764 - DNA, 27 bp, Artificial Sequence
  Description of Artificial Sequence: Synthetic oligonucleotide
cacggaatgtgaaggcccggtcacaga

SEQ ID NO: 18765 - DNA, 27 bp, Artificial Sequence
  Description of Artificial Sequence: Synthetic oligonucleotide
acggaatgtgaaggcccggtcacagac

SEQ ID NO: 18766 - DNA, 27 bp, Artificial Sequence
  Description of Artificial Sequence: Synthetic oligonucleotide
cggaatgtgaaggcccggtcacagact

SEQ ID NO: 18767 - DNA, 27 bp, Artificial Sequence
  Description of Artificial Sequence: Synthetic oligonucleotide
ggaatgtgaaggcccggtcacagactg

SEQ ID NO: 18768 - DNA, 28 bp, Artificial Sequence
  Description of Artificial Sequence: Synthetic oligonucleotide
gaatgtgaaggcccggtcacagactgac

SEQ ID NO: 18769 - DNA, 28 bp, Artificial Sequence
  Description of Artificial Sequence: Synthetic oligonucleotide
aatgtgaaggcccggtcacagactgacc

SEQ ID NO: 18770 - DNA, 27 bp, Artificial Sequence
  Description of Artificial Sequence: Synthetic oligonucleotide
atgtgaaggcccggtcacagactgacc

SEQ ID NO: 18771 - DNA, 26 bp, Artificial Sequence
  Description of Artificial Sequence: Synthetic oligonucleotide
tgtgaaggcccggtcacagactgacc

SEQ ID NO: 18772 - DNA, 25 bp, Artificial Sequence
  Description of Artificial Sequence: Synthetic oligonucleotide
gtgaaggcccggtcacagactgacc

SEQ ID NO: 18773 - DNA, 26 bp, Artificial Sequence
  Description of Artificial Sequence: Synthetic oligonucleotide
tgaaggcccggtcacagactgaccga

SEQ ID NO: 18774 - DNA, 25 bp, Artificial Sequence
  Description of Artificial Sequence: Synthetic oligonucleotide
gaaggcccggtcacagactgaccga

SEQ ID NO: 18775 - DNA, 26 bp, Artificial Sequence
  Description of Artificial Sequence: Synthetic oligonucleotide
aaggcccggtcacagactgaccgagt

SEQ ID NO: 18776 - DNA, 25 bp, Artificial Sequence
  Description of Artificial Sequence: Synthetic oligonucleotide
aggcccggtcacagactgaccgagt

SEQ ID NO: 18777 - DNA, 24 bp, Artificial Sequence
  Description of Artificial Sequence: Synthetic oligonucleotide
ggcccggtcacagactgaccgagt

SEQ ID NO: 18778 - DNA, 24 bp, Artificial Sequence
  Description of Artificial Sequence: Synthetic oligonucleotide
gcccggtcacagactgaccgagtg

SEQ ID NO: 18779 - DNA, 25 bp, Artificial Sequence
  Description of Artificial Sequence: Synthetic oligonucleotide
cccggtcacagactgaccgagtgga

SEQ ID NO: 18780 - DNA, 25 bp, Artificial Sequence
  Description of Artificial Sequence: Synthetic oligonucleotide
ccggtcacagactgaccgagtggac

SEQ ID NO: 18781 - DNA, 26 bp, Artificial Sequence
  Description of Artificial Sequence: Synthetic oligonucleotide
cggtcacagactgaccgagtggacct

SEQ ID NO: 18782 - DNA, 26 bp, Artificial Sequence
  Description of Artificial Sequence: Synthetic oligonucleotide
ggtcacagactgaccgagtggacctg

SEQ ID NO: 18783 - DNA, 22 bp, Artificial Sequence
  Description of Artificial Sequence: Synthetic oligonucleotide
ccgcgagccagaggatggagcg

SEQ ID NO: 18784 - DNA, 22 bp, Artificial Sequence
  Description of Artificial Sequence: Synthetic oligonucleotide
cgcgagccagaggatggagcgg

SEQ ID NO: 18785 - DNA, 22 bp, Artificial Sequence
  Description of Artificial Sequence: Synthetic oligonucleotide
gcgagccagaggatggagcggc

SEQ ID NO: 18786 - DNA, 22 bp, Artificial Sequence
  Description of Artificial Sequence: Synthetic oligonucleotide
cgagccagaggatggagcggcg

SEQ ID NO: 18787 - DNA, 22 bp, Artificial Sequence
  Description of Artificial Sequence: Synthetic oligonucleotide
gagccagaggatggagcggcgg

SEQ ID NO: 18788 - DNA, 22 bp, Artificial Sequence
  Description of Artificial Sequence: Synthetic oligonucleotide
agccagaggatggagcggcggg

SEQ ID NO: 18789 - DNA, 21 bp, Artificial Sequence
  Description of Artificial Sequence: Synthetic oligonucleotide
gccagaggatggagcggcggg

SEQ ID NO: 18790 - DNA, 21 bp, Artificial Sequence
  Description of Artificial Sequence: Synthetic oligonucleotide
ccagaggatggagcggcgggc

SEQ ID NO: 18791 - DNA, 21 bp, Artificial Sequence
  Description of Artificial Sequence: Synthetic oligonucleotide
cagaggatggagcggcgggcg

SEQ ID NO: 18792 - DNA, 21 bp, Artificial Sequence
  Description of Artificial Sequence: Synthetic oligonucleotide
agaggatggagcggcgggcgc

SEQ ID NO: 18793 - DNA, 20 bp, Artificial Sequence
  Description of Artificial Sequence: Synthetic oligonucleotide
gaggatggagcggcgggcgc

SEQ ID NO: 18794 - DNA, 20 bp, Artificial Sequence
  Description of Artificial Sequence: Synthetic oligonucleotide
aggatggagcggcgggcgcc

SEQ ID NO: 18795 - DNA, 20 bp, Artificial Sequence
  Description of Artificial Sequence: Synthetic oligonucleotide
ggatggagcggcgggcgcct

SEQ ID NO: 18796 - DNA, 20 bp, Artificial Sequence
  Description of Artificial Sequence: Synthetic oligonucleotide
gatggagcggcgggcgccgt

SEQ ID NO: 18797 - DNA, 20 bp, Artificial Sequence
  Description of Artificial Sequence: Synthetic oligonucleotide
atggagcggcgggcgccgtg

SEQ ID NO: 18798 - DNA, 20 bp, Artificial Sequence
  Description of Artificial Sequence: Synthetic oligonucleotide
tggagcggcgggcgccgtgt

SEQ ID NO: 18799 - DNA, 20 bp, Artificial Sequence
  Description of Artificial Sequence: Synthetic oligonucleotide
ggagcggcgggcgccgtgtt

SEQ ID NO: 18800 - DNA, 21 bp, Artificial Sequence
  Description of Artificial Sequence: Synthetic oligonucleotide
gagcggcgggcgccgtggata

SEQ ID NO: 18801 - DNA, 22 bp, Artificial Sequence
  Description of Artificial Sequence: Synthetic oligonucleotide
agcggcgggcgccgtggataga

SEQ ID NO: 18802 - DNA, 21 bp, Artificial Sequence
  Description of Artificial Sequence: Synthetic oligonucleotide
gcggcgggcgccgtggataga

SEQ ID NO: 18803 - DNA, 21 bp, Artificial Sequence
  Description of Artificial Sequence: Synthetic oligonucleotide
cggcgggcgccgtggatagag

SEQ ID NO: 18804 - DNA, 22 bp, Artificial Sequence
  Description of Artificial Sequence: Synthetic oligonucleotide
ggcgggcgccgtggatagagca

SEQ ID NO: 18805 - DNA, 26 bp, Artificial Sequence
  Description of Artificial Sequence: Synthetic oligonucleotide
tcgtggagaccaggcctgcagggaat

SEQ ID NO: 18806 - DNA, 25 bp, Artificial Sequence
  Description of Artificial Sequence: Synthetic oligonucleotide
cgtggagaccaggcctgcagggaat

SEQ ID NO: 18807 - DNA, 25 bp, Artificial Sequence
  Description of Artificial Sequence: Synthetic oligonucleotide
gtggagaccaggcctgcagggaatg

SEQ ID NO: 18808 - DNA, 27 bp, Artificial Sequence
  Description of Artificial Sequence: Synthetic oligonucleotide
tggagaccaggcctgcagggaatggaa

SEQ ID NO: 18809 - DNA, 26 bp, Artificial Sequence
  Description of Artificial Sequence: Synthetic oligonucleotide
ggagaccaggcctgcagggaatggaa

SEQ ID NO: 18810 - DNA, 26 bp, Artificial Sequence
  Description of Artificial Sequence: Synthetic oligonucleotide
gagaccaggcctgcagggaatggaac

SEQ ID NO: 18811 - DNA, 27 bp, Artificial Sequence
  Description of Artificial Sequence: Synthetic oligonucleotide
agaccaggcctgcagggaatggaacct

SEQ ID NO: 18812 - DNA, 27 bp, Artificial Sequence
  Description of Artificial Sequence: Synthetic oligonucleotide
gaccaggcctgcagggaatggaacctt

SEQ ID NO: 18813 - DNA, 27 bp, Artificial Sequence
  Description of Artificial Sequence: Synthetic oligonucleotide
accaggcctgcagggaatggaaccttc

SEQ ID NO: 18814 - DNA, 26 bp, Artificial Sequence
  Description of Artificial Sequence: Synthetic oligonucleotide
ccaggcctgcagggaatggaaccttc

SEQ ID NO: 18815 - DNA, 27 bp, Artificial Sequence
  Description of Artificial Sequence: Synthetic oligonucleotide
caggcctgcagggaatggaaccttcca

SEQ ID NO: 18816 - DNA, 27 bp, Artificial Sequence
  Description of Artificial Sequence: Synthetic oligonucleotide
aggcctgcagggaatggaaccttccag

SEQ ID NO: 18817 - DNA, 27 bp, Artificial Sequence
  Description of Artificial Sequence: Synthetic oligonucleotide
ggcctgcagggaatggaaccttccaga

SEQ ID NO: 18818 - DNA, 28 bp, Artificial Sequence
  Description of Artificial Sequence: Synthetic oligonucleotide
gcctgcagggaatggaaccttccagaag

SEQ ID NO: 18819 - DNA, 29 bp, Artificial Sequence
  Description of Artificial Sequence: Synthetic oligonucleotide
cctgcagggaatggaaccttccagaagtg

SEQ ID NO: 18820 - DNA, 29 bp, Artificial Sequence
  Description of Artificial Sequence: Synthetic oligonucleotide
ctgcagggaatggaaccttccagaagtgg

SEQ ID NO: 18821 - DNA, 29 bp, Artificial Sequence
  Description of Artificial Sequence: Synthetic oligonucleotide
tgcagggaatggaaccttccagaagtggg

SEQ ID NO: 18822 - DNA, 28 bp, Artificial Sequence
  Description of Artificial Sequence: Synthetic oligonucleotide
gcagggaatggaaccttccagaagtggg

SEQ ID NO: 18823 - DNA, 28 bp, Artificial Sequence
  Description of Artificial Sequence: Synthetic oligonucleotide
cagggaatggaaccttccagaagtgggc

SEQ ID NO: 18824 - DNA, 28 bp, Artificial Sequence
  Description of Artificial Sequence: Synthetic oligonucleotide
agggaatggaaccttccagaagtgggcg

SEQ ID NO: 18825 - DNA, 27 bp, Artificial Sequence
  Description of Artificial Sequence: Synthetic oligonucleotide
gggaatggaaccttccagaagtgggcg

SEQ ID NO: 18826 - DNA, 27 bp, Artificial Sequence
  Description of Artificial Sequence: Synthetic oligonucleotide
ggaatggaaccttccagaagtgggcgg

SEQ ID NO: 18827 - DNA, 27 bp, Artificial Sequence
  Description of Artificial Sequence: Synthetic oligonucleotide
gaatggaaccttccagaagtgggcggc

SEQ ID NO: 18828 - DNA, 28 bp, Artificial Sequence
  Description of Artificial Sequence: Synthetic oligonucleotide
aatggaaccttccagaagtgggcggctg

SEQ ID NO: 18829 - DNA, 26 bp, Artificial Sequence
  Description of Artificial Sequence: Synthetic oligonucleotide
ggacatggcggctcagatcacccaga

SEQ ID NO: 18830 - DNA, 26 bp, Artificial Sequence
  Description of Artificial Sequence: Synthetic oligonucleotide
gacatggcggctcagatcacccagag

SEQ ID NO: 18831 - DNA, 27 bp, Artificial Sequence
  Description of Artificial Sequence: Synthetic oligonucleotide
acatggcggctcagatcacccagagca

SEQ ID NO: 18832 - DNA, 27 bp, Artificial Sequence
  Description of Artificial Sequence: Synthetic oligonucleotide
catggcggctcagatcacccagagcaa

SEQ ID NO: 18833 - DNA, 27 bp, Artificial Sequence
  Description of Artificial Sequence: Synthetic oligonucleotide
atggcggctcagatcacccagagcaag

SEQ ID NO: 18834 - DNA, 27 bp, Artificial Sequence
  Description of Artificial Sequence: Synthetic oligonucleotide
tggcggctcagatcacccagagcaagt

SEQ ID NO: 18835 - DNA, 26 bp, Artificial Sequence
  Description of Artificial Sequence: Synthetic oligonucleotide
ggcggctcagatcacccagagcaagt

SEQ ID NO: 18836 - DNA, 26 bp, Artificial Sequence
  Description of Artificial Sequence: Synthetic oligonucleotide
gcggctcagatcacccagagcaagtg

SEQ ID NO: 18837 - DNA, 26 bp, Artificial Sequence
  Description of Artificial Sequence: Synthetic oligonucleotide
cggctcagatcacccagagcaagtgg

SEQ ID NO: 18838 - DNA, 27 bp, Artificial Sequence
  Description of Artificial Sequence: Synthetic oligonucleotide
ggctcagatcacccagagcaagtggga

SEQ ID NO: 18839 - DNA, 27 bp, Artificial Sequence
  Description of Artificial Sequence: Synthetic oligonucleotide
gctcagatcacccagagcaagtgggag

SEQ ID NO: 18840 - DNA, 27 bp, Artificial Sequence
  Description of Artificial Sequence: Synthetic oligonucleotide
ctcagatcacccagagcaagtgggagg

SEQ ID NO: 18841 - DNA, 27 bp, Artificial Sequence
  Description of Artificial Sequence: Synthetic oligonucleotide
tcagatcacccagagcaagtgggaggc

SEQ ID NO: 18842 - DNA, 26 bp, Artificial Sequence
  Description of Artificial Sequence: Synthetic oligonucleotide
cagatcacccagagcaagtgggaggc

SEQ ID NO: 18843 - DNA, 26 bp, Artificial Sequence
  Description of Artificial Sequence: Synthetic oligonucleotide
agatcacccagagcaagtgggaggcg

SEQ ID NO: 18844 - DNA, 25 bp, Artificial Sequence
  Description of Artificial Sequence: Synthetic oligonucleotide
gatcacccagagcaagtgggaggcg

SEQ ID NO: 18845 - DNA, 25 bp, Artificial Sequence
  Description of Artificial Sequence: Synthetic oligonucleotide
atcacccagagcaagtgggaggcgg

SEQ ID NO: 18846 - DNA, 24 bp, Artificial Sequence
  Description of Artificial Sequence: Synthetic oligonucleotide
tcacccagagcaagtgggaggcgg

SEQ ID NO: 18847 - DNA, 23 bp, Artificial Sequence
  Description of Artificial Sequence: Synthetic oligonucleotide
cacccagagcaagtgggaggcgg

SEQ ID NO: 18848 - DNA, 23 bp, Artificial Sequence
  Description of Artificial Sequence: Synthetic oligonucleotide
acccagagcaagtgggaggcggc

SEQ ID NO: 18849 - DNA, 22 bp, Artificial Sequence
  Description of Artificial Sequence: Synthetic oligonucleotide
cccagagcaagtgggaggcggc

SEQ ID NO: 18850 - DNA, 22 bp, Artificial Sequence
  Description of Artificial Sequence: Synthetic oligonucleotide
ccagagcaagtgggaggcggcc

SEQ ID NO: 18851 - DNA, 22 bp, Artificial Sequence
  Description of Artificial Sequence: Synthetic oligonucleotide
cagagcaagtgggaggcggccc

SEQ ID NO: 18852 - DNA, 24 bp, Artificial Sequence
  Description of Artificial Sequence: Synthetic oligonucleotide
agagcaagtgggaggcggcccgtt

SEQ ID NO: 18853 - DNA, 23 bp, Artificial Sequence
  Description of Artificial Sequence: Synthetic oligonucleotide
gagcaagtgggaggcggcccgtt

SEQ ID NO: 18854 - DNA, 23 bp, Artificial Sequence
  Description of Artificial Sequence: Synthetic oligonucleotide
agcaagtgggaggcggcccgttg

SEQ ID NO: 18855 - DNA, 20 bp, Artificial Sequence
  Description of Artificial Sequence: Synthetic oligonucleotide
gcggcggacatggcggctcg

SEQ ID NO: 18856 - DNA, 22 bp, Artificial Sequence
  Description of Artificial Sequence: Synthetic oligonucleotide
cggcggacatggcggctcggat

SEQ ID NO: 18857 - DNA, 23 bp, Artificial Sequence
  Description of Artificial Sequence: Synthetic oligonucleotide
ggcggacatggcggctcggatca

SEQ ID NO: 18858 - DNA, 23 bp, Artificial Sequence
  Description of Artificial Sequence: Synthetic oligonucleotide
gcggacatggcggctcggatcac

SEQ ID NO: 18859 - DNA, 23 bp, Artificial Sequence
  Description of Artificial Sequence: Synthetic oligonucleotide
cggacatggcggctcggatcacc

SEQ ID NO: 18860 - DNA, 24 bp, Artificial Sequence
  Description of Artificial Sequence: Synthetic oligonucleotide
ggacatggcggctcggatcaccca

SEQ ID NO: 18861 - DNA, 24 bp, Artificial Sequence
  Description of Artificial Sequence: Synthetic oligonucleotide
gacatggcggctcggatcacccag

SEQ ID NO: 18862 - DNA, 24 bp, Artificial Sequence
  Description of Artificial Sequence: Synthetic oligonucleotide
acatggcggctcggatcacccagc

SEQ ID NO: 18863 - DNA, 23 bp, Artificial Sequence
  Description of Artificial Sequence: Synthetic oligonucleotide
catggcggctcggatcacccagc

SEQ ID NO: 18864 - DNA, 23 bp, Artificial Sequence
  Description of Artificial Sequence: Synthetic oligonucleotide
atggcggctcggatcacccagcg

SEQ ID NO: 18865 - DNA, 22 bp, Artificial Sequence
  Description of Artificial Sequence: Synthetic oligonucleotide
tggcggctcggatcacccagcg

SEQ ID NO: 18866 - DNA, 21 bp, Artificial Sequence
  Description of Artificial Sequence: Synthetic oligonucleotide
ggcggctcggatcacccagcg

SEQ ID NO: 18867 - DNA, 23 bp, Artificial Sequence
  Description of Artificial Sequence: Synthetic oligonucleotide
gcggctcggatcacccagcgcaa

SEQ ID NO: 18868 - DNA, 24 bp, Artificial Sequence
  Description of Artificial Sequence: Synthetic oligonucleotide
cggctcggatcacccagcgcaagt

SEQ ID NO: 18869 - DNA, 24 bp, Artificial Sequence
  Description of Artificial Sequence: Synthetic oligonucleotide
ggctcggatcacccagcgcaagtg

SEQ ID NO: 18870 - DNA, 24 bp, Artificial Sequence
  Description of Artificial Sequence: Synthetic oligonucleotide
gctcggatcacccagcgcaagtgg

SEQ ID NO: 18871 - DNA, 25 bp, Artificial Sequence
  Description of Artificial Sequence: Synthetic oligonucleotide
ctcggatcacccagcgcaagtggga

SEQ ID NO: 18872 - DNA, 25 bp, Artificial Sequence
  Description of Artificial Sequence: Synthetic oligonucleotide
tcggatcacccagcgcaagtgggag

SEQ ID NO: 18873 - DNA, 24 bp, Artificial Sequence
  Description of Artificial Sequence: Synthetic oligonucleotide
cggatcacccagcgcaagtgggag

SEQ ID NO: 18874 - DNA, 24 bp, Artificial Sequence
  Description of Artificial Sequence: Synthetic oligonucleotide
ggatcacccagcgcaagtgggagg

SEQ ID NO: 18875 - DNA, 21 bp, Artificial Sequence
  Description of Artificial Sequence: Synthetic oligonucleotide
ttggaccgcggcggacacggc

SEQ ID NO: 18876 - DNA, 20 bp, Artificial Sequence
  Description of Artificial Sequence: Synthetic oligonucleotide
tggaccgcggcggacacggc

SEQ ID NO: 18877 - DNA, 20 bp, Artificial Sequence
  Description of Artificial Sequence: Synthetic oligonucleotide
ggaccgcggcggacacggct

SEQ ID NO: 18878 - DNA, 20 bp, Artificial Sequence
  Description of Artificial Sequence: Synthetic oligonucleotide
gaccgcggcggacacggcgt

SEQ ID NO: 18879 - DNA, 20 bp, Artificial Sequence
  Description of Artificial Sequence: Synthetic oligonucleotide
accgcggcggacacggcggt

SEQ ID NO: 18880 - DNA, 20 bp, Artificial Sequence
  Description of Artificial Sequence: Synthetic oligonucleotide
ccgcggcggacacggcggtt

SEQ ID NO: 18881 - DNA, 20 bp, Artificial Sequence
  Description of Artificial Sequence: Synthetic oligonucleotide
cgcggcggacacggcggctt

SEQ ID NO: 18882 - DNA, 20 bp, Artificial Sequence
  Description of Artificial Sequence: Synthetic oligonucleotide
gcggcggacacggcggctca

SEQ ID NO: 18883 - DNA, 22 bp, Artificial Sequence
  Description of Artificial Sequence: Synthetic oligonucleotide
cggcggacacggcggctcagat

SEQ ID NO: 18884 - DNA, 23 bp, Artificial Sequence
  Description of Artificial Sequence: Synthetic oligonucleotide
ggcggacacggcggctcagatca

SEQ ID NO: 18885 - DNA, 23 bp, Artificial Sequence
  Description of Artificial Sequence: Synthetic oligonucleotide
gcggacacggcggctcagatcac

SEQ ID NO: 18886 - DNA, 23 bp, Artificial Sequence
  Description of Artificial Sequence: Synthetic oligonucleotide
cggacacggcggctcagatcacc

SEQ ID NO: 18887 - DNA, 24 bp, Artificial Sequence
  Description of Artificial Sequence: Synthetic oligonucleotide
ggacacggcggctcagatcaccca

SEQ ID NO: 18888 - DNA, 24 bp, Artificial Sequence
  Description of Artificial Sequence: Synthetic oligonucleotide
gacacggcggctcagatcacccag

SEQ ID NO: 18889 - DNA, 24 bp, Artificial Sequence
  Description of Artificial Sequence: Synthetic oligonucleotide
acacggcggctcagatcacccagc

SEQ ID NO: 18890 - DNA, 23 bp, Artificial Sequence
  Description of Artificial Sequence: Synthetic oligonucleotide
cacggcggctcagatcacccagc

SEQ ID NO: 18891 - DNA, 23 bp, Artificial Sequence
  Description of Artificial Sequence: Synthetic oligonucleotide
acggcggctcagatcacccagcg

SEQ ID NO: 18892 - DNA, 22 bp, Artificial Sequence
  Description of Artificial Sequence: Synthetic oligonucleotide
cggcggctcagatcacccagcg

SEQ ID NO: 18893 - DNA, 20 bp, Artificial Sequence
  Description of Artificial Sequence: Synthetic oligonucleotide
agccgcgggcgccgtggaca

SEQ ID NO: 18894 - DNA, 20 bp, Artificial Sequence
  Description of Artificial Sequence: Synthetic oligonucleotide
gccgcgggcgccgtggacat

SEQ ID NO: 18895 - DNA, 20 bp, Artificial Sequence
  Description of Artificial Sequence: Synthetic oligonucleotide
ccgcgggcgccgtggacaga

SEQ ID NO: 18896 - DNA, 20 bp, Artificial Sequence
  Description of Artificial Sequence: Synthetic oligonucleotide
cgcgggcgccgtggacagag

SEQ ID NO: 18897 - DNA, 21 bp, Artificial Sequence
  Description of Artificial Sequence: Synthetic oligonucleotide
gcgggcgccgtggacagagca

SEQ ID NO: 18898 - DNA, 21 bp, Artificial Sequence
  Description of Artificial Sequence: Synthetic oligonucleotide
cgggcgccgtggacagagcag

SEQ ID NO: 18899 - DNA, 22 bp, Artificial Sequence
  Description of Artificial Sequence: Synthetic oligonucleotide
gggcgccgtggacagagcagga

SEQ ID NO: 18900 - DNA, 23 bp, Artificial Sequence
  Description of Artificial Sequence: Synthetic oligonucleotide
ggcgccgtggacagagcaggaga

SEQ ID NO: 18901 - DNA, 23 bp, Artificial Sequence
  Description of Artificial Sequence: Synthetic oligonucleotide
gcgccgtggacagagcaggagag

SEQ ID NO: 18902 - DNA, 23 bp, Artificial Sequence
  Description of Artificial Sequence: Synthetic oligonucleotide
cgccgtggacagagcaggagagg

SEQ ID NO: 18903 - DNA, 23 bp, Artificial Sequence
  Description of Artificial Sequence: Synthetic oligonucleotide
gccgtggacagagcaggagaggc

SEQ ID NO: 18904 - DNA, 24 bp, Artificial Sequence
  Description of Artificial Sequence: Synthetic oligonucleotide
ccgtggacagagcaggagaggcct

SEQ ID NO: 18905 - DNA, 25 bp, Artificial Sequence
  Description of Artificial Sequence: Synthetic oligonucleotide
cgtggacagagcaggagaggcctga

SEQ ID NO: 18906 - DNA, 27 bp, Artificial Sequence
  Description of Artificial Sequence: Synthetic oligonucleotide
gtggacagagcaggagaggcctgagta

SEQ ID NO: 18907 - DNA, 29 bp, Artificial Sequence
  Description of Artificial Sequence: Synthetic oligonucleotide
tggacagagcaggagaggcctgagtattg

SEQ ID NO: 18908 - DNA, 28 bp, Artificial Sequence
  Description of Artificial Sequence: Synthetic oligonucleotide
ggacagagcaggagaggcctgagtattg

SEQ ID NO: 18909 - DNA, 28 bp, Artificial Sequence
  Description of Artificial Sequence: Synthetic oligonucleotide
gacagagcaggagaggcctgagtattgg

SEQ ID NO: 18910 - DNA, 28 bp, Artificial Sequence
  Description of Artificial Sequence: Synthetic oligonucleotide
acagagcaggagaggcctgagtattggg

SEQ ID NO: 18911 - DNA, 27 bp, Artificial Sequence
  Description of Artificial Sequence: Synthetic oligonucleotide
cagagcaggagaggcctgagtattggg

SEQ ID NO: 18912 - DNA, 26 bp, Artificial Sequence
  Description of Artificial Sequence: Synthetic oligonucleotide
cggagcagttgagagcctacctggac

SEQ ID NO: 18913 - DNA, 26 bp, Artificial Sequence
  Description of Artificial Sequence: Synthetic oligonucleotide
ggagcagttgagagcctacctggacg

SEQ ID NO: 18914 - DNA, 26 bp, Artificial Sequence
  Description of Artificial Sequence: Synthetic oligonucleotide
gagcagttgagagcctacctggacgg

SEQ ID NO: 18915 - DNA, 27 bp, Artificial Sequence
  Description of Artificial Sequence: Synthetic oligonucleotide
agcagttgagagcctacctggacggca

SEQ ID NO: 18916 - DNA, 26 bp, Artificial Sequence
  Description of Artificial Sequence: Synthetic oligonucleotide
gcagttgagagcctacctggacggca

SEQ ID NO: 18917 - DNA, 26 bp, Artificial Sequence
  Description of Artificial Sequence: Synthetic oligonucleotide
cagttgagagcctacctggacggcac

SEQ ID NO: 18918 - DNA, 27 bp, Artificial Sequence
  Description of Artificial Sequence: Synthetic oligonucleotide
agttgagagcctacctggacggcacgt

SEQ ID NO: 18919 - DNA, 26 bp, Artificial Sequence
  Description of Artificial Sequence: Synthetic oligonucleotide
gttgagagcctacctggacggcacgt

SEQ ID NO: 18920 - DNA, 26 bp, Artificial Sequence
  Description of Artificial Sequence: Synthetic oligonucleotide
ttgagagcctacctggacggcacgtg

SEQ ID NO: 18921 - DNA, 25 bp, Artificial Sequence
  Description of Artificial Sequence: Synthetic oligonucleotide
tgagagcctacctggacggcacgtg

SEQ ID NO: 18922 - DNA, 24 bp, Artificial Sequence
  Description of Artificial Sequence: Synthetic oligonucleotide
gagagcctacctggacggcacgtg

SEQ ID NO: 18923 - DNA, 24 bp, Artificial Sequence
  Description of Artificial Sequence: Synthetic oligonucleotide
agagcctacctggacggcacgtgc

SEQ ID NO: 18924 - DNA, 23 bp, Artificial Sequence
  Description of Artificial Sequence: Synthetic oligonucleotide
gagcctacctggacggcacgtgc

SEQ ID NO: 18925 - DNA, 24 bp, Artificial Sequence
  Description of Artificial Sequence: Synthetic oligonucleotide
agcctacctggacggcacgtgcgt

SEQ ID NO: 18926 - DNA, 23 bp, Artificial Sequence
  Description of Artificial Sequence: Synthetic oligonucleotide
gcctacctggacggcacgtgcgt

SEQ ID NO: 18927 - DNA, 23 bp, Artificial Sequence
  Description of Artificial Sequence: Synthetic oligonucleotide
cctacctggacggcacgtgcgtg

SEQ ID NO: 18928 - DNA, 24 bp, Artificial Sequence
  Description of Artificial Sequence: Synthetic oligonucleotide
ctacctggacggcacgtgcgtgga

SEQ ID NO: 18929 - DNA, 25 bp, Artificial Sequence
  Description of Artificial Sequence: Synthetic oligonucleotide
tacctggacggcacgtgcgtggagt

SEQ ID NO: 18930 - DNA, 24 bp, Artificial Sequence
  Description of Artificial Sequence: Synthetic oligonucleotide
acctggacggcacgtgcgtggagt

SEQ ID NO: 18931 - DNA, 23 bp, Artificial Sequence
  Description of Artificial Sequence: Synthetic oligonucleotide
cctggacggcacgtgcgtggagt

SEQ ID NO: 18932 - DNA, 23 bp, Artificial Sequence
  Description of Artificial Sequence: Synthetic oligonucleotide
ctggacggcacgtgcgtggagtg

SEQ ID NO: 18933 - DNA, 23 bp, Artificial Sequence
  Description of Artificial Sequence: Synthetic oligonucleotide
tggacggcacgtgcgtggagtgg

SEQ ID NO: 18934 - DNA, 22 bp, Artificial Sequence
  Description of Artificial Sequence: Synthetic oligonucleotide
ggacggcacgtgcgtggagtgg

SEQ ID NO: 18935 - DNA, 23 bp, Artificial Sequence
  Description of Artificial Sequence: Synthetic oligonucleotide
gacggcacgtgcgtggagtggct

SEQ ID NO: 18936 - DNA, 23 bp, Artificial Sequence
  Description of Artificial Sequence: Synthetic oligonucleotide
acggcacgtgcgtggagtggctc

SEQ ID NO: 18937 - DNA, 22 bp, Artificial Sequence
  Description of Artificial Sequence: Synthetic oligonucleotide
cggcacgtgcgtggagtggctc

SEQ ID NO: 18938 - DNA, 21 bp, Artificial Sequence
  Description of Artificial Sequence: Synthetic oligonucleotide
gggcgcctcctccgcgggtat

SEQ ID NO: 18939 - DNA, 23 bp, Artificial Sequence
  Description of Artificial Sequence: Synthetic oligonucleotide
ggcgcctcctccgcgggtatgaa

SEQ ID NO: 18940 - DNA, 24 bp, Artificial Sequence
  Description of Artificial Sequence: Synthetic oligonucleotide
gcgcctcctccgcgggtatgaaca

SEQ ID NO: 18941 - DNA, 24 bp, Artificial Sequence
  Description of Artificial Sequence: Synthetic oligonucleotide
cgcctcctccgcgggtatgaacag

SEQ ID NO: 18942 - DNA, 25 bp, Artificial Sequence
  Description of Artificial Sequence: Synthetic oligonucleotide
gcctcctccgcgggtatgaacagca

SEQ ID NO: 18943 - DNA, 25 bp, Artificial Sequence
  Description of Artificial Sequence: Synthetic oligonucleotide
cctcctccgcgggtatgaacagcac

SEQ ID NO: 18944 - DNA, 25 bp, Artificial Sequence
  Description of Artificial Sequence: Synthetic oligonucleotide
ctcctccgcgggtatgaacagcacg

SEQ ID NO: 18945 - DNA, 27 bp, Artificial Sequence
  Description of Artificial Sequence: Synthetic oligonucleotide
atttctccacatccgtgtcccggccca

SEQ ID NO: 18946 - DNA, 26 bp, Artificial Sequence
  Description of Artificial Sequence: Synthetic oligonucleotide
tttctccacatccgtgtcccggccca

SEQ ID NO: 18947 - DNA, 25 bp, Artificial Sequence
  Description of Artificial Sequence: Synthetic oligonucleotide
ttctccacatccgtgtcccggccca

SEQ ID NO: 18948 - DNA, 24 bp, Artificial Sequence
  Description of Artificial Sequence: Synthetic oligonucleotide
tctccacatccgtgtcccggccca

SEQ ID NO: 18949 - DNA, 23 bp, Artificial Sequence
  Description of Artificial Sequence: Synthetic oligonucleotide
ctccacatccgtgtcccggccca

SEQ ID NO: 18950 - DNA, 23 bp, Artificial Sequence
  Description of Artificial Sequence: Synthetic oligonucleotide
tccacatccgtgtcccggcccag

SEQ ID NO: 18951 - DNA, 22 bp, Artificial Sequence
  Description of Artificial Sequence: Synthetic oligonucleotide
ccacatccgtgtcccggcccag

SEQ ID NO: 18952 - DNA, 23 bp, Artificial Sequence
  Description of Artificial Sequence: Synthetic oligonucleotide
cacatccgtgtcccggcccagca

SEQ ID NO: 18953 - DNA, 24 bp, Artificial Sequence
  Description of Artificial Sequence: Synthetic oligonucleotide
acatccgtgtcccggcccagcagt

SEQ ID NO: 18954 - DNA, 23 bp, Artificial Sequence
  Description of Artificial Sequence: Synthetic oligonucleotide
catccgtgtcccggcccagcagt

SEQ ID NO: 18955 - DNA, 23 bp, Artificial Sequence
  Description of Artificial Sequence: Synthetic oligonucleotide
atccgtgtcccggcccagcagtg

SEQ ID NO: 18956 - DNA, 22 bp, Artificial Sequence
  Description of Artificial Sequence: Synthetic oligonucleotide
tccgtgtcccggcccagcagtg

SEQ ID NO: 18957 - DNA, 21 bp, Artificial Sequence
  Description of Artificial Sequence: Synthetic oligonucleotide
ccgtgtcccggcccagcagtg

SEQ ID NO: 18958 - DNA, 22 bp, Artificial Sequence
  Description of Artificial Sequence: Synthetic oligonucleotide
cgtgtcccggcccagcagtgga

SEQ ID NO: 18959 - DNA, 23 bp, Artificial Sequence
  Description of Artificial Sequence: Synthetic oligonucleotide
gtgtcccggcccagcagtggaga

SEQ ID NO: 18960 - DNA, 23 bp, Artificial Sequence
  Description of Artificial Sequence: Synthetic oligonucleotide
tgtcccggcccagcagtggagag

SEQ ID NO: 18961 - DNA, 22 bp, Artificial Sequence
  Description of Artificial Sequence: Synthetic oligonucleotide
gtcccggcccagcagtggagag

SEQ ID NO: 18962 - DNA, 22 bp, Artificial Sequence
  Description of Artificial Sequence: Synthetic oligonucleotide
tcccggcccagcagtggagagc

SEQ ID NO: 18963 - DNA, 21 bp, Artificial Sequence
  Description of Artificial Sequence: Synthetic oligonucleotide
cccggcccagcagtggagagc

SEQ ID NO: 18964 - DNA, 21 bp, Artificial Sequence
  Description of Artificial Sequence: Synthetic oligonucleotide
ccggcccagcagtggagagcc

SEQ ID NO: 18965 - DNA, 21 bp, Artificial Sequence
  Description of Artificial Sequence: Synthetic oligonucleotide
cggcccagcagtggagagccc

SEQ ID NO: 18966 - DNA, 21 bp, Artificial Sequence
  Description of Artificial Sequence: Synthetic oligonucleotide
ggcccagcagtggagagcccc

SEQ ID NO: 18967 - DNA, 21 bp, Artificial Sequence
  Description of Artificial Sequence: Synthetic oligonucleotide
gcccagcagtggagagccccg

SEQ ID NO: 18968 - DNA, 23 bp, Artificial Sequence
  Description of Artificial Sequence: Synthetic oligonucleotide
cccagcagtggagagccccgctt

SEQ ID NO: 18969 - DNA, 25 bp, Artificial Sequence
  Description of Artificial Sequence: Synthetic oligonucleotide
ccagcagtggagagccccgcttcat

SEQ ID NO: 18970 - DNA, 25 bp, Artificial Sequence
  Description of Artificial Sequence: Synthetic oligonucleotide
cagcagtggagagccccgcttcatc

SEQ ID NO: 18971 - DNA, 25 bp, Artificial Sequence
  Description of Artificial Sequence: Synthetic oligonucleotide
agcagtggagagccccgcttcatcg

SEQ ID NO: 18972 - DNA, 22 bp, Artificial Sequence
  Description of Artificial Sequence: Synthetic oligonucleotide
agcgcacggacccccccaagac

SEQ ID NO: 18973 - DNA, 21 bp, Artificial Sequence
  Description of Artificial Sequence: Synthetic oligonucleotide
gcgcacggacccccccaagac

SEQ ID NO: 18974 - DNA, 21 bp, Artificial Sequence
  Description of Artificial Sequence: Synthetic oligonucleotide
cgcacggacccccccaagacg

SEQ ID NO: 18975 - DNA, 25 bp, Artificial Sequence
  Description of Artificial Sequence: Synthetic oligonucleotide
gcacggacccccccaagacgcatat

SEQ ID NO: 18976 - DNA, 26 bp, Artificial Sequence
  Description of Artificial Sequence: Synthetic oligonucleotide
cacggacccccccaagacgcatatga

SEQ ID NO: 18977 - DNA, 27 bp, Artificial Sequence
  Description of Artificial Sequence: Synthetic oligonucleotide
acggacccccccaagacgcatatgact

SEQ ID NO: 18978 - DNA, 26 bp, Artificial Sequence
  Description of Artificial Sequence: Synthetic oligonucleotide
cggacccccccaagacgcatatgact

SEQ ID NO: 18979 - DNA, 27 bp, Artificial Sequence
  Description of Artificial Sequence: Synthetic oligonucleotide
ggacccccccaagacgcatatgactca

SEQ ID NO: 18980 - DNA, 27 bp, Artificial Sequence
  Description of Artificial Sequence: Synthetic oligonucleotide
gacccccccaagacgcatatgactcac

SEQ ID NO: 18981 - DNA, 27 bp, Artificial Sequence
  Description of Artificial Sequence: Synthetic oligonucleotide
acccccccaagacgcatatgactcacc

SEQ ID NO: 18982 - DNA, 27 bp, Artificial Sequence
  Description of Artificial Sequence: Synthetic oligonucleotide
cccccccaagacgcatatgactcacca

SEQ ID NO: 18983 - DNA, 27 bp, Artificial Sequence
  Description of Artificial Sequence: Synthetic oligonucleotide
ccccccaagacgcatatgactcaccac

SEQ ID NO: 18984 - DNA, 27 bp, Artificial Sequence
  Description of Artificial Sequence: Synthetic oligonucleotide
acctgccatgtgcagcatgagggtctc

SEQ ID NO: 18985 - DNA, 26 bp, Artificial Sequence
  Description of Artificial Sequence: Synthetic oligonucleotide
cctgccatgtgcagcatgagggtctc

SEQ ID NO: 18986 - DNA, 26 bp, Artificial Sequence
  Description of Artificial Sequence: Synthetic oligonucleotide
ctgccatgtgcagcatgagggtctcc

SEQ ID NO: 18987 - DNA, 26 bp, Artificial Sequence
  Description of Artificial Sequence: Synthetic oligonucleotide
tgccatgtgcagcatgagggtctccc

SEQ ID NO: 18988 - DNA, 25 bp, Artificial Sequence
  Description of Artificial Sequence: Synthetic oligonucleotide
gccatgtgcagcatgagggtctccc

SEQ ID NO: 18989 - DNA, 27 bp, Artificial Sequence
  Description of Artificial Sequence: Synthetic oligonucleotide
ccatgtgcagcatgagggtctccccaa

SEQ ID NO: 18990 - DNA, 27 bp, Artificial Sequence
  Description of Artificial Sequence: Synthetic oligonucleotide
catgtgcagcatgagggtctccccaag

SEQ ID NO: 18991 - DNA, 27 bp, Artificial Sequence
  Description of Artificial Sequence: Synthetic oligonucleotide
atgtgcagcatgagggtctccccaagc

SEQ ID NO: 18992 - DNA, 26 bp, Artificial Sequence
  Description of Artificial Sequence: Synthetic oligonucleotide
tgtgcagcatgagggtctccccaagc

SEQ ID NO: 18993 - DNA, 25 bp, Artificial Sequence
  Description of Artificial Sequence: Synthetic oligonucleotide
gtgcagcatgagggtctccccaagc

SEQ ID NO: 18994 - DNA, 25 bp, Artificial Sequence
  Description of Artificial Sequence: Synthetic oligonucleotide
tgcagcatgagggtctccccaagcc

SEQ ID NO: 18995 - DNA, 24 bp, Artificial Sequence
  Description of Artificial Sequence: Synthetic oligonucleotide
gcagcatgagggtctccccaagcc

SEQ ID NO: 18996 - DNA, 24 bp, Artificial Sequence
  Description of Artificial Sequence: Synthetic oligonucleotide
cagcatgagggtctccccaagccc

SEQ ID NO: 18997 - DNA, 25 bp, Artificial Sequence
  Description of Artificial Sequence: Synthetic oligonucleotide
agcatgagggtctccccaagcccct

SEQ ID NO: 18998 - DNA, 24 bp, Artificial Sequence
  Description of Artificial Sequence: Synthetic oligonucleotide
gcatgagggtctccccaagcccct

SEQ ID NO: 18999 - DNA, 25 bp, Artificial Sequence
  Description of Artificial Sequence: Synthetic oligonucleotide
catgagggtctccccaagcccctca

SEQ ID NO: 19000 - DNA, 25 bp, Artificial Sequence
  Description of Artificial Sequence: Synthetic oligonucleotide
atgagggtctccccaagcccctcac

SEQ ID NO: 19001 - DNA, 24 bp, Artificial Sequence
  Description of Artificial Sequence: Synthetic oligonucleotide
tgagggtctccccaagcccctcac

SEQ ID NO: 19002 - DNA, 23 bp, Artificial Sequence
  Description of Artificial Sequence: Synthetic oligonucleotide
gagggtctccccaagcccctcac

SEQ ID NO: 19003 - DNA, 23 bp, Artificial Sequence
  Description of Artificial Sequence: Synthetic oligonucleotide
agggtctccccaagcccctcacc

SEQ ID NO: 19004 - DNA, 22 bp, Artificial Sequence
  Description of Artificial Sequence: Synthetic oligonucleotide
gggtctccccaagcccctcacc

SEQ ID NO: 19005 - DNA, 23 bp, Artificial Sequence
  Description of Artificial Sequence: Synthetic oligonucleotide
ggtctccccaagcccctcaccct

SEQ ID NO: 19006 - DNA, 24 bp, Artificial Sequence
  Description of Artificial Sequence: Synthetic oligonucleotide
gtctccccaagcccctcaccctga

SEQ ID NO: 19007 - DNA, 26 bp, Artificial Sequence
  Description of Artificial Sequence: Synthetic oligonucleotide
tctccccaagcccctcaccctgagat

SEQ ID NO: 19008 - DNA, 25 bp, Artificial Sequence
  Description of Artificial Sequence: Synthetic oligonucleotide
ctccccaagcccctcaccctgagat

SEQ ID NO: 19009 - DNA, 25 bp, Artificial Sequence
  Description of Artificial Sequence: Synthetic oligonucleotide
tccccaagcccctcaccctgagatg

SEQ ID NO: 19010 - DNA, 24 bp, Artificial Sequence
  Description of Artificial Sequence: Synthetic oligonucleotide
ccccaagcccctcaccctgagatg

SEQ ID NO: 19011 - DNA, 24 bp, Artificial Sequence
  Description of Artificial Sequence: Synthetic oligonucleotide
ctcttggaccgcggcagacatggc

SEQ ID NO: 19012 - DNA, 24 bp, Artificial Sequence
  Description of Artificial Sequence: Synthetic oligonucleotide
tcttggaccgcggcagacatggcg

SEQ ID NO: 19013 - DNA, 23 bp, Artificial Sequence
  Description of Artificial Sequence: Synthetic oligonucleotide
cttggaccgcggcagacatggcg

SEQ ID NO: 19014 - DNA, 23 bp, Artificial Sequence
  Description of Artificial Sequence: Synthetic oligonucleotide
ttggaccgcggcagacatggcgg

SEQ ID NO: 19015 - DNA, 22 bp, Artificial Sequence
  Description of Artificial Sequence: Synthetic oligonucleotide
tggaccgcggcagacatggcgg

SEQ ID NO: 19016 - DNA, 21 bp, Artificial Sequence
  Description of Artificial Sequence: Synthetic oligonucleotide
ggaccgcggcagacatggcgg

SEQ ID NO: 19017 - DNA, 22 bp, Artificial Sequence
  Description of Artificial Sequence: Synthetic oligonucleotide
gaccgcggcagacatggcggct

SEQ ID NO: 19018 - DNA, 23 bp, Artificial Sequence
  Description of Artificial Sequence: Synthetic oligonucleotide
accgcggcagacatggcggctca

SEQ ID NO: 19019 - DNA, 22 bp, Artificial Sequence
  Description of Artificial Sequence: Synthetic oligonucleotide
ccgcggcagacatggcggctca

SEQ ID NO: 19020 - DNA, 24 bp, Artificial Sequence
  Description of Artificial Sequence: Synthetic oligonucleotide
cgcggcagacatggcggctcagat

SEQ ID NO: 19021 - DNA, 25 bp, Artificial Sequence
  Description of Artificial Sequence: Synthetic oligonucleotide
gcggcagacatggcggctcagatca

SEQ ID NO: 19022 - DNA, 25 bp, Artificial Sequence
  Description of Artificial Sequence: Synthetic oligonucleotide
cggcagacatggcggctcagatcac

SEQ ID NO: 19023 - DNA, 25 bp, Artificial Sequence
  Description of Artificial Sequence: Synthetic oligonucleotide
ggcagacatggcggctcagatcacc

SEQ ID NO: 19024 - DNA, 26 bp, Artificial Sequence
  Description of Artificial Sequence: Synthetic oligonucleotide
gcagacatggcggctcagatcaccca

SEQ ID NO: 19025 - DNA, 26 bp, Artificial Sequence
  Description of Artificial Sequence: Synthetic oligonucleotide
cagacatggcggctcagatcacccag

SEQ ID NO: 19026 - DNA, 26 bp, Artificial Sequence
  Description of Artificial Sequence: Synthetic oligonucleotide
agacatggcggctcagatcacccagc

SEQ ID NO: 19027 - DNA, 22 bp, Artificial Sequence
  Description of Artificial Sequence: Synthetic oligonucleotide
cggggagccccgcttcatcgct

SEQ ID NO: 19028 - DNA, 23 bp, Artificial Sequence
  Description of Artificial Sequence: Synthetic oligonucleotide
ggggagccccgcttcatcgctgt

SEQ ID NO: 19029 - DNA, 23 bp, Artificial Sequence
  Description of Artificial Sequence: Synthetic oligonucleotide
gggagccccgcttcatcgctgtg

SEQ ID NO: 19030 - DNA, 23 bp, Artificial Sequence
  Description of Artificial Sequence: Synthetic oligonucleotide
ggagccccgcttcatcgctgtgg

SEQ ID NO: 19031 - DNA, 23 bp, Artificial Sequence
  Description of Artificial Sequence: Synthetic oligonucleotide
gagccccgcttcatcgctgtggg

SEQ ID NO: 19032 - DNA, 25 bp, Artificial Sequence
  Description of Artificial Sequence: Synthetic oligonucleotide
agccccgcttcatcgctgtgggcta

SEQ ID NO: 19033 - DNA, 24 bp, Artificial Sequence
  Description of Artificial Sequence: Synthetic oligonucleotide
gccccgcttcatcgctgtgggcta

SEQ ID NO: 19034 - DNA, 24 bp, Artificial Sequence
  Description of Artificial Sequence: Synthetic oligonucleotide
ccccgcttcatcgctgtgggctac

SEQ ID NO: 19035 - DNA, 25 bp, Artificial Sequence
  Description of Artificial Sequence: Synthetic oligonucleotide
cccgcttcatcgctgtgggctacgt

SEQ ID NO: 19036 - DNA, 25 bp, Artificial Sequence
  Description of Artificial Sequence: Synthetic oligonucleotide
ccgcttcatcgctgtgggctacgtg

SEQ ID NO: 19037 - DNA, 26 bp, Artificial Sequence
  Description of Artificial Sequence: Synthetic oligonucleotide
cgcttcatcgctgtgggctacgtgga

SEQ ID NO: 19038 - DNA, 26 bp, Artificial Sequence
  Description of Artificial Sequence: Synthetic oligonucleotide
gcttcatcgctgtgggctacgtggac

SEQ ID NO: 19039 - DNA, 27 bp, Artificial Sequence
  Description of Artificial Sequence: Synthetic oligonucleotide
cttcatcgctgtgggctacgtggacga

SEQ ID NO: 19040 - DNA, 27 bp, Artificial Sequence
  Description of Artificial Sequence: Synthetic oligonucleotide
ttcatcgctgtgggctacgtggacgac

SEQ ID NO: 19041 - DNA, 27 bp, Artificial Sequence
  Description of Artificial Sequence: Synthetic oligonucleotide
tcatcgctgtgggctacgtggacgaca

SEQ ID NO: 19042 - DNA, 26 bp, Artificial Sequence
  Description of Artificial Sequence: Synthetic oligonucleotide
catcgctgtgggctacgtggacgaca

SEQ ID NO: 19043 - DNA, 26 bp, Artificial Sequence
  Description of Artificial Sequence: Synthetic oligonucleotide
atcgctgtgggctacgtggacgacac

SEQ ID NO: 19044 - DNA, 25 bp, Artificial Sequence
  Description of Artificial Sequence: Synthetic oligonucleotide
tcgctgtgggctacgtggacgacac

SEQ ID NO: 19045 - DNA, 24 bp, Artificial Sequence
  Description of Artificial Sequence: Synthetic oligonucleotide
cgctgtgggctacgtggacgacac

SEQ ID NO: 19046 - DNA, 24 bp, Artificial Sequence
  Description of Artificial Sequence: Synthetic oligonucleotide
gctgtgggctacgtggacgacacg

SEQ ID NO: 19047 - DNA, 25 bp, Artificial Sequence
  Description of Artificial Sequence: Synthetic oligonucleotide
ctgtgggctacgtggacgacacgca

SEQ ID NO: 19048 - DNA, 27 bp, Artificial Sequence
  Description of Artificial Sequence: Synthetic oligonucleotide
tgtgggctacgtggacgacacgcagtt

SEQ ID NO: 19049 - DNA, 28 bp, Artificial Sequence
  Description of Artificial Sequence: Synthetic oligonucleotide
gcccactcacagattgaccgagtggatc

SEQ ID NO: 19050 - DNA, 29 bp, Artificial Sequence
  Description of Artificial Sequence: Synthetic oligonucleotide
cccactcacagattgaccgagtggatctg

SEQ ID NO: 19051 - DNA, 29 bp, Artificial Sequence
  Description of Artificial Sequence: Synthetic oligonucleotide
ccactcacagattgaccgagtggatctgg

SEQ ID NO: 19052 - DNA, 29 bp, Artificial Sequence
  Description of Artificial Sequence: Synthetic oligonucleotide
cactcacagattgaccgagtggatctggg

SEQ ID NO: 19053 - DNA, 29 bp, Artificial Sequence
  Description of Artificial Sequence: Synthetic oligonucleotide
actcacagattgaccgagtggatctgggg

SEQ ID NO: 19054 - DNA, 28 bp, Artificial Sequence
  Description of Artificial Sequence: Synthetic oligonucleotide
ctcacagattgaccgagtggatctgggg

SEQ ID NO: 19055 - DNA, 29 bp, Artificial Sequence
  Description of Artificial Sequence: Synthetic oligonucleotide
tcacagattgaccgagtggatctggggac

SEQ ID NO: 19056 - DNA, 28 bp, Artificial Sequence
  Description of Artificial Sequence: Synthetic oligonucleotide
cacagattgaccgagtggatctggggac

SEQ ID NO: 19057 - DNA, 28 bp, Artificial Sequence
  Description of Artificial Sequence: Synthetic oligonucleotide
acagattgaccgagtggatctggggacc

SEQ ID NO: 19058 - DNA, 27 bp, Artificial Sequence
  Description of Artificial Sequence: Synthetic oligonucleotide
cagattgaccgagtggatctggggacc

SEQ ID NO: 19059 - DNA, 27 bp, Artificial Sequence
  Description of Artificial Sequence: Synthetic oligonucleotide
agattgaccgagtggatctggggaccc

SEQ ID NO: 19060 - DNA, 27 bp, Artificial Sequence
  Description of Artificial Sequence: Synthetic oligonucleotide
gattgaccgagtggatctggggaccct

SEQ ID NO: 19061 - DNA, 27 bp, Artificial Sequence
  Description of Artificial Sequence: Synthetic oligonucleotide
attgaccgagtggatctggggaccctg

SEQ ID NO: 19062 - DNA, 26 bp, Artificial Sequence
  Description of Artificial Sequence: Synthetic oligonucleotide
ttgaccgagtggatctggggaccctg

SEQ ID NO: 19063 - DNA, 25 bp, Artificial Sequence
  Description of Artificial Sequence: Synthetic oligonucleotide
tgaccgagtggatctggggaccctg

SEQ ID NO: 19064 - DNA, 24 bp, Artificial Sequence
  Description of Artificial Sequence: Synthetic oligonucleotide
gaccgagtggatctggggaccctg

SEQ ID NO: 19065 - DNA, 26 bp, Artificial Sequence
  Description of Artificial Sequence: Synthetic oligonucleotide
caggagaggccggagtattgggacca

SEQ ID NO: 19066 - DNA, 26 bp, Artificial Sequence
  Description of Artificial Sequence: Synthetic oligonucleotide
aggagaggccggagtattgggaccag

SEQ ID NO: 19067 - DNA, 25 bp, Artificial Sequence
  Description of Artificial Sequence: Synthetic oligonucleotide
ggagaggccggagtattgggaccag

SEQ ID NO: 19068 - DNA, 26 bp, Artificial Sequence
  Description of Artificial Sequence: Synthetic oligonucleotide
gagaggccggagtattgggaccagga

SEQ ID NO: 19069 - DNA, 27 bp, Artificial Sequence
  Description of Artificial Sequence: Synthetic oligonucleotide
agaggccggagtattgggaccaggaga

SEQ ID NO: 19070 - DNA, 26 bp, Artificial Sequence
  Description of Artificial Sequence: Synthetic oligonucleotide
gaggccggagtattgggaccaggaga

SEQ ID NO: 19071 - DNA, 27 bp, Artificial Sequence
  Description of Artificial Sequence: Synthetic oligonucleotide
aggccggagtattgggaccaggagaca

SEQ ID NO: 19072 - DNA, 27 bp, Artificial Sequence
  Description of Artificial Sequence: Synthetic oligonucleotide
ccgtgtggcggagcagttgagagctta

SEQ ID NO: 19073 - DNA, 27 bp, Artificial Sequence
  Description of Artificial Sequence: Synthetic oligonucleotide
cgtgtggcggagcagttgagagcttac

SEQ ID NO: 19074 - DNA, 27 bp, Artificial Sequence
  Description of Artificial Sequence: Synthetic oligonucleotide
gtgtggcggagcagttgagagcttacc

SEQ ID NO: 19075 - DNA, 28 bp, Artificial Sequence
  Description of Artificial Sequence: Synthetic oligonucleotide
tgtggcggagcagttgagagcttacctg

SEQ ID NO: 19076 - DNA, 27 bp, Artificial Sequence
  Description of Artificial Sequence: Synthetic oligonucleotide
gtggcggagcagttgagagcttacctg

SEQ ID NO: 19077 - DNA, 27 bp, Artificial Sequence
  Description of Artificial Sequence: Synthetic oligonucleotide
tggcggagcagttgagagcttacctgg

SEQ ID NO: 19078 - DNA, 27 bp, Artificial Sequence
  Description of Artificial Sequence: Synthetic oligonucleotide
ggcggagcagttgagagcttacctgga

SEQ ID NO: 19079 - DNA, 27 bp, Artificial Sequence
  Description of Artificial Sequence: Synthetic oligonucleotide
gcggagcagttgagagcttacctggag

SEQ ID NO: 19080 - DNA, 27 bp, Artificial Sequence
  Description of Artificial Sequence: Synthetic oligonucleotide
cggagcagttgagagcttacctggagg

SEQ ID NO: 19081 - DNA, 27 bp, Artificial Sequence
  Description of Artificial Sequence: Synthetic oligonucleotide
ggagcagttgagagcttacctggaggg

SEQ ID NO: 19082 - DNA, 27 bp, Artificial Sequence
  Description of Artificial Sequence: Synthetic oligonucleotide
gagcagttgagagcttacctggagggc

SEQ ID NO: 19083 - DNA, 28 bp, Artificial Sequence
  Description of Artificial Sequence: Synthetic oligonucleotide
agcagttgagagcttacctggagggcac

SEQ ID NO: 19084 - DNA, 27 bp, Artificial Sequence
  Description of Artificial Sequence: Synthetic oligonucleotide
gcagttgagagcttacctggagggcac

SEQ ID NO: 19085 - DNA, 27 bp, Artificial Sequence
  Description of Artificial Sequence: Synthetic oligonucleotide
cagttgagagcttacctggagggcacg

SEQ ID NO: 19086 - DNA, 28 bp, Artificial Sequence
  Description of Artificial Sequence: Synthetic oligonucleotide
agttgagagcttacctggagggcacgtg

SEQ ID NO: 19087 - DNA, 27 bp, Artificial Sequence
  Description of Artificial Sequence: Synthetic oligonucleotide
gttgagagcttacctggagggcacgtg

SEQ ID NO: 19088 - DNA, 27 bp, Artificial Sequence
  Description of Artificial Sequence: Synthetic oligonucleotide
ttgagagcttacctggagggcacgtgc

SEQ ID NO: 19089 - DNA, 26 bp, Artificial Sequence
  Description of Artificial Sequence: Synthetic oligonucleotide
tgagagcttacctggagggcacgtgc

SEQ ID NO: 19090 - DNA, 25 bp, Artificial Sequence
  Description of Artificial Sequence: Synthetic oligonucleotide
gagagcttacctggagggcacgtgc

SEQ ID NO: 19091 - DNA, 26 bp, Artificial Sequence
  Description of Artificial Sequence: Synthetic oligonucleotide
agagcttacctggagggcacgtgcgt

SEQ ID NO: 19092 - DNA, 25 bp, Artificial Sequence
  Description of Artificial Sequence: Synthetic oligonucleotide
gagcttacctggagggcacgtgcgt

SEQ ID NO: 19093 - DNA, 25 bp, Artificial Sequence
  Description of Artificial Sequence: Synthetic oligonucleotide
agcttacctggagggcacgtgcgtg

SEQ ID NO: 19094 - DNA, 24 bp, Artificial Sequence
  Description of Artificial Sequence: Synthetic oligonucleotide
gcttacctggagggcacgtgcgtg

SEQ ID NO: 19095 - DNA, 25 bp, Artificial Sequence
  Description of Artificial Sequence: Synthetic oligonucleotide
cttacctggagggcacgtgcgtgga

SEQ ID NO: 19096 - DNA, 26 bp, Artificial Sequence
  Description of Artificial Sequence: Synthetic oligonucleotide
ttacctggagggcacgtgcgtggagt

SEQ ID NO: 19097 - DNA, 30 bp, Artificial Sequence
  Description of Artificial Sequence: Synthetic oligonucleotide
gcctacgacggcaaggattacatcgctttg

SEQ ID NO: 19098 - DNA, 32 bp, Artificial Sequence
  Description of Artificial Sequence: Synthetic oligonucleotide
cctacgacggcaaggattacatcgctttgaac

SEQ ID NO: 19099 - DNA, 32 bp, Artificial Sequence
  Description of Artificial Sequence: Synthetic oligonucleotide
ctacgacggcaaggattacatcgctttgaacg

SEQ ID NO: 19100 - DNA, 33 bp, Artificial Sequence
  Description of Artificial Sequence: Synthetic oligonucleotide
tacgacggcaaggattacatcgctttgaacgag

SEQ ID NO: 19101 - DNA, 32 bp, Artificial Sequence
  Description of Artificial Sequence: Synthetic oligonucleotide
acgacggcaaggattacatcgctttgaacgag

SEQ ID NO: 19102 - DNA, 31 bp, Artificial Sequence
  Description of Artificial Sequence: Synthetic oligonucleotide
cgacggcaaggattacatcgctttgaacgag

SEQ ID NO: 19103 - DNA, 31 bp, Artificial Sequence
  Description of Artificial Sequence: Synthetic oligonucleotide
gacggcaaggattacatcgctttgaacgagg

SEQ ID NO: 19104 - DNA, 32 bp, Artificial Sequence
  Description of Artificial Sequence: Synthetic oligonucleotide
acggcaaggattacatcgctttgaacgaggac

SEQ ID NO: 19105 - DNA, 31 bp, Artificial Sequence
  Description of Artificial Sequence: Synthetic oligonucleotide
cggcaaggattacatcgctttgaacgaggac

SEQ ID NO: 19106 - DNA, 31 bp, Artificial Sequence
  Description of Artificial Sequence: Synthetic oligonucleotide
ggcaaggattacatcgctttgaacgaggacc

SEQ ID NO: 19107 - DNA, 32 bp, Artificial Sequence
  Description of Artificial Sequence: Synthetic oligonucleotide
gcaaggattacatcgctttgaacgaggacctg

SEQ ID NO: 19108 - DNA, 32 bp, Artificial Sequence
  Description of Artificial Sequence: Synthetic oligonucleotide
caaggattacatcgctttgaacgaggacctgc

SEQ ID NO: 19109 - DNA, 32 bp, Artificial Sequence
  Description of Artificial Sequence: Synthetic oligonucleotide
aaggattacatcgctttgaacgaggacctgcg

SEQ ID NO: 19110 - DNA, 31 bp, Artificial Sequence
  Description of Artificial Sequence: Synthetic oligonucleotide
aggattacatcgctttgaacgaggacctgcg

SEQ ID NO: 19111 - DNA, 30 bp, Artificial Sequence
  Description of Artificial Sequence: Synthetic oligonucleotide
ggattacatcgctttgaacgaggacctgcg

SEQ ID NO: 19112 - DNA, 30 bp, Artificial Sequence
  Description of Artificial Sequence: Synthetic oligonucleotide
gattacatcgctttgaacgaggacctgcgc

SEQ ID NO: 19113 - DNA, 31 bp, Artificial Sequence
  Description of Artificial Sequence: Synthetic oligonucleotide
attacatcgctttgaacgaggacctgcgctc

SEQ ID NO: 19114 - DNA, 30 bp, Artificial Sequence
  Description of Artificial Sequence: Synthetic oligonucleotide
ttacatcgctttgaacgaggacctgcgctc

SEQ ID NO: 19115 - DNA, 29 bp, Artificial Sequence
  Description of Artificial Sequence: Synthetic oligonucleotide
tacatcgctttgaacgaggacctgcgctc

SEQ ID NO: 19116 - DNA, 28 bp, Artificial Sequence
  Description of Artificial Sequence: Synthetic oligonucleotide
acatcgctttgaacgaggacctgcgctc

SEQ ID NO: 19117 - DNA, 27 bp, Artificial Sequence
  Description of Artificial Sequence: Synthetic oligonucleotide
catcgctttgaacgaggacctgcgctc

SEQ ID NO: 19118 - DNA, 29 bp, Artificial Sequence
  Description of Artificial Sequence: Synthetic oligonucleotide
atcgctttgaacgaggacctgcgctcttg

SEQ ID NO: 19119 - DNA, 28 bp, Artificial Sequence
  Description of Artificial Sequence: Synthetic oligonucleotide
tcgctttgaacgaggacctgcgctcttg

SEQ ID NO: 19120 - DNA, 27 bp, Artificial Sequence
  Description of Artificial Sequence: Synthetic oligonucleotide
cgctttgaacgaggacctgcgctcttg

SEQ ID NO: 19121 - DNA, 27 bp, Artificial Sequence
  Description of Artificial Sequence: Synthetic oligonucleotide
gctttgaacgaggacctgcgctcttgg

SEQ ID NO: 19122 - DNA, 28 bp, Artificial Sequence
  Description of Artificial Sequence: Synthetic oligonucleotide
ctttgaacgaggacctgcgctcttggac

SEQ ID NO: 19123 - DNA, 28 bp, Artificial Sequence
  Description of Artificial Sequence: Synthetic oligonucleotide
tttgaacgaggacctgcgctcttggacc

SEQ ID NO: 19124 - DNA, 30 bp, Artificial Sequence
  Description of Artificial Sequence: Synthetic oligonucleotide
ctgagtattgggaccaggagacacggaaag

SEQ ID NO: 19125 - DNA, 31 bp, Artificial Sequence
  Description of Artificial Sequence: Synthetic oligonucleotide
tgagtattgggaccaggagacacggaaagtg

SEQ ID NO: 19126 - DNA, 27 bp, Artificial Sequence
  Description of Artificial Sequence: Synthetic oligonucleotide
ggaccaggagacacggaatgtgaaggg

SEQ ID NO: 19127 - DNA, 27 bp, Artificial Sequence
  Description of Artificial Sequence: Synthetic oligonucleotide
gaccaggagacacggaatgtgaagggc

SEQ ID NO: 19128 - DNA, 27 bp, Artificial Sequence
  Description of Artificial Sequence: Synthetic oligonucleotide
accaggagacacggaatgtgaagggcc

SEQ ID NO: 19129 - DNA, 27 bp, Artificial Sequence
  Description of Artificial Sequence: Synthetic oligonucleotide
ccaggagacacggaatgtgaagggcca

SEQ ID NO: 19130 - DNA, 27 bp, Artificial Sequence
  Description of Artificial Sequence: Synthetic oligonucleotide
caggagacacggaatgtgaagggccac

SEQ ID NO: 19131 - DNA, 28 bp, Artificial Sequence
  Description of Artificial Sequence: Synthetic oligonucleotide
aggagacacggaatgtgaagggccactc

SEQ ID NO: 19132 - DNA, 27 bp, Artificial Sequence
  Description of Artificial Sequence: Synthetic oligonucleotide
ggagacacggaatgtgaagggccactc

SEQ ID NO: 19133 - DNA, 28 bp, Artificial Sequence
  Description of Artificial Sequence: Synthetic oligonucleotide
gagacacggaatgtgaagggccactcac

SEQ ID NO: 19134 - DNA, 29 bp, Artificial Sequence
  Description of Artificial Sequence: Synthetic oligonucleotide
agacacggaatgtgaagggccactcacag

SEQ ID NO: 19135 - DNA, 28 bp, Artificial Sequence
  Description of Artificial Sequence: Synthetic oligonucleotide
gacacggaatgtgaagggccactcacag

SEQ ID NO: 19136 - DNA, 31 bp, Artificial Sequence
  Description of Artificial Sequence: Synthetic oligonucleotide
acacggaatgtgaagggccactcacagattg

SEQ ID NO: 19137 - DNA, 30 bp, Artificial Sequence
  Description of Artificial Sequence: Synthetic oligonucleotide
cacggaatgtgaagggccactcacagattg

SEQ ID NO: 19138 - DNA, 31 bp, Artificial Sequence
  Description of Artificial Sequence: Synthetic oligonucleotide
acggaatgtgaagggccactcacagattgac

SEQ ID NO: 19139 - DNA, 30 bp, Artificial Sequence
  Description of Artificial Sequence: Synthetic oligonucleotide
cggaatgtgaagggccactcacagattgac

SEQ ID NO: 19140 - DNA, 30 bp, Artificial Sequence
  Description of Artificial Sequence: Synthetic oligonucleotide
ggaatgtgaagggccactcacagattgacc

SEQ ID NO: 19141 - DNA, 30 bp, Artificial Sequence
  Description of Artificial Sequence: Synthetic oligonucleotide
gaatgtgaagggccactcacagattgaccg

SEQ ID NO: 19142 - DNA, 31 bp, Artificial Sequence
  Description of Artificial Sequence: Synthetic oligonucleotide
aatgtgaagggccactcacagattgaccgag

SEQ ID NO: 19143 - DNA, 30 bp, Artificial Sequence
  Description of Artificial Sequence: Synthetic oligonucleotide
atgtgaagggccactcacagattgaccgag

SEQ ID NO: 19144 - DNA, 29 bp, Artificial Sequence
  Description of Artificial Sequence: Synthetic oligonucleotide
tgtgaagggccactcacagattgaccgag

SEQ ID NO: 19145 - DNA, 28 bp, Artificial Sequence
  Description of Artificial Sequence: Synthetic oligonucleotide
gtgaagggccactcacagattgaccgag

SEQ ID NO: 19146 - DNA, 29 bp, Artificial Sequence
  Description of Artificial Sequence: Synthetic oligonucleotide
tgaagggccactcacagattgaccgagtg

SEQ ID NO: 19147 - DNA, 28 bp, Artificial Sequence
  Description of Artificial Sequence: Synthetic oligonucleotide
gaagggccactcacagattgaccgagtg

SEQ ID NO: 19148 - DNA, 28 bp, Artificial Sequence
  Description of Artificial Sequence: Synthetic oligonucleotide
aagggccactcacagattgaccgagtgg

SEQ ID NO: 19149 - DNA, 27 bp, Artificial Sequence
  Description of Artificial Sequence: Synthetic oligonucleotide
agggccactcacagattgaccgagtgg

SEQ ID NO: 19150 - DNA, 27 bp, Artificial Sequence
  Description of Artificial Sequence: Synthetic oligonucleotide
gggccactcacagattgaccgagtgga

SEQ ID NO: 19151 - DNA, 27 bp, Artificial Sequence
  Description of Artificial Sequence: Synthetic oligonucleotide
ggccactcacagattgaccgagtggac

SEQ ID NO: 19152 - DNA, 27 bp, Artificial Sequence
  Description of Artificial Sequence: Synthetic oligonucleotide
gccactcacagattgaccgagtggacc

SEQ ID NO: 19153 - DNA, 27 bp, Artificial Sequence
  Description of Artificial Sequence: Synthetic oligonucleotide
cgaggccggttctcacaccatccagaa

SEQ ID NO: 19154 - DNA, 27 bp, Artificial Sequence
  Description of Artificial Sequence: Synthetic oligonucleotide
gaggccggttctcacaccatccagaag

SEQ ID NO: 19155 - DNA, 29 bp, Artificial Sequence
  Description of Artificial Sequence: Synthetic oligonucleotide
aggccggttctcacaccatccagaagatg

SEQ ID NO: 19156 - DNA, 28 bp, Artificial Sequence
  Description of Artificial Sequence: Synthetic oligonucleotide
ggccggttctcacaccatccagaagatg

SEQ ID NO: 19157 - DNA, 31 bp, Artificial Sequence
  Description of Artificial Sequence: Synthetic oligonucleotide
gccggttctcacaccatccagaagatgtatg

SEQ ID NO: 19158 - DNA, 31 bp, Artificial Sequence
  Description of Artificial Sequence: Synthetic oligonucleotide
ccggttctcacaccatccagaagatgtatgg

SEQ ID NO: 19159 - DNA, 31 bp, Artificial Sequence
  Description of Artificial Sequence: Synthetic oligonucleotide
cggttctcacaccatccagaagatgtatggc

SEQ ID NO: 19160 - DNA, 32 bp, Artificial Sequence
  Description of Artificial Sequence: Synthetic oligonucleotide
ggttctcacaccatccagaagatgtatggctg

SEQ ID NO: 19161 - DNA, 32 bp, Artificial Sequence
  Description of Artificial Sequence: Synthetic oligonucleotide
gttctcacaccatccagaagatgtatggctgc

SEQ ID NO: 19162 - DNA, 32 bp, Artificial Sequence
  Description of Artificial Sequence: Synthetic oligonucleotide
ttctcacaccatccagaagatgtatggctgcg

SEQ ID NO: 19163 - DNA, 31 bp, Artificial Sequence
  Description of Artificial Sequence: Synthetic oligonucleotide
tctcacaccatccagaagatgtatggctgcg

SEQ ID NO: 19164 - DNA, 30 bp, Artificial Sequence
  Description of Artificial Sequence: Synthetic oligonucleotide
ctcacaccatccagaagatgtatggctgcg

SEQ ID NO: 19165 - DNA, 31 bp, Artificial Sequence
  Description of Artificial Sequence: Synthetic oligonucleotide
tcacaccatccagaagatgtatggctgcgac

SEQ ID NO: 19166 - DNA, 30 bp, Artificial Sequence
  Description of Artificial Sequence: Synthetic oligonucleotide
cacaccatccagaagatgtatggctgcgac

SEQ ID NO: 19167 - DNA, 30 bp, Artificial Sequence
  Description of Artificial Sequence: Synthetic oligonucleotide
acaccatccagaagatgtatggctgcgacg

SEQ ID NO: 19168 - DNA, 29 bp, Artificial Sequence
  Description of Artificial Sequence: Synthetic oligonucleotide
caccatccagaagatgtatggctgcgacg

SEQ ID NO: 19169 - DNA, 30 bp, Artificial Sequence
  Description of Artificial Sequence: Synthetic oligonucleotide
accatccagaagatgtatggctgcgacgtg

SEQ ID NO: 19170 - DNA, 29 bp, Artificial Sequence
  Description of Artificial Sequence: Synthetic oligonucleotide
ccatccagaagatgtatggctgcgacgtg

SEQ ID NO: 19171 - DNA, 29 bp, Artificial Sequence
  Description of Artificial Sequence: Synthetic oligonucleotide
catccagaagatgtatggctgcgacgtgg

SEQ ID NO: 19172 - DNA, 29 bp, Artificial Sequence
  Description of Artificial Sequence: Synthetic oligonucleotide
atccagaagatgtatggctgcgacgtggg

SEQ ID NO: 19173 - DNA, 28 bp, Artificial Sequence
  Description of Artificial Sequence: Synthetic oligonucleotide
tccagaagatgtatggctgcgacgtggg

SEQ ID NO: 19174 - DNA, 27 bp, Artificial Sequence
  Description of Artificial Sequence: Synthetic oligonucleotide
ccagaagatgtatggctgcgacgtggg

SEQ ID NO: 19175 - DNA, 27 bp, Artificial Sequence
  Description of Artificial Sequence: Synthetic oligonucleotide
cagaagatgtatggctgcgacgtgggg

SEQ ID NO: 19176 - DNA, 28 bp, Artificial Sequence
  Description of Artificial Sequence: Synthetic oligonucleotide
agaagatgtatggctgcgacgtggggtc

SEQ ID NO: 19177 - DNA, 27 bp, Artificial Sequence
  Description of Artificial Sequence: Synthetic oligonucleotide
gaagatgtatggctgcgacgtggggtc

SEQ ID NO: 19178 - DNA, 27 bp, Artificial Sequence
  Description of Artificial Sequence: Synthetic oligonucleotide
aagatgtatggctgcgacgtggggtcg

SEQ ID NO: 19179 - DNA, 26 bp, Artificial Sequence
  Description of Artificial Sequence: Synthetic oligonucleotide
agatgtatggctgcgacgtggggtcg

SEQ ID NO: 19180 - DNA, 30 bp, Artificial Sequence
  Description of Artificial Sequence: Synthetic oligonucleotide
gacggcaaggattacatcgccttgaacgac

SEQ ID NO: 19181 - DNA, 30 bp, Artificial Sequence
  Description of Artificial Sequence: Synthetic oligonucleotide
acggcaaggattacatcgccttgaacgacg

SEQ ID NO: 19182 - DNA, 29 bp, Artificial Sequence
  Description of Artificial Sequence: Synthetic oligonucleotide
cggcaaggattacatcgccttgaacgacg

SEQ ID NO: 19183 - DNA, 30 bp, Artificial Sequence
  Description of Artificial Sequence: Synthetic oligonucleotide
ggcaaggattacatcgccttgaacgacgac

SEQ ID NO: 19184 - DNA, 30 bp, Artificial Sequence
  Description of Artificial Sequence: Synthetic oligonucleotide
gcaaggattacatcgccttgaacgacgacc

SEQ ID NO: 19185 - DNA, 31 bp, Artificial Sequence
  Description of Artificial Sequence: Synthetic oligonucleotide
caaggattacatcgccttgaacgacgacctg

SEQ ID NO: 19186 - DNA, 31 bp, Artificial Sequence
  Description of Artificial Sequence: Synthetic oligonucleotide
aaggattacatcgccttgaacgacgacctgc

SEQ ID NO: 19187 - DNA, 30 bp, Artificial Sequence
  Description of Artificial Sequence: Synthetic oligonucleotide
aggattacatcgccttgaacgacgacctgc

SEQ ID NO: 19188 - DNA, 29 bp, Artificial Sequence
  Description of Artificial Sequence: Synthetic oligonucleotide
ggattacatcgccttgaacgacgacctgc

SEQ ID NO: 19189 - DNA, 29 bp, Artificial Sequence
  Description of Artificial Sequence: Synthetic oligonucleotide
gattacatcgccttgaacgacgacctgcg

SEQ ID NO: 19190 - DNA, 29 bp, Artificial Sequence
  Description of Artificial Sequence: Synthetic oligonucleotide
attacatcgccttgaacgacgacctgcgc

SEQ ID NO: 19191 - DNA, 28 bp, Artificial Sequence
  Description of Artificial Sequence: Synthetic oligonucleotide
ttacatcgccttgaacgacgacctgcgc

SEQ ID NO: 19192 - DNA, 27 bp, Artificial Sequence
  Description of Artificial Sequence: Synthetic oligonucleotide
tacatcgccttgaacgacgacctgcgc

SEQ ID NO: 19193 - DNA, 27 bp, Artificial Sequence
  Description of Artificial Sequence: Synthetic oligonucleotide
acatcgccttgaacgacgacctgcgct

SEQ ID NO: 19194 - DNA, 26 bp, Artificial Sequence
  Description of Artificial Sequence: Synthetic oligonucleotide
catcgccttgaacgacgacctgcgct

SEQ ID NO: 19195 - DNA, 27 bp, Artificial Sequence
  Description of Artificial Sequence: Synthetic oligonucleotide
atcgccttgaacgacgacctgcgctct

SEQ ID NO: 19196 - DNA, 27 bp, Artificial Sequence
  Description of Artificial Sequence: Synthetic oligonucleotide
tcgccttgaacgacgacctgcgctctt

SEQ ID NO: 19197 - DNA, 26 bp, Artificial Sequence
  Description of Artificial Sequence: Synthetic oligonucleotide
cgccttgaacgacgacctgcgctctt

SEQ ID NO: 19198 - DNA, 26 bp, Artificial Sequence
  Description of Artificial Sequence: Synthetic oligonucleotide
gccttgaacgacgacctgcgctcttg

SEQ ID NO: 19199 - DNA, 27 bp, Artificial Sequence
  Description of Artificial Sequence: Synthetic oligonucleotide
ccttgaacgacgacctgcgctcttgga

SEQ ID NO: 19200 - DNA, 27 bp, Artificial Sequence
  Description of Artificial Sequence: Synthetic oligonucleotide
cttgaacgacgacctgcgctcttggac

SEQ ID NO: 19201 - DNA, 27 bp, Artificial Sequence
  Description of Artificial Sequence: Synthetic oligonucleotide
ttgaacgacgacctgcgctcttggacc

SEQ ID NO: 19202 - DNA, 26 bp, Artificial Sequence
  Description of Artificial Sequence: Synthetic oligonucleotide
tgaacgacgacctgcgctcttggacc

SEQ ID NO: 19203 - DNA, 25 bp, Artificial Sequence
  Description of Artificial Sequence: Synthetic oligonucleotide
gaacgacgacctgcgctcttggacc

SEQ ID NO: 19204 - DNA, 25 bp, Artificial Sequence
  Description of Artificial Sequence: Synthetic oligonucleotide
aacgacgacctgcgctcttggaccg

SEQ ID NO: 19205 - DNA, 24 bp, Artificial Sequence
  Description of Artificial Sequence: Synthetic oligonucleotide
acgacgacctgcgctcttggaccg

SEQ ID NO: 19206 - DNA, 23 bp, Artificial Sequence
  Description of Artificial Sequence: Synthetic oligonucleotide
cgacgacctgcgctcttggaccg

SEQ ID NO: 19207 - DNA, 21 bp, Artificial Sequence
  Description of Artificial Sequence: Synthetic oligonucleotide
cgcacggaccccccccaagac

SEQ ID NO: 19208 - DNA, 21 bp, Artificial Sequence
  Description of Artificial Sequence: Synthetic oligonucleotide
gcacggaccccccccaagacg

SEQ ID NO: 19209 - DNA, 25 bp, Artificial Sequence
  Description of Artificial Sequence: Synthetic oligonucleotide
cacggaccccccccaagacgcatat

SEQ ID NO: 19210 - DNA, 26 bp, Artificial Sequence
  Description of Artificial Sequence: Synthetic oligonucleotide
acggaccccccccaagacgcatatga

SEQ ID NO: 19211 - DNA, 25 bp, Artificial Sequence
  Description of Artificial Sequence: Synthetic oligonucleotide
cggaccccccccaagacgcatatga

SEQ ID NO: 19212 - DNA, 26 bp, Artificial Sequence
  Description of Artificial Sequence: Synthetic oligonucleotide
ggaccccccccaagacgcatatgact

SEQ ID NO: 19213 - DNA, 27 bp, Artificial Sequence
  Description of Artificial Sequence: Synthetic oligonucleotide
gaccccccccaagacgcatatgactca

SEQ ID NO: 19214 - DNA, 27 bp, Artificial Sequence
  Description of Artificial Sequence: Synthetic oligonucleotide
accccccccaagacgcatatgactcac

SEQ ID NO: 19215 - DNA, 26 bp, Artificial Sequence
  Description of Artificial Sequence: Synthetic oligonucleotide
ccccccccaagacgcatatgactcac

SEQ ID NO: 19216 - DNA, 27 bp, Artificial Sequence
  Description of Artificial Sequence: Synthetic oligonucleotide
aggagacacggaatgtgaaggcccgct

SEQ ID NO: 19217 - DNA, 26 bp, Artificial Sequence
  Description of Artificial Sequence: Synthetic oligonucleotide
ggagacacggaatgtgaaggcccgct

SEQ ID NO: 19218 - DNA, 27 bp, Artificial Sequence
  Description of Artificial Sequence: Synthetic oligonucleotide
gagacacggaatgtgaaggcccgctca

SEQ ID NO: 19219 - DNA, 27 bp, Artificial Sequence
  Description of Artificial Sequence: Synthetic oligonucleotide
agacacggaatgtgaaggcccgctcac

SEQ ID NO: 19220 - DNA, 27 bp, Artificial Sequence
  Description of Artificial Sequence: Synthetic oligonucleotide
gacacggaatgtgaaggcccgctcaca

SEQ ID NO: 19221 - DNA, 27 bp, Artificial Sequence
  Description of Artificial Sequence: Synthetic oligonucleotide
acacggaatgtgaaggcccgctcacag

SEQ ID NO: 19222 - DNA, 27 bp, Artificial Sequence
  Description of Artificial Sequence: Synthetic oligonucleotide
cacggaatgtgaaggcccgctcacaga

SEQ ID NO: 19223 - DNA, 29 bp, Artificial Sequence
  Description of Artificial Sequence: Synthetic oligonucleotide
acggaatgtgaaggcccgctcacagattg

SEQ ID NO: 19224 - DNA, 28 bp, Artificial Sequence
  Description of Artificial Sequence: Synthetic oligonucleotide
cggaatgtgaaggcccgctcacagattg

SEQ ID NO: 19225 - DNA, 29 bp, Artificial Sequence
  Description of Artificial Sequence: Synthetic oligonucleotide
ggaatgtgaaggcccgctcacagattgac

SEQ ID NO: 19226 - DNA, 29 bp, Artificial Sequence
  Description of Artificial Sequence: Synthetic oligonucleotide
gaatgtgaaggcccgctcacagattgacc

SEQ ID NO: 19227 - DNA, 29 bp, Artificial Sequence
  Description of Artificial Sequence: Synthetic oligonucleotide
aatgtgaaggcccgctcacagattgaccg

SEQ ID NO: 19228 - DNA, 28 bp, Artificial Sequence
  Description of Artificial Sequence: Synthetic oligonucleotide
atgtgaaggcccgctcacagattgaccg

SEQ ID NO: 19229 - DNA, 27 bp, Artificial Sequence
  Description of Artificial Sequence: Synthetic oligonucleotide
tgtgaaggcccgctcacagattgaccg

SEQ ID NO: 19230 - DNA, 27 bp, Artificial Sequence
  Description of Artificial Sequence: Synthetic oligonucleotide
gtgaaggcccgctcacagattgaccga

SEQ ID NO: 19231 - DNA, 27 bp, Artificial Sequence
  Description of Artificial Sequence: Synthetic oligonucleotide
tgaaggcccgctcacagattgaccgag

SEQ ID NO: 19232 - DNA, 27 bp, Artificial Sequence
  Description of Artificial Sequence: Synthetic oligonucleotide
gaaggcccgctcacagattgaccgagt

SEQ ID NO: 19233 - DNA, 27 bp, Artificial Sequence
  Description of Artificial Sequence: Synthetic oligonucleotide
aaggcccgctcacagattgaccgagtg

SEQ ID NO: 19234 - DNA, 26 bp, Artificial Sequence
  Description of Artificial Sequence: Synthetic oligonucleotide
aggcccgctcacagattgaccgagtg

SEQ ID NO: 19235 - DNA, 25 bp, Artificial Sequence
  Description of Artificial Sequence: Synthetic oligonucleotide
ggcccgctcacagattgaccgagtg

SEQ ID NO: 19236 - DNA, 26 bp, Artificial Sequence
  Description of Artificial Sequence: Synthetic oligonucleotide
gcccgctcacagattgaccgagtgga

SEQ ID NO: 19237 - DNA, 26 bp, Artificial Sequence
  Description of Artificial Sequence: Synthetic oligonucleotide
cccgctcacagattgaccgagtggac

SEQ ID NO: 19238 - DNA, 27 bp, Artificial Sequence
  Description of Artificial Sequence: Synthetic oligonucleotide
ccgctcacagattgaccgagtggacct

SEQ ID NO: 19239 - DNA, 27 bp, Artificial Sequence
  Description of Artificial Sequence: Synthetic oligonucleotide
cgctcacagattgaccgagtggacctg

SEQ ID NO: 19240 - DNA, 27 bp, Artificial Sequence
  Description of Artificial Sequence: Synthetic oligonucleotide
gctcacagattgaccgagtggacctgg

SEQ ID NO: 19241 - DNA, 25 bp, Artificial Sequence
  Description of Artificial Sequence: Synthetic oligonucleotide
cgggcgctgtggatagagcaggaga

SEQ ID NO: 19242 - DNA, 25 bp, Artificial Sequence
  Description of Artificial Sequence: Synthetic oligonucleotide
gggcgctgtggatagagcaggagag

SEQ ID NO: 19243 - DNA, 25 bp, Artificial Sequence
  Description of Artificial Sequence: Synthetic oligonucleotide
ggcgctgtggatagagcaggagagg

SEQ ID NO: 19244 - DNA, 25 bp, Artificial Sequence
  Description of Artificial Sequence: Synthetic oligonucleotide
gcgctgtggatagagcaggagaggc

SEQ ID NO: 19245 - DNA, 26 bp, Artificial Sequence
  Description of Artificial Sequence: Synthetic oligonucleotide
cgctgtggatagagcaggagaggcct

SEQ ID NO: 19246 - DNA, 27 bp, Artificial Sequence
  Description of Artificial Sequence: Synthetic oligonucleotide
gctgtggatagagcaggagaggcctga

SEQ ID NO: 19247 - DNA, 27 bp, Artificial Sequence
  Description of Artificial Sequence: Synthetic oligonucleotide
ctgtggatagagcaggagaggcctgag

SEQ ID NO: 19248 - DNA, 31 bp, Artificial Sequence
  Description of Artificial Sequence: Synthetic oligonucleotide
tgtggatagagcaggagaggcctgagtattg

SEQ ID NO: 19249 - DNA, 33 bp, Artificial Sequence
  Description of Artificial Sequence: Synthetic oligonucleotide
acacggaatgtgaaggcccactcacagattaac

SEQ ID NO: 19250 - DNA, 32 bp, Artificial Sequence
  Description of Artificial Sequence: Synthetic oligonucleotide
cacggaatgtgaaggcccactcacagattaac

SEQ ID NO: 19251 - DNA, 32 bp, Artificial Sequence
  Description of Artificial Sequence: Synthetic oligonucleotide
acggaatgtgaaggcccactcacagattaacc

SEQ ID NO: 19252 - DNA, 31 bp, Artificial Sequence
  Description of Artificial Sequence: Synthetic oligonucleotide
cggaatgtgaaggcccactcacagattaacc

SEQ ID NO: 19253 - DNA, 31 bp, Artificial Sequence
  Description of Artificial Sequence: Synthetic oligonucleotide
ggaatgtgaaggcccactcacagattaaccg

SEQ ID NO: 19254 - DNA, 32 bp, Artificial Sequence
  Description of Artificial Sequence: Synthetic oligonucleotide
gaatgtgaaggcccactcacagattaaccgag

SEQ ID NO: 19255 - DNA, 33 bp, Artificial Sequence
  Description of Artificial Sequence: Synthetic oligonucleotide
aatgtgaaggcccactcacagattaaccgagtg

SEQ ID NO: 19256 - DNA, 32 bp, Artificial Sequence
  Description of Artificial Sequence: Synthetic oligonucleotide
atgtgaaggcccactcacagattaaccgagtg

SEQ ID NO: 19257 - DNA, 31 bp, Artificial Sequence
  Description of Artificial Sequence: Synthetic oligonucleotide
tgtgaaggcccactcacagattaaccgagtg

SEQ ID NO: 19258 - DNA, 30 bp, Artificial Sequence
  Description of Artificial Sequence: Synthetic oligonucleotide
gtgaaggcccactcacagattaaccgagtg

SEQ ID NO: 19259 - DNA, 30 bp, Artificial Sequence
  Description of Artificial Sequence: Synthetic oligonucleotide
tgaaggcccactcacagattaaccgagtgg

SEQ ID NO: 19260 - DNA, 29 bp, Artificial Sequence
  Description of Artificial Sequence: Synthetic oligonucleotide
gaaggcccactcacagattaaccgagtgg

SEQ ID NO: 19261 - DNA, 30 bp, Artificial Sequence
  Description of Artificial Sequence: Synthetic oligonucleotide
aaggcccactcacagattaaccgagtggac

SEQ ID NO: 19262 - DNA, 29 bp, Artificial Sequence
  Description of Artificial Sequence: Synthetic oligonucleotide
aggcccactcacagattaaccgagtggac

SEQ ID NO: 19263 - DNA, 28 bp, Artificial Sequence
  Description of Artificial Sequence: Synthetic oligonucleotide
ggcccactcacagattaaccgagtggac

SEQ ID NO: 19264 - DNA, 28 bp, Artificial Sequence
  Description of Artificial Sequence: Synthetic oligonucleotide
gcccactcacagattaaccgagtggacc

SEQ ID NO: 19265 - DNA, 29 bp, Artificial Sequence
  Description of Artificial Sequence: Synthetic oligonucleotide
cccactcacagattaaccgagtggacctg

SEQ ID NO: 19266 - DNA, 29 bp, Artificial Sequence
  Description of Artificial Sequence: Synthetic oligonucleotide
ccactcacagattaaccgagtggacctgg

SEQ ID NO: 19267 - DNA, 29 bp, Artificial Sequence
  Description of Artificial Sequence: Synthetic oligonucleotide
cactcacagattaaccgagtggacctggg

SEQ ID NO: 19268 - DNA, 29 bp, Artificial Sequence
  Description of Artificial Sequence: Synthetic oligonucleotide
actcacagattaaccgagtggacctgggg

SEQ ID NO: 19269 - DNA, 28 bp, Artificial Sequence
  Description of Artificial Sequence: Synthetic oligonucleotide
ctcacagattaaccgagtggacctgggg

SEQ ID NO: 19270 - DNA, 29 bp, Artificial Sequence
  Description of Artificial Sequence: Synthetic oligonucleotide
tcacagattaaccgagtggacctggggac

SEQ ID NO: 19271 - DNA, 28 bp, Artificial Sequence
  Description of Artificial Sequence: Synthetic oligonucleotide
cacagattaaccgagtggacctggggac

SEQ ID NO: 19272 - DNA, 28 bp, Artificial Sequence
  Description of Artificial Sequence: Synthetic oligonucleotide
acagattaaccgagtggacctggggacc

SEQ ID NO: 19273 - DNA, 27 bp, Artificial Sequence
  Description of Artificial Sequence: Synthetic oligonucleotide
cagattaaccgagtggacctggggacc

SEQ ID NO: 19274 - DNA, 27 bp, Artificial Sequence
  Description of Artificial Sequence: Synthetic oligonucleotide
agattaaccgagtggacctggggaccc

SEQ ID NO: 19275 - DNA, 27 bp, Artificial Sequence
  Description of Artificial Sequence: Synthetic oligonucleotide
gattaaccgagtggacctggggaccct

SEQ ID NO: 19276 - DNA, 27 bp, Artificial Sequence
  Description of Artificial Sequence: Synthetic oligonucleotide
attaaccgagtggacctggggaccctg

SEQ ID NO: 19277 - DNA, 26 bp, Artificial Sequence
  Description of Artificial Sequence: Synthetic oligonucleotide
ttaaccgagtggacctggggaccctg

SEQ ID NO: 19278 - DNA, 25 bp, Artificial Sequence
  Description of Artificial Sequence: Synthetic oligonucleotide
taaccgagtggacctggggaccctg

SEQ ID NO: 19279 - DNA, 24 bp, Artificial Sequence
  Description of Artificial Sequence: Synthetic oligonucleotide
aaccgagtggacctggggaccctg

SEQ ID NO: 19280 - DNA, 25 bp, Artificial Sequence
  Description of Artificial Sequence: Synthetic oligonucleotide
tacctggagggcacgtgcgtggaga

SEQ ID NO: 19281 - DNA, 24 bp, Artificial Sequence
  Description of Artificial Sequence: Synthetic oligonucleotide
acctggagggcacgtgcgtggaga

SEQ ID NO: 19282 - DNA, 23 bp, Artificial Sequence
  Description of Artificial Sequence: Synthetic oligonucleotide
cctggagggcacgtgcgtggaga

SEQ ID NO: 19283 - DNA, 23 bp, Artificial Sequence
  Description of Artificial Sequence: Synthetic oligonucleotide
ctggagggcacgtgcgtggagag

SEQ ID NO: 19284 - DNA, 23 bp, Artificial Sequence
  Description of Artificial Sequence: Synthetic oligonucleotide
tggagggcacgtgcgtggagagg

SEQ ID NO: 19285 - DNA, 22 bp, Artificial Sequence
  Description of Artificial Sequence: Synthetic oligonucleotide
ggagggcacgtgcgtggagagg

SEQ ID NO: 19286 - DNA, 23 bp, Artificial Sequence
  Description of Artificial Sequence: Synthetic oligonucleotide
gagggcacgtgcgtggagaggct

SEQ ID NO: 19287 - DNA, 23 bp, Artificial Sequence
  Description of Artificial Sequence: Synthetic oligonucleotide
agggcacgtgcgtggagaggctc

SEQ ID NO: 19288 - DNA, 22 bp, Artificial Sequence
  Description of Artificial Sequence: Synthetic oligonucleotide
gggcacgtgcgtggagaggctc

SEQ ID NO: 19289 - DNA, 22 bp, Artificial Sequence
  Description of Artificial Sequence: Synthetic oligonucleotide
ggcacgtgcgtggagaggctcc

SEQ ID NO: 19290 - DNA, 22 bp, Artificial Sequence
  Description of Artificial Sequence: Synthetic oligonucleotide
gcacgtgcgtggagaggctccg

SEQ ID NO: 19291 - DNA, 23 bp, Artificial Sequence
  Description of Artificial Sequence: Synthetic oligonucleotide
cacgtgcgtggagaggctccgca

SEQ ID NO: 19292 - DNA, 26 bp, Artificial Sequence
  Description of Artificial Sequence: Synthetic oligonucleotide
acgtgcgtggagaggctccgcagata

SEQ ID NO: 19293 - DNA, 25 bp, Artificial Sequence
  Description of Artificial Sequence: Synthetic oligonucleotide
cgtgcgtggagaggctccgcagata

SEQ ID NO: 19294 - DNA, 25 bp, Artificial Sequence
  Description of Artificial Sequence: Synthetic oligonucleotide
gtgcgtggagaggctccgcagatac

SEQ ID NO: 19295 - DNA, 26 bp, Artificial Sequence
  Description of Artificial Sequence: Synthetic oligonucleotide
tgcgtggagaggctccgcagatacct

SEQ ID NO: 19296 - DNA, 25 bp, Artificial Sequence
  Description of Artificial Sequence: Synthetic oligonucleotide
gcgtggagaggctccgcagatacct

SEQ ID NO: 19297 - DNA, 25 bp, Artificial Sequence
  Description of Artificial Sequence: Synthetic oligonucleotide
cgtggagaggctccgcagatacctg

SEQ ID NO: 19298 - DNA, 26 bp, Artificial Sequence
  Description of Artificial Sequence: Synthetic oligonucleotide
gtggagaggctccgcagatacctgga

SEQ ID NO: 19299 - DNA, 27 bp, Artificial Sequence
  Description of Artificial Sequence: Synthetic oligonucleotide
tggagaggctccgcagatacctggaga

SEQ ID NO: 19300 - DNA, 27 bp, Artificial Sequence
  Description of Artificial Sequence: Synthetic oligonucleotide
ggagaggctccgcagatacctggagaa

SEQ ID NO: 19301 - DNA, 27 bp, Artificial Sequence
  Description of Artificial Sequence: Synthetic oligonucleotide
gagaggctccgcagatacctggagaac

SEQ ID NO: 19302 - DNA, 27 bp, Artificial Sequence
  Description of Artificial Sequence: Synthetic oligonucleotide
agaggctccgcagatacctggagaacg

SEQ ID NO: 19303 - DNA, 26 bp, Artificial Sequence
  Description of Artificial Sequence: Synthetic oligonucleotide
gaggctccgcagatacctggagaacg

SEQ ID NO: 19304 - DNA, 26 bp, Artificial Sequence
  Description of Artificial Sequence: Synthetic oligonucleotide
aggctccgcagatacctggagaacgg

SEQ ID NO: 19305 - DNA, 25 bp, Artificial Sequence
  Description of Artificial Sequence: Synthetic oligonucleotide
ggcggacatggtggctcagatcacc

SEQ ID NO: 19306 - DNA, 26 bp, Artificial Sequence
  Description of Artificial Sequence: Synthetic oligonucleotide
gcggacatggtggctcagatcaccca

SEQ ID NO: 19307 - DNA, 26 bp, Artificial Sequence
  Description of Artificial Sequence: Synthetic oligonucleotide
cggacatggtggctcagatcacccag

SEQ ID NO: 19308 - DNA, 26 bp, Artificial Sequence
  Description of Artificial Sequence: Synthetic oligonucleotide
ggacatggtggctcagatcacccagc

SEQ ID NO: 19309 - DNA, 26 bp, Artificial Sequence
  Description of Artificial Sequence: Synthetic oligonucleotide
gacatggtggctcagatcacccagcg

SEQ ID NO: 19310 - DNA, 27 bp, Artificial Sequence
  Description of Artificial Sequence: Synthetic oligonucleotide
acatggtggctcagatcacccagcgca

SEQ ID NO: 19311 - DNA, 27 bp, Artificial Sequence
  Description of Artificial Sequence: Synthetic oligonucleotide
catggtggctcagatcacccagcgcaa

SEQ ID NO: 19312 - DNA, 27 bp, Artificial Sequence
  Description of Artificial Sequence: Synthetic oligonucleotide
atggtggctcagatcacccagcgcaag

SEQ ID NO: 19313 - DNA, 27 bp, Artificial Sequence
  Description of Artificial Sequence: Synthetic oligonucleotide
tggtggctcagatcacccagcgcaagt

SEQ ID NO: 19314 - DNA, 26 bp, Artificial Sequence
  Description of Artificial Sequence: Synthetic oligonucleotide
ggtggctcagatcacccagcgcaagt

SEQ ID NO: 19315 - DNA, 26 bp, Artificial Sequence
  Description of Artificial Sequence: Synthetic oligonucleotide
gtggctcagatcacccagcgcaagtg

SEQ ID NO: 19316 - DNA, 26 bp, Artificial Sequence
  Description of Artificial Sequence: Synthetic oligonucleotide
tggctcagatcacccagcgcaagtgg

SEQ ID NO: 19317 - DNA, 26 bp, Artificial Sequence
  Description of Artificial Sequence: Synthetic oligonucleotide
gctactacaaccagagcgaggccggt

SEQ ID NO: 19318 - DNA, 26 bp, Artificial Sequence
  Description of Artificial Sequence: Synthetic oligonucleotide
ctactacaaccagagcgaggccggtg

SEQ ID NO: 19319 - DNA, 27 bp, Artificial Sequence
  Description of Artificial Sequence: Synthetic oligonucleotide
tactacaaccagagcgaggccggtgct

SEQ ID NO: 19320 - DNA, 26 bp, Artificial Sequence
  Description of Artificial Sequence: Synthetic oligonucleotide
actacaaccagagcgaggccggtgct

SEQ ID NO: 19321 - DNA, 25 bp, Artificial Sequence
  Description of Artificial Sequence: Synthetic oligonucleotide
ctacaaccagagcgaggccggtgct

SEQ ID NO: 19322 - DNA, 26 bp, Artificial Sequence
  Description of Artificial Sequence: Synthetic oligonucleotide
tacaaccagagcgaggccggtgctca

SEQ ID NO: 19323 - DNA, 25 bp, Artificial Sequence
  Description of Artificial Sequence: Synthetic oligonucleotide
acaaccagagcgaggccggtgctca

SEQ ID NO: 19324 - DNA, 24 bp, Artificial Sequence
  Description of Artificial Sequence: Synthetic oligonucleotide
caaccagagcgaggccggtgctca

SEQ ID NO: 19325 - DNA, 25 bp, Artificial Sequence
  Description of Artificial Sequence: Synthetic oligonucleotide
aaccagagcgaggccggtgctcaca

SEQ ID NO: 19326 - DNA, 24 bp, Artificial Sequence
  Description of Artificial Sequence: Synthetic oligonucleotide
accagagcgaggccggtgctcaca

SEQ ID NO: 19327 - DNA, 23 bp, Artificial Sequence
  Description of Artificial Sequence: Synthetic oligonucleotide
ccagagcgaggccggtgctcaca

SEQ ID NO: 19328 - DNA, 23 bp, Artificial Sequence
  Description of Artificial Sequence: Synthetic oligonucleotide
cagagcgaggccggtgctcacac

SEQ ID NO: 19329 - DNA, 25 bp, Artificial Sequence
  Description of Artificial Sequence: Synthetic oligonucleotide
agagcgaggccggtgctcacaccat

SEQ ID NO: 19330 - DNA, 24 bp, Artificial Sequence
  Description of Artificial Sequence: Synthetic oligonucleotide
gagcgaggccggtgctcacaccat

SEQ ID NO: 19331 - DNA, 24 bp, Artificial Sequence
  Description of Artificial Sequence: Synthetic oligonucleotide
agcgaggccggtgctcacaccatc

SEQ ID NO: 19332 - DNA, 23 bp, Artificial Sequence
  Description of Artificial Sequence: Synthetic oligonucleotide
gcgaggccggtgctcacaccatc

SEQ ID NO: 19333 - DNA, 24 bp, Artificial Sequence
  Description of Artificial Sequence: Synthetic oligonucleotide
cgaggccggtgctcacaccatcca

SEQ ID NO: 19334 - DNA, 26 bp, Artificial Sequence
  Description of Artificial Sequence: Synthetic oligonucleotide
gaggccggtgctcacaccatccagat

SEQ ID NO: 19335 - DNA, 27 bp, Artificial Sequence
  Description of Artificial Sequence: Synthetic oligonucleotide
aggccggtgctcacaccatccagatga

SEQ ID NO: 19336 - DNA, 27 bp, Artificial Sequence
  Description of Artificial Sequence: Synthetic oligonucleotide
ggccggtgctcacaccatccagatgat

SEQ ID NO: 19337 - DNA, 27 bp, Artificial Sequence
  Description of Artificial Sequence: Synthetic oligonucleotide
gccggtgctcacaccatccagatgatg

SEQ ID NO: 19338 - DNA, 30 bp, Artificial Sequence
  Description of Artificial Sequence: Synthetic oligonucleotide
ccggtgctcacaccatccagatgatgtatg

SEQ ID NO: 19339 - DNA, 30 bp, Artificial Sequence
  Description of Artificial Sequence: Synthetic oligonucleotide
cggtgctcacaccatccagatgatgtatgg

SEQ ID NO: 19340 - DNA, 30 bp, Artificial Sequence
  Description of Artificial Sequence: Synthetic oligonucleotide
ggtgctcacaccatccagatgatgtatggc

SEQ ID NO: 19341 - DNA, 31 bp, Artificial Sequence
  Description of Artificial Sequence: Synthetic oligonucleotide
gtgctcacaccatccagatgatgtatggctg

SEQ ID NO: 19342 - DNA, 31 bp, Artificial Sequence
  Description of Artificial Sequence: Synthetic oligonucleotide
tgctcacaccatccagatgatgtatggctgc

SEQ ID NO: 19343 - DNA, 30 bp, Artificial Sequence
  Description of Artificial Sequence: Synthetic oligonucleotide
gctcacaccatccagatgatgtatggctgc

SEQ ID NO: 19344 - DNA, 25 bp, Artificial Sequence
  Description of Artificial Sequence: Synthetic oligonucleotide
ccgtggatagagcaggagaggcctg

SEQ ID NO: 19345 - DNA, 25 bp, Artificial Sequence
  Description of Artificial Sequence: Synthetic oligonucleotide
cgtggatagagcaggagaggcctgc

SEQ ID NO: 19346 - DNA, 27 bp, Artificial Sequence
  Description of Artificial Sequence: Synthetic oligonucleotide
gtggatagagcaggagaggcctgcgta

SEQ ID NO: 19347 - DNA, 29 bp, Artificial Sequence
  Description of Artificial Sequence: Synthetic oligonucleotide
tggatagagcaggagaggcctgcgtattg

SEQ ID NO: 19348 - DNA, 28 bp, Artificial Sequence
  Description of Artificial Sequence: Synthetic oligonucleotide
ggatagagcaggagaggcctgcgtattg

SEQ ID NO: 19349 - DNA, 28 bp, Artificial Sequence
  Description of Artificial Sequence: Synthetic oligonucleotide
gatagagcaggagaggcctgcgtattgg

SEQ ID NO: 19350 - DNA, 28 bp, Artificial Sequence
  Description of Artificial Sequence: Synthetic oligonucleotide
atagagcaggagaggcctgcgtattggg

SEQ ID NO: 19351 - DNA, 27 bp, Artificial Sequence
  Description of Artificial Sequence: Synthetic oligonucleotide
tagagcaggagaggcctgcgtattggg

SEQ ID NO: 19352 - DNA, 27 bp, Artificial Sequence
  Description of Artificial Sequence: Synthetic oligonucleotide
agagcaggagaggcctgcgtattggga

SEQ ID NO: 19353 - DNA, 26 bp, Artificial Sequence
  Description of Artificial Sequence: Synthetic oligonucleotide
gagcaggagaggcctgcgtattggga

SEQ ID NO: 19354 - DNA, 26 bp, Artificial Sequence
  Description of Artificial Sequence: Synthetic oligonucleotide
agcaggagaggcctgcgtattgggac

SEQ ID NO: 19355 - DNA, 25 bp, Artificial Sequence
  Description of Artificial Sequence: Synthetic oligonucleotide
gcaggagaggcctgcgtattgggac

SEQ ID NO: 19356 - DNA, 26 bp, Artificial Sequence
  Description of Artificial Sequence: Synthetic oligonucleotide
caggagaggcctgcgtattgggacca

SEQ ID NO: 19357 - DNA, 26 bp, Artificial Sequence
  Description of Artificial Sequence: Synthetic oligonucleotide
aggagaggcctgcgtattgggaccag

SEQ ID NO: 19358 - DNA, 25 bp, Artificial Sequence
  Description of Artificial Sequence: Synthetic oligonucleotide
ggagaggcctgcgtattgggaccag

SEQ ID NO: 19359 - DNA, 26 bp, Artificial Sequence
  Description of Artificial Sequence: Synthetic oligonucleotide
gagaggcctgcgtattgggaccagga

SEQ ID NO: 19360 - DNA, 27 bp, Artificial Sequence
  Description of Artificial Sequence: Synthetic oligonucleotide
agaggcctgcgtattgggaccaggaga

SEQ ID NO: 19361 - DNA, 26 bp, Artificial Sequence
  Description of Artificial Sequence: Synthetic oligonucleotide
gaggcctgcgtattgggaccaggaga

SEQ ID NO: 19362 - DNA, 27 bp, Artificial Sequence
  Description of Artificial Sequence: Synthetic oligonucleotide
aggcctgcgtattgggaccaggagaca

SEQ ID NO: 19363 - DNA, 26 bp, Artificial Sequence
  Description of Artificial Sequence: Synthetic oligonucleotide
ggcctgcgtattgggaccaggagaca

SEQ ID NO: 19364 - DNA, 26 bp, Artificial Sequence
  Description of Artificial Sequence: Synthetic oligonucleotide
gcctgcgtattgggaccaggagacac

SEQ ID NO: 19365 - DNA, 26 bp, Artificial Sequence
  Description of Artificial Sequence: Synthetic oligonucleotide
cctgcgtattgggaccaggagacacg

SEQ ID NO: 19366 - DNA, 27 bp, Artificial Sequence
  Description of Artificial Sequence: Synthetic oligonucleotide
ctgcgtattgggaccaggagacacgga

SEQ ID NO: 19367 - DNA, 29 bp, Artificial Sequence
  Description of Artificial Sequence: Synthetic oligonucleotide
tgcgtattgggaccaggagacacggaatg

SEQ ID NO: 19368 - DNA, 28 bp, Artificial Sequence
  Description of Artificial Sequence: Synthetic oligonucleotide
gcgtattgggaccaggagacacggaatg

SEQ ID NO: 19369 - DNA, 29 bp, Artificial Sequence
  Description of Artificial Sequence: Synthetic oligonucleotide
cgtattgggaccaggagacacggaatgtg

SEQ ID NO: 19370 - DNA, 30 bp, Artificial Sequence
  Description of Artificial Sequence: Synthetic oligonucleotide
gatggaaccttccagaagtgggcgtctatg

SEQ ID NO: 19371 - DNA, 30 bp, Artificial Sequence
  Description of Artificial Sequence: Synthetic oligonucleotide
atggaaccttccagaagtgggcgtctatgg

SEQ ID NO: 19372 - DNA, 29 bp, Artificial Sequence
  Description of Artificial Sequence: Synthetic oligonucleotide
tggaaccttccagaagtgggcgtctatgg

SEQ ID NO: 19373 - DNA, 28 bp, Artificial Sequence
  Description of Artificial Sequence: Synthetic oligonucleotide
ggaaccttccagaagtgggcgtctatgg

SEQ ID NO: 19374 - DNA, 29 bp, Artificial Sequence
  Description of Artificial Sequence: Synthetic oligonucleotide
gaaccttccagaagtgggcgtctatggtg

SEQ ID NO: 19375 - DNA, 29 bp, Artificial Sequence
  Description of Artificial Sequence: Synthetic oligonucleotide
aaccttccagaagtgggcgtctatggtgg

SEQ ID NO: 19376 - DNA, 28 bp, Artificial Sequence
  Description of Artificial Sequence: Synthetic oligonucleotide
accttccagaagtgggcgtctatggtgg

SEQ ID NO: 19377 - DNA, 27 bp, Artificial Sequence
  Description of Artificial Sequence: Synthetic oligonucleotide
ccttccagaagtgggcgtctatggtgg

SEQ ID NO: 19378 - DNA, 28 bp, Artificial Sequence
  Description of Artificial Sequence: Synthetic oligonucleotide
cttccagaagtgggcgtctatggtggtg

SEQ ID NO: 19379 - DNA, 28 bp, Artificial Sequence
  Description of Artificial Sequence: Synthetic oligonucleotide
ttccagaagtgggcgtctatggtggtgc

SEQ ID NO: 19380 - DNA, 27 bp, Artificial Sequence
  Description of Artificial Sequence: Synthetic oligonucleotide
tccagaagtgggcgtctatggtggtgc

SEQ ID NO: 19381 - DNA, 26 bp, Artificial Sequence
  Description of Artificial Sequence: Synthetic oligonucleotide
ccagaagtgggcgtctatggtggtgc

SEQ ID NO: 19382 - DNA, 27 bp, Artificial Sequence
  Description of Artificial Sequence: Synthetic oligonucleotide
cagaagtgggcgtctatggtggtgcct

SEQ ID NO: 19383 - DNA, 28 bp, Artificial Sequence
  Description of Artificial Sequence: Synthetic oligonucleotide
agaagtgggcgtctatggtggtgccttc

SEQ ID NO: 19384 - DNA, 27 bp, Artificial Sequence
  Description of Artificial Sequence: Synthetic oligonucleotide
gaagtgggcgtctatggtggtgccttc

SEQ ID NO: 19385 - DNA, 28 bp, Artificial Sequence
  Description of Artificial Sequence: Synthetic oligonucleotide
aagtgggcgtctatggtggtgccttctg

SEQ ID NO: 19386 - DNA, 27 bp, Artificial Sequence
  Description of Artificial Sequence: Synthetic oligonucleotide
agtgggcgtctatggtggtgccttctg

SEQ ID NO: 19387 - DNA, 26 bp, Artificial Sequence
  Description of Artificial Sequence: Synthetic oligonucleotide
gtgggcgtctatggtggtgccttctg

SEQ ID NO: 19388 - DNA, 27 bp, Artificial Sequence
  Description of Artificial Sequence: Synthetic oligonucleotide
tgggcgtctatggtggtgccttctgga

SEQ ID NO: 19389 - DNA, 26 bp, Artificial Sequence
  Description of Artificial Sequence: Synthetic oligonucleotide
gggcgtctatggtggtgccttctgga

SEQ ID NO: 19390 - DNA, 27 bp, Artificial Sequence
  Description of Artificial Sequence: Synthetic oligonucleotide
ggcgtctatggtggtgccttctggaca

SEQ ID NO: 19391 - DNA, 27 bp, Artificial Sequence
  Description of Artificial Sequence: Synthetic oligonucleotide
gcgtctatggtggtgccttctggacag

SEQ ID NO: 19392 - DNA, 27 bp, Artificial Sequence
  Description of Artificial Sequence: Synthetic oligonucleotide
cgtctatggtggtgccttctggacagg

SEQ ID NO: 19393 - DNA, 28 bp, Artificial Sequence
  Description of Artificial Sequence: Synthetic oligonucleotide
gtctatggtggtgccttctggacaggag

SEQ ID NO: 19394 - DNA, 28 bp, Artificial Sequence
  Description of Artificial Sequence: Synthetic oligonucleotide
tctatggtggtgccttctggacaggagc

SEQ ID NO: 19395 - DNA, 27 bp, Artificial Sequence
  Description of Artificial Sequence: Synthetic oligonucleotide
ctatggtggtgccttctggacaggagc

SEQ ID NO: 19396 - DNA, 28 bp, Artificial Sequence
  Description of Artificial Sequence: Synthetic oligonucleotide
tatggtggtgccttctggacaggagcag

SEQ ID NO: 19397 - DNA, 27 bp, Artificial Sequence
  Description of Artificial Sequence: Synthetic oligonucleotide
atggtggtgccttctggacaggagcag

SEQ ID NO: 19398 - DNA, 26 bp, Artificial Sequence
  Description of Artificial Sequence: Synthetic oligonucleotide
cagttgagagcctacctggagggcag

SEQ ID NO: 19399 - DNA, 27 bp, Artificial Sequence
  Description of Artificial Sequence: Synthetic oligonucleotide
agttgagagcctacctggagggcaggt

SEQ ID NO: 19400 - DNA, 26 bp, Artificial Sequence
  Description of Artificial Sequence: Synthetic oligonucleotide
gttgagagcctacctggagggcaggt

SEQ ID NO: 19401 - DNA, 26 bp, Artificial Sequence
  Description of Artificial Sequence: Synthetic oligonucleotide
ttgagagcctacctggagggcaggtg

SEQ ID NO: 19402 - DNA, 25 bp, Artificial Sequence
  Description of Artificial Sequence: Synthetic oligonucleotide
tgagagcctacctggagggcaggtg

SEQ ID NO: 19403 - DNA, 24 bp, Artificial Sequence
  Description of Artificial Sequence: Synthetic oligonucleotide
gagagcctacctggagggcaggtg

SEQ ID NO: 19404 - DNA, 24 bp, Artificial Sequence
  Description of Artificial Sequence: Synthetic oligonucleotide
agagcctacctggagggcaggtgc

SEQ ID NO: 19405 - DNA, 23 bp, Artificial Sequence
  Description of Artificial Sequence: Synthetic oligonucleotide
gagcctacctggagggcaggtgc

SEQ ID NO: 19406 - DNA, 24 bp, Artificial Sequence
  Description of Artificial Sequence: Synthetic oligonucleotide
agcctacctggagggcaggtgcgt

SEQ ID NO: 19407 - DNA, 23 bp, Artificial Sequence
  Description of Artificial Sequence: Synthetic oligonucleotide
gcctacctggagggcaggtgcgt

SEQ ID NO: 19408 - DNA, 23 bp, Artificial Sequence
  Description of Artificial Sequence: Synthetic oligonucleotide
cctacctggagggcaggtgcgtg

SEQ ID NO: 19409 - DNA, 24 bp, Artificial Sequence
  Description of Artificial Sequence: Synthetic oligonucleotide
ctacctggagggcaggtgcgtgga

SEQ ID NO: 19410 - DNA, 25 bp, Artificial Sequence
  Description of Artificial Sequence: Synthetic oligonucleotide
tacctggagggcaggtgcgtggagt

SEQ ID NO: 19411 - DNA, 24 bp, Artificial Sequence
  Description of Artificial Sequence: Synthetic oligonucleotide
acctggagggcaggtgcgtggagt

SEQ ID NO: 19412 - DNA, 23 bp, Artificial Sequence
  Description of Artificial Sequence: Synthetic oligonucleotide
cctggagggcaggtgcgtggagt

SEQ ID NO: 19413 - DNA, 23 bp, Artificial Sequence
  Description of Artificial Sequence: Synthetic oligonucleotide
ctggagggcaggtgcgtggagtg

SEQ ID NO: 19414 - DNA, 23 bp, Artificial Sequence
  Description of Artificial Sequence: Synthetic oligonucleotide
tggagggcaggtgcgtggagtgg

SEQ ID NO: 19415 - DNA, 22 bp, Artificial Sequence
  Description of Artificial Sequence: Synthetic oligonucleotide
ggagggcaggtgcgtggagtgg

SEQ ID NO: 19416 - DNA, 23 bp, Artificial Sequence
  Description of Artificial Sequence: Synthetic oligonucleotide
gagggcaggtgcgtggagtggct

SEQ ID NO: 19417 - DNA, 23 bp, Artificial Sequence
  Description of Artificial Sequence: Synthetic oligonucleotide
agggcaggtgcgtggagtggctc

SEQ ID NO: 19418 - DNA, 22 bp, Artificial Sequence
  Description of Artificial Sequence: Synthetic oligonucleotide
gggcaggtgcgtggagtggctc

SEQ ID NO: 19419 - DNA, 22 bp, Artificial Sequence
  Description of Artificial Sequence: Synthetic oligonucleotide
ggcaggtgcgtggagtggctcc

SEQ ID NO: 19420 - DNA, 22 bp, Artificial Sequence
  Description of Artificial Sequence: Synthetic oligonucleotide
gcaggtgcgtggagtggctccg

SEQ ID NO: 19421 - DNA, 23 bp, Artificial Sequence
  Description of Artificial Sequence: Synthetic oligonucleotide
caggtgcgtggagtggctccgca

SEQ ID NO: 19422 - DNA, 26 bp, Artificial Sequence
  Description of Artificial Sequence: Synthetic oligonucleotide
aggtgcgtggagtggctccgcagata

SEQ ID NO: 19423 - DNA, 28 bp, Artificial Sequence
  Description of Artificial Sequence: Synthetic oligonucleotide
gacgcctacgacggcaaggattacatcc

SEQ ID NO: 19424 - DNA, 28 bp, Artificial Sequence
  Description of Artificial Sequence: Synthetic oligonucleotide
acgcctacgacggcaaggattacatccc

SEQ ID NO: 19425 - DNA, 27 bp, Artificial Sequence
  Description of Artificial Sequence: Synthetic oligonucleotide
cgcctacgacggcaaggattacatccc

SEQ ID NO: 19426 - DNA, 27 bp, Artificial Sequence
  Description of Artificial Sequence: Synthetic oligonucleotide
gcctacgacggcaaggattacatcccc

SEQ ID NO: 19427 - DNA, 29 bp, Artificial Sequence
  Description of Artificial Sequence: Synthetic oligonucleotide
cctacgacggcaaggattacatccccttg

SEQ ID NO: 19428 - DNA, 31 bp, Artificial Sequence
  Description of Artificial Sequence: Synthetic oligonucleotide
ctacgacggcaaggattacatccccttgaac

SEQ ID NO: 19429 - DNA, 31 bp, Artificial Sequence
  Description of Artificial Sequence: Synthetic oligonucleotide
tacgacggcaaggattacatccccttgaacg

SEQ ID NO: 19430 - DNA, 30 bp, Artificial Sequence
  Description of Artificial Sequence: Synthetic oligonucleotide
acgacggcaaggattacatccccttgaacg

SEQ ID NO: 19431 - DNA, 29 bp, Artificial Sequence
  Description of Artificial Sequence: Synthetic oligonucleotide
cgacggcaaggattacatccccttgaacg

SEQ ID NO: 19432 - DNA, 30 bp, Artificial Sequence
  Description of Artificial Sequence: Synthetic oligonucleotide
gacggcaaggattacatccccttgaacgag

SEQ ID NO: 19433 - DNA, 30 bp, Artificial Sequence
  Description of Artificial Sequence: Synthetic oligonucleotide
acggcaaggattacatccccttgaacgagg

SEQ ID NO: 19434 - DNA, 29 bp, Artificial Sequence
  Description of Artificial Sequence: Synthetic oligonucleotide
cggcaaggattacatccccttgaacgagg

SEQ ID NO: 19435 - DNA, 30 bp, Artificial Sequence
  Description of Artificial Sequence: Synthetic oligonucleotide
ggcaaggattacatccccttgaacgaggac

SEQ ID NO: 19436 - DNA, 30 bp, Artificial Sequence
  Description of Artificial Sequence: Synthetic oligonucleotide
gcaaggattacatccccttgaacgaggacc

SEQ ID NO: 19437 - DNA, 31 bp, Artificial Sequence
  Description of Artificial Sequence: Synthetic oligonucleotide
caaggattacatccccttgaacgaggacctg

SEQ ID NO: 19438 - DNA, 31 bp, Artificial Sequence
  Description of Artificial Sequence: Synthetic oligonucleotide
aaggattacatccccttgaacgaggacctgc

SEQ ID NO: 19439 - DNA, 30 bp, Artificial Sequence
  Description of Artificial Sequence: Synthetic oligonucleotide
aggattacatccccttgaacgaggacctgc

SEQ ID NO: 19440 - DNA, 29 bp, Artificial Sequence
  Description of Artificial Sequence: Synthetic oligonucleotide
ggattacatccccttgaacgaggacctgc

SEQ ID NO: 19441 - DNA, 29 bp, Artificial Sequence
  Description of Artificial Sequence: Synthetic oligonucleotide
gattacatccccttgaacgaggacctgcg

SEQ ID NO: 19442 - DNA, 29 bp, Artificial Sequence
  Description of Artificial Sequence: Synthetic oligonucleotide
attacatccccttgaacgaggacctgcgc

SEQ ID NO: 19443 - DNA, 28 bp, Artificial Sequence
  Description of Artificial Sequence: Synthetic oligonucleotide
ttacatccccttgaacgaggacctgcgc

SEQ ID NO: 19444 - DNA, 27 bp, Artificial Sequence
  Description of Artificial Sequence: Synthetic oligonucleotide
tacatccccttgaacgaggacctgcgc

SEQ ID NO: 19445 - DNA, 27 bp, Artificial Sequence
  Description of Artificial Sequence: Synthetic oligonucleotide
acatccccttgaacgaggacctgcgct

SEQ ID NO: 19446 - DNA, 26 bp, Artificial Sequence
  Description of Artificial Sequence: Synthetic oligonucleotide
catccccttgaacgaggacctgcgct

SEQ ID NO: 19447 - DNA, 27 bp, Artificial Sequence
  Description of Artificial Sequence: Synthetic oligonucleotide
atccccttgaacgaggacctgcgctct

SEQ ID NO: 19448 - DNA, 27 bp, Artificial Sequence
  Description of Artificial Sequence: Synthetic oligonucleotide
tccccttgaacgaggacctgcgctctt

SEQ ID NO: 19449 - DNA, 26 bp, Artificial Sequence
  Description of Artificial Sequence: Synthetic oligonucleotide
ccccttgaacgaggacctgcgctctt

SEQ ID NO: 19450 - DNA, 26 bp, Artificial Sequence
  Description of Artificial Sequence: Synthetic oligonucleotide
cccttgaacgaggacctgcgctcttg

SEQ ID NO: 19451 - DNA, 25 bp, Artificial Sequence
  Description of Artificial Sequence: Synthetic oligonucleotide
tgggcgccgtggatagagcaggaga

SEQ ID NO: 19452 - DNA, 32 bp, Artificial Sequence
  Description of Artificial Sequence: Synthetic oligonucleotide
tattgggaccaggagacacggaatgtgaagac

SEQ ID NO: 19453 - DNA, 31 bp, Artificial Sequence
  Description of Artificial Sequence: Synthetic oligonucleotide
attgggaccaggagacacggaatgtgaagac

SEQ ID NO: 19454 - DNA, 30 bp, Artificial Sequence
  Description of Artificial Sequence: Synthetic oligonucleotide
ttgggaccaggagacacggaatgtgaagac

SEQ ID NO: 19455 - DNA, 29 bp, Artificial Sequence
  Description of Artificial Sequence: Synthetic oligonucleotide
tgggaccaggagacacggaatgtgaagac

SEQ ID NO: 19456 - DNA, 28 bp, Artificial Sequence
  Description of Artificial Sequence: Synthetic oligonucleotide
gggaccaggagacacggaatgtgaagac

SEQ ID NO: 19457 - DNA, 28 bp, Artificial Sequence
  Description of Artificial Sequence: Synthetic oligonucleotide
ggaccaggagacacggaatgtgaagacc

SEQ ID NO: 19458 - DNA, 28 bp, Artificial Sequence
  Description of Artificial Sequence: Synthetic oligonucleotide
gaccaggagacacggaatgtgaagaccc

SEQ ID NO: 19459 - DNA, 29 bp, Artificial Sequence
  Description of Artificial Sequence: Synthetic oligonucleotide
accaggagacacggaatgtgaagacccac

SEQ ID NO: 19460 - DNA, 28 bp, Artificial Sequence
  Description of Artificial Sequence: Synthetic oligonucleotide
ccaggagacacggaatgtgaagacccac

SEQ ID NO: 19461 - DNA, 29 bp, Artificial Sequence
  Description of Artificial Sequence: Synthetic oligonucleotide
caggagacacggaatgtgaagacccactc

SEQ ID NO: 19462 - DNA, 30 bp, Artificial Sequence
  Description of Artificial Sequence: Synthetic oligonucleotide
aggagacacggaatgtgaagacccactcac

SEQ ID NO: 19463 - DNA, 29 bp, Artificial Sequence
  Description of Artificial Sequence: Synthetic oligonucleotide
ggagacacggaatgtgaagacccactcac

SEQ ID NO: 19464 - DNA, 30 bp, Artificial Sequence
  Description of Artificial Sequence: Synthetic oligonucleotide
gagacacggaatgtgaagacccactcacag

SEQ ID NO: 19465 - DNA, 33 bp, Artificial Sequence
  Description of Artificial Sequence: Synthetic oligonucleotide
agacacggaatgtgaagacccactcacagattg

SEQ ID NO: 19466 - DNA, 32 bp, Artificial Sequence
  Description of Artificial Sequence: Synthetic oligonucleotide
gacacggaatgtgaagacccactcacagattg

SEQ ID NO: 19467 - DNA, 33 bp, Artificial Sequence
  Description of Artificial Sequence: Synthetic oligonucleotide
acacggaatgtgaagacccactcacagattgac

SEQ ID NO: 19468 - DNA, 32 bp, Artificial Sequence
  Description of Artificial Sequence: Synthetic oligonucleotide
cacggaatgtgaagacccactcacagattgac

SEQ ID NO: 19469 - DNA, 32 bp, Artificial Sequence
  Description of Artificial Sequence: Synthetic oligonucleotide
acggaatgtgaagacccactcacagattgacc

SEQ ID NO: 19470 - DNA, 31 bp, Artificial Sequence
  Description of Artificial Sequence: Synthetic oligonucleotide
cggaatgtgaagacccactcacagattgacc

SEQ ID NO: 19471 - DNA, 31 bp, Artificial Sequence
  Description of Artificial Sequence: Synthetic oligonucleotide
ggaatgtgaagacccactcacagattgaccg

SEQ ID NO: 19472 - DNA, 32 bp, Artificial Sequence
  Description of Artificial Sequence: Synthetic oligonucleotide
gaatgtgaagacccactcacagattgaccgag

SEQ ID NO: 19473 - DNA, 33 bp, Artificial Sequence
  Description of Artificial Sequence: Synthetic oligonucleotide
aatgtgaagacccactcacagattgaccgagtg

SEQ ID NO: 19474 - DNA, 32 bp, Artificial Sequence
  Description of Artificial Sequence: Synthetic oligonucleotide
atgtgaagacccactcacagattgaccgagtg

SEQ ID NO: 19475 - DNA, 31 bp, Artificial Sequence
  Description of Artificial Sequence: Synthetic oligonucleotide
tgtgaagacccactcacagattgaccgagtg

SEQ ID NO: 19476 - DNA, 30 bp, Artificial Sequence
  Description of Artificial Sequence: Synthetic oligonucleotide
gtgaagacccactcacagattgaccgagtg

SEQ ID NO: 19477 - DNA, 30 bp, Artificial Sequence
  Description of Artificial Sequence: Synthetic oligonucleotide
tgaagacccactcacagattgaccgagtgg

SEQ ID NO: 19478 - DNA, 29 bp, Artificial Sequence
  Description of Artificial Sequence: Synthetic oligonucleotide
gaagacccactcacagattgaccgagtgg

SEQ ID NO: 19479 - DNA, 30 bp, Artificial Sequence
  Description of Artificial Sequence: Synthetic oligonucleotide
aagacccactcacagattgaccgagtggac

SEQ ID NO: 19480 - DNA, 29 bp, Artificial Sequence
  Description of Artificial Sequence: Synthetic oligonucleotide
agacccactcacagattgaccgagtggac

SEQ ID NO: 19481 - DNA, 28 bp, Artificial Sequence
  Description of Artificial Sequence: Synthetic oligonucleotide
gacccactcacagattgaccgagtggac

SEQ ID NO: 19482 - DNA, 28 bp, Artificial Sequence
  Description of Artificial Sequence: Synthetic oligonucleotide
acccactcacagattgaccgagtggacc

SEQ ID NO: 19483 - DNA, 25 bp, Artificial Sequence
  Description of Artificial Sequence: Synthetic oligonucleotide
cgggcgccgtggatagagcagaaga

SEQ ID NO: 19484 - DNA, 25 bp, Artificial Sequence
  Description of Artificial Sequence: Synthetic oligonucleotide
gggcgccgtggatagagcagaagag

SEQ ID NO: 19485 - DNA, 25 bp, Artificial Sequence
  Description of Artificial Sequence: Synthetic oligonucleotide
ggcgccgtggatagagcagaagagg

SEQ ID NO: 19486 - DNA, 25 bp, Artificial Sequence
  Description of Artificial Sequence: Synthetic oligonucleotide
gcgccgtggatagagcagaagaggc

SEQ ID NO: 19487 - DNA, 26 bp, Artificial Sequence
  Description of Artificial Sequence: Synthetic oligonucleotide
cgccgtggatagagcagaagaggcct

SEQ ID NO: 19488 - DNA, 27 bp, Artificial Sequence
  Description of Artificial Sequence: Synthetic oligonucleotide
gccgtggatagagcagaagaggcctga

SEQ ID NO: 19489 - DNA, 27 bp, Artificial Sequence
  Description of Artificial Sequence: Synthetic oligonucleotide
ccgtggatagagcagaagaggcctgag

SEQ ID NO: 19490 - DNA, 31 bp, Artificial Sequence
  Description of Artificial Sequence: Synthetic oligonucleotide
cgtggatagagcagaagaggcctgagtattg

SEQ ID NO: 19491 - DNA, 31 bp, Artificial Sequence
  Description of Artificial Sequence: Synthetic oligonucleotide
gtggatagagcagaagaggcctgagtattgg

SEQ ID NO: 19492 - DNA, 31 bp, Artificial Sequence
  Description of Artificial Sequence: Synthetic oligonucleotide
tggatagagcagaagaggcctgagtattggg

SEQ ID NO: 19493 - DNA, 30 bp, Artificial Sequence
  Description of Artificial Sequence: Synthetic oligonucleotide
ggatagagcagaagaggcctgagtattggg

SEQ ID NO: 19494 - DNA, 31 bp, Artificial Sequence
  Description of Artificial Sequence: Synthetic oligonucleotide
gatagagcagaagaggcctgagtattgggac

SEQ ID NO: 19495 - DNA, 31 bp, Artificial Sequence
  Description of Artificial Sequence: Synthetic oligonucleotide
atagagcagaagaggcctgagtattgggacc

SEQ ID NO: 19496 - DNA, 30 bp, Artificial Sequence
  Description of Artificial Sequence: Synthetic oligonucleotide
tagagcagaagaggcctgagtattgggacc

SEQ ID NO: 19497 - DNA, 29 bp, Artificial Sequence
  Description of Artificial Sequence: Synthetic oligonucleotide
agagcagaagaggcctgagtattgggacc

SEQ ID NO: 19498 - DNA, 28 bp, Artificial Sequence
  Description of Artificial Sequence: Synthetic oligonucleotide
gagcagaagaggcctgagtattgggacc

SEQ ID NO: 19499 - DNA, 29 bp, Artificial Sequence
  Description of Artificial Sequence: Synthetic oligonucleotide
agcagaagaggcctgagtattgggaccag

SEQ ID NO: 19500 - DNA, 28 bp, Artificial Sequence
  Description of Artificial Sequence: Synthetic oligonucleotide
gcagaagaggcctgagtattgggaccag

SEQ ID NO: 19501 - DNA, 28 bp, Artificial Sequence
  Description of Artificial Sequence: Synthetic oligonucleotide
cagaagaggcctgagtattgggaccagg

SEQ ID NO: 19502 - DNA, 29 bp, Artificial Sequence
  Description of Artificial Sequence: Synthetic oligonucleotide
agaagaggcctgagtattgggaccaggag

SEQ ID NO: 19503 - DNA, 28 bp, Artificial Sequence
  Description of Artificial Sequence: Synthetic oligonucleotide
gaagaggcctgagtattgggaccaggag

SEQ ID NO: 19504 - DNA, 29 bp, Artificial Sequence
  Description of Artificial Sequence: Synthetic oligonucleotide
aagaggcctgagtattgggaccaggagac

SEQ ID NO: 19505 - DNA, 22 bp, Artificial Sequence
  Description of Artificial Sequence: Synthetic oligonucleotide
tcggacgggcgcttcctccgct

SEQ ID NO: 19506 - DNA, 21 bp, Artificial Sequence
  Description of Artificial Sequence: Synthetic oligonucleotide
cggacgggcgcttcctccgct

SEQ ID NO: 19507 - DNA, 21 bp, Artificial Sequence
  Description of Artificial Sequence: Synthetic oligonucleotide
ggacgggcgcttcctccgctg

SEQ ID NO: 19508 - DNA, 23 bp, Artificial Sequence
  Description of Artificial Sequence: Synthetic oligonucleotide
gacgggcgcttcctccgctggta

SEQ ID NO: 19509 - DNA, 23 bp, Artificial Sequence
  Description of Artificial Sequence: Synthetic oligonucleotide
acgggcgcttcctccgctggtac

SEQ ID NO: 19510 - DNA, 22 bp, Artificial Sequence
  Description of Artificial Sequence: Synthetic oligonucleotide
cgggcgcttcctccgctggtac

SEQ ID NO: 19511 - DNA, 23 bp, Artificial Sequence
  Description of Artificial Sequence: Synthetic oligonucleotide
gggcgcttcctccgctggtacca

SEQ ID NO: 19512 - DNA, 23 bp, Artificial Sequence
  Description of Artificial Sequence: Synthetic oligonucleotide
ggcgcttcctccgctggtaccag

SEQ ID NO: 19513 - DNA, 24 bp, Artificial Sequence
  Description of Artificial Sequence: Synthetic oligonucleotide
gcgcttcctccgctggtaccagca

SEQ ID NO: 19514 - DNA, 24 bp, Artificial Sequence
  Description of Artificial Sequence: Synthetic oligonucleotide
cgcttcctccgctggtaccagcag

SEQ ID NO: 19515 - DNA, 25 bp, Artificial Sequence
  Description of Artificial Sequence: Synthetic oligonucleotide
gcttcctccgctggtaccagcagga

SEQ ID NO: 19516 - DNA, 25 bp, Artificial Sequence
  Description of Artificial Sequence: Synthetic oligonucleotide
cttcctccgctggtaccagcaggac

SEQ ID NO: 19517 - DNA, 25 bp, Artificial Sequence
  Description of Artificial Sequence: Synthetic oligonucleotide
ttcctccgctggtaccagcaggacg

SEQ ID NO: 19518 - DNA, 24 bp, Artificial Sequence
  Description of Artificial Sequence: Synthetic oligonucleotide
tcctccgctggtaccagcaggacg

SEQ ID NO: 19519 - DNA, 23 bp, Artificial Sequence
  Description of Artificial Sequence: Synthetic oligonucleotide
cctccgctggtaccagcaggacg

SEQ ID NO: 19520 - DNA, 23 bp, Artificial Sequence
  Description of Artificial Sequence: Synthetic oligonucleotide
ctccgctggtaccagcaggacgc

SEQ ID NO: 19521 - DNA, 25 bp, Artificial Sequence
  Description of Artificial Sequence: Synthetic oligonucleotide
tccgctggtaccagcaggacgccta

SEQ ID NO: 19522 - DNA, 24 bp, Artificial Sequence
  Description of Artificial Sequence: Synthetic oligonucleotide
ccgctggtaccagcaggacgccta

SEQ ID NO: 19523 - DNA, 24 bp, Artificial Sequence
  Description of Artificial Sequence: Synthetic oligonucleotide
cgctggtaccagcaggacgcctac

SEQ ID NO: 19524 - DNA, 25 bp, Artificial Sequence
  Description of Artificial Sequence: Synthetic oligonucleotide
gctggtaccagcaggacgcctacga

SEQ ID NO: 19525 - DNA, 25 bp, Artificial Sequence
  Description of Artificial Sequence: Synthetic oligonucleotide
ctggtaccagcaggacgcctacgac

SEQ ID NO: 19526 - DNA, 25 bp, Artificial Sequence
  Description of Artificial Sequence: Synthetic oligonucleotide
tggtaccagcaggacgcctacgacg

SEQ ID NO: 19527 - DNA, 28 bp, Artificial Sequence
  Description of Artificial Sequence: Synthetic oligonucleotide
tgaaggcccactcacagattgaccgagg

SEQ ID NO: 19528 - DNA, 27 bp, Artificial Sequence
  Description of Artificial Sequence: Synthetic oligonucleotide
gaaggcccactcacagattgaccgagg

SEQ ID NO: 19529 - DNA, 27 bp, Artificial Sequence
  Description of Artificial Sequence: Synthetic oligonucleotide
aaggcccactcacagattgaccgaggg

SEQ ID NO: 19530 - DNA, 26 bp, Artificial Sequence
  Description of Artificial Sequence: Synthetic oligonucleotide
aggcccactcacagattgaccgaggg

SEQ ID NO: 19531 - DNA, 25 bp, Artificial Sequence
  Description of Artificial Sequence: Synthetic oligonucleotide
ggcccactcacagattgaccgaggg

SEQ ID NO: 19532 - DNA, 26 bp, Artificial Sequence
  Description of Artificial Sequence: Synthetic oligonucleotide
gcccactcacagattgaccgagggga

SEQ ID NO: 19533 - DNA, 26 bp, Artificial Sequence
  Description of Artificial Sequence: Synthetic oligonucleotide
cccactcacagattgaccgaggggac

SEQ ID NO: 19534 - DNA, 27 bp, Artificial Sequence
  Description of Artificial Sequence: Synthetic oligonucleotide
ccactcacagattgaccgaggggacct

SEQ ID NO: 19535 - DNA, 27 bp, Artificial Sequence
  Description of Artificial Sequence: Synthetic oligonucleotide
cactcacagattgaccgaggggacctg

SEQ ID NO: 19536 - DNA, 27 bp, Artificial Sequence
  Description of Artificial Sequence: Synthetic oligonucleotide
actcacagattgaccgaggggacctgg

SEQ ID NO: 19537 - DNA, 26 bp, Artificial Sequence
  Description of Artificial Sequence: Synthetic oligonucleotide
ctcacagattgaccgaggggacctgg

SEQ ID NO: 19538 - DNA, 26 bp, Artificial Sequence
  Description of Artificial Sequence: Synthetic oligonucleotide
tcacagattgaccgaggggacctggg

SEQ ID NO: 19539 - DNA, 25 bp, Artificial Sequence
  Description of Artificial Sequence: Synthetic oligonucleotide
cacagattgaccgaggggacctggg

SEQ ID NO: 19540 - DNA, 26 bp, Artificial Sequence
  Description of Artificial Sequence: Synthetic oligonucleotide
acagattgaccgaggggacctgggga

SEQ ID NO: 19541 - DNA, 25 bp, Artificial Sequence
  Description of Artificial Sequence: Synthetic oligonucleotide
cagattgaccgaggggacctgggga

SEQ ID NO: 19542 - DNA, 25 bp, Artificial Sequence
  Description of Artificial Sequence: Synthetic oligonucleotide
agattgaccgaggggacctggggac

SEQ ID NO: 19543 - DNA, 24 bp, Artificial Sequence
  Description of Artificial Sequence: Synthetic oligonucleotide
gattgaccgaggggacctggggac

SEQ ID NO: 19544 - DNA, 24 bp, Artificial Sequence
  Description of Artificial Sequence: Synthetic oligonucleotide
attgaccgaggggacctggggacc

SEQ ID NO: 19545 - DNA, 23 bp, Artificial Sequence
  Description of Artificial Sequence: Synthetic oligonucleotide
ttgaccgaggggacctggggacc

SEQ ID NO: 19546 - DNA, 22 bp, Artificial Sequence
  Description of Artificial Sequence: Synthetic oligonucleotide
tgaccgaggggacctggggacc

SEQ ID NO: 19547 - DNA, 21 bp, Artificial Sequence
  Description of Artificial Sequence: Synthetic oligonucleotide
gaccgaggggacctggggacc

SEQ ID NO: 19548 - DNA, 22 bp, Artificial Sequence
  Description of Artificial Sequence: Synthetic oligonucleotide
accgaggggacctggggaccct

SEQ ID NO: 19549 - DNA, 21 bp, Artificial Sequence
  Description of Artificial Sequence: Synthetic oligonucleotide
ccgaggggacctggggaccct

SEQ ID NO: 19550 - DNA, 21 bp, Artificial Sequence
  Description of Artificial Sequence: Synthetic oligonucleotide
cgaggggacctggggaccctg

SEQ ID NO: 19551 - DNA, 21 bp, Artificial Sequence
  Description of Artificial Sequence: Synthetic oligonucleotide
gaggggacctggggaccctgc

SEQ ID NO: 19552 - DNA, 21 bp, Artificial Sequence
  Description of Artificial Sequence: Synthetic oligonucleotide
aggggacctggggaccctgcg

SEQ ID NO: 19553 - DNA, 20 bp, Artificial Sequence
  Description of Artificial Sequence: Synthetic oligonucleotide
ggggacctggggaccctgcg

SEQ ID NO: 19554 - DNA, 20 bp, Artificial Sequence
  Description of Artificial Sequence: Synthetic oligonucleotide
gggacctggggaccctgcgc

SEQ ID NO: 19555 - DNA, 24 bp, Artificial Sequence
  Description of Artificial Sequence: Synthetic oligonucleotide
ctacctggagggcacgtgcgtgca

SEQ ID NO: 19556 - DNA, 25 bp, Artificial Sequence
  Description of Artificial Sequence: Synthetic oligonucleotide
tacctggagggcacgtgcgtgcagt

SEQ ID NO: 19557 - DNA, 24 bp, Artificial Sequence
  Description of Artificial Sequence: Synthetic oligonucleotide
acctggagggcacgtgcgtgcagt

SEQ ID NO: 19558 - DNA, 23 bp, Artificial Sequence
  Description of Artificial Sequence: Synthetic oligonucleotide
cctggagggcacgtgcgtgcagt

SEQ ID NO: 19559 - DNA, 23 bp, Artificial Sequence
  Description of Artificial Sequence: Synthetic oligonucleotide
ctggagggcacgtgcgtgcagtg

SEQ ID NO: 19560 - DNA, 23 bp, Artificial Sequence
  Description of Artificial Sequence: Synthetic oligonucleotide
tggagggcacgtgcgtgcagtgg

SEQ ID NO: 19561 - DNA, 22 bp, Artificial Sequence
  Description of Artificial Sequence: Synthetic oligonucleotide
ggagggcacgtgcgtgcagtgg

SEQ ID NO: 19562 - DNA, 23 bp, Artificial Sequence
  Description of Artificial Sequence: Synthetic oligonucleotide
gagggcacgtgcgtgcagtggct

SEQ ID NO: 19563 - DNA, 23 bp, Artificial Sequence
  Description of Artificial Sequence: Synthetic oligonucleotide
agggcacgtgcgtgcagtggctc

SEQ ID NO: 19564 - DNA, 22 bp, Artificial Sequence
  Description of Artificial Sequence: Synthetic oligonucleotide
gggcacgtgcgtgcagtggctc

SEQ ID NO: 19565 - DNA, 22 bp, Artificial Sequence
  Description of Artificial Sequence: Synthetic oligonucleotide
ggcacgtgcgtgcagtggctcc

SEQ ID NO: 19566 - DNA, 22 bp, Artificial Sequence
  Description of Artificial Sequence: Synthetic oligonucleotide
gcacgtgcgtgcagtggctccg

SEQ ID NO: 19567 - DNA, 23 bp, Artificial Sequence
  Description of Artificial Sequence: Synthetic oligonucleotide
cacgtgcgtgcagtggctccgca

SEQ ID NO: 19568 - DNA, 26 bp, Artificial Sequence
  Description of Artificial Sequence: Synthetic oligonucleotide
acgtgcgtgcagtggctccgcagata

SEQ ID NO: 19569 - DNA, 25 bp, Artificial Sequence
  Description of Artificial Sequence: Synthetic oligonucleotide
cgtgcgtgcagtggctccgcagata

SEQ ID NO: 19570 - DNA, 25 bp, Artificial Sequence
  Description of Artificial Sequence: Synthetic oligonucleotide
gtgcgtgcagtggctccgcagatac

SEQ ID NO: 19571 - DNA, 26 bp, Artificial Sequence
  Description of Artificial Sequence: Synthetic oligonucleotide
tgcgtgcagtggctccgcagatacct

SEQ ID NO: 19572 - DNA, 25 bp, Artificial Sequence
  Description of Artificial Sequence: Synthetic oligonucleotide
gcgtgcagtggctccgcagatacct

SEQ ID NO: 19573 - DNA, 25 bp, Artificial Sequence
  Description of Artificial Sequence: Synthetic oligonucleotide
cgtgcagtggctccgcagatacctg

SEQ ID NO: 19574 - DNA, 26 bp, Artificial Sequence
  Description of Artificial Sequence: Synthetic oligonucleotide
gtgcagtggctccgcagatacctgga

SEQ ID NO: 19575 - DNA, 27 bp, Artificial Sequence
  Description of Artificial Sequence: Synthetic oligonucleotide
tgcagtggctccgcagatacctggaga

SEQ ID NO: 19576 - DNA, 27 bp, Artificial Sequence
  Description of Artificial Sequence: Synthetic oligonucleotide
gcagtggctccgcagatacctggagaa

SEQ ID NO: 19577 - DNA, 27 bp, Artificial Sequence
  Description of Artificial Sequence: Synthetic oligonucleotide
cagtggctccgcagatacctggagaac

SEQ ID NO: 19578 - DNA, 26 bp, Artificial Sequence
  Description of Artificial Sequence: Synthetic oligonucleotide
gagagcgaggccggttctcacaccat

SEQ ID NO: 19579 - DNA, 20 bp, Artificial Sequence
  Description of Artificial Sequence: Synthetic oligonucleotide
cgctcttggaccgcggcggg

SEQ ID NO: 19580 - DNA, 22 bp, Artificial Sequence
  Description of Artificial Sequence: Synthetic oligonucleotide
gctcttggaccgcggcgggcat

SEQ ID NO: 19581 - DNA, 22 bp, Artificial Sequence
  Description of Artificial Sequence: Synthetic oligonucleotide
ctcttggaccgcggcgggcatg

SEQ ID NO: 19582 - DNA, 22 bp, Artificial Sequence
  Description of Artificial Sequence: Synthetic oligonucleotide
tcttggaccgcggcgggcatgg

SEQ ID NO: 19583 - DNA, 21 bp, Artificial Sequence
  Description of Artificial Sequence: Synthetic oligonucleotide
cttggaccgcggcgggcatgg

SEQ ID NO: 19584 - DNA, 21 bp, Artificial Sequence
  Description of Artificial Sequence: Synthetic oligonucleotide
ttggaccgcggcgggcatggc

SEQ ID NO: 19585 - DNA, 20 bp, Artificial Sequence
  Description of Artificial Sequence: Synthetic oligonucleotide
tggaccgcggcgggcatggc

SEQ ID NO: 19586 - DNA, 20 bp, Artificial Sequence
  Description of Artificial Sequence: Synthetic oligonucleotide
ggaccgcggcgggcatggct

SEQ ID NO: 19587 - DNA, 20 bp, Artificial Sequence
  Description of Artificial Sequence: Synthetic oligonucleotide
gaccgcggcgggcatggcgt

SEQ ID NO: 19588 - DNA, 20 bp, Artificial Sequence
  Description of Artificial Sequence: Synthetic oligonucleotide
accgcggcgggcatggcggt

SEQ ID NO: 19589 - DNA, 20 bp, Artificial Sequence
  Description of Artificial Sequence: Synthetic oligonucleotide
ccgcggcgggcatggcggtt

SEQ ID NO: 19590 - DNA, 20 bp, Artificial Sequence
  Description of Artificial Sequence: Synthetic oligonucleotide
cgcggcgggcatggcggctt

SEQ ID NO: 19591 - DNA, 20 bp, Artificial Sequence
  Description of Artificial Sequence: Synthetic oligonucleotide
gcggcgggcatggcggctca

SEQ ID NO: 19592 - DNA, 22 bp, Artificial Sequence
  Description of Artificial Sequence: Synthetic oligonucleotide
cggcgggcatggcggctcagat

SEQ ID NO: 19593 - DNA, 23 bp, Artificial Sequence
  Description of Artificial Sequence: Synthetic oligonucleotide
ggcgggcatggcggctcagatca

SEQ ID NO: 19594 - DNA, 23 bp, Artificial Sequence
  Description of Artificial Sequence: Synthetic oligonucleotide
gcgggcatggcggctcagatcac

SEQ ID NO: 19595 - DNA, 23 bp, Artificial Sequence
  Description of Artificial Sequence: Synthetic oligonucleotide
cgggcatggcggctcagatcacc

SEQ ID NO: 19596 - DNA, 24 bp, Artificial Sequence
  Description of Artificial Sequence: Synthetic oligonucleotide
gggcatggcggctcagatcaccca

SEQ ID NO: 19597 - DNA, 24 bp, Artificial Sequence
  Description of Artificial Sequence: Synthetic oligonucleotide
ggcatggcggctcagatcacccag

SEQ ID NO: 19598 - DNA, 24 bp, Artificial Sequence
  Description of Artificial Sequence: Synthetic oligonucleotide
gcatggcggctcagatcacccagc

SEQ ID NO: 19599 - DNA, 28 bp, Artificial Sequence
  Description of Artificial Sequence: Synthetic oligonucleotide
gggatggaaccttccagaagtgggcatc

SEQ ID NO: 19600 - DNA, 29 bp, Artificial Sequence
  Description of Artificial Sequence: Synthetic oligonucleotide
ggatggaaccttccagaagtgggcatctg

SEQ ID NO: 19601 - DNA, 30 bp, Artificial Sequence
  Description of Artificial Sequence: Synthetic oligonucleotide
gatggaaccttccagaagtgggcatctgtg

SEQ ID NO: 19602 - DNA, 30 bp, Artificial Sequence
  Description of Artificial Sequence: Synthetic oligonucleotide
atggaaccttccagaagtgggcatctgtgg

SEQ ID NO: 19603 - DNA, 29 bp, Artificial Sequence
  Description of Artificial Sequence: Synthetic oligonucleotide
tggaaccttccagaagtgggcatctgtgg

SEQ ID NO: 19604 - DNA, 28 bp, Artificial Sequence
  Description of Artificial Sequence: Synthetic oligonucleotide
ggaaccttccagaagtgggcatctgtgg

SEQ ID NO: 19605 - DNA, 29 bp, Artificial Sequence
  Description of Artificial Sequence: Synthetic oligonucleotide
gaaccttccagaagtgggcatctgtggtg

SEQ ID NO: 19606 - DNA, 29 bp, Artificial Sequence
  Description of Artificial Sequence: Synthetic oligonucleotide
aaccttccagaagtgggcatctgtggtgg

SEQ ID NO: 19607 - DNA, 28 bp, Artificial Sequence
  Description of Artificial Sequence: Synthetic oligonucleotide
accttccagaagtgggcatctgtggtgg

SEQ ID NO: 19608 - DNA, 27 bp, Artificial Sequence
  Description of Artificial Sequence: Synthetic oligonucleotide
ccttccagaagtgggcatctgtggtgg

SEQ ID NO: 19609 - DNA, 28 bp, Artificial Sequence
  Description of Artificial Sequence: Synthetic oligonucleotide
cttccagaagtgggcatctgtggtggtg

SEQ ID NO: 19610 - DNA, 28 bp, Artificial Sequence
  Description of Artificial Sequence: Synthetic oligonucleotide
ttccagaagtgggcatctgtggtggtgc

SEQ ID NO: 19611 - DNA, 27 bp, Artificial Sequence
  Description of Artificial Sequence: Synthetic oligonucleotide
tccagaagtgggcatctgtggtggtgc

SEQ ID NO: 19612 - DNA, 26 bp, Artificial Sequence
  Description of Artificial Sequence: Synthetic oligonucleotide
ccagaagtgggcatctgtggtggtgc

SEQ ID NO: 19613 - DNA, 27 bp, Artificial Sequence
  Description of Artificial Sequence: Synthetic oligonucleotide
cagaagtgggcatctgtggtggtgcct

SEQ ID NO: 19614 - DNA, 28 bp, Artificial Sequence
  Description of Artificial Sequence: Synthetic oligonucleotide
agaagtgggcatctgtggtggtgccttc

SEQ ID NO: 19615 - DNA, 27 bp, Artificial Sequence
  Description of Artificial Sequence: Synthetic oligonucleotide
gaagtgggcatctgtggtggtgccttc

SEQ ID NO: 19616 - DNA, 28 bp, Artificial Sequence
  Description of Artificial Sequence: Synthetic oligonucleotide
aagtgggcatctgtggtggtgccttctg

SEQ ID NO: 19617 - DNA, 27 bp, Artificial Sequence
  Description of Artificial Sequence: Synthetic oligonucleotide
agtgggcatctgtggtggtgccttctg

SEQ ID NO: 19618 - DNA, 26 bp, Artificial Sequence
  Description of Artificial Sequence: Synthetic oligonucleotide
gtgggcatctgtggtggtgccttctg

SEQ ID NO: 19619 - DNA, 27 bp, Artificial Sequence
  Description of Artificial Sequence: Synthetic oligonucleotide
tgggcatctgtggtggtgccttctgga

SEQ ID NO: 19620 - DNA, 26 bp, Artificial Sequence
  Description of Artificial Sequence: Synthetic oligonucleotide
gggcatctgtggtggtgccttctgga

SEQ ID NO: 19621 - DNA, 27 bp, Artificial Sequence
  Description of Artificial Sequence: Synthetic oligonucleotide
ggcatctgtggtggtgccttctggaca

SEQ ID NO: 19622 - DNA, 27 bp, Artificial Sequence
  Description of Artificial Sequence: Synthetic oligonucleotide
gcatctgtggtggtgccttctggacag

SEQ ID NO: 19623 - DNA, 27 bp, Artificial Sequence
  Description of Artificial Sequence: Synthetic oligonucleotide
catctgtggtggtgccttctggacagg

SEQ ID NO: 19624 - DNA, 28 bp, Artificial Sequence
  Description of Artificial Sequence: Synthetic oligonucleotide
atctgtggtggtgccttctggacaggag

SEQ ID NO: 19625 - DNA, 21 bp, Artificial Sequence
  Description of Artificial Sequence: Synthetic oligonucleotide
cgcaagtgggaggcggcccga

SEQ ID NO: 19626 - DNA, 22 bp, Artificial Sequence
  Description of Artificial Sequence: Synthetic oligonucleotide
gcaagtgggaggcggcccgagt

SEQ ID NO: 19627 - DNA, 22 bp, Artificial Sequence
  Description of Artificial Sequence: Synthetic oligonucleotide
caagtgggaggcggcccgagtg

SEQ ID NO: 19628 - DNA, 22 bp, Artificial Sequence
  Description of Artificial Sequence: Synthetic oligonucleotide
aagtgggaggcggcccgagtgg

SEQ ID NO: 19629 - DNA, 21 bp, Artificial Sequence
  Description of Artificial Sequence: Synthetic oligonucleotide
agtgggaggcggcccgagtgg

SEQ ID NO: 19630 - DNA, 20 bp, Artificial Sequence
  Description of Artificial Sequence: Synthetic oligonucleotide
gtgggaggcggcccgagtgg

SEQ ID NO: 19631 - DNA, 20 bp, Artificial Sequence
  Description of Artificial Sequence: Synthetic oligonucleotide
tgggaggcggcccgagtggc

SEQ ID NO: 19632 - DNA, 20 bp, Artificial Sequence
  Description of Artificial Sequence: Synthetic oligonucleotide
gggaggcggcccgagtggct

SEQ ID NO: 19633 - DNA, 20 bp, Artificial Sequence
  Description of Artificial Sequence: Synthetic oligonucleotide
ggaggcggcccgagtggcgt

SEQ ID NO: 19634 - DNA, 20 bp, Artificial Sequence
  Description of Artificial Sequence: Synthetic oligonucleotide
gaggcggcccgagtggcgga

SEQ ID NO: 19635 - DNA, 20 bp, Artificial Sequence
  Description of Artificial Sequence: Synthetic oligonucleotide
aggcggcccgagtggcggag

SEQ ID NO: 19636 - DNA, 20 bp, Artificial Sequence
  Description of Artificial Sequence: Synthetic oligonucleotide
ggcggcccgagtggcggagt

SEQ ID NO: 19637 - DNA, 20 bp, Artificial Sequence
  Description of Artificial Sequence: Synthetic oligonucleotide
gcggcccgagtggcggagca

SEQ ID NO: 19638 - DNA, 22 bp, Artificial Sequence
  Description of Artificial Sequence: Synthetic oligonucleotide
cggcccgagtggcggagcagtt

SEQ ID NO: 19639 - DNA, 23 bp, Artificial Sequence
  Description of Artificial Sequence: Synthetic oligonucleotide
ggcccgagtggcggagcagttga

SEQ ID NO: 19640 - DNA, 24 bp, Artificial Sequence
  Description of Artificial Sequence: Synthetic oligonucleotide
gcccgagtggcggagcagttgaga

SEQ ID NO: 19641 - DNA, 24 bp, Artificial Sequence
  Description of Artificial Sequence: Synthetic oligonucleotide
cccgagtggcggagcagttgagag

SEQ ID NO: 19642 - DNA, 24 bp, Artificial Sequence
  Description of Artificial Sequence: Synthetic oligonucleotide
ccgagtggcggagcagttgagagc

SEQ ID NO: 19643 - DNA, 26 bp, Artificial Sequence
  Description of Artificial Sequence: Synthetic oligonucleotide
cgagtggcggagcagttgagagccta

SEQ ID NO: 19644 - DNA, 26 bp, Artificial Sequence
  Description of Artificial Sequence: Synthetic oligonucleotide
gagtggcggagcagttgagagcctac

SEQ ID NO: 19645 - DNA, 27 bp, Artificial Sequence
  Description of Artificial Sequence: Synthetic oligonucleotide
agtggcggagcagttgagagcctacct

SEQ ID NO: 19646 - DNA, 30 bp, Artificial Sequence
  Description of Artificial Sequence: Synthetic oligonucleotide
aggacgcctacgacggcaaggattacatag

SEQ ID NO: 19647 - DNA, 29 bp, Artificial Sequence
  Description of Artificial Sequence: Synthetic oligonucleotide
ggacgcctacgacggcaaggattacatag

SEQ ID NO: 19648 - DNA, 29 bp, Artificial Sequence
  Description of Artificial Sequence: Synthetic oligonucleotide
gacgcctacgacggcaaggattacatagc

SEQ ID NO: 19649 - DNA, 30 bp, Artificial Sequence
  Description of Artificial Sequence: Synthetic oligonucleotide
gcctacgacggcaaggattacatagccttg

SEQ ID NO: 19650 - DNA, 32 bp, Artificial Sequence
  Description of Artificial Sequence: Synthetic oligonucleotide
cctacgacggcaaggattacatagccttgaac

SEQ ID NO: 19651 - DNA, 32 bp, Artificial Sequence
  Description of Artificial Sequence: Synthetic oligonucleotide
ctacgacggcaaggattacatagccttgaacg

SEQ ID NO: 19652 - DNA, 33 bp, Artificial Sequence
  Description of Artificial Sequence: Synthetic oligonucleotide
tacgacggcaaggattacatagccttgaacgag

SEQ ID NO: 19653 - DNA, 32 bp, Artificial Sequence
  Description of Artificial Sequence: Synthetic oligonucleotide
acgacggcaaggattacatagccttgaacgag

SEQ ID NO: 19654 - DNA, 31 bp, Artificial Sequence
  Description of Artificial Sequence: Synthetic oligonucleotide
cgacggcaaggattacatagccttgaacgag

SEQ ID NO: 19655 - DNA, 31 bp, Artificial Sequence
  Description of Artificial Sequence: Synthetic oligonucleotide
gacggcaaggattacatagccttgaacgagg

SEQ ID NO: 19656 - DNA, 32 bp, Artificial Sequence
  Description of Artificial Sequence: Synthetic oligonucleotide
acggcaaggattacatagccttgaacgaggac

SEQ ID NO: 19657 - DNA, 31 bp, Artificial Sequence
  Description of Artificial Sequence: Synthetic oligonucleotide
cggcaaggattacatagccttgaacgaggac

SEQ ID NO: 19658 - DNA, 31 bp, Artificial Sequence
  Description of Artificial Sequence: Synthetic oligonucleotide
ggcaaggattacatagccttgaacgaggacc

SEQ ID NO: 19659 - DNA, 32 bp, Artificial Sequence
  Description of Artificial Sequence: Synthetic oligonucleotide
gcaaggattacatagccttgaacgaggacctg

SEQ ID NO: 19660 - DNA, 32 bp, Artificial Sequence
  Description of Artificial Sequence: Synthetic oligonucleotide
caaggattacatagccttgaacgaggacctgc

SEQ ID NO: 19661 - DNA, 32 bp, Artificial Sequence
  Description of Artificial Sequence: Synthetic oligonucleotide
aaggattacatagccttgaacgaggacctgcg

SEQ ID NO: 19662 - DNA, 31 bp, Artificial Sequence
  Description of Artificial Sequence: Synthetic oligonucleotide
aggattacatagccttgaacgaggacctgcg

SEQ ID NO: 19663 - DNA, 30 bp, Artificial Sequence
  Description of Artificial Sequence: Synthetic oligonucleotide
ggattacatagccttgaacgaggacctgcg

SEQ ID NO: 19664 - DNA, 30 bp, Artificial Sequence
  Description of Artificial Sequence: Synthetic oligonucleotide
gattacatagccttgaacgaggacctgcgc

SEQ ID NO: 19665 - DNA, 31 bp, Artificial Sequence
  Description of Artificial Sequence: Synthetic oligonucleotide
attacatagccttgaacgaggacctgcgctc

SEQ ID NO: 19666 - DNA, 30 bp, Artificial Sequence
  Description of Artificial Sequence: Synthetic oligonucleotide
ttacatagccttgaacgaggacctgcgctc

SEQ ID NO: 19667 - DNA, 29 bp, Artificial Sequence
  Description of Artificial Sequence: Synthetic oligonucleotide
tacatagccttgaacgaggacctgcgctc

SEQ ID NO: 19668 - DNA, 28 bp, Artificial Sequence
  Description of Artificial Sequence: Synthetic oligonucleotide
acatagccttgaacgaggacctgcgctc

SEQ ID NO: 19669 - DNA, 27 bp, Artificial Sequence
  Description of Artificial Sequence: Synthetic oligonucleotide
catagccttgaacgaggacctgcgctc

SEQ ID NO: 19670 - DNA, 29 bp, Artificial Sequence
  Description of Artificial Sequence: Synthetic oligonucleotide
atagccttgaacgaggacctgcgctcttg

SEQ ID NO: 19671 - DNA, 28 bp, Artificial Sequence
  Description of Artificial Sequence: Synthetic oligonucleotide
tagccttgaacgaggacctgcgctcttg

SEQ ID NO: 19672 - DNA, 27 bp, Artificial Sequence
  Description of Artificial Sequence: Synthetic oligonucleotide
agccttgaacgaggacctgcgctcttg

SEQ ID NO: 19673 - DNA, 26 bp, Artificial Sequence
  Description of Artificial Sequence: Synthetic oligonucleotide
caggaggggccagagtattgggacca

SEQ ID NO: 19674 - DNA, 26 bp, Artificial Sequence
  Description of Artificial Sequence: Synthetic oligonucleotide
aggaggggccagagtattgggaccag

SEQ ID NO: 19675 - DNA, 25 bp, Artificial Sequence
  Description of Artificial Sequence: Synthetic oligonucleotide
ggaggggccagagtattgggaccag

SEQ ID NO: 19676 - DNA, 26 bp, Artificial Sequence
  Description of Artificial Sequence: Synthetic oligonucleotide
gaggggccagagtattgggaccagga

SEQ ID NO: 19677 - DNA, 27 bp, Artificial Sequence
  Description of Artificial Sequence: Synthetic oligonucleotide
aggggccagagtattgggaccaggaga

SEQ ID NO: 19678 - DNA, 26 bp, Artificial Sequence
  Description of Artificial Sequence: Synthetic oligonucleotide
ggggccagagtattgggaccaggaga

SEQ ID NO: 19679 - DNA, 27 bp, Artificial Sequence
  Description of Artificial Sequence: Synthetic oligonucleotide
gggccagagtattgggaccaggagaca

SEQ ID NO: 19680 - DNA, 27 bp, Artificial Sequence
  Description of Artificial Sequence: Synthetic oligonucleotide
gttgagagcctacctggagggcgagtt

SEQ ID NO: 19681 - DNA, 27 bp, Artificial Sequence
  Description of Artificial Sequence: Synthetic oligonucleotide
ttgagagcctacctggagggcgagttc

SEQ ID NO: 19682 - DNA, 26 bp, Artificial Sequence
  Description of Artificial Sequence: Synthetic oligonucleotide
tgagagcctacctggagggcgagttc

SEQ ID NO: 19683 - DNA, 25 bp, Artificial Sequence
  Description of Artificial Sequence: Synthetic oligonucleotide
gagagcctacctggagggcgagttc

SEQ ID NO: 19684 - DNA, 26 bp, Artificial Sequence
  Description of Artificial Sequence: Synthetic oligonucleotide
agagcctacctggagggcgagttcgt

SEQ ID NO: 19685 - DNA, 25 bp, Artificial Sequence
  Description of Artificial Sequence: Synthetic oligonucleotide
gagcctacctggagggcgagttcgt

SEQ ID NO: 19686 - DNA, 25 bp, Artificial Sequence
  Description of Artificial Sequence: Synthetic oligonucleotide
agcctacctggagggcgagttcgtg

SEQ ID NO: 19687 - DNA, 24 bp, Artificial Sequence
  Description of Artificial Sequence: Synthetic oligonucleotide
gcctacctggagggcgagttcgtg

SEQ ID NO: 19688 - DNA, 25 bp, Artificial Sequence
  Description of Artificial Sequence: Synthetic oligonucleotide
cctacctggagggcgagttcgtgga

SEQ ID NO: 19689 - DNA, 20 bp, Artificial Sequence
  Description of Artificial Sequence: Synthetic oligonucleotide
tgtcccggcccggccgcctt

SEQ ID NO: 19690 - DNA, 20 bp, Artificial Sequence
  Description of Artificial Sequence: Synthetic oligonucleotide
gtcccggcccggccgccttt

SEQ ID NO: 19691 - DNA, 20 bp, Artificial Sequence
  Description of Artificial Sequence: Synthetic oligonucleotide
tcccggcccggccgccgttt

SEQ ID NO: 19692 - DNA, 20 bp, Artificial Sequence
  Description of Artificial Sequence: Synthetic oligonucleotide
cccggcccggccgccgtttt

SEQ ID NO: 19693 - DNA, 20 bp, Artificial Sequence
  Description of Artificial Sequence: Synthetic oligonucleotide
ccggcccggccgccggtttt

SEQ ID NO: 19694 - DNA, 20 bp, Artificial Sequence
  Description of Artificial Sequence: Synthetic oligonucleotide
cggcccggccgccgggattt

SEQ ID NO: 19695 - DNA, 20 bp, Artificial Sequence
  Description of Artificial Sequence: Synthetic oligonucleotide
ggcccggccgccgggagttt

SEQ ID NO: 19696 - DNA, 20 bp, Artificial Sequence
  Description of Artificial Sequence: Synthetic oligonucleotide
gcccggccgccgggagcttt

SEQ ID NO: 19697 - DNA, 20 bp, Artificial Sequence
  Description of Artificial Sequence: Synthetic oligonucleotide
cccggccgccgggagccttt

SEQ ID NO: 19698 - DNA, 20 bp, Artificial Sequence
  Description of Artificial Sequence: Synthetic oligonucleotide
ccggccgccgggagcccttt

SEQ ID NO: 19699 - DNA, 20 bp, Artificial Sequence
  Description of Artificial Sequence: Synthetic oligonucleotide
cggccgccgggagccccttt

SEQ ID NO: 19700 - DNA, 20 bp, Artificial Sequence
  Description of Artificial Sequence: Synthetic oligonucleotide
ggccgccgggagccccgttt

SEQ ID NO: 19701 - DNA, 20 bp, Artificial Sequence
  Description of Artificial Sequence: Synthetic oligonucleotide
gccgccgggagccccgcttt

SEQ ID NO: 19702 - DNA, 21 bp, Artificial Sequence
  Description of Artificial Sequence: Synthetic oligonucleotide
ccgccgggagccccgcttcat

SEQ ID NO: 19703 - DNA, 21 bp, Artificial Sequence
  Description of Artificial Sequence: Synthetic oligonucleotide
cgccgggagccccgcttcatc

SEQ ID NO: 19704 - DNA, 21 bp, Artificial Sequence
  Description of Artificial Sequence: Synthetic oligonucleotide
gccgggagccccgcttcatcg

SEQ ID NO: 19705 - DNA, 21 bp, Artificial Sequence
  Description of Artificial Sequence: Synthetic oligonucleotide
ccgggagccccgcttcatcgc

SEQ ID NO: 19706 - DNA, 21 bp, Artificial Sequence
  Description of Artificial Sequence: Synthetic oligonucleotide
cgggagccccgcttcatcgcc

SEQ ID NO: 19707 - DNA, 27 bp, Artificial Sequence
  Description of Artificial Sequence: Synthetic oligonucleotide
ccgcagatacctggagaacgggaaggt

SEQ ID NO: 19708 - DNA, 27 bp, Artificial Sequence
  Description of Artificial Sequence: Synthetic oligonucleotide
cgcagatacctggagaacgggaaggtg

SEQ ID NO: 19709 - DNA, 28 bp, Artificial Sequence
  Description of Artificial Sequence: Synthetic oligonucleotide
gcagatacctggagaacgggaaggtgac

SEQ ID NO: 19710 - DNA, 28 bp, Artificial Sequence
  Description of Artificial Sequence: Synthetic oligonucleotide
cagatacctggagaacgggaaggtgacg

SEQ ID NO: 19711 - DNA, 28 bp, Artificial Sequence
  Description of Artificial Sequence: Synthetic oligonucleotide
agatacctggagaacgggaaggtgacgc

SEQ ID NO: 19712 - DNA, 27 bp, Artificial Sequence
  Description of Artificial Sequence: Synthetic oligonucleotide
gatacctggagaacgggaaggtgacgc

SEQ ID NO: 19713 - DNA, 28 bp, Artificial Sequence
  Description of Artificial Sequence: Synthetic oligonucleotide
atacctggagaacgggaaggtgacgctg

SEQ ID NO: 19714 - DNA, 27 bp, Artificial Sequence
  Description of Artificial Sequence: Synthetic oligonucleotide
tacctggagaacgggaaggtgacgctg

SEQ ID NO: 19715 - DNA, 26 bp, Artificial Sequence
  Description of Artificial Sequence: Synthetic oligonucleotide
acctggagaacgggaaggtgacgctg

SEQ ID NO: 19716 - DNA, 25 bp, Artificial Sequence
  Description of Artificial Sequence: Synthetic oligonucleotide
cctggagaacgggaaggtgacgctg

SEQ ID NO: 19717 - DNA, 26 bp, Artificial Sequence
  Description of Artificial Sequence: Synthetic oligonucleotide
ctggagaacgggaaggtgacgctgca

SEQ ID NO: 19718 - DNA, 26 bp, Artificial Sequence
  Description of Artificial Sequence: Synthetic oligonucleotide
tggagaacgggaaggtgacgctgcag

SEQ ID NO: 19719 - DNA, 25 bp, Artificial Sequence
  Description of Artificial Sequence: Synthetic oligonucleotide
ggagaacgggaaggtgacgctgcag

SEQ ID NO: 19720 - DNA, 25 bp, Artificial Sequence
  Description of Artificial Sequence: Synthetic oligonucleotide
gagaacgggaaggtgacgctgcagc

SEQ ID NO: 19721 - DNA, 25 bp, Artificial Sequence
  Description of Artificial Sequence: Synthetic oligonucleotide
agaacgggaaggtgacgctgcagcg

SEQ ID NO: 19722 - DNA, 24 bp, Artificial Sequence
  Description of Artificial Sequence: Synthetic oligonucleotide
gaacgggaaggtgacgctgcagcg

SEQ ID NO: 19723 - DNA, 25 bp, Artificial Sequence
  Description of Artificial Sequence: Synthetic oligonucleotide
aacgggaaggtgacgctgcagcgca

SEQ ID NO: 19724 - DNA, 24 bp, Artificial Sequence
  Description of Artificial Sequence: Synthetic oligonucleotide
acgggaaggtgacgctgcagcgca

SEQ ID NO: 19725 - DNA, 23 bp, Artificial Sequence
  Description of Artificial Sequence: Synthetic oligonucleotide
cgggaaggtgacgctgcagcgca

SEQ ID NO: 19726 - DNA, 23 bp, Artificial Sequence
  Description of Artificial Sequence: Synthetic oligonucleotide
gggaaggtgacgctgcagcgcac

SEQ ID NO: 19727 - DNA, 23 bp, Artificial Sequence
  Description of Artificial Sequence: Synthetic oligonucleotide
ggaaggtgacgctgcagcgcacg

SEQ ID NO: 19728 - DNA, 23 bp, Artificial Sequence
  Description of Artificial Sequence: Synthetic oligonucleotide
gaaggtgacgctgcagcgcacgg

SEQ ID NO: 19729 - DNA, 20 bp, Artificial Sequence
  Description of Artificial Sequence: Synthetic oligonucleotide
ccgcggggagccccgcttct

SEQ ID NO: 19730 - DNA, 20 bp, Artificial Sequence
  Description of Artificial Sequence: Synthetic oligonucleotide
cgcggggagccccgcttcgt

SEQ ID NO: 19731 - DNA, 20 bp, Artificial Sequence
  Description of Artificial Sequence: Synthetic oligonucleotide
gcggggagccccgcttcgtc

SEQ ID NO: 19732 - DNA, 20 bp, Artificial Sequence
  Description of Artificial Sequence: Synthetic oligonucleotide
cggggagccccgcttcgtcg

SEQ ID NO: 19733 - DNA, 20 bp, Artificial Sequence
  Description of Artificial Sequence: Synthetic oligonucleotide
ggggagccccgcttcgtcgc

SEQ ID NO: 19734 - DNA, 20 bp, Artificial Sequence
  Description of Artificial Sequence: Synthetic oligonucleotide
gggagccccgcttcgtcgcc

SEQ ID NO: 19735 - DNA, 21 bp, Artificial Sequence
  Description of Artificial Sequence: Synthetic oligonucleotide
ggagccccgcttcgtcgccgt

SEQ ID NO: 19736 - DNA, 21 bp, Artificial Sequence
  Description of Artificial Sequence: Synthetic oligonucleotide
gagccccgcttcgtcgccgtg

SEQ ID NO: 19737 - DNA, 21 bp, Artificial Sequence
  Description of Artificial Sequence: Synthetic oligonucleotide
agccccgcttcgtcgccgtgg

SEQ ID NO: 19738 - DNA, 20 bp, Artificial Sequence
  Description of Artificial Sequence: Synthetic oligonucleotide
gccccgcttcgtcgccgtgg

SEQ ID NO: 19739 - DNA, 20 bp, Artificial Sequence
  Description of Artificial Sequence: Synthetic oligonucleotide
ccccgcttcgtcgccgtggg

SEQ ID NO: 19740 - DNA, 22 bp, Artificial Sequence
  Description of Artificial Sequence: Synthetic oligonucleotide
cccgcttcgtcgccgtgggcta

SEQ ID NO: 19741 - DNA, 22 bp, Artificial Sequence
  Description of Artificial Sequence: Synthetic oligonucleotide
ccgcttcgtcgccgtgggctac

SEQ ID NO: 19742 - DNA, 23 bp, Artificial Sequence
  Description of Artificial Sequence: Synthetic oligonucleotide
cgcttcgtcgccgtgggctacgt

SEQ ID NO: 19743 - DNA, 23 bp, Artificial Sequence
  Description of Artificial Sequence: Synthetic oligonucleotide
gcttcgtcgccgtgggctacgtg

SEQ ID NO: 19744 - DNA, 24 bp, Artificial Sequence
  Description of Artificial Sequence: Synthetic oligonucleotide
cttcgtcgccgtgggctacgtgga

SEQ ID NO: 19745 - DNA, 24 bp, Artificial Sequence
  Description of Artificial Sequence: Synthetic oligonucleotide
ttcgtcgccgtgggctacgtggac

SEQ ID NO: 19746 - DNA, 23 bp, Artificial Sequence
  Description of Artificial Sequence: Synthetic oligonucleotide
tcgtcgccgtgggctacgtggac

SEQ ID NO: 19747 - DNA, 22 bp, Artificial Sequence
  Description of Artificial Sequence: Synthetic oligonucleotide
cgtcgccgtgggctacgtggac

SEQ ID NO: 19748 - DNA, 23 bp, Artificial Sequence
  Description of Artificial Sequence: Synthetic oligonucleotide
gtcgccgtgggctacgtggacga

SEQ ID NO: 19749 - DNA, 24 bp, Artificial Sequence
  Description of Artificial Sequence: Synthetic oligonucleotide
ctggagggcacgtgcgtggagtga

SEQ ID NO: 19750 - DNA, 25 bp, Artificial Sequence
  Description of Artificial Sequence: Synthetic oligonucleotide
tggagggcacgtgcgtggagtgact

SEQ ID NO: 19751 - DNA, 24 bp, Artificial Sequence
  Description of Artificial Sequence: Synthetic oligonucleotide
ggagggcacgtgcgtggagtgact

SEQ ID NO: 19752 - DNA, 24 bp, Artificial Sequence
  Description of Artificial Sequence: Synthetic oligonucleotide
gagggcacgtgcgtggagtgactc

SEQ ID NO: 19753 - DNA, 24 bp, Artificial Sequence
  Description of Artificial Sequence: Synthetic oligonucleotide
agggcacgtgcgtggagtgactcc

SEQ ID NO: 19754 - DNA, 23 bp, Artificial Sequence
  Description of Artificial Sequence: Synthetic oligonucleotide
gggcacgtgcgtggagtgactcc

SEQ ID NO: 19755 - DNA, 23 bp, Artificial Sequence
  Description of Artificial Sequence: Synthetic oligonucleotide
ggcacgtgcgtggagtgactccg

SEQ ID NO: 19756 - DNA, 24 bp, Artificial Sequence
  Description of Artificial Sequence: Synthetic oligonucleotide
gcacgtgcgtggagtgactccgca

SEQ ID NO: 19757 - DNA, 27 bp, Artificial Sequence
  Description of Artificial Sequence: Synthetic oligonucleotide
cacgtgcgtggagtgactccgcagata

SEQ ID NO: 19758 - DNA, 27 bp, Artificial Sequence
  Description of Artificial Sequence: Synthetic oligonucleotide
acgtgcgtggagtgactccgcagatac

SEQ ID NO: 19759 - DNA, 26 bp, Artificial Sequence
  Description of Artificial Sequence: Synthetic oligonucleotide
cgtgcgtggagtgactccgcagatac

SEQ ID NO: 19760 - DNA, 27 bp, Artificial Sequence
  Description of Artificial Sequence: Synthetic oligonucleotide
gtgcgtggagtgactccgcagatacct

SEQ ID NO: 19761 - DNA, 27 bp, Artificial Sequence
  Description of Artificial Sequence: Synthetic oligonucleotide
tgcgtggagtgactccgcagatacctg

SEQ ID NO: 19762 - DNA, 26 bp, Artificial Sequence
  Description of Artificial Sequence: Synthetic oligonucleotide
gcgtggagtgactccgcagatacctg

SEQ ID NO: 19763 - DNA, 27 bp, Artificial Sequence
  Description of Artificial Sequence: Synthetic oligonucleotide
cgtggagtgactccgcagatacctgga

SEQ ID NO: 19764 - DNA, 27 bp, Artificial Sequence
  Description of Artificial Sequence: Synthetic oligonucleotide
gtggagtgactccgcagatacctggag

SEQ ID NO: 19765 - DNA, 29 bp, Artificial Sequence
  Description of Artificial Sequence: Synthetic oligonucleotide
tggagtgactccgcagatacctggagaac

SEQ ID NO: 19766 - DNA, 28 bp, Artificial Sequence
  Description of Artificial Sequence: Synthetic oligonucleotide
ggagtgactccgcagatacctggagaac

SEQ ID NO: 19767 - DNA, 28 bp, Artificial Sequence
  Description of Artificial Sequence: Synthetic oligonucleotide
gagtgactccgcagatacctggagaacg

SEQ ID NO: 19768 - DNA, 28 bp, Artificial Sequence
  Description of Artificial Sequence: Synthetic oligonucleotide
agtgactccgcagatacctggagaacgg

SEQ ID NO: 19769 - DNA, 27 bp, Artificial Sequence
  Description of Artificial Sequence: Synthetic oligonucleotide
gtgactccgcagatacctggagaacgg

SEQ ID NO: 19770 - DNA, 27 bp, Artificial Sequence
  Description of Artificial Sequence: Synthetic oligonucleotide
tgactccgcagatacctggagaacggg

SEQ ID NO: 19771 - DNA, 27 bp, Artificial Sequence
  Description of Artificial Sequence: Synthetic oligonucleotide
gactccgcagatacctggagaacggga

SEQ ID NO: 19772 - DNA, 28 bp, Artificial Sequence
  Description of Artificial Sequence: Synthetic oligonucleotide
actccgcagatacctggagaacgggaag

SEQ ID NO: 19773 - DNA, 33 bp, Artificial Sequence
  Description of Artificial Sequence: Synthetic oligonucleotide
gctcccactccatgaggtatttcttcatatccg

SEQ ID NO: 19774 - DNA, 34 bp, Artificial Sequence
  Description of Artificial Sequence: Synthetic oligonucleotide
ctcccactccatgaggtatttcttcatatccgtg

SEQ ID NO: 19775 - DNA, 35 bp, Artificial Sequence
  Description of Artificial Sequence: Synthetic oligonucleotide
tcccactccatgaggtatttcttcatatccgtgtc

SEQ ID NO: 19776 - DNA, 34 bp, Artificial Sequence
  Description of Artificial Sequence: Synthetic oligonucleotide
cccactccatgaggtatttcttcatatccgtgtc

SEQ ID NO: 19777 - DNA, 34 bp, Artificial Sequence
  Description of Artificial Sequence: Synthetic oligonucleotide
ccactccatgaggtatttcttcatatccgtgtcc

SEQ ID NO: 19778 - DNA, 34 bp, Artificial Sequence
  Description of Artificial Sequence: Synthetic oligonucleotide
cactccatgaggtatttcttcatatccgtgtccc

SEQ ID NO: 19779 - DNA, 34 bp, Artificial Sequence
  Description of Artificial Sequence: Synthetic oligonucleotide
actccatgaggtatttcttcatatccgtgtcccg

SEQ ID NO: 19780 - DNA, 33 bp, Artificial Sequence
  Description of Artificial Sequence: Synthetic oligonucleotide
ctccatgaggtatttcttcatatccgtgtcccg

SEQ ID NO: 19781 - DNA, 33 bp, Artificial Sequence
  Description of Artificial Sequence: Synthetic oligonucleotide
tccatgaggtatttcttcatatccgtgtcccgg

SEQ ID NO: 19782 - DNA, 32 bp, Artificial Sequence
  Description of Artificial Sequence: Synthetic oligonucleotide
ccatgaggtatttcttcatatccgtgtcccgg

SEQ ID NO: 19783 - DNA, 32 bp, Artificial Sequence
  Description of Artificial Sequence: Synthetic oligonucleotide
catgaggtatttcttcatatccgtgtcccggc

SEQ ID NO: 19784 - DNA, 32 bp, Artificial Sequence
  Description of Artificial Sequence: Synthetic oligonucleotide
atgaggtatttcttcatatccgtgtcccggcc

SEQ ID NO: 19785 - DNA, 31 bp, Artificial Sequence
  Description of Artificial Sequence: Synthetic oligonucleotide
tgaggtatttcttcatatccgtgtcccggcc

SEQ ID NO: 19786 - DNA, 30 bp, Artificial Sequence
  Description of Artificial Sequence: Synthetic oligonucleotide
gaggtatttcttcatatccgtgtcccggcc

SEQ ID NO: 19787 - DNA, 30 bp, Artificial Sequence
  Description of Artificial Sequence: Synthetic oligonucleotide
aggtatttcttcatatccgtgtcccggccc

SEQ ID NO: 19788 - DNA, 29 bp, Artificial Sequence
  Description of Artificial Sequence: Synthetic oligonucleotide
ggtatttcttcatatccgtgtcccggccc

SEQ ID NO: 19789 - DNA, 29 bp, Artificial Sequence
  Description of Artificial Sequence: Synthetic oligonucleotide
gtatttcttcatatccgtgtcccggcccg

SEQ ID NO: 19790 - DNA, 29 bp, Artificial Sequence
  Description of Artificial Sequence: Synthetic oligonucleotide
tatttcttcatatccgtgtcccggcccgg

SEQ ID NO: 19791 - DNA, 28 bp, Artificial Sequence
  Description of Artificial Sequence: Synthetic oligonucleotide
atttcttcatatccgtgtcccggcccgg

SEQ ID NO: 19792 - DNA, 27 bp, Artificial Sequence
  Description of Artificial Sequence: Synthetic oligonucleotide
tttcttcatatccgtgtcccggcccgg

SEQ ID NO: 19793 - DNA, 26 bp, Artificial Sequence
  Description of Artificial Sequence: Synthetic oligonucleotide
ttcttcatatccgtgtcccggcccgg

SEQ ID NO: 19794 - DNA, 25 bp, Artificial Sequence
  Description of Artificial Sequence: Synthetic oligonucleotide
tcttcatatccgtgtcccggcccgg

SEQ ID NO: 19795 - DNA, 24 bp, Artificial Sequence
  Description of Artificial Sequence: Synthetic oligonucleotide
cttcatatccgtgtcccggcccgg

SEQ ID NO: 19796 - DNA, 24 bp, Artificial Sequence
  Description of Artificial Sequence: Synthetic oligonucleotide
ttcatatccgtgtcccggcccggc

SEQ ID NO: 19797 - DNA, 23 bp, Artificial Sequence
  Description of Artificial Sequence: Synthetic oligonucleotide
tcatatccgtgtcccggcccggc

SEQ ID NO: 19798 - DNA, 22 bp, Artificial Sequence
  Description of Artificial Sequence: Synthetic oligonucleotide
catatccgtgtcccggcccggc

SEQ ID NO: 19799 - DNA, 22 bp, Artificial Sequence
  Description of Artificial Sequence: Synthetic oligonucleotide
atatccgtgtcccggcccggcc

SEQ ID NO: 19800 - DNA, 21 bp, Artificial Sequence
  Description of Artificial Sequence: Synthetic oligonucleotide
tatccgtgtcccggcccggcc

SEQ ID NO: 19801 - DNA, 21 bp, Artificial Sequence
  Description of Artificial Sequence: Synthetic oligonucleotide
ttggaccgcggcggccatggc

SEQ ID NO: 19802 - DNA, 20 bp, Artificial Sequence
  Description of Artificial Sequence: Synthetic oligonucleotide
tggaccgcggcggccatggc

SEQ ID NO: 19803 - DNA, 20 bp, Artificial Sequence
  Description of Artificial Sequence: Synthetic oligonucleotide
ggaccgcggcggccatggct

SEQ ID NO: 19804 - DNA, 20 bp, Artificial Sequence
  Description of Artificial Sequence: Synthetic oligonucleotide
gaccgcggcggccatggcgt

SEQ ID NO: 19805 - DNA, 20 bp, Artificial Sequence
  Description of Artificial Sequence: Synthetic oligonucleotide
accgcggcggccatggcggt

SEQ ID NO: 19806 - DNA, 20 bp, Artificial Sequence
  Description of Artificial Sequence: Synthetic oligonucleotide
ccgcggcggccatggcggtt

SEQ ID NO: 19807 - DNA, 20 bp, Artificial Sequence
  Description of Artificial Sequence: Synthetic oligonucleotide
cgcggcggccatggcggctt

SEQ ID NO: 19808 - DNA, 20 bp, Artificial Sequence
  Description of Artificial Sequence: Synthetic oligonucleotide
gcggcggccatggcggctca

SEQ ID NO: 19809 - DNA, 22 bp, Artificial Sequence
  Description of Artificial Sequence: Synthetic oligonucleotide
cggcggccatggcggctcagat

SEQ ID NO: 19810 - DNA, 23 bp, Artificial Sequence
  Description of Artificial Sequence: Synthetic oligonucleotide
ggcggccatggcggctcagatca

SEQ ID NO: 19811 - DNA, 23 bp, Artificial Sequence
  Description of Artificial Sequence: Synthetic oligonucleotide
gcggccatggcggctcagatcac

SEQ ID NO: 19812 - DNA, 23 bp, Artificial Sequence
  Description of Artificial Sequence: Synthetic oligonucleotide
cggccatggcggctcagatcacc

SEQ ID NO: 19813 - DNA, 24 bp, Artificial Sequence
  Description of Artificial Sequence: Synthetic oligonucleotide
ggccatggcggctcagatcaccca

SEQ ID NO: 19814 - DNA, 24 bp, Artificial Sequence
  Description of Artificial Sequence: Synthetic oligonucleotide
gccatggcggctcagatcacccag

SEQ ID NO: 19815 - DNA, 24 bp, Artificial Sequence
  Description of Artificial Sequence: Synthetic oligonucleotide
ccatggcggctcagatcacccagc

SEQ ID NO: 19816 - DNA, 21 bp, Artificial Sequence
  Description of Artificial Sequence: Synthetic oligonucleotide
ggaggcggcccgtgtggcgaa

SEQ ID NO: 19817 - DNA, 21 bp, Artificial Sequence
  Description of Artificial Sequence: Synthetic oligonucleotide
gaggcggcccgtgtggcgaag

SEQ ID NO: 19818 - DNA, 22 bp, Artificial Sequence
  Description of Artificial Sequence: Synthetic oligonucleotide
aggcggcccgtgtggcgaagca

SEQ ID NO: 19819 - DNA, 21 bp, Artificial Sequence
  Description of Artificial Sequence: Synthetic oligonucleotide
ggcggcccgtgtggcgaagca

SEQ ID NO: 19820 - DNA, 23 bp, Artificial Sequence
  Description of Artificial Sequence: Synthetic oligonucleotide
gcggcccgtgtggcgaagcagtt

SEQ ID NO: 19821 - DNA, 24 bp, Artificial Sequence
  Description of Artificial Sequence: Synthetic oligonucleotide
cggcccgtgtggcgaagcagttga

SEQ ID NO: 19822 - DNA, 25 bp, Artificial Sequence
  Description of Artificial Sequence: Synthetic oligonucleotide
ggcccgtgtggcgaagcagttgaga

SEQ ID NO: 19823 - DNA, 25 bp, Artificial Sequence
  Description of Artificial Sequence: Synthetic oligonucleotide
gcccgtgtggcgaagcagttgagag

SEQ ID NO: 19824 - DNA, 25 bp, Artificial Sequence
  Description of Artificial Sequence: Synthetic oligonucleotide
cccgtgtggcgaagcagttgagagc

SEQ ID NO: 19825 - DNA, 27 bp, Artificial Sequence
  Description of Artificial Sequence: Synthetic oligonucleotide
ccgtgtggcgaagcagttgagagccta

SEQ ID NO: 19826 - DNA, 27 bp, Artificial Sequence
  Description of Artificial Sequence: Synthetic oligonucleotide
cgtgtggcgaagcagttgagagcctac

SEQ ID NO: 19827 - DNA, 27 bp, Artificial Sequence
  Description of Artificial Sequence: Synthetic oligonucleotide
gtgtggcgaagcagttgagagcctacc

SEQ ID NO: 19828 - DNA, 28 bp, Artificial Sequence
  Description of Artificial Sequence: Synthetic oligonucleotide
tgtggcgaagcagttgagagcctacctg

SEQ ID NO: 19829 - DNA, 27 bp, Artificial Sequence
  Description of Artificial Sequence: Synthetic oligonucleotide
gtggcgaagcagttgagagcctacctg

SEQ ID NO: 19830 - DNA, 27 bp, Artificial Sequence
  Description of Artificial Sequence: Synthetic oligonucleotide
tggcgaagcagttgagagcctacctgg

SEQ ID NO: 19831 - DNA, 27 bp, Artificial Sequence
  Description of Artificial Sequence: Synthetic oligonucleotide
ggcgaagcagttgagagcctacctgga

SEQ ID NO: 19832 - DNA, 27 bp, Artificial Sequence
  Description of Artificial Sequence: Synthetic oligonucleotide
gcgaagcagttgagagcctacctggag

SEQ ID NO: 19833 - DNA, 27 bp, Artificial Sequence
  Description of Artificial Sequence: Synthetic oligonucleotide
cgaagcagttgagagcctacctggagg

SEQ ID NO: 19834 - DNA, 27 bp, Artificial Sequence
  Description of Artificial Sequence: Synthetic oligonucleotide
gaagcagttgagagcctacctggaggg

SEQ ID NO: 19835 - DNA, 27 bp, Artificial Sequence
  Description of Artificial Sequence: Synthetic oligonucleotide
aagcagttgagagcctacctggagggc

SEQ ID NO: 19836 - DNA, 24 bp, Artificial Sequence
  Description of Artificial Sequence: Synthetic oligonucleotide
gaggggccggagtattgggaccac

SEQ ID NO: 19837 - DNA, 25 bp, Artificial Sequence
  Description of Artificial Sequence: Synthetic oligonucleotide
aggggccggagtattgggaccacga

SEQ ID NO: 19838 - DNA, 24 bp, Artificial Sequence
  Description of Artificial Sequence: Synthetic oligonucleotide
ggggccggagtattgggaccacga

SEQ ID NO: 19839 - DNA, 25 bp, Artificial Sequence
  Description of Artificial Sequence: Synthetic oligonucleotide
gggccggagtattgggaccacgaga

SEQ ID NO: 19840 - DNA, 26 bp, Artificial Sequence
  Description of Artificial Sequence: Synthetic oligonucleotide
ggccggagtattgggaccacgagaca

SEQ ID NO: 19841 - DNA, 26 bp, Artificial Sequence
  Description of Artificial Sequence: Synthetic oligonucleotide
gccggagtattgggaccacgagacac

SEQ ID NO: 19842 - DNA, 26 bp, Artificial Sequence
  Description of Artificial Sequence: Synthetic oligonucleotide
ccggagtattgggaccacgagacacg

SEQ ID NO: 19843 - DNA, 27 bp, Artificial Sequence
  Description of Artificial Sequence: Synthetic oligonucleotide
cggagtattgggaccacgagacacgga

SEQ ID NO: 19844 - DNA, 29 bp, Artificial Sequence
  Description of Artificial Sequence: Synthetic oligonucleotide
ggagtattgggaccacgagacacggaatg

SEQ ID NO: 19845 - DNA, 30 bp, Artificial Sequence
  Description of Artificial Sequence: Synthetic oligonucleotide
gagtattgggaccacgagacacggaatgtg

SEQ ID NO: 19846 - DNA, 32 bp, Artificial Sequence
  Description of Artificial Sequence: Synthetic oligonucleotide
agtattgggaccacgagacacggaatgtgaag

SEQ ID NO: 19847 - DNA, 31 bp, Artificial Sequence
  Description of Artificial Sequence: Synthetic oligonucleotide
gtattgggaccacgagacacggaatgtgaag

SEQ ID NO: 19848 - DNA, 31 bp, Artificial Sequence
  Description of Artificial Sequence: Synthetic oligonucleotide
tattgggaccacgagacacggaatgtgaagg

SEQ ID NO: 19849 - DNA, 30 bp, Artificial Sequence
  Description of Artificial Sequence: Synthetic oligonucleotide
attgggaccacgagacacggaatgtgaagg

SEQ ID NO: 19850 - DNA, 29 bp, Artificial Sequence
  Description of Artificial Sequence: Synthetic oligonucleotide
ttgggaccacgagacacggaatgtgaagg

SEQ ID NO: 19851 - DNA, 28 bp, Artificial Sequence
  Description of Artificial Sequence: Synthetic oligonucleotide
tgggaccacgagacacggaatgtgaagg

SEQ ID NO: 19852 - DNA, 27 bp, Artificial Sequence
  Description of Artificial Sequence: Synthetic oligonucleotide
gggaccacgagacacggaatgtgaagg

SEQ ID NO: 19853 - DNA, 27 bp, Artificial Sequence
  Description of Artificial Sequence: Synthetic oligonucleotide
ggaccacgagacacggaatgtgaaggc

SEQ ID NO: 19854 - DNA, 27 bp, Artificial Sequence
  Description of Artificial Sequence: Synthetic oligonucleotide
gaccacgagacacggaatgtgaaggcc

SEQ ID NO: 19855 - DNA, 27 bp, Artificial Sequence
  Description of Artificial Sequence: Synthetic oligonucleotide
accacgagacacggaatgtgaaggccc

SEQ ID NO: 19856 - DNA, 27 bp, Artificial Sequence
  Description of Artificial Sequence: Synthetic oligonucleotide
ccacgagacacggaatgtgaaggccca

SEQ ID NO: 19857 - DNA, 27 bp, Artificial Sequence
  Description of Artificial Sequence: Synthetic oligonucleotide
cacgagacacggaatgtgaaggcccac

SEQ ID NO: 19858 - DNA, 28 bp, Artificial Sequence
  Description of Artificial Sequence: Synthetic oligonucleotide
acgagacacggaatgtgaaggcccactc

SEQ ID NO: 19859 - DNA, 27 bp, Artificial Sequence
  Description of Artificial Sequence: Synthetic oligonucleotide
cgagacacggaatgtgaaggcccactc

SEQ ID NO: 19860 - DNA, 24 bp, Artificial Sequence
  Description of Artificial Sequence: Synthetic oligonucleotide
acgtgcgtggagtggctccgcaga

SEQ ID NO: 19861 - DNA, 23 bp, Artificial Sequence
  Description of Artificial Sequence: Synthetic oligonucleotide
cgtgcgtggagtggctccgcaga

SEQ ID NO: 19862 - DNA, 24 bp, Artificial Sequence
  Description of Artificial Sequence: Synthetic oligonucleotide
gtgcgtggagtggctccgcagaca

SEQ ID NO: 19863 - DNA, 24 bp, Artificial Sequence
  Description of Artificial Sequence: Synthetic oligonucleotide
tgcgtggagtggctccgcagacac

SEQ ID NO: 19864 - DNA, 23 bp, Artificial Sequence
  Description of Artificial Sequence: Synthetic oligonucleotide
gcgtggagtggctccgcagacac

SEQ ID NO: 19865 - DNA, 24 bp, Artificial Sequence
  Description of Artificial Sequence: Synthetic oligonucleotide
cgtggagtggctccgcagacacct

SEQ ID NO: 19866 - DNA, 24 bp, Artificial Sequence
  Description of Artificial Sequence: Synthetic oligonucleotide
gtggagtggctccgcagacacctg

SEQ ID NO: 19867 - DNA, 25 bp, Artificial Sequence
  Description of Artificial Sequence: Synthetic oligonucleotide
tggagtggctccgcagacacctgga

SEQ ID NO: 19868 - DNA, 24 bp, Artificial Sequence
  Description of Artificial Sequence: Synthetic oligonucleotide
ggagtggctccgcagacacctgga

SEQ ID NO: 19869 - DNA, 26 bp, Artificial Sequence
  Description of Artificial Sequence: Synthetic oligonucleotide
gagtggctccgcagacacctggagaa

SEQ ID NO: 19870 - DNA, 26 bp, Artificial Sequence
  Description of Artificial Sequence: Synthetic oligonucleotide
agtggctccgcagacacctggagaac

SEQ ID NO: 19871 - DNA, 25 bp, Artificial Sequence
  Description of Artificial Sequence: Synthetic oligonucleotide
gtggctccgcagacacctggagaac

SEQ ID NO: 19872 - DNA, 25 bp, Artificial Sequence
  Description of Artificial Sequence: Synthetic oligonucleotide
tggctccgcagacacctggagaacg

SEQ ID NO: 19873 - DNA, 24 bp, Artificial Sequence
  Description of Artificial Sequence: Synthetic oligonucleotide
ggctccgcagacacctggagaacg

SEQ ID NO: 19874 - DNA, 24 bp, Artificial Sequence
  Description of Artificial Sequence: Synthetic oligonucleotide
gctccgcagacacctggagaacgg

SEQ ID NO: 19875 - DNA, 26 bp, Artificial Sequence
  Description of Artificial Sequence: Synthetic oligonucleotide
ctccgcagacacctggagaacgggaa

SEQ ID NO: 19876 - DNA, 26 bp, Artificial Sequence
  Description of Artificial Sequence: Synthetic oligonucleotide
tccgcagacacctggagaacgggaag

SEQ ID NO: 19877 - DNA, 25 bp, Artificial Sequence
  Description of Artificial Sequence: Synthetic oligonucleotide
ccgcagacacctggagaacgggaag

SEQ ID NO: 19878 - DNA, 26 bp, Artificial Sequence
  Description of Artificial Sequence: Synthetic oligonucleotide
cgcagacacctggagaacgggaagga

SEQ ID NO: 19879 - DNA, 27 bp, Artificial Sequence
  Description of Artificial Sequence: Synthetic oligonucleotide
gcagacacctggagaacgggaaggaga

SEQ ID NO: 19880 - DNA, 27 bp, Artificial Sequence
  Description of Artificial Sequence: Synthetic oligonucleotide
cagacacctggagaacgggaaggagac

SEQ ID NO: 19881 - DNA, 27 bp, Artificial Sequence
  Description of Artificial Sequence: Synthetic oligonucleotide
agacacctggagaacgggaaggagacg

SEQ ID NO: 19882 - DNA, 26 bp, Artificial Sequence
  Description of Artificial Sequence: Synthetic oligonucleotide
gacacctggagaacgggaaggagacg

SEQ ID NO: 19883 - DNA, 27 bp, Artificial Sequence
  Description of Artificial Sequence: Synthetic oligonucleotide
acacctggagaacgggaaggagacgct

SEQ ID NO: 19884 - DNA, 26 bp, Artificial Sequence
  Description of Artificial Sequence: Synthetic oligonucleotide
cacctggagaacgggaaggagacgct

SEQ ID NO: 19885 - DNA, 21 bp, Artificial Sequence
  Description of Artificial Sequence: Synthetic oligonucleotide
tgcagcgcacggaccccccca

SEQ ID NO: 19886 - DNA, 20 bp, Artificial Sequence
  Description of Artificial Sequence: Synthetic oligonucleotide
gcagcgcacggaccccccca

SEQ ID NO: 19887 - DNA, 20 bp, Artificial Sequence
  Description of Artificial Sequence: Synthetic oligonucleotide
cagcgcacggacccccccag

SEQ ID NO: 19888 - DNA, 21 bp, Artificial Sequence
  Description of Artificial Sequence: Synthetic oligonucleotide
agcgcacggacccccccagga

SEQ ID NO: 19889 - DNA, 20 bp, Artificial Sequence
  Description of Artificial Sequence: Synthetic oligonucleotide
gcgcacggacccccccagga

SEQ ID NO: 19890 - DNA, 20 bp, Artificial Sequence
  Description of Artificial Sequence: Synthetic oligonucleotide
cgcacggacccccccaggac

SEQ ID NO: 19891 - DNA, 20 bp, Artificial Sequence
  Description of Artificial Sequence: Synthetic oligonucleotide
gcacggacccccccaggacg

SEQ ID NO: 19892 - DNA, 24 bp, Artificial Sequence
  Description of Artificial Sequence: Synthetic oligonucleotide
cacggacccccccaggacgcatat

SEQ ID NO: 19893 - DNA, 25 bp, Artificial Sequence
  Description of Artificial Sequence: Synthetic oligonucleotide
acggacccccccaggacgcatatga

SEQ ID NO: 19894 - DNA, 24 bp, Artificial Sequence
  Description of Artificial Sequence: Synthetic oligonucleotide
cggacccccccaggacgcatatga

SEQ ID NO: 19895 - DNA, 25 bp, Artificial Sequence
  Description of Artificial Sequence: Synthetic oligonucleotide
ggacccccccaggacgcatatgact

SEQ ID NO: 19896 - DNA, 26 bp, Artificial Sequence
  Description of Artificial Sequence: Synthetic oligonucleotide
gacccccccaggacgcatatgactca

SEQ ID NO: 19897 - DNA, 26 bp, Artificial Sequence
  Description of Artificial Sequence: Synthetic oligonucleotide
acccccccaggacgcatatgactcac

SEQ ID NO: 19898 - DNA, 25 bp, Artificial Sequence
  Description of Artificial Sequence: Synthetic oligonucleotide
cccccccaggacgcatatgactcac

SEQ ID NO: 19899 - DNA, 26 bp, Artificial Sequence
  Description of Artificial Sequence: Synthetic oligonucleotide
ccccccaggacgcatatgactcacca

SEQ ID NO: 19900 - DNA, 26 bp, Artificial Sequence
  Description of Artificial Sequence: Synthetic oligonucleotide
cccccaggacgcatatgactcaccac

SEQ ID NO: 19901 - DNA, 26 bp, Artificial Sequence
  Description of Artificial Sequence: Synthetic oligonucleotide
ccccaggacgcatatgactcaccacg

SEQ ID NO: 19902 - DNA, 27 bp, Artificial Sequence
  Description of Artificial Sequence: Synthetic oligonucleotide
cccaggacgcatatgactcaccacgct

SEQ ID NO: 19903 - DNA, 27 bp, Artificial Sequence
  Description of Artificial Sequence: Synthetic oligonucleotide
ccaggacgcatatgactcaccacgctg

SEQ ID NO: 19904 - DNA, 28 bp, Artificial Sequence
  Description of Artificial Sequence: Synthetic oligonucleotide
caggacgcatatgactcaccacgctgtc

SEQ ID NO: 19905 - DNA, 29 bp, Artificial Sequence
  Description of Artificial Sequence: Synthetic oligonucleotide
aggacgcatatgactcaccacgctgtctc

SEQ ID NO: 19906 - DNA, 28 bp, Artificial Sequence
  Description of Artificial Sequence: Synthetic oligonucleotide
ggacgcatatgactcaccacgctgtctc

SEQ ID NO: 19907 - DNA, 25 bp, Artificial Sequence
  Description of Artificial Sequence: Synthetic oligonucleotide
caggagggtccggagtattgggacc

SEQ ID NO: 19908 - DNA, 25 bp, Artificial Sequence
  Description of Artificial Sequence: Synthetic oligonucleotide
aggagggtccggagtattgggaccg

SEQ ID NO: 19909 - DNA, 24 bp, Artificial Sequence
  Description of Artificial Sequence: Synthetic oligonucleotide
ggagggtccggagtattgggaccg

SEQ ID NO: 19910 - DNA, 26 bp, Artificial Sequence
  Description of Artificial Sequence: Synthetic oligonucleotide
gagggtccggagtattgggaccggaa

SEQ ID NO: 19911 - DNA, 27 bp, Artificial Sequence
  Description of Artificial Sequence: Synthetic oligonucleotide
agggtccggagtattgggaccggaaca

SEQ ID NO: 19912 - DNA, 26 bp, Artificial Sequence
  Description of Artificial Sequence: Synthetic oligonucleotide
gggtccggagtattgggaccggaaca

SEQ ID NO: 19913 - DNA, 27 bp, Artificial Sequence
  Description of Artificial Sequence: Synthetic oligonucleotide
ggtccggagtattgggaccggaacaca

SEQ ID NO: 19914 - DNA, 27 bp, Artificial Sequence
  Description of Artificial Sequence: Synthetic oligonucleotide
gtccggagtattgggaccggaacacac

SEQ ID NO: 19915 - DNA, 27 bp, Artificial Sequence
  Description of Artificial Sequence: Synthetic oligonucleotide
tccggagtattgggaccggaacacacg

SEQ ID NO: 19916 - DNA, 27 bp, Artificial Sequence
  Description of Artificial Sequence: Synthetic oligonucleotide
tatttcaccacatccgtgtcccggccg

SEQ ID NO: 19917 - DNA, 26 bp, Artificial Sequence
  Description of Artificial Sequence: Synthetic oligonucleotide
atttcaccacatccgtgtcccggccg

SEQ ID NO: 19918 - DNA, 25 bp, Artificial Sequence
  Description of Artificial Sequence: Synthetic oligonucleotide
tttcaccacatccgtgtcccggccg

SEQ ID NO: 19919 - DNA, 24 bp, Artificial Sequence
  Description of Artificial Sequence: Synthetic oligonucleotide
ttcaccacatccgtgtcccggccg

SEQ ID NO: 19920 - DNA, 23 bp, Artificial Sequence
  Description of Artificial Sequence: Synthetic oligonucleotide
tcaccacatccgtgtcccggccg

SEQ ID NO: 19921 - DNA, 22 bp, Artificial Sequence
  Description of Artificial Sequence: Synthetic oligonucleotide
caccacatccgtgtcccggccg

SEQ ID NO: 19922 - DNA, 22 bp, Artificial Sequence
  Description of Artificial Sequence: Synthetic oligonucleotide
accacatccgtgtcccggccgg

SEQ ID NO: 19923 - DNA, 21 bp, Artificial Sequence
  Description of Artificial Sequence: Synthetic oligonucleotide
ccacatccgtgtcccggccgg

SEQ ID NO: 19924 - DNA, 21 bp, Artificial Sequence
  Description of Artificial Sequence: Synthetic oligonucleotide
cacatccgtgtcccggccggg

SEQ ID NO: 19925 - DNA, 21 bp, Artificial Sequence
  Description of Artificial Sequence: Synthetic oligonucleotide
acatccgtgtcccggccgggc

SEQ ID NO: 19926 - DNA, 20 bp, Artificial Sequence
  Description of Artificial Sequence: Synthetic oligonucleotide
catccgtgtcccggccgggc

SEQ ID NO: 19927 - DNA, 20 bp, Artificial Sequence
  Description of Artificial Sequence: Synthetic oligonucleotide
atccgtgtcccggccgggcc

SEQ ID NO: 19928 - DNA, 20 bp, Artificial Sequence
  Description of Artificial Sequence: Synthetic oligonucleotide
tccgtgtcccggccgggcct

SEQ ID NO: 19929 - DNA, 20 bp, Artificial Sequence
  Description of Artificial Sequence: Synthetic oligonucleotide
ccgtgtcccggccgggcctt

SEQ ID NO: 19930 - DNA, 20 bp, Artificial Sequence
  Description of Artificial Sequence: Synthetic oligonucleotide
cgtgtcccggccgggccgtt

SEQ ID NO: 19931 - DNA, 20 bp, Artificial Sequence
  Description of Artificial Sequence: Synthetic oligonucleotide
gtgtcccggccgggccgctt

SEQ ID NO: 19932 - DNA, 20 bp, Artificial Sequence
  Description of Artificial Sequence: Synthetic oligonucleotide
tgtcccggccgggccgcgtt

SEQ ID NO: 19933 - DNA, 20 bp, Artificial Sequence
  Description of Artificial Sequence: Synthetic oligonucleotide
gtcccggccgggccgcgttt

SEQ ID NO: 19934 - DNA, 20 bp, Artificial Sequence
  Description of Artificial Sequence: Synthetic oligonucleotide
tcccggccgggccgcggttt

SEQ ID NO: 19935 - DNA, 20 bp, Artificial Sequence
  Description of Artificial Sequence: Synthetic oligonucleotide
cccggccgggccgcggtttt

SEQ ID NO: 19936 - DNA, 20 bp, Artificial Sequence
  Description of Artificial Sequence: Synthetic oligonucleotide
ccggccgggccgcgggtttt

SEQ ID NO: 19937 - DNA, 20 bp, Artificial Sequence
  Description of Artificial Sequence: Synthetic oligonucleotide
cggccgggccgcggggattt

SEQ ID NO: 19938 - DNA, 20 bp, Artificial Sequence
  Description of Artificial Sequence: Synthetic oligonucleotide
ggccgggccgcggggagttt

SEQ ID NO: 19939 - DNA, 20 bp, Artificial Sequence
  Description of Artificial Sequence: Synthetic oligonucleotide
gccgggccgcggggagcttt

SEQ ID NO: 19940 - DNA, 20 bp, Artificial Sequence
  Description of Artificial Sequence: Synthetic oligonucleotide
ccgggccgcggggagccttt

SEQ ID NO: 19941 - DNA, 20 bp, Artificial Sequence
  Description of Artificial Sequence: Synthetic oligonucleotide
cgggccgcggggagcccttt

SEQ ID NO: 19942 - DNA, 20 bp, Artificial Sequence
  Description of Artificial Sequence: Synthetic oligonucleotide
gggccgcggggagccccttt

SEQ ID NO: 19943 - DNA, 26 bp, Artificial Sequence
  Description of Artificial Sequence: Synthetic oligonucleotide
agatcacccagcgcaagtgggaggca

SEQ ID NO: 19944 - DNA, 25 bp, Artificial Sequence
  Description of Artificial Sequence: Synthetic oligonucleotide
gatcacccagcgcaagtgggaggca

SEQ ID NO: 19945 - DNA, 25 bp, Artificial Sequence
  Description of Artificial Sequence: Synthetic oligonucleotide
atcacccagcgcaagtgggaggcag

SEQ ID NO: 19946 - DNA, 24 bp, Artificial Sequence
  Description of Artificial Sequence: Synthetic oligonucleotide
tcacccagcgcaagtgggaggcag

SEQ ID NO: 19947 - DNA, 23 bp, Artificial Sequence
  Description of Artificial Sequence: Synthetic oligonucleotide
cacccagcgcaagtgggaggcag

SEQ ID NO: 19948 - DNA, 23 bp, Artificial Sequence
  Description of Artificial Sequence: Synthetic oligonucleotide
acccagcgcaagtgggaggcagc

SEQ ID NO: 19949 - DNA, 22 bp, Artificial Sequence
  Description of Artificial Sequence: Synthetic oligonucleotide
cccagcgcaagtgggaggcagc

SEQ ID NO: 19950 - DNA, 22 bp, Artificial Sequence
  Description of Artificial Sequence: Synthetic oligonucleotide
ccagcgcaagtgggaggcagcc

SEQ ID NO: 19951 - DNA, 22 bp, Artificial Sequence
  Description of Artificial Sequence: Synthetic oligonucleotide
cagcgcaagtgggaggcagccc

SEQ ID NO: 19952 - DNA, 23 bp, Artificial Sequence
  Description of Artificial Sequence: Synthetic oligonucleotide
agcgcaagtgggaggcagcccgt

SEQ ID NO: 19953 - DNA, 22 bp, Artificial Sequence
  Description of Artificial Sequence: Synthetic oligonucleotide
gcgcaagtgggaggcagcccgt

SEQ ID NO: 19954 - DNA, 23 bp, Artificial Sequence
  Description of Artificial Sequence: Synthetic oligonucleotide
cgcaagtgggaggcagcccgtgt

SEQ ID NO: 19955 - DNA, 23 bp, Artificial Sequence
  Description of Artificial Sequence: Synthetic oligonucleotide
gcaagtgggaggcagcccgtgtg

SEQ ID NO: 19956 - DNA, 23 bp, Artificial Sequence
  Description of Artificial Sequence: Synthetic oligonucleotide
caagtgggaggcagcccgtgtgg

SEQ ID NO: 19957 - DNA, 23 bp, Artificial Sequence
  Description of Artificial Sequence: Synthetic oligonucleotide
aagtgggaggcagcccgtgtggc

SEQ ID NO: 19958 - DNA, 22 bp, Artificial Sequence
  Description of Artificial Sequence: Synthetic oligonucleotide
agtgggaggcagcccgtgtggc

SEQ ID NO: 19959 - DNA, 21 bp, Artificial Sequence
  Description of Artificial Sequence: Synthetic oligonucleotide
gtgggaggcagcccgtgtggc

SEQ ID NO: 19960 - DNA, 21 bp, Artificial Sequence
  Description of Artificial Sequence: Synthetic oligonucleotide
tgggaggcagcccgtgtggcg

SEQ ID NO: 19961 - DNA, 20 bp, Artificial Sequence
  Description of Artificial Sequence: Synthetic oligonucleotide
gggaggcagcccgtgtggcg

SEQ ID NO: 19962 - DNA, 21 bp, Artificial Sequence
  Description of Artificial Sequence: Synthetic oligonucleotide
ggaggcagcccgtgtggcgga

SEQ ID NO: 19963 - DNA, 21 bp, Artificial Sequence
  Description of Artificial Sequence: Synthetic oligonucleotide
gaggcagcccgtgtggcggag

SEQ ID NO: 19964 - DNA, 22 bp, Artificial Sequence
  Description of Artificial Sequence: Synthetic oligonucleotide
aggcagcccgtgtggcggagca

SEQ ID NO: 19965 - DNA, 21 bp, Artificial Sequence
  Description of Artificial Sequence: Synthetic oligonucleotide
ggcagcccgtgtggcggagca

SEQ ID NO: 19966 - DNA, 23 bp, Artificial Sequence
  Description of Artificial Sequence: Synthetic oligonucleotide
gcagcccgtgtggcggagcagtt

SEQ ID NO: 19967 - DNA, 24 bp, Artificial Sequence
  Description of Artificial Sequence: Synthetic oligonucleotide
cagcccgtgtggcggagcagttga

SEQ ID NO: 19968 - DNA, 25 bp, Artificial Sequence
  Description of Artificial Sequence: Synthetic oligonucleotide
agcccgtgtggcggagcagttgaga

SEQ ID NO: 19969 - DNA, 27 bp, Artificial Sequence
  Description of Artificial Sequence: Synthetic oligonucleotide
ttgagagcctacctggagggcacgtgt

SEQ ID NO: 19970 - DNA, 26 bp, Artificial Sequence
  Description of Artificial Sequence: Synthetic oligonucleotide
tgagagcctacctggagggcacgtgt

SEQ ID NO: 19971 - DNA, 25 bp, Artificial Sequence
  Description of Artificial Sequence: Synthetic oligonucleotide
gagagcctacctggagggcacgtgt

SEQ ID NO: 19972 - DNA, 26 bp, Artificial Sequence
  Description of Artificial Sequence: Synthetic oligonucleotide
agagcctacctggagggcacgtgtgt

SEQ ID NO: 19973 - DNA, 25 bp, Artificial Sequence
  Description of Artificial Sequence: Synthetic oligonucleotide
gagcctacctggagggcacgtgtgt

SEQ ID NO: 19974 - DNA, 25 bp, Artificial Sequence
  Description of Artificial Sequence: Synthetic oligonucleotide
agcctacctggagggcacgtgtgtg

SEQ ID NO: 19975 - DNA, 24 bp, Artificial Sequence
  Description of Artificial Sequence: Synthetic oligonucleotide
gcctacctggagggcacgtgtgtg

SEQ ID NO: 19976 - DNA, 25 bp, Artificial Sequence
  Description of Artificial Sequence: Synthetic oligonucleotide
cctacctggagggcacgtgtgtgga

SEQ ID NO: 19977 - DNA, 26 bp, Artificial Sequence
  Description of Artificial Sequence: Synthetic oligonucleotide
ctacctggagggcacgtgtgtggagt

SEQ ID NO: 19978 - DNA, 26 bp, Artificial Sequence
  Description of Artificial Sequence: Synthetic oligonucleotide
tacctggagggcacgtgtgtggagtg

SEQ ID NO: 19979 - DNA, 25 bp, Artificial Sequence
  Description of Artificial Sequence: Synthetic oligonucleotide
acctggagggcacgtgtgtggagtg

SEQ ID NO: 19980 - DNA, 24 bp, Artificial Sequence
  Description of Artificial Sequence: Synthetic oligonucleotide
cctggagggcacgtgtgtggagtg

SEQ ID NO: 19981 - DNA, 24 bp, Artificial Sequence
  Description of Artificial Sequence: Synthetic oligonucleotide
ctggagggcacgtgtgtggagtgg

SEQ ID NO: 19982 - DNA, 25 bp, Artificial Sequence
  Description of Artificial Sequence: Synthetic oligonucleotide
tggagggcacgtgtgtggagtggct

SEQ ID NO: 19983 - DNA, 24 bp, Artificial Sequence
  Description of Artificial Sequence: Synthetic oligonucleotide
ggagggcacgtgtgtggagtggct

SEQ ID NO: 19984 - DNA, 24 bp, Artificial Sequence
  Description of Artificial Sequence: Synthetic oligonucleotide
gagggcacgtgtgtggagtggctc

SEQ ID NO: 19985 - DNA, 24 bp, Artificial Sequence
  Description of Artificial Sequence: Synthetic oligonucleotide
agggcacgtgtgtggagtggctcc

SEQ ID NO: 19986 - DNA, 23 bp, Artificial Sequence
  Description of Artificial Sequence: Synthetic oligonucleotide
gggcacgtgtgtggagtggctcc

SEQ ID NO: 19987 - DNA, 23 bp, Artificial Sequence
  Description of Artificial Sequence: Synthetic oligonucleotide
ggcacgtgtgtggagtggctccg

SEQ ID NO: 19988 - DNA, 24 bp, Artificial Sequence
  Description of Artificial Sequence: Synthetic oligonucleotide
gcacgtgtgtggagtggctccgca

SEQ ID NO: 19989 - DNA, 27 bp, Artificial Sequence
  Description of Artificial Sequence: Synthetic oligonucleotide
cacgtgtgtggagtggctccgcagata

SEQ ID NO: 19990 - DNA, 27 bp, Artificial Sequence
  Description of Artificial Sequence: Synthetic oligonucleotide
acgtgtgtggagtggctccgcagatac

SEQ ID NO: 19991 - DNA, 26 bp, Artificial Sequence
  Description of Artificial Sequence: Synthetic oligonucleotide
cgtgtgtggagtggctccgcagatac

SEQ ID NO: 19992 - DNA, 27 bp, Artificial Sequence
  Description of Artificial Sequence: Synthetic oligonucleotide
gtgtgtggagtggctccgcagatacct

SEQ ID NO: 19993 - DNA, 27 bp, Artificial Sequence
  Description of Artificial Sequence: Synthetic oligonucleotide
tgtgtggagtggctccgcagatacctg

SEQ ID NO: 19994 - DNA, 26 bp, Artificial Sequence
  Description of Artificial Sequence: Synthetic oligonucleotide
gtgtggagtggctccgcagatacctg

SEQ ID NO: 19995 - DNA, 27 bp, Artificial Sequence
  Description of Artificial Sequence: Synthetic oligonucleotide
tgtggagtggctccgcagatacctgga

SEQ ID NO: 19996 - DNA, 25 bp, Artificial Sequence
  Description of Artificial Sequence: Synthetic oligonucleotide
agacctgggcgggctcccactctat

SEQ ID NO: 19997 - DNA, 24 bp, Artificial Sequence
  Description of Artificial Sequence: Synthetic oligonucleotide
gacctgggcgggctcccactctat

SEQ ID NO: 19998 - DNA, 25 bp, Artificial Sequence
  Description of Artificial Sequence: Synthetic oligonucleotide
acctgggcgggctcccactctatga

SEQ ID NO: 19999 - DNA, 24 bp, Artificial Sequence
  Description of Artificial Sequence: Synthetic oligonucleotide
cctgggcgggctcccactctatga

SEQ ID NO: 20000 - DNA, 24 bp, Artificial Sequence
  Description of Artificial Sequence: Synthetic oligonucleotide
ctgggcgggctcccactctatgag

SEQ ID NO: 20001 - DNA, 27 bp, Artificial Sequence
  Description of Artificial Sequence: Synthetic oligonucleotide
tgggcgggctcccactctatgaggtat

SEQ ID NO: 20002 - DNA, 27 bp, Artificial Sequence
  Description of Artificial Sequence: Synthetic oligonucleotide
gggcgggctcccactctatgaggtatt

SEQ ID NO: 20003 - DNA, 28 bp, Artificial Sequence
  Description of Artificial Sequence: Synthetic oligonucleotide
ggcgggctcccactctatgaggtatttc

SEQ ID NO: 20004 - DNA, 29 bp, Artificial Sequence
  Description of Artificial Sequence: Synthetic oligonucleotide
gcgggctcccactctatgaggtatttcac

SEQ ID NO: 20005 - DNA, 29 bp, Artificial Sequence
  Description of Artificial Sequence: Synthetic oligonucleotide
cgggctcccactctatgaggtatttcacc

SEQ ID NO: 20006 - DNA, 30 bp, Artificial Sequence
  Description of Artificial Sequence: Synthetic oligonucleotide
gggctcccactctatgaggtatttcaccac

SEQ ID NO: 20007 - DNA, 32 bp, Artificial Sequence
  Description of Artificial Sequence: Synthetic oligonucleotide
ggctcccactctatgaggtatttcaccacatc

SEQ ID NO: 20008 - DNA, 32 bp, Artificial Sequence
  Description of Artificial Sequence: Synthetic oligonucleotide
gctcccactctatgaggtatttcaccacatcc

SEQ ID NO: 20009 - DNA, 32 bp, Artificial Sequence
  Description of Artificial Sequence: Synthetic oligonucleotide
ctcccactctatgaggtatttcaccacatccg

SEQ ID NO: 20010 - DNA, 33 bp, Artificial Sequence
  Description of Artificial Sequence: Synthetic oligonucleotide
tcccactctatgaggtatttcaccacatccgtg

SEQ ID NO: 20011 - DNA, 32 bp, Artificial Sequence
  Description of Artificial Sequence: Synthetic oligonucleotide
cccactctatgaggtatttcaccacatccgtg

SEQ ID NO: 20012 - DNA, 33 bp, Artificial Sequence
  Description of Artificial Sequence: Synthetic oligonucleotide
ccactctatgaggtatttcaccacatccgtgtc

SEQ ID NO: 20013 - DNA, 33 bp, Artificial Sequence
  Description of Artificial Sequence: Synthetic oligonucleotide
cactctatgaggtatttcaccacatccgtgtcc

SEQ ID NO: 20014 - DNA, 33 bp, Artificial Sequence
  Description of Artificial Sequence: Synthetic oligonucleotide
actctatgaggtatttcaccacatccgtgtccc

SEQ ID NO: 20015 - DNA, 32 bp, Artificial Sequence
  Description of Artificial Sequence: Synthetic oligonucleotide
ctctatgaggtatttcaccacatccgtgtccc

SEQ ID NO: 20016 - DNA, 32 bp, Artificial Sequence
  Description of Artificial Sequence: Synthetic oligonucleotide
tctatgaggtatttcaccacatccgtgtcccg

SEQ ID NO: 20017 - DNA, 31 bp, Artificial Sequence
  Description of Artificial Sequence: Synthetic oligonucleotide
ctatgaggtatttcaccacatccgtgtcccg

SEQ ID NO: 20018 - DNA, 31 bp, Artificial Sequence
  Description of Artificial Sequence: Synthetic oligonucleotide
tatgaggtatttcaccacatccgtgtcccgg

SEQ ID NO: 20019 - DNA, 32 bp, Artificial Sequence
  Description of Artificial Sequence: Synthetic oligonucleotide
aaggattacatcgccttgaacgaggacctgag

SEQ ID NO: 20020 - DNA, 31 bp, Artificial Sequence
  Description of Artificial Sequence: Synthetic oligonucleotide
aggattacatcgccttgaacgaggacctgag

SEQ ID NO: 20021 - DNA, 30 bp, Artificial Sequence
  Description of Artificial Sequence: Synthetic oligonucleotide
ggattacatcgccttgaacgaggacctgag

SEQ ID NO: 20022 - DNA, 30 bp, Artificial Sequence
  Description of Artificial Sequence: Synthetic oligonucleotide
gattacatcgccttgaacgaggacctgagc

SEQ ID NO: 20023 - DNA, 31 bp, Artificial Sequence
  Description of Artificial Sequence: Synthetic oligonucleotide
attacatcgccttgaacgaggacctgagctc

SEQ ID NO: 20024 - DNA, 30 bp, Artificial Sequence
  Description of Artificial Sequence: Synthetic oligonucleotide
ttacatcgccttgaacgaggacctgagctc

SEQ ID NO: 20025 - DNA, 29 bp, Artificial Sequence
  Description of Artificial Sequence: Synthetic oligonucleotide
tacatcgccttgaacgaggacctgagctc

SEQ ID NO: 20026 - DNA, 28 bp, Artificial Sequence
  Description of Artificial Sequence: Synthetic oligonucleotide
acatcgccttgaacgaggacctgagctc

SEQ ID NO: 20027 - DNA, 27 bp, Artificial Sequence
  Description of Artificial Sequence: Synthetic oligonucleotide
catcgccttgaacgaggacctgagctc

SEQ ID NO: 20028 - DNA, 27 bp, Artificial Sequence
  Description of Artificial Sequence: Synthetic oligonucleotide
atcgccttgaacgaggacctgagctcc

SEQ ID NO: 20029 - DNA, 27 bp, Artificial Sequence
  Description of Artificial Sequence: Synthetic oligonucleotide
tcgccttgaacgaggacctgagctcct

SEQ ID NO: 20030 - DNA, 26 bp, Artificial Sequence
  Description of Artificial Sequence: Synthetic oligonucleotide
cgccttgaacgaggacctgagctcct

SEQ ID NO: 20031 - DNA, 26 bp, Artificial Sequence
  Description of Artificial Sequence: Synthetic oligonucleotide
gccttgaacgaggacctgagctcctg

SEQ ID NO: 20032 - DNA, 27 bp, Artificial Sequence
  Description of Artificial Sequence: Synthetic oligonucleotide
ccttgaacgaggacctgagctcctgga

SEQ ID NO: 20033 - DNA, 27 bp, Artificial Sequence
  Description of Artificial Sequence: Synthetic oligonucleotide
cttgaacgaggacctgagctcctggac

SEQ ID NO: 20034 - DNA, 27 bp, Artificial Sequence
  Description of Artificial Sequence: Synthetic oligonucleotide
ttgaacgaggacctgagctcctggacc

SEQ ID NO: 20035 - DNA, 26 bp, Artificial Sequence
  Description of Artificial Sequence: Synthetic oligonucleotide
tgaacgaggacctgagctcctggacc

SEQ ID NO: 20036 - DNA, 25 bp, Artificial Sequence
  Description of Artificial Sequence: Synthetic oligonucleotide
gaacgaggacctgagctcctggacc

SEQ ID NO: 20037 - DNA, 25 bp, Artificial Sequence
  Description of Artificial Sequence: Synthetic oligonucleotide
aacgaggacctgagctcctggaccg

SEQ ID NO: 20038 - DNA, 24 bp, Artificial Sequence
  Description of Artificial Sequence: Synthetic oligonucleotide
acgaggacctgagctcctggaccg

SEQ ID NO: 20039 - DNA, 23 bp, Artificial Sequence
  Description of Artificial Sequence: Synthetic oligonucleotide
cgaggacctgagctcctggaccg

SEQ ID NO: 20040 - DNA, 21 bp, Artificial Sequence
  Description of Artificial Sequence: Synthetic oligonucleotide
cgcgggcgccgtggatagagc

SEQ ID NO: 20041 - DNA, 21 bp, Artificial Sequence
  Description of Artificial Sequence: Synthetic oligonucleotide
gcgggcgccgtggatagagcg

SEQ ID NO: 20042 - DNA, 21 bp, Artificial Sequence
  Description of Artificial Sequence: Synthetic oligonucleotide
cgggcgccgtggatagagcgg

SEQ ID NO: 20043 - DNA, 22 bp, Artificial Sequence
  Description of Artificial Sequence: Synthetic oligonucleotide
gggcgccgtggatagagcggga

SEQ ID NO: 20044 - DNA, 22 bp, Artificial Sequence
  Description of Artificial Sequence: Synthetic oligonucleotide
ggcgccgtggatagagcgggag

SEQ ID NO: 20045 - DNA, 22 bp, Artificial Sequence
  Description of Artificial Sequence: Synthetic oligonucleotide
gcgccgtggatagagcgggagg

SEQ ID NO: 20046 - DNA, 22 bp, Artificial Sequence
  Description of Artificial Sequence: Synthetic oligonucleotide
cgccgtggatagagcgggaggg

SEQ ID NO: 20047 - DNA, 22 bp, Artificial Sequence
  Description of Artificial Sequence: Synthetic oligonucleotide
gccgtggatagagcgggagggg

SEQ ID NO: 20048 - DNA, 22 bp, Artificial Sequence
  Description of Artificial Sequence: Synthetic oligonucleotide
ccgtggatagagcgggaggggc

SEQ ID NO: 20049 - DNA, 22 bp, Artificial Sequence
  Description of Artificial Sequence: Synthetic oligonucleotide
cgtggatagagcgggaggggcc

SEQ ID NO: 20050 - DNA, 22 bp, Artificial Sequence
  Description of Artificial Sequence: Synthetic oligonucleotide
gtggatagagcgggaggggccg

SEQ ID NO: 20051 - DNA, 23 bp, Artificial Sequence
  Description of Artificial Sequence: Synthetic oligonucleotide
tggatagagcgggaggggccgga

SEQ ID NO: 20052 - DNA, 22 bp, Artificial Sequence
  Description of Artificial Sequence: Synthetic oligonucleotide
ggatagagcgggaggggccgga

SEQ ID NO: 20053 - DNA, 26 bp, Artificial Sequence
  Description of Artificial Sequence: Synthetic oligonucleotide
gatagagcgggaggggccggagtatt

SEQ ID NO: 20054 - DNA, 26 bp, Artificial Sequence
  Description of Artificial Sequence: Synthetic oligonucleotide
atagagcgggaggggccggagtattg

SEQ ID NO: 20055 - DNA, 25 bp, Artificial Sequence
  Description of Artificial Sequence: Synthetic oligonucleotide
tagagcgggaggggccggagtattg

SEQ ID NO: 20056 - DNA, 24 bp, Artificial Sequence
  Description of Artificial Sequence: Synthetic oligonucleotide
agagcgggaggggccggagtattg

SEQ ID NO: 20057 - DNA, 23 bp, Artificial Sequence
  Description of Artificial Sequence: Synthetic oligonucleotide
aagtgggaggcggcccgtgtgga

SEQ ID NO: 20058 - DNA, 22 bp, Artificial Sequence
  Description of Artificial Sequence: Synthetic oligonucleotide
agtgggaggcggcccgtgtgga

SEQ ID NO: 20059 - DNA, 21 bp, Artificial Sequence
  Description of Artificial Sequence: Synthetic oligonucleotide
gtgggaggcggcccgtgtgga

SEQ ID NO: 20060 - DNA, 21 bp, Artificial Sequence
  Description of Artificial Sequence: Synthetic oligonucleotide
tgggaggcggcccgtgtggag

SEQ ID NO: 20061 - DNA, 20 bp, Artificial Sequence
  Description of Artificial Sequence: Synthetic oligonucleotide
gggaggcggcccgtgtggag

SEQ ID NO: 20062 - DNA, 21 bp, Artificial Sequence
  Description of Artificial Sequence: Synthetic oligonucleotide
ggaggcggcccgtgtggagga

SEQ ID NO: 20063 - DNA, 21 bp, Artificial Sequence
  Description of Artificial Sequence: Synthetic oligonucleotide
gaggcggcccgtgtggaggag

SEQ ID NO: 20064 - DNA, 22 bp, Artificial Sequence
  Description of Artificial Sequence: Synthetic oligonucleotide
aggcggcccgtgtggaggagca

SEQ ID NO: 20065 - DNA, 21 bp, Artificial Sequence
  Description of Artificial Sequence: Synthetic oligonucleotide
ggcggcccgtgtggaggagca

SEQ ID NO: 20066 - DNA, 23 bp, Artificial Sequence
  Description of Artificial Sequence: Synthetic oligonucleotide
gcggcccgtgtggaggagcagtt

SEQ ID NO: 20067 - DNA, 24 bp, Artificial Sequence
  Description of Artificial Sequence: Synthetic oligonucleotide
cggcccgtgtggaggagcagttga

SEQ ID NO: 20068 - DNA, 25 bp, Artificial Sequence
  Description of Artificial Sequence: Synthetic oligonucleotide
ggcccgtgtggaggagcagttgaga

SEQ ID NO: 20069 - DNA, 25 bp, Artificial Sequence
  Description of Artificial Sequence: Synthetic oligonucleotide
gcccgtgtggaggagcagttgagag

SEQ ID NO: 20070 - DNA, 25 bp, Artificial Sequence
  Description of Artificial Sequence: Synthetic oligonucleotide
cccgtgtggaggagcagttgagagc

SEQ ID NO: 20071 - DNA, 27 bp, Artificial Sequence
  Description of Artificial Sequence: Synthetic oligonucleotide
ccgtgtggaggagcagttgagagccta

SEQ ID NO: 20072 - DNA, 27 bp, Artificial Sequence
  Description of Artificial Sequence: Synthetic oligonucleotide
cgtgtggaggagcagttgagagcctac

SEQ ID NO: 20073 - DNA, 27 bp, Artificial Sequence
  Description of Artificial Sequence: Synthetic oligonucleotide
gtgtggaggagcagttgagagcctacc

SEQ ID NO: 20074 - DNA, 28 bp, Artificial Sequence
  Description of Artificial Sequence: Synthetic oligonucleotide
tgtggaggagcagttgagagcctacctg

SEQ ID NO: 20075 - DNA, 27 bp, Artificial Sequence
  Description of Artificial Sequence: Synthetic oligonucleotide
gtggaggagcagttgagagcctacctg

SEQ ID NO: 20076 - DNA, 27 bp, Artificial Sequence
  Description of Artificial Sequence: Synthetic oligonucleotide
tggaggagcagttgagagcctacctgg

SEQ ID NO: 20077 - DNA, 20 bp, Artificial Sequence
  Description of Artificial Sequence: Synthetic oligonucleotide
gacgtggggtcggacgggcc

SEQ ID NO: 20078 - DNA, 22 bp, Artificial Sequence
  Description of Artificial Sequence: Synthetic oligonucleotide
acgtggggtcggacgggccctt

SEQ ID NO: 20079 - DNA, 21 bp, Artificial Sequence
  Description of Artificial Sequence: Synthetic oligonucleotide
cgtggggtcggacgggccctt

SEQ ID NO: 20080 - DNA, 21 bp, Artificial Sequence
  Description of Artificial Sequence: Synthetic oligonucleotide
gtggggtcggacgggcccttc

SEQ ID NO: 20081 - DNA, 22 bp, Artificial Sequence
  Description of Artificial Sequence: Synthetic oligonucleotide
tggggtcggacgggcccttcct

SEQ ID NO: 20082 - DNA, 21 bp, Artificial Sequence
  Description of Artificial Sequence: Synthetic oligonucleotide
ggggtcggacgggcccttcct

SEQ ID NO: 20083 - DNA, 21 bp, Artificial Sequence
  Description of Artificial Sequence: Synthetic oligonucleotide
gggtcggacgggcccttcctc

SEQ ID NO: 20084 - DNA, 21 bp, Artificial Sequence
  Description of Artificial Sequence: Synthetic oligonucleotide
ggtcggacgggcccttcctcc

SEQ ID NO: 20085 - DNA, 21 bp, Artificial Sequence
  Description of Artificial Sequence: Synthetic oligonucleotide
gtcggacgggcccttcctccg

SEQ ID NO: 20086 - DNA, 21 bp, Artificial Sequence
  Description of Artificial Sequence: Synthetic oligonucleotide
tcggacgggcccttcctccgc

SEQ ID NO: 20087 - DNA, 20 bp, Artificial Sequence
  Description of Artificial Sequence: Synthetic oligonucleotide
cggacgggcccttcctccgc

SEQ ID NO: 20088 - DNA, 20 bp, Artificial Sequence
  Description of Artificial Sequence: Synthetic oligonucleotide
ggacgggcccttcctccgcg

SEQ ID NO: 20089 - DNA, 20 bp, Artificial Sequence
  Description of Artificial Sequence: Synthetic oligonucleotide
gacgggcccttcctccgcgg

SEQ ID NO: 20090 - DNA, 22 bp, Artificial Sequence
  Description of Artificial Sequence: Synthetic oligonucleotide
acgggcccttcctccgcgggta

SEQ ID NO: 20091 - DNA, 21 bp, Artificial Sequence
  Description of Artificial Sequence: Synthetic oligonucleotide
cgggcccttcctccgcgggta

SEQ ID NO: 20092 - DNA, 21 bp, Artificial Sequence
  Description of Artificial Sequence: Synthetic oligonucleotide
gggcccttcctccgcgggtac

SEQ ID NO: 20093 - DNA, 22 bp, Artificial Sequence
  Description of Artificial Sequence: Synthetic oligonucleotide
ggcccttcctccgcgggtacca

SEQ ID NO: 20094 - DNA, 22 bp, Artificial Sequence
  Description of Artificial Sequence: Synthetic oligonucleotide
gcccttcctccgcgggtaccag

SEQ ID NO: 20095 - DNA, 23 bp, Artificial Sequence
  Description of Artificial Sequence: Synthetic oligonucleotide
cccttcctccgcgggtaccagca

SEQ ID NO: 20096 - DNA, 23 bp, Artificial Sequence
  Description of Artificial Sequence: Synthetic oligonucleotide
ccttcctccgcgggtaccagcag

SEQ ID NO: 20097 - DNA, 21 bp, Artificial Sequence
  Description of Artificial Sequence: Synthetic oligonucleotide
ccagaggatggagccgcgggg

SEQ ID NO: 20098 - DNA, 21 bp, Artificial Sequence
  Description of Artificial Sequence: Synthetic oligonucleotide
cagaggatggagccgcggggg

SEQ ID NO: 20099 - DNA, 21 bp, Artificial Sequence
  Description of Artificial Sequence: Synthetic oligonucleotide
agaggatggagccgcgggggc

SEQ ID NO: 20100 - DNA, 20 bp, Artificial Sequence
  Description of Artificial Sequence: Synthetic oligonucleotide
gaggatggagccgcgggggc

SEQ ID NO: 20101 - DNA, 20 bp, Artificial Sequence
  Description of Artificial Sequence: Synthetic oligonucleotide
aggatggagccgcgggggcc

SEQ ID NO: 20102 - DNA, 20 bp, Artificial Sequence
  Description of Artificial Sequence: Synthetic oligonucleotide
ggatggagccgcgggggcct

SEQ ID NO: 20103 - DNA, 20 bp, Artificial Sequence
  Description of Artificial Sequence: Synthetic oligonucleotide
gatggagccgcgggggccgt

SEQ ID NO: 20104 - DNA, 20 bp, Artificial Sequence
  Description of Artificial Sequence: Synthetic oligonucleotide
atggagccgcgggggccgtg

SEQ ID NO: 20105 - DNA, 20 bp, Artificial Sequence
  Description of Artificial Sequence: Synthetic oligonucleotide
tggagccgcgggggccgtgt

SEQ ID NO: 20106 - DNA, 20 bp, Artificial Sequence
  Description of Artificial Sequence: Synthetic oligonucleotide
ggagccgcgggggccgtgtt

SEQ ID NO: 20107 - DNA, 21 bp, Artificial Sequence
  Description of Artificial Sequence: Synthetic oligonucleotide
gagccgcgggggccgtggata

SEQ ID NO: 20108 - DNA, 22 bp, Artificial Sequence
  Description of Artificial Sequence: Synthetic oligonucleotide
agccgcgggggccgtggataga

SEQ ID NO: 20109 - DNA, 21 bp, Artificial Sequence
  Description of Artificial Sequence: Synthetic oligonucleotide
gccgcgggggccgtggataga

SEQ ID NO: 20110 - DNA, 21 bp, Artificial Sequence
  Description of Artificial Sequence: Synthetic oligonucleotide
ccgcgggggccgtggatagag

SEQ ID NO: 20111 - DNA, 22 bp, Artificial Sequence
  Description of Artificial Sequence: Synthetic oligonucleotide
cgcgggggccgtggatagagca

SEQ ID NO: 20112 - DNA, 22 bp, Artificial Sequence
  Description of Artificial Sequence: Synthetic oligonucleotide
gcgggggccgtggatagagcag

SEQ ID NO: 20113 - DNA, 23 bp, Artificial Sequence
  Description of Artificial Sequence: Synthetic oligonucleotide
cgggggccgtggatagagcagga

SEQ ID NO: 20114 - DNA, 23 bp, Artificial Sequence
  Description of Artificial Sequence: Synthetic oligonucleotide
gggggccgtggatagagcaggag

SEQ ID NO: 20115 - DNA, 23 bp, Artificial Sequence
  Description of Artificial Sequence: Synthetic oligonucleotide
ggggccgtggatagagcaggagg

SEQ ID NO: 20116 - DNA, 23 bp, Artificial Sequence
  Description of Artificial Sequence: Synthetic oligonucleotide
gggccgtggatagagcaggaggg

SEQ ID NO: 20117 - DNA, 23 bp, Artificial Sequence
  Description of Artificial Sequence: Synthetic oligonucleotide
ggccgtggatagagcaggagggg

SEQ ID NO: 20118 - DNA, 28 bp, Artificial Sequence
  Description of Artificial Sequence: Synthetic oligonucleotide
tgaaggcccactcacagattgaccgagc

SEQ ID NO: 20119 - DNA, 27 bp, Artificial Sequence
  Description of Artificial Sequence: Synthetic oligonucleotide
gaaggcccactcacagattgaccgagc

SEQ ID NO: 20120 - DNA, 27 bp, Artificial Sequence
  Description of Artificial Sequence: Synthetic oligonucleotide
aaggcccactcacagattgaccgagcg

SEQ ID NO: 20121 - DNA, 26 bp, Artificial Sequence
  Description of Artificial Sequence: Synthetic oligonucleotide
aggcccactcacagattgaccgagcg

SEQ ID NO: 20122 - DNA, 25 bp, Artificial Sequence
  Description of Artificial Sequence: Synthetic oligonucleotide
ggcccactcacagattgaccgagcg

SEQ ID NO: 20123 - DNA, 26 bp, Artificial Sequence
  Description of Artificial Sequence: Synthetic oligonucleotide
gcccactcacagattgaccgagcgga

SEQ ID NO: 20124 - DNA, 26 bp, Artificial Sequence
  Description of Artificial Sequence: Synthetic oligonucleotide
cccactcacagattgaccgagcggac

SEQ ID NO: 20125 - DNA, 27 bp, Artificial Sequence
  Description of Artificial Sequence: Synthetic oligonucleotide
ccactcacagattgaccgagcggacct

SEQ ID NO: 20126 - DNA, 27 bp, Artificial Sequence
  Description of Artificial Sequence: Synthetic oligonucleotide
cactcacagattgaccgagcggacctg

SEQ ID NO: 20127 - DNA, 27 bp, Artificial Sequence
  Description of Artificial Sequence: Synthetic oligonucleotide
actcacagattgaccgagcggacctgg

SEQ ID NO: 20128 - DNA, 26 bp, Artificial Sequence
  Description of Artificial Sequence: Synthetic oligonucleotide
ctcacagattgaccgagcggacctgg

SEQ ID NO: 20129 - DNA, 26 bp, Artificial Sequence
  Description of Artificial Sequence: Synthetic oligonucleotide
tcacagattgaccgagcggacctggg

SEQ ID NO: 20130 - DNA, 25 bp, Artificial Sequence
  Description of Artificial Sequence: Synthetic oligonucleotide
cacagattgaccgagcggacctggg

SEQ ID NO: 20131 - DNA, 26 bp, Artificial Sequence
  Description of Artificial Sequence: Synthetic oligonucleotide
acagattgaccgagcggacctgggga

SEQ ID NO: 20132 - DNA, 25 bp, Artificial Sequence
  Description of Artificial Sequence: Synthetic oligonucleotide
cagattgaccgagcggacctgggga

SEQ ID NO: 20133 - DNA, 25 bp, Artificial Sequence
  Description of Artificial Sequence: Synthetic oligonucleotide
agattgaccgagcggacctggggac

SEQ ID NO: 20134 - DNA, 24 bp, Artificial Sequence
  Description of Artificial Sequence: Synthetic oligonucleotide
gattgaccgagcggacctggggac

SEQ ID NO: 20135 - DNA, 24 bp, Artificial Sequence
  Description of Artificial Sequence: Synthetic oligonucleotide
attgaccgagcggacctggggacc

SEQ ID NO: 20136 - DNA, 23 bp, Artificial Sequence
  Description of Artificial Sequence: Synthetic oligonucleotide
ttgaccgagcggacctggggacc

SEQ ID NO: 20137 - DNA, 25 bp, Artificial Sequence
  Description of Artificial Sequence: Synthetic oligonucleotide
aacgaggacctgcgctcttggaccc

SEQ ID NO: 20138 - DNA, 24 bp, Artificial Sequence
  Description of Artificial Sequence: Synthetic oligonucleotide
acgaggacctgcgctcttggaccc

SEQ ID NO: 20139 - DNA, 23 bp, Artificial Sequence
  Description of Artificial Sequence: Synthetic oligonucleotide
cgaggacctgcgctcttggaccc

SEQ ID NO: 20140 - DNA, 23 bp, Artificial Sequence
  Description of Artificial Sequence: Synthetic oligonucleotide
gaggacctgcgctcttggacccc

SEQ ID NO: 20141 - DNA, 23 bp, Artificial Sequence
  Description of Artificial Sequence: Synthetic oligonucleotide
aggacctgcgctcttggaccccg

SEQ ID NO: 20142 - DNA, 22 bp, Artificial Sequence
  Description of Artificial Sequence: Synthetic oligonucleotide
ggacctgcgctcttggaccccg

SEQ ID NO: 20143 - DNA, 22 bp, Artificial Sequence
  Description of Artificial Sequence: Synthetic oligonucleotide
gacctgcgctcttggaccccgg

SEQ ID NO: 20144 - DNA, 22 bp, Artificial Sequence
  Description of Artificial Sequence: Synthetic oligonucleotide
acctgcgctcttggaccccggc

SEQ ID NO: 20145 - DNA, 21 bp, Artificial Sequence
  Description of Artificial Sequence: Synthetic oligonucleotide
cctgcgctcttggaccccggc

SEQ ID NO: 20146 - DNA, 21 bp, Artificial Sequence
  Description of Artificial Sequence: Synthetic oligonucleotide
ctgcgctcttggaccccggcg

SEQ ID NO: 20147 - DNA, 22 bp, Artificial Sequence
  Description of Artificial Sequence: Synthetic oligonucleotide
tgcgctcttggaccccggcgga

SEQ ID NO: 20148 - DNA, 21 bp, Artificial Sequence
  Description of Artificial Sequence: Synthetic oligonucleotide
gcgctcttggaccccggcgga

SEQ ID NO: 20149 - DNA, 23 bp, Artificial Sequence
  Description of Artificial Sequence: Synthetic oligonucleotide
cgctcttggaccccggcggacat

SEQ ID NO: 20150 - DNA, 23 bp, Artificial Sequence
  Description of Artificial Sequence: Synthetic oligonucleotide
gctcttggaccccggcggacatg

SEQ ID NO: 20151 - DNA, 23 bp, Artificial Sequence
  Description of Artificial Sequence: Synthetic oligonucleotide
ctcttggaccccggcggacatgg

SEQ ID NO: 20152 - DNA, 23 bp, Artificial Sequence
  Description of Artificial Sequence: Synthetic oligonucleotide
tcttggaccccggcggacatggc

SEQ ID NO: 20153 - DNA, 22 bp, Artificial Sequence
  Description of Artificial Sequence: Synthetic oligonucleotide
cttggaccccggcggacatggc

SEQ ID NO: 20154 - DNA, 22 bp, Artificial Sequence
  Description of Artificial Sequence: Synthetic oligonucleotide
ttggaccccggcggacatggcg

SEQ ID NO: 20155 - DNA, 21 bp, Artificial Sequence
  Description of Artificial Sequence: Synthetic oligonucleotide
tggaccccggcggacatggcg

SEQ ID NO: 20156 - DNA, 20 bp, Artificial Sequence
  Description of Artificial Sequence: Synthetic oligonucleotide
ggaccccggcggacatggcg

SEQ ID NO: 20157 - DNA, 20 bp, Artificial Sequence
  Description of Artificial Sequence: Synthetic oligonucleotide
gaccccggcggacatggcgg

SEQ ID NO: 20158 - DNA, 21 bp, Artificial Sequence
  Description of Artificial Sequence: Synthetic oligonucleotide
accccggcggacatggcggct

SEQ ID NO: 20159 - DNA, 20 bp, Artificial Sequence
  Description of Artificial Sequence: Synthetic oligonucleotide
ccccggcggacatggcggct

SEQ ID NO: 20160 - DNA, 21 bp, Artificial Sequence
  Description of Artificial Sequence: Synthetic oligonucleotide
cccggcggacatggcggctca

SEQ ID NO: 20161 - DNA, 23 bp, Artificial Sequence
  Description of Artificial Sequence: Synthetic oligonucleotide
ccggcggacatggcggctcagat

SEQ ID NO: 20162 - DNA, 29 bp, Artificial Sequence
  Description of Artificial Sequence: Synthetic oligonucleotide
ggagtattgggacgaggagacagggaatg

SEQ ID NO: 20163 - DNA, 30 bp, Artificial Sequence
  Description of Artificial Sequence: Synthetic oligonucleotide
gagtattgggacgaggagacagggaatgtg

SEQ ID NO: 20164 - DNA, 32 bp, Artificial Sequence
  Description of Artificial Sequence: Synthetic oligonucleotide
agtattgggacgaggagacagggaatgtgaag

SEQ ID NO: 20165 - DNA, 31 bp, Artificial Sequence
  Description of Artificial Sequence: Synthetic oligonucleotide
gtattgggacgaggagacagggaatgtgaag

SEQ ID NO: 20166 - DNA, 31 bp, Artificial Sequence
  Description of Artificial Sequence: Synthetic oligonucleotide
tattgggacgaggagacagggaatgtgaagg

SEQ ID NO: 20167 - DNA, 30 bp, Artificial Sequence
  Description of Artificial Sequence: Synthetic oligonucleotide
attgggacgaggagacagggaatgtgaagg

SEQ ID NO: 20168 - DNA, 29 bp, Artificial Sequence
  Description of Artificial Sequence: Synthetic oligonucleotide
ttgggacgaggagacagggaatgtgaagg

SEQ ID NO: 20169 - DNA, 28 bp, Artificial Sequence
  Description of Artificial Sequence: Synthetic oligonucleotide
tgggacgaggagacagggaatgtgaagg

SEQ ID NO: 20170 - DNA, 27 bp, Artificial Sequence
  Description of Artificial Sequence: Synthetic oligonucleotide
gggacgaggagacagggaatgtgaagg

SEQ ID NO: 20171 - DNA, 27 bp, Artificial Sequence
  Description of Artificial Sequence: Synthetic oligonucleotide
ggacgaggagacagggaatgtgaaggc

SEQ ID NO: 20172 - DNA, 27 bp, Artificial Sequence
  Description of Artificial Sequence: Synthetic oligonucleotide
gacgaggagacagggaatgtgaaggcc

SEQ ID NO: 20173 - DNA, 27 bp, Artificial Sequence
  Description of Artificial Sequence: Synthetic oligonucleotide
acgaggagacagggaatgtgaaggccc

SEQ ID NO: 20174 - DNA, 27 bp, Artificial Sequence
  Description of Artificial Sequence: Synthetic oligonucleotide
cgaggagacagggaatgtgaaggccca

SEQ ID NO: 20175 - DNA, 27 bp, Artificial Sequence
  Description of Artificial Sequence: Synthetic oligonucleotide
gaggagacagggaatgtgaaggcccac

SEQ ID NO: 20176 - DNA, 28 bp, Artificial Sequence
  Description of Artificial Sequence: Synthetic oligonucleotide
aggagacagggaatgtgaaggcccactc

SEQ ID NO: 20177 - DNA, 27 bp, Artificial Sequence
  Description of Artificial Sequence: Synthetic oligonucleotide
ggagacagggaatgtgaaggcccactc

SEQ ID NO: 20178 - DNA, 28 bp, Artificial Sequence
  Description of Artificial Sequence: Synthetic oligonucleotide
gagacagggaatgtgaaggcccactcac

SEQ ID NO: 20179 - DNA, 29 bp, Artificial Sequence
  Description of Artificial Sequence: Synthetic oligonucleotide
agacagggaatgtgaaggcccactcacag

SEQ ID NO: 20180 - DNA, 28 bp, Artificial Sequence
  Description of Artificial Sequence: Synthetic oligonucleotide
gacagggaatgtgaaggcccactcacag

SEQ ID NO: 20181 - DNA, 31 bp, Artificial Sequence
  Description of Artificial Sequence: Synthetic oligonucleotide
acagggaatgtgaaggcccactcacagattg

SEQ ID NO: 20182 - DNA, 30 bp, Artificial Sequence
  Description of Artificial Sequence: Synthetic oligonucleotide
cagggaatgtgaaggcccactcacagattg

SEQ ID NO: 20183 - DNA, 31 bp, Artificial Sequence
  Description of Artificial Sequence: Synthetic oligonucleotide
agggaatgtgaaggcccactcacagattgac

SEQ ID NO: 20184 - DNA, 30 bp, Artificial Sequence
  Description of Artificial Sequence: Synthetic oligonucleotide
gggaatgtgaaggcccactcacagattgac

SEQ ID NO: 20185 - DNA, 24 bp, Artificial Sequence
  Description of Artificial Sequence: Synthetic oligonucleotide
gcttcatcgccgtgggctacgtgg

SEQ ID NO: 20186 - DNA, 24 bp, Artificial Sequence
  Description of Artificial Sequence: Synthetic oligonucleotide
cttcatcgccgtgggctacgtggg

SEQ ID NO: 20187 - DNA, 24 bp, Artificial Sequence
  Description of Artificial Sequence: Synthetic oligonucleotide
ttcatcgccgtgggctacgtgggc

SEQ ID NO: 20188 - DNA, 23 bp, Artificial Sequence
  Description of Artificial Sequence: Synthetic oligonucleotide
tcatcgccgtgggctacgtgggc

SEQ ID NO: 20189 - DNA, 22 bp, Artificial Sequence
  Description of Artificial Sequence: Synthetic oligonucleotide
catcgccgtgggctacgtgggc

SEQ ID NO: 20190 - DNA, 23 bp, Artificial Sequence
  Description of Artificial Sequence: Synthetic oligonucleotide
atcgccgtgggctacgtgggcga

SEQ ID NO: 20191 - DNA, 22 bp, Artificial Sequence
  Description of Artificial Sequence: Synthetic oligonucleotide
tcgccgtgggctacgtgggcga

SEQ ID NO: 20192 - DNA, 21 bp, Artificial Sequence
  Description of Artificial Sequence: Synthetic oligonucleotide
cgccgtgggctacgtgggcga

SEQ ID NO: 20193 - DNA, 22 bp, Artificial Sequence
  Description of Artificial Sequence: Synthetic oligonucleotide
gccgtgggctacgtgggcgaca

SEQ ID NO: 20194 - DNA, 22 bp, Artificial Sequence
  Description of Artificial Sequence: Synthetic oligonucleotide
ccgtgggctacgtgggcgacac

SEQ ID NO: 20195 - DNA, 22 bp, Artificial Sequence
  Description of Artificial Sequence: Synthetic oligonucleotide
cgtgggctacgtgggcgacacg

SEQ ID NO: 20196 - DNA, 23 bp, Artificial Sequence
  Description of Artificial Sequence: Synthetic oligonucleotide
gtgggctacgtgggcgacacgca

SEQ ID NO: 20197 - DNA, 25 bp, Artificial Sequence
  Description of Artificial Sequence: Synthetic oligonucleotide
tgggctacgtgggcgacacgcagtt

SEQ ID NO: 20198 - DNA, 24 bp, Artificial Sequence
  Description of Artificial Sequence: Synthetic oligonucleotide
gggctacgtgggcgacacgcagtt

SEQ ID NO: 20199 - DNA, 24 bp, Artificial Sequence
  Description of Artificial Sequence: Synthetic oligonucleotide
ggctacgtgggcgacacgcagttc

SEQ ID NO: 20200 - DNA, 25 bp, Artificial Sequence
  Description of Artificial Sequence: Synthetic oligonucleotide
gctacgtgggcgacacgcagttcgt

SEQ ID NO: 20201 - DNA, 25 bp, Artificial Sequence
  Description of Artificial Sequence: Synthetic oligonucleotide
ctacgtgggcgacacgcagttcgtg

SEQ ID NO: 20202 - DNA, 25 bp, Artificial Sequence
  Description of Artificial Sequence: Synthetic oligonucleotide
tacgtgggcgacacgcagttcgtgc

SEQ ID NO: 20203 - DNA, 24 bp, Artificial Sequence
  Description of Artificial Sequence: Synthetic oligonucleotide
acgtgggcgacacgcagttcgtgc

SEQ ID NO: 20204 - DNA, 23 bp, Artificial Sequence
  Description of Artificial Sequence: Synthetic oligonucleotide
cgtgggcgacacgcagttcgtgc

SEQ ID NO: 20205 - DNA, 23 bp, Artificial Sequence
  Description of Artificial Sequence: Synthetic oligonucleotide
gtgggcgacacgcagttcgtgcg

SEQ ID NO: 20206 - DNA, 25 bp, Artificial Sequence
  Description of Artificial Sequence: Synthetic oligonucleotide
tgggcgacacgcagttcgtgcggtt

SEQ ID NO: 20207 - DNA, 24 bp, Artificial Sequence
  Description of Artificial Sequence: Synthetic oligonucleotide
gggcgacacgcagttcgtgcggtt

SEQ ID NO: 20208 - DNA, 24 bp, Artificial Sequence
  Description of Artificial Sequence: Synthetic oligonucleotide
ggcgacacgcagttcgtgcggttc

SEQ ID NO: 20209 - DNA, 25 bp, Artificial Sequence
  Description of Artificial Sequence: Synthetic oligonucleotide
gcgacacgcagttcgtgcggttcga

SEQ ID NO: 20210 - DNA, 25 bp, Artificial Sequence
  Description of Artificial Sequence: Synthetic oligonucleotide
acggagctcgtggagaccaggccta

SEQ ID NO: 20211 - DNA, 24 bp, Artificial Sequence
  Description of Artificial Sequence: Synthetic oligonucleotide
cggagctcgtggagaccaggccta

SEQ ID NO: 20212 - DNA, 25 bp, Artificial Sequence
  Description of Artificial Sequence: Synthetic oligonucleotide
ggagctcgtggagaccaggcctaca

SEQ ID NO: 20213 - DNA, 25 bp, Artificial Sequence
  Description of Artificial Sequence: Synthetic oligonucleotide
gagctcgtggagaccaggcctacag

SEQ ID NO: 20214 - DNA, 25 bp, Artificial Sequence
  Description of Artificial Sequence: Synthetic oligonucleotide
agctcgtggagaccaggcctacagg

SEQ ID NO: 20215 - DNA, 24 bp, Artificial Sequence
  Description of Artificial Sequence: Synthetic oligonucleotide
gctcgtggagaccaggcctacagg

SEQ ID NO: 20216 - DNA, 24 bp, Artificial Sequence
  Description of Artificial Sequence: Synthetic oligonucleotide
ctcgtggagaccaggcctacaggg

SEQ ID NO: 20217 - DNA, 26 bp, Artificial Sequence
  Description of Artificial Sequence: Synthetic oligonucleotide
tcgtggagaccaggcctacaggggat

SEQ ID NO: 20218 - DNA, 25 bp, Artificial Sequence
  Description of Artificial Sequence: Synthetic oligonucleotide
cgtggagaccaggcctacaggggat

SEQ ID NO: 20219 - DNA, 25 bp, Artificial Sequence
  Description of Artificial Sequence: Synthetic oligonucleotide
gtggagaccaggcctacaggggatg

SEQ ID NO: 20220 - DNA, 27 bp, Artificial Sequence
  Description of Artificial Sequence: Synthetic oligonucleotide
tggagaccaggcctacaggggatggaa

SEQ ID NO: 20221 - DNA, 26 bp, Artificial Sequence
  Description of Artificial Sequence: Synthetic oligonucleotide
ggagaccaggcctacaggggatggaa

SEQ ID NO: 20222 - DNA, 26 bp, Artificial Sequence
  Description of Artificial Sequence: Synthetic oligonucleotide
gagaccaggcctacaggggatggaac

SEQ ID NO: 20223 - DNA, 27 bp, Artificial Sequence
  Description of Artificial Sequence: Synthetic oligonucleotide
agaccaggcctacaggggatggaacct

SEQ ID NO: 20224 - DNA, 27 bp, Artificial Sequence
  Description of Artificial Sequence: Synthetic oligonucleotide
gaccaggcctacaggggatggaacctt

SEQ ID NO: 20225 - DNA, 27 bp, Artificial Sequence
  Description of Artificial Sequence: Synthetic oligonucleotide
accaggcctacaggggatggaaccttc

SEQ ID NO: 20226 - DNA, 26 bp, Artificial Sequence
  Description of Artificial Sequence: Synthetic oligonucleotide
ccaggcctacaggggatggaaccttc

SEQ ID NO: 20227 - DNA, 27 bp, Artificial Sequence
  Description of Artificial Sequence: Synthetic oligonucleotide
caggcctacaggggatggaaccttcca

SEQ ID NO: 20228 - DNA, 27 bp, Artificial Sequence
  Description of Artificial Sequence: Synthetic oligonucleotide
aggcctacaggggatggaaccttccag

SEQ ID NO: 20229 - DNA, 27 bp, Artificial Sequence
  Description of Artificial Sequence: Synthetic oligonucleotide
ggcctacaggggatggaaccttccaga

SEQ ID NO: 20230 - DNA, 28 bp, Artificial Sequence
  Description of Artificial Sequence: Synthetic oligonucleotide
gcctacaggggatggaaccttccagaag

SEQ ID NO: 20231 - DNA, 29 bp, Artificial Sequence
  Description of Artificial Sequence: Synthetic oligonucleotide
cctacaggggatggaaccttccagaagtg

SEQ ID NO: 20232 - DNA, 29 bp, Artificial Sequence
  Description of Artificial Sequence: Synthetic oligonucleotide
ctacaggggatggaaccttccagaagtgg

SEQ ID NO: 20233 - DNA, 29 bp, Artificial Sequence
  Description of Artificial Sequence: Synthetic oligonucleotide
tacaggggatggaaccttccagaagtggg

SEQ ID NO: 20234 - DNA, 28 bp, Artificial Sequence
  Description of Artificial Sequence: Synthetic oligonucleotide
acaggggatggaaccttccagaagtggg

SEQ ID NO: 20235 - DNA, 25 bp, Artificial Sequence
  Description of Artificial Sequence: Synthetic oligonucleotide
ttcatcgccgtgggctacgtggacg

SEQ ID NO: 20236 - DNA, 24 bp, Artificial Sequence
  Description of Artificial Sequence: Synthetic oligonucleotide
tcatcgccgtgggctacgtggacg

SEQ ID NO: 20237 - DNA, 23 bp, Artificial Sequence
  Description of Artificial Sequence: Synthetic oligonucleotide
catcgccgtgggctacgtggacg

SEQ ID NO: 20238 - DNA, 23 bp, Artificial Sequence
  Description of Artificial Sequence: Synthetic oligonucleotide
atcgccgtgggctacgtggacgc

SEQ ID NO: 20239 - DNA, 22 bp, Artificial Sequence
  Description of Artificial Sequence: Synthetic oligonucleotide
tcgccgtgggctacgtggacgc

SEQ ID NO: 20240 - DNA, 21 bp, Artificial Sequence
  Description of Artificial Sequence: Synthetic oligonucleotide
cgccgtgggctacgtggacgc

SEQ ID NO: 20241 - DNA, 22 bp, Artificial Sequence
  Description of Artificial Sequence: Synthetic oligonucleotide
gccgtgggctacgtggacgcca

SEQ ID NO: 20242 - DNA, 22 bp, Artificial Sequence
  Description of Artificial Sequence: Synthetic oligonucleotide
ccgtgggctacgtggacgccac

SEQ ID NO: 20243 - DNA, 22 bp, Artificial Sequence
  Description of Artificial Sequence: Synthetic oligonucleotide
cgtgggctacgtggacgccacg

SEQ ID NO: 20244 - DNA, 23 bp, Artificial Sequence
  Description of Artificial Sequence: Synthetic oligonucleotide
gtgggctacgtggacgccacgca

SEQ ID NO: 20245 - DNA, 25 bp, Artificial Sequence
  Description of Artificial Sequence: Synthetic oligonucleotide
tgggctacgtggacgccacgcagtt

SEQ ID NO: 20246 - DNA, 24 bp, Artificial Sequence
  Description of Artificial Sequence: Synthetic oligonucleotide
gggctacgtggacgccacgcagtt

SEQ ID NO: 20247 - DNA, 24 bp, Artificial Sequence
  Description of Artificial Sequence: Synthetic oligonucleotide
ggctacgtggacgccacgcagttc

SEQ ID NO: 20248 - DNA, 25 bp, Artificial Sequence
  Description of Artificial Sequence: Synthetic oligonucleotide
gctacgtggacgccacgcagttcgt

SEQ ID NO: 20249 - DNA, 25 bp, Artificial Sequence
  Description of Artificial Sequence: Synthetic oligonucleotide
ctacgtggacgccacgcagttcgtg

SEQ ID NO: 20250 - DNA, 25 bp, Artificial Sequence
  Description of Artificial Sequence: Synthetic oligonucleotide
tacgtggacgccacgcagttcgtgc

SEQ ID NO: 20251 - DNA, 24 bp, Artificial Sequence
  Description of Artificial Sequence: Synthetic oligonucleotide
acgtggacgccacgcagttcgtgc

SEQ ID NO: 20252 - DNA, 23 bp, Artificial Sequence
  Description of Artificial Sequence: Synthetic oligonucleotide
cgtggacgccacgcagttcgtgc

SEQ ID NO: 20253 - DNA, 23 bp, Artificial Sequence
  Description of Artificial Sequence: Synthetic oligonucleotide
gtggacgccacgcagttcgtgcg

SEQ ID NO: 20254 - DNA, 25 bp, Artificial Sequence
  Description of Artificial Sequence: Synthetic oligonucleotide
tggacgccacgcagttcgtgcggtt

SEQ ID NO: 20255 - DNA, 24 bp, Artificial Sequence
  Description of Artificial Sequence: Synthetic oligonucleotide
ggacgccacgcagttcgtgcggtt

SEQ ID NO: 20256 - DNA, 24 bp, Artificial Sequence
  Description of Artificial Sequence: Synthetic oligonucleotide
gacgccacgcagttcgtgcggttc

SEQ ID NO: 20257 - DNA, 25 bp, Artificial Sequence
  Description of Artificial Sequence: Synthetic oligonucleotide
acgccacgcagttcgtgcggttcga

SEQ ID NO: 20258 - DNA, 24 bp, Artificial Sequence
  Description of Artificial Sequence: Synthetic oligonucleotide
cgccacgcagttcgtgcggttcga

SEQ ID NO: 20259 - DNA, 25 bp, Artificial Sequence
  Description of Artificial Sequence: Synthetic oligonucleotide
gccacgcagttcgtgcggttcgaca

SEQ ID NO: 20260 - DNA, 25 bp, Artificial Sequence
  Description of Artificial Sequence: Synthetic oligonucleotide
ccacgcagttcgtgcggttcgacag

SEQ ID NO: 20261 - DNA, 24 bp, Artificial Sequence
  Description of Artificial Sequence: Synthetic oligonucleotide
tatggctgcgacgtggggtcggag

SEQ ID NO: 20262 - DNA, 23 bp, Artificial Sequence
  Description of Artificial Sequence: Synthetic oligonucleotide
atggctgcgacgtggggtcggag

SEQ ID NO: 20263 - DNA, 22 bp, Artificial Sequence
  Description of Artificial Sequence: Synthetic oligonucleotide
tggctgcgacgtggggtcggag

SEQ ID NO: 20264 - DNA, 21 bp, Artificial Sequence
  Description of Artificial Sequence: Synthetic oligonucleotide
ggctgcgacgtggggtcggag

SEQ ID NO: 20265 - DNA, 21 bp, Artificial Sequence
  Description of Artificial Sequence: Synthetic oligonucleotide
gctgcgacgtggggtcggagg

SEQ ID NO: 20266 - DNA, 21 bp, Artificial Sequence
  Description of Artificial Sequence: Synthetic oligonucleotide
ctgcgacgtggggtcggaggg

SEQ ID NO: 20267 - DNA, 21 bp, Artificial Sequence
  Description of Artificial Sequence: Synthetic oligonucleotide
tgcgacgtggggtcggagggg

SEQ ID NO: 20268 - DNA, 20 bp, Artificial Sequence
  Description of Artificial Sequence: Synthetic oligonucleotide
gcgacgtggggtcggagggg

SEQ ID NO: 20269 - DNA, 20 bp, Artificial Sequence
  Description of Artificial Sequence: Synthetic oligonucleotide
cgacgtggggtcggaggggc

SEQ ID NO: 20270 - DNA, 20 bp, Artificial Sequence
  Description of Artificial Sequence: Synthetic oligonucleotide
gacgtggggtcggaggggcg

SEQ ID NO: 20271 - DNA, 22 bp, Artificial Sequence
  Description of Artificial Sequence: Synthetic oligonucleotide
acgtggggtcggaggggcgctt

SEQ ID NO: 20272 - DNA, 21 bp, Artificial Sequence
  Description of Artificial Sequence: Synthetic oligonucleotide
cgtggggtcggaggggcgctt

SEQ ID NO: 20273 - DNA, 21 bp, Artificial Sequence
  Description of Artificial Sequence: Synthetic oligonucleotide
gtggggtcggaggggcgcttc

SEQ ID NO: 20274 - DNA, 22 bp, Artificial Sequence
  Description of Artificial Sequence: Synthetic oligonucleotide
tggggtcggaggggcgcttcct

SEQ ID NO: 20275 - DNA, 21 bp, Artificial Sequence
  Description of Artificial Sequence: Synthetic oligonucleotide
ggggtcggaggggcgcttcct

SEQ ID NO: 20276 - DNA, 21 bp, Artificial Sequence
  Description of Artificial Sequence: Synthetic oligonucleotide
gggtcggaggggcgcttcctc

SEQ ID NO: 20277 - DNA, 21 bp, Artificial Sequence
  Description of Artificial Sequence: Synthetic oligonucleotide
ggtcggaggggcgcttcctcc

SEQ ID NO: 20278 - DNA, 21 bp, Artificial Sequence
  Description of Artificial Sequence: Synthetic oligonucleotide
gtcggaggggcgcttcctccg

SEQ ID NO: 20279 - DNA, 21 bp, Artificial Sequence
  Description of Artificial Sequence: Synthetic oligonucleotide
tcggaggggcgcttcctccgc

SEQ ID NO: 20280 - DNA, 20 bp, Artificial Sequence
  Description of Artificial Sequence: Synthetic oligonucleotide
cggaggggcgcttcctccgc

SEQ ID NO: 20281 - DNA, 20 bp, Artificial Sequence
  Description of Artificial Sequence: Synthetic oligonucleotide
ggaggggcgcttcctccgcg

SEQ ID NO: 20282 - DNA, 20 bp, Artificial Sequence
  Description of Artificial Sequence: Synthetic oligonucleotide
gaggggcgcttcctccgcgg

SEQ ID NO: 20283 - DNA, 22 bp, Artificial Sequence
  Description of Artificial Sequence: Synthetic oligonucleotide
aggggcgcttcctccgcgggta

SEQ ID NO: 20284 - DNA, 21 bp, Artificial Sequence
  Description of Artificial Sequence: Synthetic oligonucleotide
ggggcgcttcctccgcgggta

SEQ ID NO: 20285 - DNA, 20 bp, Artificial Sequence
  Description of Artificial Sequence: Synthetic oligonucleotide
gtggggtcggacgggcgcgt

SEQ ID NO: 20286 - DNA, 20 bp, Artificial Sequence
  Description of Artificial Sequence: Synthetic oligonucleotide
tggggtcggacgggcgcgtc

SEQ ID NO: 20287 - DNA, 20 bp, Artificial Sequence
  Description of Artificial Sequence: Synthetic oligonucleotide
ggggtcggacgggcgcgtct

SEQ ID NO: 20288 - DNA, 20 bp, Artificial Sequence
  Description of Artificial Sequence: Synthetic oligonucleotide
gggtcggacgggcgcgtcct

SEQ ID NO: 20289 - DNA, 20 bp, Artificial Sequence
  Description of Artificial Sequence: Synthetic oligonucleotide
ggtcggacgggcgcgtcctc

SEQ ID NO: 20290 - DNA, 20 bp, Artificial Sequence
  Description of Artificial Sequence: Synthetic oligonucleotide
gtcggacgggcgcgtcctcc

SEQ ID NO: 20291 - DNA, 20 bp, Artificial Sequence
  Description of Artificial Sequence: Synthetic oligonucleotide
tcggacgggcgcgtcctccg

SEQ ID NO: 20292 - DNA, 20 bp, Artificial Sequence
  Description of Artificial Sequence: Synthetic oligonucleotide
cggacgggcgcgtcctccgt

SEQ ID NO: 20293 - DNA, 20 bp, Artificial Sequence
  Description of Artificial Sequence: Synthetic oligonucleotide
ggacgggcgcgtcctccgct

SEQ ID NO: 20294 - DNA, 20 bp, Artificial Sequence
  Description of Artificial Sequence: Synthetic oligonucleotide
gacgggcgcgtcctccgcgt

SEQ ID NO: 20295 - DNA, 20 bp, Artificial Sequence
  Description of Artificial Sequence: Synthetic oligonucleotide
acgggcgcgtcctccgcggt

SEQ ID NO: 20296 - DNA, 20 bp, Artificial Sequence
  Description of Artificial Sequence: Synthetic oligonucleotide
cgggcgcgtcctccgcggtt

SEQ ID NO: 20297 - DNA, 20 bp, Artificial Sequence
  Description of Artificial Sequence: Synthetic oligonucleotide
gggcgcgtcctccgcgggta

SEQ ID NO: 20298 - DNA, 20 bp, Artificial Sequence
  Description of Artificial Sequence: Synthetic oligonucleotide
ggcgcgtcctccgcgggtac

SEQ ID NO: 20299 - DNA, 21 bp, Artificial Sequence
  Description of Artificial Sequence: Synthetic oligonucleotide
gcgcgtcctccgcgggtacca

SEQ ID NO: 20300 - DNA, 21 bp, Artificial Sequence
  Description of Artificial Sequence: Synthetic oligonucleotide
cgcgtcctccgcgggtaccag

SEQ ID NO: 20301 - DNA, 22 bp, Artificial Sequence
  Description of Artificial Sequence: Synthetic oligonucleotide
gcgtcctccgcgggtaccagca

SEQ ID NO: 20302 - DNA, 22 bp, Artificial Sequence
  Description of Artificial Sequence: Synthetic oligonucleotide
cgtcctccgcgggtaccagcag

SEQ ID NO: 20303 - DNA, 23 bp, Artificial Sequence
  Description of Artificial Sequence: Synthetic oligonucleotide
gtcctccgcgggtaccagcagga

SEQ ID NO: 20304 - DNA, 32 bp, Artificial Sequence
  Description of Artificial Sequence: Synthetic oligonucleotide
aaggattacatcgccttgaacgaggacctgtg

SEQ ID NO: 20305 - DNA, 31 bp, Artificial Sequence
  Description of Artificial Sequence: Synthetic oligonucleotide
aggattacatcgccttgaacgaggacctgtg

SEQ ID NO: 20306 - DNA, 30 bp, Artificial Sequence
  Description of Artificial Sequence: Synthetic oligonucleotide
ggattacatcgccttgaacgaggacctgtg

SEQ ID NO: 20307 - DNA, 30 bp, Artificial Sequence
  Description of Artificial Sequence: Synthetic oligonucleotide
gattacatcgccttgaacgaggacctgtgc

SEQ ID NO: 20308 - DNA, 31 bp, Artificial Sequence
  Description of Artificial Sequence: Synthetic oligonucleotide
attacatcgccttgaacgaggacctgtgctc

SEQ ID NO: 20309 - DNA, 30 bp, Artificial Sequence
  Description of Artificial Sequence: Synthetic oligonucleotide
ttacatcgccttgaacgaggacctgtgctc

SEQ ID NO: 20310 - DNA, 29 bp, Artificial Sequence
  Description of Artificial Sequence: Synthetic oligonucleotide
tacatcgccttgaacgaggacctgtgctc

SEQ ID NO: 20311 - DNA, 28 bp, Artificial Sequence
  Description of Artificial Sequence: Synthetic oligonucleotide
acatcgccttgaacgaggacctgtgctc

SEQ ID NO: 20312 - DNA, 27 bp, Artificial Sequence
  Description of Artificial Sequence: Synthetic oligonucleotide
catcgccttgaacgaggacctgtgctc

SEQ ID NO: 20313 - DNA, 29 bp, Artificial Sequence
  Description of Artificial Sequence: Synthetic oligonucleotide
atcgccttgaacgaggacctgtgctcttg

SEQ ID NO: 20314 - DNA, 28 bp, Artificial Sequence
  Description of Artificial Sequence: Synthetic oligonucleotide
tcgccttgaacgaggacctgtgctcttg

SEQ ID NO: 20315 - DNA, 27 bp, Artificial Sequence
  Description of Artificial Sequence: Synthetic oligonucleotide
cgccttgaacgaggacctgtgctcttg

SEQ ID NO: 20316 - DNA, 27 bp, Artificial Sequence
  Description of Artificial Sequence: Synthetic oligonucleotide
gccttgaacgaggacctgtgctcttgg

SEQ ID NO: 20317 - DNA, 28 bp, Artificial Sequence
  Description of Artificial Sequence: Synthetic oligonucleotide
ccttgaacgaggacctgtgctcttggac

SEQ ID NO: 20318 - DNA, 28 bp, Artificial Sequence
  Description of Artificial Sequence: Synthetic oligonucleotide
cttgaacgaggacctgtgctcttggacc

SEQ ID NO: 20319 - DNA, 28 bp, Artificial Sequence
  Description of Artificial Sequence: Synthetic oligonucleotide
ttgaacgaggacctgtgctcttggaccg

SEQ ID NO: 20320 - DNA, 27 bp, Artificial Sequence
  Description of Artificial Sequence: Synthetic oligonucleotide
tgaacgaggacctgtgctcttggaccg

SEQ ID NO: 20321 - DNA, 26 bp, Artificial Sequence
  Description of Artificial Sequence: Synthetic oligonucleotide
gaacgaggacctgtgctcttggaccg

SEQ ID NO: 20322 - DNA, 26 bp, Artificial Sequence
  Description of Artificial Sequence: Synthetic oligonucleotide
aacgaggacctgtgctcttggaccgc

SEQ ID NO: 20323 - DNA, 25 bp, Artificial Sequence
  Description of Artificial Sequence: Synthetic oligonucleotide
acgaggacctgtgctcttggaccgc

SEQ ID NO: 20324 - DNA, 24 bp, Artificial Sequence
  Description of Artificial Sequence: Synthetic oligonucleotide
cgaggacctgtgctcttggaccgc

SEQ ID NO: 20325 - DNA, 24 bp, Artificial Sequence
  Description of Artificial Sequence: Synthetic oligonucleotide
gaggacctgtgctcttggaccgcg

SEQ ID NO: 20326 - DNA, 24 bp, Artificial Sequence
  Description of Artificial Sequence: Synthetic oligonucleotide
aggacctgtgctcttggaccgcgg

SEQ ID NO: 20327 - DNA, 23 bp, Artificial Sequence
  Description of Artificial Sequence: Synthetic oligonucleotide
ggacctgtgctcttggaccgcgg

SEQ ID NO: 20328 - DNA, 23 bp, Artificial Sequence
  Description of Artificial Sequence: Synthetic oligonucleotide
gacctgtgctcttggaccgcggc

SEQ ID NO: 20329 - DNA, 23 bp, Artificial Sequence
  Description of Artificial Sequence: Synthetic oligonucleotide
acctgtgctcttggaccgcggcg

SEQ ID NO: 20330 - DNA, 22 bp, Artificial Sequence
  Description of Artificial Sequence: Synthetic oligonucleotide
cctgtgctcttggaccgcggcg

SEQ ID NO: 20331 - DNA, 23 bp, Artificial Sequence
  Description of Artificial Sequence: Synthetic oligonucleotide
ctgtgctcttggaccgcggcgga

SEQ ID NO: 20332 - DNA, 25 bp, Artificial Sequence
  Description of Artificial Sequence: Synthetic oligonucleotide
tgtgctcttggaccgcggcggacat

SEQ ID NO: 20333 - DNA, 24 bp, Artificial Sequence
  Description of Artificial Sequence: Synthetic oligonucleotide
gtgctcttggaccgcggcggacat

SEQ ID NO: 20334 - DNA, 24 bp, Artificial Sequence
  Description of Artificial Sequence: Synthetic oligonucleotide
tgctcttggaccgcggcggacatg

SEQ ID NO: 20335 - DNA, 24 bp, Artificial Sequence
  Description of Artificial Sequence: Synthetic oligonucleotide
atggccatcatggcgccccgaacc

SEQ ID NO: 20336 - DNA, 23 bp, Artificial Sequence
  Description of Artificial Sequence: Synthetic oligonucleotide
tggccatcatggcgccccgaacc

SEQ ID NO: 20337 - DNA, 22 bp, Artificial Sequence
  Description of Artificial Sequence: Synthetic oligonucleotide
ggccatcatggcgccccgaacc

SEQ ID NO: 20338 - DNA, 23 bp, Artificial Sequence
  Description of Artificial Sequence: Synthetic oligonucleotide
gccatcatggcgccccgaaccct

SEQ ID NO: 20339 - DNA, 23 bp, Artificial Sequence
  Description of Artificial Sequence: Synthetic oligonucleotide
ccatcatggcgccccgaaccctc

SEQ ID NO: 20340 - DNA, 24 bp, Artificial Sequence
  Description of Artificial Sequence: Synthetic oligonucleotide
catcatggcgccccgaaccctcgt

SEQ ID NO: 20341 - DNA, 24 bp, Artificial Sequence
  Description of Artificial Sequence: Synthetic oligonucleotide
atcatggcgccccgaaccctcgtc

SEQ ID NO: 20342 - DNA, 27 bp, Artificial Sequence
  Description of Artificial Sequence: Synthetic oligonucleotide
cggaacacacggaaagtgaaggcccag

SEQ ID NO: 20343 - DNA, 28 bp, Artificial Sequence
  Description of Artificial Sequence: Synthetic oligonucleotide
ggaacacacggaaagtgaaggcccagtc

SEQ ID NO: 20344 - DNA, 29 bp, Artificial Sequence
  Description of Artificial Sequence: Synthetic oligonucleotide
gaacacacggaaagtgaaggcccagtcac

SEQ ID NO: 20345 - DNA, 30 bp, Artificial Sequence
  Description of Artificial Sequence: Synthetic oligonucleotide
aacacacggaaagtgaaggcccagtcacag

SEQ ID NO: 20346 - DNA, 29 bp, Artificial Sequence
  Description of Artificial Sequence: Synthetic oligonucleotide
acacacggaaagtgaaggcccagtcacag

SEQ ID NO: 20347 - DNA, 28 bp, Artificial Sequence
  Description of Artificial Sequence: Synthetic oligonucleotide
cacacggaaagtgaaggcccagtcacag

SEQ ID NO: 20348 - DNA, 23 bp, Artificial Sequence
  Description of Artificial Sequence: Synthetic oligonucleotide
agcgcacggacgcccccaagaca

SEQ ID NO: 20349 - DNA, 22 bp, Artificial Sequence
  Description of Artificial Sequence: Synthetic oligonucleotide
gcgcacggacgcccccaagaca

SEQ ID NO: 20350 - DNA, 26 bp, Artificial Sequence
  Description of Artificial Sequence: Synthetic oligonucleotide
cgcacggacgcccccaagacacatat

SEQ ID NO: 20351 - DNA, 27 bp, Artificial Sequence
  Description of Artificial Sequence: Synthetic oligonucleotide
gcacggacgcccccaagacacatatga

SEQ ID NO: 20352 - DNA, 27 bp, Artificial Sequence
  Description of Artificial Sequence: Synthetic oligonucleotide
cacggacgcccccaagacacatatgac

SEQ ID NO: 20353 - DNA, 28 bp, Artificial Sequence
  Description of Artificial Sequence: Synthetic oligonucleotide
acggacgcccccaagacacatatgactc

SEQ ID NO: 20354 - DNA, 27 bp, Artificial Sequence
  Description of Artificial Sequence: Synthetic oligonucleotide
cggacgcccccaagacacatatgactc

SEQ ID NO: 20355 - DNA, 28 bp, Artificial Sequence
  Description of Artificial Sequence: Synthetic oligonucleotide
ggacgcccccaagacacatatgactcac

SEQ ID NO: 20356 - DNA, 28 bp, Artificial Sequence
  Description of Artificial Sequence: Synthetic oligonucleotide
gacgcccccaagacacatatgactcacc

SEQ ID NO: 20357 - DNA, 29 bp, Artificial Sequence
  Description of Artificial Sequence: Synthetic oligonucleotide
acgcccccaagacacatatgactcaccac

SEQ ID NO: 20358 - DNA, 28 bp, Artificial Sequence
  Description of Artificial Sequence: Synthetic oligonucleotide
cgcccccaagacacatatgactcaccac

SEQ ID NO: 20359 - DNA, 28 bp, Artificial Sequence
  Description of Artificial Sequence: Synthetic oligonucleotide
gcccccaagacacatatgactcaccacg

SEQ ID NO: 20360 - DNA, 28 bp, Artificial Sequence
  Description of Artificial Sequence: Synthetic oligonucleotide
cccccaagacacatatgactcaccacgc

SEQ ID NO: 20361 - DNA, 29 bp, Artificial Sequence
  Description of Artificial Sequence: Synthetic oligonucleotide
ccccaagacacatatgactcaccacgctg

SEQ ID NO: 20362 - DNA, 30 bp, Artificial Sequence
  Description of Artificial Sequence: Synthetic oligonucleotide
cccaagacacatatgactcaccacgctgtc

SEQ ID NO: 20363 - DNA, 31 bp, Artificial Sequence
  Description of Artificial Sequence: Synthetic oligonucleotide
ccaagacacatatgactcaccacgctgtctc

SEQ ID NO: 20364 - DNA, 32 bp, Artificial Sequence
  Description of Artificial Sequence: Synthetic oligonucleotide
caagacacatatgactcaccacgctgtctctg

SEQ ID NO: 20365 - DNA, 33 bp, Artificial Sequence
  Description of Artificial Sequence: Synthetic oligonucleotide
aagacacatatgactcaccacgctgtctctgac

SEQ ID NO: 20366 - DNA, 32 bp, Artificial Sequence
  Description of Artificial Sequence: Synthetic oligonucleotide
agacacatatgactcaccacgctgtctctgac

SEQ ID NO: 20367 - DNA, 31 bp, Artificial Sequence
  Description of Artificial Sequence: Synthetic oligonucleotide
gacacatatgactcaccacgctgtctctgac

SEQ ID NO: 20368 - DNA, 31 bp, Artificial Sequence
  Description of Artificial Sequence: Synthetic oligonucleotide
acacatatgactcaccacgctgtctctgacc

SEQ ID NO: 20369 - DNA, 30 bp, Artificial Sequence
  Description of Artificial Sequence: Synthetic oligonucleotide
cacatatgactcaccacgctgtctctgacc

SEQ ID NO: 20370 - DNA, 32 bp, Artificial Sequence
  Description of Artificial Sequence: Synthetic oligonucleotide
acatatgactcaccacgctgtctctgaccatg

SEQ ID NO: 20371 - DNA, 24 bp, Artificial Sequence
  Description of Artificial Sequence: Synthetic oligonucleotide
cccaccatccccatcgtgggcatc

SEQ ID NO: 20372 - DNA, 26 bp, Artificial Sequence
  Description of Artificial Sequence: Synthetic oligonucleotide
ccaccatccccatcgtgggcatcctt

SEQ ID NO: 20373 - DNA, 26 bp, Artificial Sequence
  Description of Artificial Sequence: Synthetic oligonucleotide
caccatccccatcgtgggcatccttg

SEQ ID NO: 20374 - DNA, 27 bp, Artificial Sequence
  Description of Artificial Sequence: Synthetic oligonucleotide
accatccccatcgtgggcatccttgct

SEQ ID NO: 20375 - DNA, 26 bp, Artificial Sequence
  Description of Artificial Sequence: Synthetic oligonucleotide
ccatccccatcgtgggcatccttgct

SEQ ID NO: 20376 - DNA, 26 bp, Artificial Sequence
  Description of Artificial Sequence: Synthetic oligonucleotide
catccccatcgtgggcatccttgctg

SEQ ID NO: 20377 - DNA, 26 bp, Artificial Sequence
  Description of Artificial Sequence: Synthetic oligonucleotide
atccccatcgtgggcatccttgctgg

SEQ ID NO: 20378 - DNA, 25 bp, Artificial Sequence
  Description of Artificial Sequence: Synthetic oligonucleotide
tccccatcgtgggcatccttgctgg

SEQ ID NO: 20379 - DNA, 24 bp, Artificial Sequence
  Description of Artificial Sequence: Synthetic oligonucleotide
ccccatcgtgggcatccttgctgg

SEQ ID NO: 20380 - DNA, 24 bp, Artificial Sequence
  Description of Artificial Sequence: Synthetic oligonucleotide
cccatcgtgggcatccttgctggc

SEQ ID NO: 20381 - DNA, 25 bp, Artificial Sequence
  Description of Artificial Sequence: Synthetic oligonucleotide
ccatcgtgggcatccttgctggcct

SEQ ID NO: 20382 - DNA, 25 bp, Artificial Sequence
  Description of Artificial Sequence: Synthetic oligonucleotide
catcgtgggcatccttgctggcctg

SEQ ID NO: 20383 - DNA, 27 bp, Artificial Sequence
  Description of Artificial Sequence: Synthetic oligonucleotide
atcgtgggcatccttgctggcctggtt

SEQ ID NO: 20384 - DNA, 26 bp, Artificial Sequence
  Description of Artificial Sequence: Synthetic oligonucleotide
tcgtgggcatccttgctggcctggtt

SEQ ID NO: 20385 - DNA, 25 bp, Artificial Sequence
  Description of Artificial Sequence: Synthetic oligonucleotide
cgtgggcatccttgctggcctggtt

SEQ ID NO: 20386 - DNA, 26 bp, Artificial Sequence
  Description of Artificial Sequence: Synthetic oligonucleotide
gtgggcatccttgctggcctggttct

SEQ ID NO: 20387 - DNA, 27 bp, Artificial Sequence
  Description of Artificial Sequence: Synthetic oligonucleotide
tgggcatccttgctggcctggttctct

SEQ ID NO: 20388 - DNA, 27 bp, Artificial Sequence
  Description of Artificial Sequence: Synthetic oligonucleotide
gggcatccttgctggcctggttctctt

SEQ ID NO: 20389 - DNA, 28 bp, Artificial Sequence
  Description of Artificial Sequence: Synthetic oligonucleotide
ggcatccttgctggcctggttctctttg

SEQ ID NO: 20390 - DNA, 28 bp, Artificial Sequence
  Description of Artificial Sequence: Synthetic oligonucleotide
gcatccttgctggcctggttctctttgg

SEQ ID NO: 20391 - DNA, 29 bp, Artificial Sequence
  Description of Artificial Sequence: Synthetic oligonucleotide
catccttgctggcctggttctctttggag

SEQ ID NO: 20392 - DNA, 29 bp, Artificial Sequence
  Description of Artificial Sequence: Synthetic oligonucleotide
atccttgctggcctggttctctttggagc

SEQ ID NO: 20393 - DNA, 28 bp, Artificial Sequence
  Description of Artificial Sequence: Synthetic oligonucleotide
tccttgctggcctggttctctttggagc

SEQ ID NO: 20394 - DNA, 27 bp, Artificial Sequence
  Description of Artificial Sequence: Synthetic oligonucleotide
ccttgctggcctggttctctttggagc

SEQ ID NO: 20395 - DNA, 28 bp, Artificial Sequence
  Description of Artificial Sequence: Synthetic oligonucleotide
cttgctggcctggttctctttggagctg

SEQ ID NO: 20396 - DNA, 27 bp, Artificial Sequence
  Description of Artificial Sequence: Synthetic oligonucleotide
tcacagactgaccgagtggacctgggt

SEQ ID NO: 20397 - DNA, 27 bp, Artificial Sequence
  Description of Artificial Sequence: Synthetic oligonucleotide
cacagactgaccgagtggacctgggta

SEQ ID NO: 20398 - DNA, 27 bp, Artificial Sequence
  Description of Artificial Sequence: Synthetic oligonucleotide
acagactgaccgagtggacctgggtac

SEQ ID NO: 20399 - DNA, 26 bp, Artificial Sequence
  Description of Artificial Sequence: Synthetic oligonucleotide
cagactgaccgagtggacctgggtac

SEQ ID NO: 20400 - DNA, 26 bp, Artificial Sequence
  Description of Artificial Sequence: Synthetic oligonucleotide
agactgaccgagtggacctgggtacc

SEQ ID NO: 20401 - DNA, 25 bp, Artificial Sequence
  Description of Artificial Sequence: Synthetic oligonucleotide
gactgaccgagtggacctgggtacc

SEQ ID NO: 20402 - DNA, 26 bp, Artificial Sequence
  Description of Artificial Sequence: Synthetic oligonucleotide
actgaccgagtggacctgggtaccct

SEQ ID NO: 20403 - DNA, 25 bp, Artificial Sequence
  Description of Artificial Sequence: Synthetic oligonucleotide
ctgaccgagtggacctgggtaccct

SEQ ID NO: 20404 - DNA, 25 bp, Artificial Sequence
  Description of Artificial Sequence: Synthetic oligonucleotide
tgaccgagtggacctgggtaccctg

SEQ ID NO: 20405 - DNA, 24 bp, Artificial Sequence
  Description of Artificial Sequence: Synthetic oligonucleotide
gaccgagtggacctgggtaccctg

SEQ ID NO: 20406 - DNA, 24 bp, Artificial Sequence
  Description of Artificial Sequence: Synthetic oligonucleotide
accgagtggacctgggtaccctgc

SEQ ID NO: 20407 - DNA, 23 bp, Artificial Sequence
  Description of Artificial Sequence: Synthetic oligonucleotide
ccgagtggacctgggtaccctgc

SEQ ID NO: 20408 - DNA, 23 bp, Artificial Sequence
  Description of Artificial Sequence: Synthetic oligonucleotide
cgagtggacctgggtaccctgcg

SEQ ID NO: 20409 - DNA, 23 bp, Artificial Sequence
  Description of Artificial Sequence: Synthetic oligonucleotide
gagtggacctgggtaccctgcgc

SEQ ID NO: 20410 - DNA, 23 bp, Artificial Sequence
  Description of Artificial Sequence: Synthetic oligonucleotide
agtggacctgggtaccctgcgcg

SEQ ID NO: 20411 - DNA, 22 bp, Artificial Sequence
  Description of Artificial Sequence: Synthetic oligonucleotide
gtggacctgggtaccctgcgcg

SEQ ID NO: 20412 - DNA, 22 bp, Artificial Sequence
  Description of Artificial Sequence: Synthetic oligonucleotide
tggacctgggtaccctgcgcgg

SEQ ID NO: 20413 - DNA, 21 bp, Artificial Sequence
  Description of Artificial Sequence: Synthetic oligonucleotide
ggacctgggtaccctgcgcgg

SEQ ID NO: 20414 - DNA, 23 bp, Artificial Sequence
  Description of Artificial Sequence: Synthetic oligonucleotide
gacctgggtaccctgcgcggcta

SEQ ID NO: 20415 - DNA, 25 bp, Artificial Sequence
  Description of Artificial Sequence: Synthetic oligonucleotide
acctgggtaccctgcgcggctacta

SEQ ID NO: 20416 - DNA, 24 bp, Artificial Sequence
  Description of Artificial Sequence: Synthetic oligonucleotide
cctgggtaccctgcgcggctacta

SEQ ID NO: 20417 - DNA, 26 bp, Artificial Sequence
  Description of Artificial Sequence: Synthetic oligonucleotide
ctgggtaccctgcgcggctactacaa

SEQ ID NO: 20418 - DNA, 26 bp, Artificial Sequence
  Description of Artificial Sequence: Synthetic oligonucleotide
tgggtaccctgcgcggctactacaac

SEQ ID NO: 20419 - DNA, 25 bp, Artificial Sequence
  Description of Artificial Sequence: Synthetic oligonucleotide
gggtaccctgcgcggctactacaac

SEQ ID NO: 20420 - DNA, 26 bp, Artificial Sequence
  Description of Artificial Sequence: Synthetic oligonucleotide
ggtaccctgcgcggctactacaacca

SEQ ID NO: 20421 - DNA, 27 bp, Artificial Sequence
  Description of Artificial Sequence: Synthetic oligonucleotide
gtaccctgcgcggctactacaaccaga

SEQ ID NO: 20422 - DNA, 27 bp, Artificial Sequence
  Description of Artificial Sequence: Synthetic oligonucleotide
taccctgcgcggctactacaaccagag

SEQ ID NO: 20423 - DNA, 25 bp, Artificial Sequence
  Description of Artificial Sequence: Synthetic oligonucleotide
caggagaggccggagtattgggacc

SEQ ID NO: 20424 - DNA, 25 bp, Artificial Sequence
  Description of Artificial Sequence: Synthetic oligonucleotide
aggagaggccggagtattgggaccg

SEQ ID NO: 20425 - DNA, 24 bp, Artificial Sequence
  Description of Artificial Sequence: Synthetic oligonucleotide
ggagaggccggagtattgggaccg

SEQ ID NO: 20426 - DNA, 26 bp, Artificial Sequence
  Description of Artificial Sequence: Synthetic oligonucleotide
gagaggccggagtattgggaccggaa

SEQ ID NO: 20427 - DNA, 27 bp, Artificial Sequence
  Description of Artificial Sequence: Synthetic oligonucleotide
agaggccggagtattgggaccggaaca

SEQ ID NO: 20428 - DNA, 26 bp, Artificial Sequence
  Description of Artificial Sequence: Synthetic oligonucleotide
gaggccggagtattgggaccggaaca

SEQ ID NO: 20429 - DNA, 27 bp, Artificial Sequence
  Description of Artificial Sequence: Synthetic oligonucleotide
aggccggagtattgggaccggaacaca

SEQ ID NO: 20430 - DNA, 31 bp, Artificial Sequence
  Description of Artificial Sequence: Synthetic oligonucleotide
aggacgcttacgacggcaaggattacatctc

SEQ ID NO: 20431 - DNA, 30 bp, Artificial Sequence
  Description of Artificial Sequence: Synthetic oligonucleotide
ggacgcttacgacggcaaggattacatctc

SEQ ID NO: 20432 - DNA, 30 bp, Artificial Sequence
  Description of Artificial Sequence: Synthetic oligonucleotide
gacgcttacgacggcaaggattacatctcc

SEQ ID NO: 20433 - DNA, 30 bp, Artificial Sequence
  Description of Artificial Sequence: Synthetic oligonucleotide
acgcttacgacggcaaggattacatctccc

SEQ ID NO: 20434 - DNA, 29 bp, Artificial Sequence
  Description of Artificial Sequence: Synthetic oligonucleotide
cgcttacgacggcaaggattacatctccc

SEQ ID NO: 20435 - DNA, 30 bp, Artificial Sequence
  Description of Artificial Sequence: Synthetic oligonucleotide
gcttacgacggcaaggattacatctccctg

SEQ ID NO: 20436 - DNA, 32 bp, Artificial Sequence
  Description of Artificial Sequence: Synthetic oligonucleotide
cttacgacggcaaggattacatctccctgaac

SEQ ID NO: 20437 - DNA, 32 bp, Artificial Sequence
  Description of Artificial Sequence: Synthetic oligonucleotide
ttacgacggcaaggattacatctccctgaacg

SEQ ID NO: 20438 - DNA, 31 bp, Artificial Sequence
  Description of Artificial Sequence: Synthetic oligonucleotide
tacgacggcaaggattacatctccctgaacg

SEQ ID NO: 20439 - DNA, 30 bp, Artificial Sequence
  Description of Artificial Sequence: Synthetic oligonucleotide
acgacggcaaggattacatctccctgaacg

SEQ ID NO: 20440 - DNA, 29 bp, Artificial Sequence
  Description of Artificial Sequence: Synthetic oligonucleotide
cgacggcaaggattacatctccctgaacg

SEQ ID NO: 20441 - DNA, 30 bp, Artificial Sequence
  Description of Artificial Sequence: Synthetic oligonucleotide
gacggcaaggattacatctccctgaacgag

SEQ ID NO: 20442 - DNA, 30 bp, Artificial Sequence
  Description of Artificial Sequence: Synthetic oligonucleotide
acggcaaggattacatctccctgaacgagg

SEQ ID NO: 20443 - DNA, 29 bp, Artificial Sequence
  Description of Artificial Sequence: Synthetic oligonucleotide
cggcaaggattacatctccctgaacgagg

SEQ ID NO: 20444 - DNA, 30 bp, Artificial Sequence
  Description of Artificial Sequence: Synthetic oligonucleotide
ggcaaggattacatctccctgaacgaggac

SEQ ID NO: 20445 - DNA, 30 bp, Artificial Sequence
  Description of Artificial Sequence: Synthetic oligonucleotide
gcaaggattacatctccctgaacgaggacc

SEQ ID NO: 20446 - DNA, 31 bp, Artificial Sequence
  Description of Artificial Sequence: Synthetic oligonucleotide
caaggattacatctccctgaacgaggacctg

SEQ ID NO: 20447 - DNA, 31 bp, Artificial Sequence
  Description of Artificial Sequence: Synthetic oligonucleotide
aaggattacatctccctgaacgaggacctgc

SEQ ID NO: 20448 - DNA, 30 bp, Artificial Sequence
  Description of Artificial Sequence: Synthetic oligonucleotide
aggattacatctccctgaacgaggacctgc

SEQ ID NO: 20449 - DNA, 29 bp, Artificial Sequence
  Description of Artificial Sequence: Synthetic oligonucleotide
ggattacatctccctgaacgaggacctgc

SEQ ID NO: 20450 - DNA, 29 bp, Artificial Sequence
  Description of Artificial Sequence: Synthetic oligonucleotide
gattacatctccctgaacgaggacctgcg

SEQ ID NO: 20451 - DNA, 29 bp, Artificial Sequence
  Description of Artificial Sequence: Synthetic oligonucleotide
attacatctccctgaacgaggacctgcgc

SEQ ID NO: 20452 - DNA, 28 bp, Artificial Sequence
  Description of Artificial Sequence: Synthetic oligonucleotide
ttacatctccctgaacgaggacctgcgc

SEQ ID NO: 20453 - DNA, 27 bp, Artificial Sequence
  Description of Artificial Sequence: Synthetic oligonucleotide
tacatctccctgaacgaggacctgcgc

SEQ ID NO: 20454 - DNA, 27 bp, Artificial Sequence
  Description of Artificial Sequence: Synthetic oligonucleotide
acatctccctgaacgaggacctgcgct

SEQ ID NO: 20455 - DNA, 26 bp, Artificial Sequence
  Description of Artificial Sequence: Synthetic oligonucleotide
catctccctgaacgaggacctgcgct

SEQ ID NO: 20456 - DNA, 27 bp, Artificial Sequence
  Description of Artificial Sequence: Synthetic oligonucleotide
atctccctgaacgaggacctgcgctct

SEQ ID NO: 20457 - DNA, 27 bp, Artificial Sequence
  Description of Artificial Sequence: Synthetic oligonucleotide
tctccctgaacgaggacctgcgctctt

SEQ ID NO: 20458 - DNA, 26 bp, Artificial Sequence
  Description of Artificial Sequence: Synthetic oligonucleotide
ctccctgaacgaggacctgcgctctt

SEQ ID NO: 20459 - DNA, 26 bp, Artificial Sequence
  Description of Artificial Sequence: Synthetic oligonucleotide
tccctgaacgaggacctgcgctcttg

SEQ ID NO: 20460 - DNA, 32 bp, Artificial Sequence
  Description of Artificial Sequence: Synthetic oligonucleotide
tattgggaccggaacacacggaatgtgaagtc

SEQ ID NO: 20461 - DNA, 31 bp, Artificial Sequence
  Description of Artificial Sequence: Synthetic oligonucleotide
attgggaccggaacacacggaatgtgaagtc

SEQ ID NO: 20462 - DNA, 30 bp, Artificial Sequence
  Description of Artificial Sequence: Synthetic oligonucleotide
ttgggaccggaacacacggaatgtgaagtc

SEQ ID NO: 20463 - DNA, 29 bp, Artificial Sequence
  Description of Artificial Sequence: Synthetic oligonucleotide
tgggaccggaacacacggaatgtgaagtc

SEQ ID NO: 20464 - DNA, 28 bp, Artificial Sequence
  Description of Artificial Sequence: Synthetic oligonucleotide
gggaccggaacacacggaatgtgaagtc

SEQ ID NO: 20465 - DNA, 28 bp, Artificial Sequence
  Description of Artificial Sequence: Synthetic oligonucleotide
ggaccggaacacacggaatgtgaagtcc

SEQ ID NO: 20466 - DNA, 28 bp, Artificial Sequence
  Description of Artificial Sequence: Synthetic oligonucleotide
gaccggaacacacggaatgtgaagtccc

SEQ ID NO: 20467 - DNA, 29 bp, Artificial Sequence
  Description of Artificial Sequence: Synthetic oligonucleotide
accggaacacacggaatgtgaagtcccag

SEQ ID NO: 20468 - DNA, 28 bp, Artificial Sequence
  Description of Artificial Sequence: Synthetic oligonucleotide
ccggaacacacggaatgtgaagtcccag

SEQ ID NO: 20469 - DNA, 29 bp, Artificial Sequence
  Description of Artificial Sequence: Synthetic oligonucleotide
cggaacacacggaatgtgaagtcccagtc

SEQ ID NO: 20470 - DNA, 30 bp, Artificial Sequence
  Description of Artificial Sequence: Synthetic oligonucleotide
ggaacacacggaatgtgaagtcccagtcac

SEQ ID NO: 20471 - DNA, 31 bp, Artificial Sequence
  Description of Artificial Sequence: Synthetic oligonucleotide
gaacacacggaatgtgaagtcccagtcacag

SEQ ID NO: 20472 - DNA, 32 bp, Artificial Sequence
  Description of Artificial Sequence: Synthetic oligonucleotide
aacacacggaatgtgaagtcccagtcacagac

SEQ ID NO: 20473 - DNA, 31 bp, Artificial Sequence
  Description of Artificial Sequence: Synthetic oligonucleotide
acacacggaatgtgaagtcccagtcacagac

SEQ ID NO: 20474 - DNA, 30 bp, Artificial Sequence
  Description of Artificial Sequence: Synthetic oligonucleotide
cacacggaatgtgaagtcccagtcacagac

SEQ ID NO: 20475 - DNA, 31 bp, Artificial Sequence
  Description of Artificial Sequence: Synthetic oligonucleotide
acacggaatgtgaagtcccagtcacagactg

SEQ ID NO: 20476 - DNA, 30 bp, Artificial Sequence
  Description of Artificial Sequence: Synthetic oligonucleotide
cacggaatgtgaagtcccagtcacagactg

SEQ ID NO: 20477 - DNA, 31 bp, Artificial Sequence
  Description of Artificial Sequence: Synthetic oligonucleotide
acggaatgtgaagtcccagtcacagactgac

SEQ ID NO: 20478 - DNA, 30 bp, Artificial Sequence
  Description of Artificial Sequence: Synthetic oligonucleotide
cggaatgtgaagtcccagtcacagactgac

SEQ ID NO: 20479 - DNA, 30 bp, Artificial Sequence
  Description of Artificial Sequence: Synthetic oligonucleotide
ggaatgtgaagtcccagtcacagactgacc

SEQ ID NO: 20480 - DNA, 30 bp, Artificial Sequence
  Description of Artificial Sequence: Synthetic oligonucleotide
gaatgtgaagtcccagtcacagactgaccg

SEQ ID NO: 20481 - DNA, 31 bp, Artificial Sequence
  Description of Artificial Sequence: Synthetic oligonucleotide
aatgtgaagtcccagtcacagactgaccgag

SEQ ID NO: 20482 - DNA, 30 bp, Artificial Sequence
  Description of Artificial Sequence: Synthetic oligonucleotide
atgtgaagtcccagtcacagactgaccgag

SEQ ID NO: 20483 - DNA, 29 bp, Artificial Sequence
  Description of Artificial Sequence: Synthetic oligonucleotide
tgtgaagtcccagtcacagactgaccgag

SEQ ID NO: 20484 - DNA, 28 bp, Artificial Sequence
  Description of Artificial Sequence: Synthetic oligonucleotide
gtgaagtcccagtcacagactgaccgag

SEQ ID NO: 20485 - DNA, 29 bp, Artificial Sequence
  Description of Artificial Sequence: Synthetic oligonucleotide
tgaagtcccagtcacagactgaccgagtg

SEQ ID NO: 20486 - DNA, 28 bp, Artificial Sequence
  Description of Artificial Sequence: Synthetic oligonucleotide
gaagtcccagtcacagactgaccgagtg

SEQ ID NO: 20487 - DNA, 28 bp, Artificial Sequence
  Description of Artificial Sequence: Synthetic oligonucleotide
aagtcccagtcacagactgaccgagtgg

SEQ ID NO: 20488 - DNA, 27 bp, Artificial Sequence
  Description of Artificial Sequence: Synthetic oligonucleotide
agtcccagtcacagactgaccgagtgg

SEQ ID NO: 20489 - DNA, 27 bp, Artificial Sequence
  Description of Artificial Sequence: Synthetic oligonucleotide
gtcccagtcacagactgaccgagtgga

SEQ ID NO: 20490 - DNA, 27 bp, Artificial Sequence
  Description of Artificial Sequence: Synthetic oligonucleotide
tcccagtcacagactgaccgagtggac

SEQ ID NO: 20491 - DNA, 31 bp, Artificial Sequence
  Description of Artificial Sequence: Synthetic oligonucleotide
gacggttctcacaccctccagatgatgtatg

SEQ ID NO: 20492 - DNA, 31 bp, Artificial Sequence
  Description of Artificial Sequence: Synthetic oligonucleotide
acggttctcacaccctccagatgatgtatgg

SEQ ID NO: 20493 - DNA, 24 bp, Artificial Sequence
  Description of Artificial Sequence: Synthetic oligonucleotide
ggtaccggcaggacgcctacgact

SEQ ID NO: 20494 - DNA, 24 bp, Artificial Sequence
  Description of Artificial Sequence: Synthetic oligonucleotide
gtaccggcaggacgcctacgactg

SEQ ID NO: 20495 - DNA, 26 bp, Artificial Sequence
  Description of Artificial Sequence: Synthetic oligonucleotide
taccggcaggacgcctacgactgcaa

SEQ ID NO: 20496 - DNA, 25 bp, Artificial Sequence
  Description of Artificial Sequence: Synthetic oligonucleotide
accggcaggacgcctacgactgcaa

SEQ ID NO: 20497 - DNA, 24 bp, Artificial Sequence
  Description of Artificial Sequence: Synthetic oligonucleotide
ccggcaggacgcctacgactgcaa

SEQ ID NO: 20498 - DNA, 24 bp, Artificial Sequence
  Description of Artificial Sequence: Synthetic oligonucleotide
cggcaggacgcctacgactgcaag

SEQ ID NO: 20499 - DNA, 27 bp, Artificial Sequence
  Description of Artificial Sequence: Synthetic oligonucleotide
ggcaggacgcctacgactgcaaggatt

SEQ ID NO: 20500 - DNA, 28 bp, Artificial Sequence
  Description of Artificial Sequence: Synthetic oligonucleotide
gcaggacgcctacgactgcaaggattac

SEQ ID NO: 20501 - DNA, 30 bp, Artificial Sequence
  Description of Artificial Sequence: Synthetic oligonucleotide
caggacgcctacgactgcaaggattacatc

SEQ ID NO: 20502 - DNA, 30 bp, Artificial Sequence
  Description of Artificial Sequence: Synthetic oligonucleotide
aggacgcctacgactgcaaggattacatcg

SEQ ID NO: 20503 - DNA, 29 bp, Artificial Sequence
  Description of Artificial Sequence: Synthetic oligonucleotide
ggacgcctacgactgcaaggattacatcg

SEQ ID NO: 20504 - DNA, 29 bp, Artificial Sequence
  Description of Artificial Sequence: Synthetic oligonucleotide
gacgcctacgactgcaaggattacatcgc

SEQ ID NO: 20505 - DNA, 29 bp, Artificial Sequence
  Description of Artificial Sequence: Synthetic oligonucleotide
acgcctacgactgcaaggattacatcgcc

SEQ ID NO: 20506 - DNA, 28 bp, Artificial Sequence
  Description of Artificial Sequence: Synthetic oligonucleotide
cgcctacgactgcaaggattacatcgcc

SEQ ID NO: 20507 - DNA, 28 bp, Artificial Sequence
  Description of Artificial Sequence: Synthetic oligonucleotide
gcctacgactgcaaggattacatcgccc

SEQ ID NO: 20508 - DNA, 29 bp, Artificial Sequence
  Description of Artificial Sequence: Synthetic oligonucleotide
cctacgactgcaaggattacatcgccctg

SEQ ID NO: 20509 - DNA, 31 bp, Artificial Sequence
  Description of Artificial Sequence: Synthetic oligonucleotide
ctacgactgcaaggattacatcgccctgaac

SEQ ID NO: 20510 - DNA, 31 bp, Artificial Sequence
  Description of Artificial Sequence: Synthetic oligonucleotide
tacgactgcaaggattacatcgccctgaacg

SEQ ID NO: 20511 - DNA, 30 bp, Artificial Sequence
  Description of Artificial Sequence: Synthetic oligonucleotide
acgactgcaaggattacatcgccctgaacg

SEQ ID NO: 20512 - DNA, 29 bp, Artificial Sequence
  Description of Artificial Sequence: Synthetic oligonucleotide
cgactgcaaggattacatcgccctgaacg

SEQ ID NO: 20513 - DNA, 30 bp, Artificial Sequence
  Description of Artificial Sequence: Synthetic oligonucleotide
gactgcaaggattacatcgccctgaacgag

SEQ ID NO: 20514 - DNA, 30 bp, Artificial Sequence
  Description of Artificial Sequence: Synthetic oligonucleotide
actgcaaggattacatcgccctgaacgagg

SEQ ID NO: 20515 - DNA, 29 bp, Artificial Sequence
  Description of Artificial Sequence: Synthetic oligonucleotide
ctgcaaggattacatcgccctgaacgagg

SEQ ID NO: 20516 - DNA, 30 bp, Artificial Sequence
  Description of Artificial Sequence: Synthetic oligonucleotide
tgcaaggattacatcgccctgaacgaggac

SEQ ID NO: 20517 - DNA, 25 bp, Artificial Sequence
  Description of Artificial Sequence: Synthetic oligonucleotide
agtggagagcctacctggagggcga

SEQ ID NO: 20518 - DNA, 24 bp, Artificial Sequence
  Description of Artificial Sequence: Synthetic oligonucleotide
gtggagagcctacctggagggcga

SEQ ID NO: 20519 - DNA, 25 bp, Artificial Sequence
  Description of Artificial Sequence: Synthetic oligonucleotide
tggagagcctacctggagggcgagt

SEQ ID NO: 20520 - DNA, 24 bp, Artificial Sequence
  Description of Artificial Sequence: Synthetic oligonucleotide
ggagagcctacctggagggcgagt

SEQ ID NO: 20521 - DNA, 23 bp, Artificial Sequence
  Description of Artificial Sequence: Synthetic oligonucleotide
ggtgcgtggagtggctccgcaga

SEQ ID NO: 20522 - DNA, 21 bp, Artificial Sequence
  Description of Artificial Sequence: Synthetic oligonucleotide
cctacctggagggccggtgcg

SEQ ID NO: 20523 - DNA, 21 bp, Artificial Sequence
  Description of Artificial Sequence: Synthetic oligonucleotide
ctacctggagggccggtgcgc

SEQ ID NO: 20524 - DNA, 21 bp, Artificial Sequence
  Description of Artificial Sequence: Synthetic oligonucleotide
tacctggagggccggtgcgcg

SEQ ID NO: 20525 - DNA, 20 bp, Artificial Sequence
  Description of Artificial Sequence: Synthetic oligonucleotide
acctggagggccggtgcgcg

SEQ ID NO: 20526 - DNA, 20 bp, Artificial Sequence
  Description of Artificial Sequence: Synthetic oligonucleotide
cctggagggccggtgcgcgt

SEQ ID NO: 20527 - DNA, 20 bp, Artificial Sequence
  Description of Artificial Sequence: Synthetic oligonucleotide
ctggagggccggtgcgcgga

SEQ ID NO: 20528 - DNA, 21 bp, Artificial Sequence
  Description of Artificial Sequence: Synthetic oligonucleotide
tggagggccggtgcgcggagt

SEQ ID NO: 20529 - DNA, 20 bp, Artificial Sequence
  Description of Artificial Sequence: Synthetic oligonucleotide
ggagggccggtgcgcggagt

SEQ ID NO: 20530 - DNA, 20 bp, Artificial Sequence
  Description of Artificial Sequence: Synthetic oligonucleotide
gagggccggtgcgcggagtg

SEQ ID NO: 20531 - DNA, 20 bp, Artificial Sequence
  Description of Artificial Sequence: Synthetic oligonucleotide
agggccggtgcgcggagtgg

SEQ ID NO: 20532 - DNA, 20 bp, Artificial Sequence
  Description of Artificial Sequence: Synthetic oligonucleotide
gggccggtgcgcggagtggt

SEQ ID NO: 20533 - DNA, 20 bp, Artificial Sequence
  Description of Artificial Sequence: Synthetic oligonucleotide
ggccggtgcgcggagtggct

SEQ ID NO: 20534 - DNA, 20 bp, Artificial Sequence
  Description of Artificial Sequence: Synthetic oligonucleotide
gccggtgcgcggagtggctc

SEQ ID NO: 20535 - DNA, 20 bp, Artificial Sequence
  Description of Artificial Sequence: Synthetic oligonucleotide
ccggtgcgcggagtggctcc

SEQ ID NO: 20536 - DNA, 20 bp, Artificial Sequence
  Description of Artificial Sequence: Synthetic oligonucleotide
cggtgcgcggagtggctccg

SEQ ID NO: 20537 - DNA, 21 bp, Artificial Sequence
  Description of Artificial Sequence: Synthetic oligonucleotide
ggtgcgcggagtggctccgca

SEQ ID NO: 20538 - DNA, 24 bp, Artificial Sequence
  Description of Artificial Sequence: Synthetic oligonucleotide
gtgcgcggagtggctccgcagata

SEQ ID NO: 20539 - DNA, 24 bp, Artificial Sequence
  Description of Artificial Sequence: Synthetic oligonucleotide
tgcgcggagtggctccgcagatac

SEQ ID NO: 20540 - DNA, 23 bp, Artificial Sequence
  Description of Artificial Sequence: Synthetic oligonucleotide
gcgcggagtggctccgcagatac

SEQ ID NO: 20541 - DNA, 24 bp, Artificial Sequence
  Description of Artificial Sequence: Synthetic oligonucleotide
cgcggagtggctccgcagatacct

SEQ ID NO: 20542 - DNA, 24 bp, Artificial Sequence
  Description of Artificial Sequence: Synthetic oligonucleotide
gcggagtggctccgcagatacctg

SEQ ID NO: 20543 - DNA, 25 bp, Artificial Sequence
  Description of Artificial Sequence: Synthetic oligonucleotide
cggagtggctccgcagatacctgga

SEQ ID NO: 20544 - DNA, 26 bp, Artificial Sequence
  Description of Artificial Sequence: Synthetic oligonucleotide
gcgtctgtggtggtgccttctggaga

SEQ ID NO: 20545 - DNA, 26 bp, Artificial Sequence
  Description of Artificial Sequence: Synthetic oligonucleotide
cgtctgtggtggtgccttctggagag

SEQ ID NO: 20546 - DNA, 27 bp, Artificial Sequence
  Description of Artificial Sequence: Synthetic oligonucleotide
gtctgtggtggtgccttctggagagga

SEQ ID NO: 20547 - DNA, 27 bp, Artificial Sequence
  Description of Artificial Sequence: Synthetic oligonucleotide
tctgtggtggtgccttctggagaggag

SEQ ID NO: 20548 - DNA, 26 bp, Artificial Sequence
  Description of Artificial Sequence: Synthetic oligonucleotide
atcgccgtgggctacgtggacgacat

SEQ ID NO: 20549 - DNA, 25 bp, Artificial Sequence
  Description of Artificial Sequence: Synthetic oligonucleotide
tcgccgtgggctacgtggacgacat

SEQ ID NO: 20550 - DNA, 24 bp, Artificial Sequence
  Description of Artificial Sequence: Synthetic oligonucleotide
cgccgtgggctacgtggacgacat

SEQ ID NO: 20551 - DNA, 24 bp, Artificial Sequence
  Description of Artificial Sequence: Synthetic oligonucleotide
gccgtgggctacgtggacgacatg

SEQ ID NO: 20552 - DNA, 25 bp, Artificial Sequence
  Description of Artificial Sequence: Synthetic oligonucleotide
ccgtgggctacgtggacgacatgca

SEQ ID NO: 20553 - DNA, 27 bp, Artificial Sequence
  Description of Artificial Sequence: Synthetic oligonucleotide
cgtgggctacgtggacgacatgcagtt

SEQ ID NO: 20554 - DNA, 27 bp, Artificial Sequence
  Description of Artificial Sequence: Synthetic oligonucleotide
gtgggctacgtggacgacatgcagttc

SEQ ID NO: 20555 - DNA, 27 bp, Artificial Sequence
  Description of Artificial Sequence: Synthetic oligonucleotide
tgggctacgtggacgacatgcagttcg

SEQ ID NO: 20556 - DNA, 27 bp, Artificial Sequence
  Description of Artificial Sequence: Synthetic oligonucleotide
gggctacgtggacgacatgcagttcgt

SEQ ID NO: 20557 - DNA, 27 bp, Artificial Sequence
  Description of Artificial Sequence: Synthetic oligonucleotide
ggctacgtggacgacatgcagttcgtg

SEQ ID NO: 20558 - DNA, 27 bp, Artificial Sequence
  Description of Artificial Sequence: Synthetic oligonucleotide
gctacgtggacgacatgcagttcgtgc

SEQ ID NO: 20559 - DNA, 27 bp, Artificial Sequence
  Description of Artificial Sequence: Synthetic oligonucleotide
ctacgtggacgacatgcagttcgtgcg

SEQ ID NO: 20560 - DNA, 27 bp, Artificial Sequence
  Description of Artificial Sequence: Synthetic oligonucleotide
tacgtggacgacatgcagttcgtgcgg

SEQ ID NO: 20561 - DNA, 27 bp, Artificial Sequence
  Description of Artificial Sequence: Synthetic oligonucleotide
acgtggacgacatgcagttcgtgcggt

SEQ ID NO: 20562 - DNA, 27 bp, Artificial Sequence
  Description of Artificial Sequence: Synthetic oligonucleotide
cgtggacgacatgcagttcgtgcggtt

SEQ ID NO: 20563 - DNA, 27 bp, Artificial Sequence
  Description of Artificial Sequence: Synthetic oligonucleotide
gtggacgacatgcagttcgtgcggttc

SEQ ID NO: 20564 - DNA, 27 bp, Artificial Sequence
  Description of Artificial Sequence: Synthetic oligonucleotide
tggacgacatgcagttcgtgcggttcg

SEQ ID NO: 20565 - DNA, 27 bp, Artificial Sequence
  Description of Artificial Sequence: Synthetic oligonucleotide
ggacgacatgcagttcgtgcggttcga

SEQ ID NO: 20566 - DNA, 27 bp, Artificial Sequence
  Description of Artificial Sequence: Synthetic oligonucleotide
gacgacatgcagttcgtgcggttcgac

SEQ ID NO: 20567 - DNA, 28 bp, Artificial Sequence
  Description of Artificial Sequence: Synthetic oligonucleotide
acgacatgcagttcgtgcggttcgacag

SEQ ID NO: 20568 - DNA, 27 bp, Artificial Sequence
  Description of Artificial Sequence: Synthetic oligonucleotide
cgacatgcagttcgtgcggttcgacag

SEQ ID NO: 20569 - DNA, 27 bp, Artificial Sequence
  Description of Artificial Sequence: Synthetic oligonucleotide
gacatgcagttcgtgcggttcgacagc

SEQ ID NO: 20570 - DNA, 27 bp, Artificial Sequence
  Description of Artificial Sequence: Synthetic oligonucleotide
acatgcagttcgtgcggttcgacagcg

SEQ ID NO: 20571 - DNA, 27 bp, Artificial Sequence
  Description of Artificial Sequence: Synthetic oligonucleotide
catgcagttcgtgcggttcgacagcga

SEQ ID NO: 20572 - DNA, 27 bp, Artificial Sequence
  Description of Artificial Sequence: Synthetic oligonucleotide
atgcagttcgtgcggttcgacagcgac

SEQ ID NO: 20573 - DNA, 26 bp, Artificial Sequence
  Description of Artificial Sequence: Synthetic oligonucleotide
tgcagttcgtgcggttcgacagcgac

SEQ ID NO: 20574 - DNA, 20 bp, Artificial Sequence
  Description of Artificial Sequence: Synthetic oligonucleotide
cagcgcgcggacgcccccaa

SEQ ID NO: 20575 - DNA, 21 bp, Artificial Sequence
  Description of Artificial Sequence: Synthetic oligonucleotide
agcgcgcggacgcccccaaga

SEQ ID NO: 20576 - DNA, 20 bp, Artificial Sequence
  Description of Artificial Sequence: Synthetic oligonucleotide
gcgcgcggacgcccccaaga

SEQ ID NO: 20577 - DNA, 20 bp, Artificial Sequence
  Description of Artificial Sequence: Synthetic oligonucleotide
cgcgcggacgcccccaagac

SEQ ID NO: 20578 - DNA, 20 bp, Artificial Sequence
  Description of Artificial Sequence: Synthetic oligonucleotide
gcgcggacgcccccaagacg

SEQ ID NO: 20579 - DNA, 24 bp, Artificial Sequence
  Description of Artificial Sequence: Synthetic oligonucleotide
cgcggacgcccccaagacgcatat

SEQ ID NO: 20580 - DNA, 25 bp, Artificial Sequence
  Description of Artificial Sequence: Synthetic oligonucleotide
gcggacgcccccaagacgcatatga

SEQ ID NO: 20581 - DNA, 32 bp, Artificial Sequence
  Description of Artificial Sequence: Synthetic oligonucleotide
ggctcccactccatgaggtatttctacacttc

SEQ ID NO: 20582 - DNA, 23 bp, Artificial Sequence
  Description of Artificial Sequence: Synthetic oligonucleotide
ggaaggagacgctgcagcgcacc

SEQ ID NO: 20583 - DNA, 23 bp, Artificial Sequence
  Description of Artificial Sequence: Synthetic oligonucleotide
gaaggagacgctgcagcgcaccg

SEQ ID NO: 20584 - DNA, 29 bp, Artificial Sequence
  Description of Artificial Sequence: Synthetic oligonucleotide
gtatttctacacttccgtgtcccggcctg

SEQ ID NO: 20585 - DNA, 29 bp, Artificial Sequence
  Description of Artificial Sequence: Synthetic oligonucleotide
tatttctacacttccgtgtcccggcctgg

SEQ ID NO: 20586 - DNA, 28 bp, Artificial Sequence
  Description of Artificial Sequence: Synthetic oligonucleotide
atttctacacttccgtgtcccggcctgg

SEQ ID NO: 20587 - DNA, 27 bp, Artificial Sequence
  Description of Artificial Sequence: Synthetic oligonucleotide
tttctacacttccgtgtcccggcctgg

SEQ ID NO: 20588 - DNA, 26 bp, Artificial Sequence
  Description of Artificial Sequence: Synthetic oligonucleotide
ttctacacttccgtgtcccggcctgg

SEQ ID NO: 20589 - DNA, 25 bp, Artificial Sequence
  Description of Artificial Sequence: Synthetic oligonucleotide
tctacacttccgtgtcccggcctgg

SEQ ID NO: 20590 - DNA, 24 bp, Artificial Sequence
  Description of Artificial Sequence: Synthetic oligonucleotide
ctacacttccgtgtcccggcctgg

SEQ ID NO: 20591 - DNA, 24 bp, Artificial Sequence
  Description of Artificial Sequence: Synthetic oligonucleotide
tacacttccgtgtcccggcctggc

SEQ ID NO: 20592 - DNA, 23 bp, Artificial Sequence
  Description of Artificial Sequence: Synthetic oligonucleotide
acacttccgtgtcccggcctggc

SEQ ID NO: 20593 - DNA, 22 bp, Artificial Sequence
  Description of Artificial Sequence: Synthetic oligonucleotide
cacttccgtgtcccggcctggc

SEQ ID NO: 20594 - DNA, 22 bp, Artificial Sequence
  Description of Artificial Sequence: Synthetic oligonucleotide
acttccgtgtcccggcctggcc

SEQ ID NO: 20595 - DNA, 21 bp, Artificial Sequence
  Description of Artificial Sequence: Synthetic oligonucleotide
cttccgtgtcccggcctggcc

SEQ ID NO: 20596 - DNA, 21 bp, Artificial Sequence
  Description of Artificial Sequence: Synthetic oligonucleotide
ttccgtgtcccggcctggccg

SEQ ID NO: 20597 - DNA, 27 bp, Artificial Sequence
  Description of Artificial Sequence: Synthetic oligonucleotide
ggccctgagcttctaccctgcggaaat

SEQ ID NO: 20598 - DNA, 27 bp, Artificial Sequence
  Description of Artificial Sequence: Synthetic oligonucleotide
gccctgagcttctaccctgcggaaatc

SEQ ID NO: 20599 - DNA, 28 bp, Artificial Sequence
  Description of Artificial Sequence: Synthetic oligonucleotide
ccctgagcttctaccctgcggaaatcac

SEQ ID NO: 20600 - DNA, 29 bp, Artificial Sequence
  Description of Artificial Sequence: Synthetic oligonucleotide
cctgagcttctaccctgcggaaatcacac

SEQ ID NO: 20601 - DNA, 30 bp, Artificial Sequence
  Description of Artificial Sequence: Synthetic oligonucleotide
ctgagcttctaccctgcggaaatcacactg

SEQ ID NO: 20602 - DNA, 31 bp, Artificial Sequence
  Description of Artificial Sequence: Synthetic oligonucleotide
tgagcttctaccctgcggaaatcacactgac

SEQ ID NO: 20603 - DNA, 30 bp, Artificial Sequence
  Description of Artificial Sequence: Synthetic oligonucleotide
gagcttctaccctgcggaaatcacactgac

SEQ ID NO: 20604 - DNA, 30 bp, Artificial Sequence
  Description of Artificial Sequence: Synthetic oligonucleotide
agcttctaccctgcggaaatcacactgacc

SEQ ID NO: 20605 - DNA, 29 bp, Artificial Sequence
  Description of Artificial Sequence: Synthetic oligonucleotide
gcttctaccctgcggaaatcacactgacc

SEQ ID NO: 20606 - DNA, 30 bp, Artificial Sequence
  Description of Artificial Sequence: Synthetic oligonucleotide
cttctaccctgcggaaatcacactgacctg

SEQ ID NO: 20607 - DNA, 30 bp, Artificial Sequence
  Description of Artificial Sequence: Synthetic oligonucleotide
ttctaccctgcggaaatcacactgacctgg

SEQ ID NO: 20608 - DNA, 29 bp, Artificial Sequence
  Description of Artificial Sequence: Synthetic oligonucleotide
tctaccctgcggaaatcacactgacctgg

SEQ ID NO: 20609 - DNA, 28 bp, Artificial Sequence
  Description of Artificial Sequence: Synthetic oligonucleotide
ctaccctgcggaaatcacactgacctgg

SEQ ID NO: 20610 - DNA, 28 bp, Artificial Sequence
  Description of Artificial Sequence: Synthetic oligonucleotide
taccctgcggaaatcacactgacctggc

SEQ ID NO: 20611 - DNA, 27 bp, Artificial Sequence
  Description of Artificial Sequence: Synthetic oligonucleotide
accctgcggaaatcacactgacctggc

SEQ ID NO: 20612 - DNA, 27 bp, Artificial Sequence
  Description of Artificial Sequence: Synthetic oligonucleotide
ccctgcggaaatcacactgacctggca

SEQ ID NO: 20613 - DNA, 27 bp, Artificial Sequence
  Description of Artificial Sequence: Synthetic oligonucleotide
cctgcggaaatcacactgacctggcag

SEQ ID NO: 20614 - DNA, 27 bp, Artificial Sequence
  Description of Artificial Sequence: Synthetic oligonucleotide
ctgcggaaatcacactgacctggcagc

SEQ ID NO: 20615 - DNA, 27 bp, Artificial Sequence
  Description of Artificial Sequence: Synthetic oligonucleotide
tgcggaaatcacactgacctggcagcg

SEQ ID NO: 20616 - DNA, 26 bp, Artificial Sequence
  Description of Artificial Sequence: Synthetic oligonucleotide
gcggaaatcacactgacctggcagcg

SEQ ID NO: 20617 - DNA, 26 bp, Artificial Sequence
  Description of Artificial Sequence: Synthetic oligonucleotide
cggaaatcacactgacctggcagcgg

SEQ ID NO: 20618 - DNA, 27 bp, Artificial Sequence
  Description of Artificial Sequence: Synthetic oligonucleotide
ggaaatcacactgacctggcagcggga

SEQ ID NO: 20619 - DNA, 28 bp, Artificial Sequence
  Description of Artificial Sequence: Synthetic oligonucleotide
gaaatcacactgacctggcagcgggatg

SEQ ID NO: 20620 - DNA, 28 bp, Artificial Sequence
  Description of Artificial Sequence: Synthetic oligonucleotide
aaatcacactgacctggcagcgggatgg

SEQ ID NO: 20621 - DNA, 27 bp, Artificial Sequence
  Description of Artificial Sequence: Synthetic oligonucleotide
aatcacactgacctggcagcgggatgg

SEQ ID NO: 20622 - DNA, 28 bp, Artificial Sequence
  Description of Artificial Sequence: Synthetic oligonucleotide
gcctacgacggcaaggattacatcgctc

SEQ ID NO: 20623 - DNA, 29 bp, Artificial Sequence
  Description of Artificial Sequence: Synthetic oligonucleotide
cctacgacggcaaggattacatcgctctg

SEQ ID NO: 20624 - DNA, 32 bp, Artificial Sequence
  Description of Artificial Sequence: Synthetic oligonucleotide
ctacgacggcaaggattacatcgctctgaaag

SEQ ID NO: 20625 - DNA, 33 bp, Artificial Sequence
  Description of Artificial Sequence: Synthetic oligonucleotide
tacgacggcaaggattacatcgctctgaaagag

SEQ ID NO: 20626 - DNA, 32 bp, Artificial Sequence
  Description of Artificial Sequence: Synthetic oligonucleotide
acgacggcaaggattacatcgctctgaaagag

SEQ ID NO: 20627 - DNA, 31 bp, Artificial Sequence
  Description of Artificial Sequence: Synthetic oligonucleotide
cgacggcaaggattacatcgctctgaaagag

SEQ ID NO: 20628 - DNA, 31 bp, Artificial Sequence
  Description of Artificial Sequence: Synthetic oligonucleotide
gacggcaaggattacatcgctctgaaagagg

SEQ ID NO: 20629 - DNA, 32 bp, Artificial Sequence
  Description of Artificial Sequence: Synthetic oligonucleotide
acggcaaggattacatcgctctgaaagaggac

SEQ ID NO: 20630 - DNA, 31 bp, Artificial Sequence
  Description of Artificial Sequence: Synthetic oligonucleotide
cggcaaggattacatcgctctgaaagaggac

SEQ ID NO: 20631 - DNA, 31 bp, Artificial Sequence
  Description of Artificial Sequence: Synthetic oligonucleotide
ggcaaggattacatcgctctgaaagaggacc

SEQ ID NO: 20632 - DNA, 32 bp, Artificial Sequence
  Description of Artificial Sequence: Synthetic oligonucleotide
gcaaggattacatcgctctgaaagaggacctg

SEQ ID NO: 20633 - DNA, 32 bp, Artificial Sequence
  Description of Artificial Sequence: Synthetic oligonucleotide
caaggattacatcgctctgaaagaggacctgc

SEQ ID NO: 20634 - DNA, 32 bp, Artificial Sequence
  Description of Artificial Sequence: Synthetic oligonucleotide
aaggattacatcgctctgaaagaggacctgcg

SEQ ID NO: 20635 - DNA, 31 bp, Artificial Sequence
  Description of Artificial Sequence: Synthetic oligonucleotide
aggattacatcgctctgaaagaggacctgcg

SEQ ID NO: 20636 - DNA, 30 bp, Artificial Sequence
  Description of Artificial Sequence: Synthetic oligonucleotide
ggattacatcgctctgaaagaggacctgcg

SEQ ID NO: 20637 - DNA, 30 bp, Artificial Sequence
  Description of Artificial Sequence: Synthetic oligonucleotide
gattacatcgctctgaaagaggacctgcgc

SEQ ID NO: 20638 - DNA, 31 bp, Artificial Sequence
  Description of Artificial Sequence: Synthetic oligonucleotide
attacatcgctctgaaagaggacctgcgctc

SEQ ID NO: 20639 - DNA, 30 bp, Artificial Sequence
  Description of Artificial Sequence: Synthetic oligonucleotide
ttacatcgctctgaaagaggacctgcgctc

SEQ ID NO: 20640 - DNA, 29 bp, Artificial Sequence
  Description of Artificial Sequence: Synthetic oligonucleotide
tacatcgctctgaaagaggacctgcgctc

SEQ ID NO: 20641 - DNA, 28 bp, Artificial Sequence
  Description of Artificial Sequence: Synthetic oligonucleotide
acatcgctctgaaagaggacctgcgctc

SEQ ID NO: 20642 - DNA, 27 bp, Artificial Sequence
  Description of Artificial Sequence: Synthetic oligonucleotide
catcgctctgaaagaggacctgcgctc

SEQ ID NO: 20643 - DNA, 29 bp, Artificial Sequence
  Description of Artificial Sequence: Synthetic oligonucleotide
atcgctctgaaagaggacctgcgctcttg

SEQ ID NO: 20644 - DNA, 28 bp, Artificial Sequence
  Description of Artificial Sequence: Synthetic oligonucleotide
tcgctctgaaagaggacctgcgctcttg

SEQ ID NO: 20645 - DNA, 27 bp, Artificial Sequence
  Description of Artificial Sequence: Synthetic oligonucleotide
cgctctgaaagaggacctgcgctcttg

SEQ ID NO: 20646 - DNA, 27 bp, Artificial Sequence
  Description of Artificial Sequence: Synthetic oligonucleotide
gctctgaaagaggacctgcgctcttgg

SEQ ID NO: 20647 - DNA, 28 bp, Artificial Sequence
  Description of Artificial Sequence: Synthetic oligonucleotide
ctctgaaagaggacctgcgctcttggac

SEQ ID NO: 20648 - DNA, 28 bp, Artificial Sequence
  Description of Artificial Sequence: Synthetic oligonucleotide
tctgaaagaggacctgcgctcttggacc

SEQ ID NO: 20649 - DNA, 26 bp, Artificial Sequence
  Description of Artificial Sequence: Synthetic oligonucleotide
gcgcggctactacaaccagagcgaag

SEQ ID NO: 20650 - DNA, 26 bp, Artificial Sequence
  Description of Artificial Sequence: Synthetic oligonucleotide
cgcggctactacaaccagagcgaagc

SEQ ID NO: 20651 - DNA, 26 bp, Artificial Sequence
  Description of Artificial Sequence: Synthetic oligonucleotide
gcggctactacaaccagagcgaagcc

SEQ ID NO: 20652 - DNA, 26 bp, Artificial Sequence
  Description of Artificial Sequence: Synthetic oligonucleotide
cggctactacaaccagagcgaagccg

SEQ ID NO: 20653 - DNA, 27 bp, Artificial Sequence
  Description of Artificial Sequence: Synthetic oligonucleotide
ggctactacaaccagagcgaagccggt

SEQ ID NO: 20654 - DNA, 28 bp, Artificial Sequence
  Description of Artificial Sequence: Synthetic oligonucleotide
gctactacaaccagagcgaagccggttc

SEQ ID NO: 20655 - DNA, 29 bp, Artificial Sequence
  Description of Artificial Sequence: Synthetic oligonucleotide
ctactacaaccagagcgaagccggttctc

SEQ ID NO: 20656 - DNA, 30 bp, Artificial Sequence
  Description of Artificial Sequence: Synthetic oligonucleotide
tactacaaccagagcgaagccggttctcac

SEQ ID NO: 20657 - DNA, 29 bp, Artificial Sequence
  Description of Artificial Sequence: Synthetic oligonucleotide
actacaaccagagcgaagccggttctcac

SEQ ID NO: 20658 - DNA, 28 bp, Artificial Sequence
  Description of Artificial Sequence: Synthetic oligonucleotide
ctacaaccagagcgaagccggttctcac

SEQ ID NO: 20659 - DNA, 29 bp, Artificial Sequence
  Description of Artificial Sequence: Synthetic oligonucleotide
tacaaccagagcgaagccggttctcacac

SEQ ID NO: 20660 - DNA, 28 bp, Artificial Sequence
  Description of Artificial Sequence: Synthetic oligonucleotide
acaaccagagcgaagccggttctcacac

SEQ ID NO: 20661 - DNA, 27 bp, Artificial Sequence
  Description of Artificial Sequence: Synthetic oligonucleotide
caaccagagcgaagccggttctcacac

SEQ ID NO: 20662 - DNA, 27 bp, Artificial Sequence
  Description of Artificial Sequence: Synthetic oligonucleotide
aaccagagcgaagccggttctcacacc

SEQ ID NO: 20663 - DNA, 27 bp, Artificial Sequence
  Description of Artificial Sequence: Synthetic oligonucleotide
accagagcgaagccggttctcacacca

SEQ ID NO: 20664 - DNA, 27 bp, Artificial Sequence
  Description of Artificial Sequence: Synthetic oligonucleotide
ccagagcgaagccggttctcacaccat

SEQ ID NO: 20665 - DNA, 27 bp, Artificial Sequence
  Description of Artificial Sequence: Synthetic oligonucleotide
cagagcgaagccggttctcacaccatc

SEQ ID NO: 20666 - DNA, 27 bp, Artificial Sequence
  Description of Artificial Sequence: Synthetic oligonucleotide
agagcgaagccggttctcacaccatcc

SEQ ID NO: 20667 - DNA, 27 bp, Artificial Sequence
  Description of Artificial Sequence: Synthetic oligonucleotide
gagcgaagccggttctcacaccatcca

SEQ ID NO: 20668 - DNA, 27 bp, Artificial Sequence
  Description of Artificial Sequence: Synthetic oligonucleotide
agcgaagccggttctcacaccatccag

SEQ ID NO: 20669 - DNA, 27 bp, Artificial Sequence
  Description of Artificial Sequence: Synthetic oligonucleotide
gcgaagccggttctcacaccatccaga

SEQ ID NO: 20670 - DNA, 27 bp, Artificial Sequence
  Description of Artificial Sequence: Synthetic oligonucleotide
cgaagccggttctcacaccatccagag

SEQ ID NO: 20671 - DNA, 27 bp, Artificial Sequence
  Description of Artificial Sequence: Synthetic oligonucleotide
gaagccggttctcacaccatccagagg

SEQ ID NO: 20672 - DNA, 29 bp, Artificial Sequence
  Description of Artificial Sequence: Synthetic oligonucleotide
aagccggttctcacaccatccagaggatg

SEQ ID NO: 20673 - DNA, 28 bp, Artificial Sequence
  Description of Artificial Sequence: Synthetic oligonucleotide
agccggttctcacaccatccagaggatg

SEQ ID NO: 20674 - DNA, 33 bp, Artificial Sequence
  Description of Artificial Sequence: Synthetic oligonucleotide
gctctcactccatgaggtatttctacacttccg

SEQ ID NO: 20675 - DNA, 34 bp, Artificial Sequence
  Description of Artificial Sequence: Synthetic oligonucleotide
ctctcactccatgaggtatttctacacttccgtg

SEQ ID NO: 20676 - DNA, 35 bp, Artificial Sequence
  Description of Artificial Sequence: Synthetic oligonucleotide
tctcactccatgaggtatttctacacttccgtgtc

SEQ ID NO: 20677 - DNA, 34 bp, Artificial Sequence
  Description of Artificial Sequence: Synthetic oligonucleotide
ctcactccatgaggtatttctacacttccgtgtc

SEQ ID NO: 20678 - DNA, 34 bp, Artificial Sequence
  Description of Artificial Sequence: Synthetic oligonucleotide
tcactccatgaggtatttctacacttccgtgtcc

SEQ ID NO: 20679 - DNA, 23 bp, Artificial Sequence
  Description of Artificial Sequence: Synthetic oligonucleotide
ttcctccgcgggtaccggcagca

SEQ ID NO: 20680 - DNA, 22 bp, Artificial Sequence
  Description of Artificial Sequence: Synthetic oligonucleotide
tcctccgcgggtaccggcagca

SEQ ID NO: 20681 - DNA, 21 bp, Artificial Sequence
  Description of Artificial Sequence: Synthetic oligonucleotide
cctccgcgggtaccggcagca

SEQ ID NO: 20682 - DNA, 21 bp, Artificial Sequence
  Description of Artificial Sequence: Synthetic oligonucleotide
ctccgcgggtaccggcagcac

SEQ ID NO: 20683 - DNA, 21 bp, Artificial Sequence
  Description of Artificial Sequence: Synthetic oligonucleotide
tccgcgggtaccggcagcacg

SEQ ID NO: 20684 - DNA, 20 bp, Artificial Sequence
  Description of Artificial Sequence: Synthetic oligonucleotide
ccgcgggtaccggcagcacg

SEQ ID NO: 20685 - DNA, 20 bp, Artificial Sequence
  Description of Artificial Sequence: Synthetic oligonucleotide
cgcgggtaccggcagcacgc

SEQ ID NO: 20686 - DNA, 22 bp, Artificial Sequence
  Description of Artificial Sequence: Synthetic oligonucleotide
gcgggtaccggcagcacgccta

SEQ ID NO: 20687 - DNA, 22 bp, Artificial Sequence
  Description of Artificial Sequence: Synthetic oligonucleotide
cgggtaccggcagcacgcctac

SEQ ID NO: 20688 - DNA, 23 bp, Artificial Sequence
  Description of Artificial Sequence: Synthetic oligonucleotide
gggtaccggcagcacgcctacga

SEQ ID NO: 20689 - DNA, 23 bp, Artificial Sequence
  Description of Artificial Sequence: Synthetic oligonucleotide
ggtaccggcagcacgcctacgac

SEQ ID NO: 20690 - DNA, 23 bp, Artificial Sequence
  Description of Artificial Sequence: Synthetic oligonucleotide
gtaccggcagcacgcctacgacg

SEQ ID NO: 20691 - DNA, 23 bp, Artificial Sequence
  Description of Artificial Sequence: Synthetic oligonucleotide
taccggcagcacgcctacgacgg

SEQ ID NO: 20692 - DNA, 22 bp, Artificial Sequence
  Description of Artificial Sequence: Synthetic oligonucleotide
accggcagcacgcctacgacgg

SEQ ID NO: 20693 - DNA, 21 bp, Artificial Sequence
  Description of Artificial Sequence: Synthetic oligonucleotide
ccggcagcacgcctacgacgg

SEQ ID NO: 20694 - DNA, 23 bp, Artificial Sequence
  Description of Artificial Sequence: Synthetic oligonucleotide
cggcagcacgcctacgacggcaa

SEQ ID NO: 20695 - DNA, 23 bp, Artificial Sequence
  Description of Artificial Sequence: Synthetic oligonucleotide
ggcagcacgcctacgacggcaag

SEQ ID NO: 20696 - DNA, 27 bp, Artificial Sequence
  Description of Artificial Sequence: Synthetic oligonucleotide
gcagcacgcctacgacggcaaggatta

SEQ ID NO: 20697 - DNA, 29 bp, Artificial Sequence
  Description of Artificial Sequence: Synthetic oligonucleotide
ggagtattgggacgaggagacacggaatg

SEQ ID NO: 20698 - DNA, 30 bp, Artificial Sequence
  Description of Artificial Sequence: Synthetic oligonucleotide
gagtattgggacgaggagacacggaatgtg

SEQ ID NO: 20699 - DNA, 32 bp, Artificial Sequence
  Description of Artificial Sequence: Synthetic oligonucleotide
agtattgggacgaggagacacggaatgtgaag

SEQ ID NO: 20700 - DNA, 31 bp, Artificial Sequence
  Description of Artificial Sequence: Synthetic oligonucleotide
gtattgggacgaggagacacggaatgtgaag

SEQ ID NO: 20701 - DNA, 31 bp, Artificial Sequence
  Description of Artificial Sequence: Synthetic oligonucleotide
tattgggacgaggagacacggaatgtgaagg

SEQ ID NO: 20702 - DNA, 30 bp, Artificial Sequence
  Description of Artificial Sequence: Synthetic oligonucleotide
attgggacgaggagacacggaatgtgaagg

SEQ ID NO: 20703 - DNA, 29 bp, Artificial Sequence
  Description of Artificial Sequence: Synthetic oligonucleotide
ttgggacgaggagacacggaatgtgaagg

SEQ ID NO: 20704 - DNA, 28 bp, Artificial Sequence
  Description of Artificial Sequence: Synthetic oligonucleotide
tgggacgaggagacacggaatgtgaagg

SEQ ID NO: 20705 - DNA, 27 bp, Artificial Sequence
  Description of Artificial Sequence: Synthetic oligonucleotide
gggacgaggagacacggaatgtgaagg

SEQ ID NO: 20706 - DNA, 27 bp, Artificial Sequence
  Description of Artificial Sequence: Synthetic oligonucleotide
ggacgaggagacacggaatgtgaaggc

SEQ ID NO: 20707 - DNA, 27 bp, Artificial Sequence
  Description of Artificial Sequence: Synthetic oligonucleotide
gacgaggagacacggaatgtgaaggcc

SEQ ID NO: 20708 - DNA, 27 bp, Artificial Sequence
  Description of Artificial Sequence: Synthetic oligonucleotide
acgaggagacacggaatgtgaaggccc

SEQ ID NO: 20709 - DNA, 27 bp, Artificial Sequence
  Description of Artificial Sequence: Synthetic oligonucleotide
cgaggagacacggaatgtgaaggccca

SEQ ID NO: 20710 - DNA, 27 bp, Artificial Sequence
  Description of Artificial Sequence: Synthetic oligonucleotide
gaggagacacggaatgtgaaggcccag

SEQ ID NO: 20711 - DNA, 26 bp, Artificial Sequence
  Description of Artificial Sequence: Synthetic oligonucleotide
aaccctcgtcctgctactctcggggt

SEQ ID NO: 20712 - DNA, 25 bp, Artificial Sequence
  Description of Artificial Sequence: Synthetic oligonucleotide
accctcgtcctgctactctcggggt

SEQ ID NO: 20713 - DNA, 24 bp, Artificial Sequence
  Description of Artificial Sequence: Synthetic oligonucleotide
ccctcgtcctgctactctcggggt

SEQ ID NO: 20714 - DNA, 24 bp, Artificial Sequence
  Description of Artificial Sequence: Synthetic oligonucleotide
cctcgtcctgctactctcggggtc

SEQ ID NO: 20715 - DNA, 25 bp, Artificial Sequence
  Description of Artificial Sequence: Synthetic oligonucleotide
ctcgtcctgctactctcggggtcct

SEQ ID NO: 20716 - DNA, 25 bp, Artificial Sequence
  Description of Artificial Sequence: Synthetic oligonucleotide
tcgtcctgctactctcggggtcctg

SEQ ID NO: 20717 - DNA, 24 bp, Artificial Sequence
  Description of Artificial Sequence: Synthetic oligonucleotide
cgtcctgctactctcggggtcctg

SEQ ID NO: 20718 - DNA, 24 bp, Artificial Sequence
  Description of Artificial Sequence: Synthetic oligonucleotide
gtcctgctactctcggggtcctgg

SEQ ID NO: 20719 - DNA, 24 bp, Artificial Sequence
  Description of Artificial Sequence: Synthetic oligonucleotide
tcctgctactctcggggtcctggc

SEQ ID NO: 20720 - DNA, 23 bp, Artificial Sequence
  Description of Artificial Sequence: Synthetic oligonucleotide
cctgctactctcggggtcctggc

SEQ ID NO: 20721 - DNA, 23 bp, Artificial Sequence
  Description of Artificial Sequence: Synthetic oligonucleotide
ctgctactctcggggtcctggcc

SEQ ID NO: 20722 - DNA, 24 bp, Artificial Sequence
  Description of Artificial Sequence: Synthetic oligonucleotide
tgctactctcggggtcctggccct

SEQ ID NO: 20723 - DNA, 23 bp, Artificial Sequence
  Description of Artificial Sequence: Synthetic oligonucleotide
gctactctcggggtcctggccct

SEQ ID NO: 20724 - DNA, 24 bp, Artificial Sequence
  Description of Artificial Sequence: Synthetic oligonucleotide
ctactctcggggtcctggccctga

SEQ ID NO: 20725 - DNA, 24 bp, Artificial Sequence
  Description of Artificial Sequence: Synthetic oligonucleotide
tactctcggggtcctggccctgac

SEQ ID NO: 20726 - DNA, 23 bp, Artificial Sequence
  Description of Artificial Sequence: Synthetic oligonucleotide
actctcggggtcctggccctgac

SEQ ID NO: 20727 - DNA, 22 bp, Artificial Sequence
  Description of Artificial Sequence: Synthetic oligonucleotide
ctctcggggtcctggccctgac

SEQ ID NO: 20728 - DNA, 22 bp, Artificial Sequence
  Description of Artificial Sequence: Synthetic oligonucleotide
tctcggggtcctggccctgacc

SEQ ID NO: 20729 - DNA, 21 bp, Artificial Sequence
  Description of Artificial Sequence: Synthetic oligonucleotide
ctcggggtcctggccctgacc

SEQ ID NO: 20730 - DNA, 22 bp, Artificial Sequence
  Description of Artificial Sequence: Synthetic oligonucleotide
tcggggtcctggccctgaccca

SEQ ID NO: 20731 - DNA, 21 bp, Artificial Sequence
  Description of Artificial Sequence: Synthetic oligonucleotide
cggggtcctggccctgaccca

SEQ ID NO: 20732 - DNA, 22 bp, Artificial Sequence
  Description of Artificial Sequence: Synthetic oligonucleotide
ggggtcctggccctgacccaga

SEQ ID NO: 20733 - DNA, 22 bp, Artificial Sequence
  Description of Artificial Sequence: Synthetic oligonucleotide
gggtcctggccctgacccagac

SEQ ID NO: 20734 - DNA, 23 bp, Artificial Sequence
  Description of Artificial Sequence: Synthetic oligonucleotide
ggtcctggccctgacccagacct

SEQ ID NO: 20735 - DNA, 23 bp, Artificial Sequence
  Description of Artificial Sequence: Synthetic oligonucleotide
gtcctggccctgacccagacctg

SEQ ID NO: 20736 - DNA, 23 bp, Artificial Sequence
  Description of Artificial Sequence: Synthetic oligonucleotide
tcctggccctgacccagacctgg

SEQ ID NO: 20737 - DNA, 23 bp, Artificial Sequence
  Description of Artificial Sequence: Synthetic oligonucleotide
aggggccggagtattgggaccgg

SEQ ID NO: 20738 - DNA, 22 bp, Artificial Sequence
  Description of Artificial Sequence: Synthetic oligonucleotide
ggggccggagtattgggaccgg

SEQ ID NO: 20739 - DNA, 23 bp, Artificial Sequence
  Description of Artificial Sequence: Synthetic oligonucleotide
gggccggagtattgggaccggga

SEQ ID NO: 20740 - DNA, 24 bp, Artificial Sequence
  Description of Artificial Sequence: Synthetic oligonucleotide
ggccggagtattgggaccgggaga

SEQ ID NO: 20741 - DNA, 25 bp, Artificial Sequence
  Description of Artificial Sequence: Synthetic oligonucleotide
gccggagtattgggaccgggagaca

SEQ ID NO: 20742 - DNA, 25 bp, Artificial Sequence
  Description of Artificial Sequence: Synthetic oligonucleotide
ccggagtattgggaccgggagacac

SEQ ID NO: 20743 - DNA, 25 bp, Artificial Sequence
  Description of Artificial Sequence: Synthetic oligonucleotide
cggagtattgggaccgggagacacg

SEQ ID NO: 20744 - DNA, 27 bp, Artificial Sequence
  Description of Artificial Sequence: Synthetic oligonucleotide
ggagtattgggaccgggagacacggaa

SEQ ID NO: 20745 - DNA, 28 bp, Artificial Sequence
  Description of Artificial Sequence: Synthetic oligonucleotide
gagtattgggaccgggagacacggaatg

SEQ ID NO: 20746 - DNA, 29 bp, Artificial Sequence
  Description of Artificial Sequence: Synthetic oligonucleotide
agtattgggaccgggagacacggaatgtg

SEQ ID NO: 20747 - DNA, 28 bp, Artificial Sequence
  Description of Artificial Sequence: Synthetic oligonucleotide
gtattgggaccgggagacacggaatgtg

SEQ ID NO: 20748 - DNA, 30 bp, Artificial Sequence
  Description of Artificial Sequence: Synthetic oligonucleotide
tattgggaccgggagacacggaatgtgaag

SEQ ID NO: 20749 - DNA, 29 bp, Artificial Sequence
  Description of Artificial Sequence: Synthetic oligonucleotide
attgggaccgggagacacggaatgtgaag

SEQ ID NO: 20750 - DNA, 28 bp, Artificial Sequence
  Description of Artificial Sequence: Synthetic oligonucleotide
ttgggaccgggagacacggaatgtgaag

SEQ ID NO: 20751 - DNA, 27 bp, Artificial Sequence
  Description of Artificial Sequence: Synthetic oligonucleotide
tgggaccgggagacacggaatgtgaag

SEQ ID NO: 20752 - DNA, 26 bp, Artificial Sequence
  Description of Artificial Sequence: Synthetic oligonucleotide
gggaccgggagacacggaatgtgaag

SEQ ID NO: 20753 - DNA, 26 bp, Artificial Sequence
  Description of Artificial Sequence: Synthetic oligonucleotide
ggaccgggagacacggaatgtgaagg

SEQ ID NO: 20754 - DNA, 26 bp, Artificial Sequence
  Description of Artificial Sequence: Synthetic oligonucleotide
gaccgggagacacggaatgtgaaggc

SEQ ID NO: 20755 - DNA, 26 bp, Artificial Sequence
  Description of Artificial Sequence: Synthetic oligonucleotide
accgggagacacggaatgtgaaggcc

SEQ ID NO: 20756 - DNA, 25 bp, Artificial Sequence
  Description of Artificial Sequence: Synthetic oligonucleotide
ccgggagacacggaatgtgaaggcc

SEQ ID NO: 20757 - DNA, 26 bp, Artificial Sequence
  Description of Artificial Sequence: Synthetic oligonucleotide
cgggagacacggaatgtgaaggccca

SEQ ID NO: 20758 - DNA, 25 bp, Artificial Sequence
  Description of Artificial Sequence: Synthetic oligonucleotide
caagcacaagtgggaggcggccctt

SEQ ID NO: 20759 - DNA, 26 bp, Artificial Sequence
  Description of Artificial Sequence: Synthetic oligonucleotide
aagcacaagtgggaggcggcccttgt

SEQ ID NO: 20760 - DNA, 25 bp, Artificial Sequence
  Description of Artificial Sequence: Synthetic oligonucleotide
agcacaagtgggaggcggcccttgt

SEQ ID NO: 20761 - DNA, 24 bp, Artificial Sequence
  Description of Artificial Sequence: Synthetic oligonucleotide
gcacaagtgggaggcggcccttgt

SEQ ID NO: 20762 - DNA, 24 bp, Artificial Sequence
  Description of Artificial Sequence: Synthetic oligonucleotide
cacaagtgggaggcggcccttgtg

SEQ ID NO: 20763 - DNA, 24 bp, Artificial Sequence
  Description of Artificial Sequence: Synthetic oligonucleotide
acaagtgggaggcggcccttgtgg

SEQ ID NO: 20764 - DNA, 23 bp, Artificial Sequence
  Description of Artificial Sequence: Synthetic oligonucleotide
caagtgggaggcggcccttgtgg

SEQ ID NO: 20765 - DNA, 23 bp, Artificial Sequence
  Description of Artificial Sequence: Synthetic oligonucleotide
aagtgggaggcggcccttgtggc

SEQ ID NO: 20766 - DNA, 22 bp, Artificial Sequence
  Description of Artificial Sequence: Synthetic oligonucleotide
agtgggaggcggcccttgtggc

SEQ ID NO: 20767 - DNA, 21 bp, Artificial Sequence
  Description of Artificial Sequence: Synthetic oligonucleotide
gtgggaggcggcccttgtggc

SEQ ID NO: 20768 - DNA, 21 bp, Artificial Sequence
  Description of Artificial Sequence: Synthetic oligonucleotide
tgggaggcggcccttgtggcg

SEQ ID NO: 20769 - DNA, 20 bp, Artificial Sequence
  Description of Artificial Sequence: Synthetic oligonucleotide
gggaggcggcccttgtggcg

SEQ ID NO: 20770 - DNA, 21 bp, Artificial Sequence
  Description of Artificial Sequence: Synthetic oligonucleotide
ggaggcggcccttgtggcgga

SEQ ID NO: 20771 - DNA, 21 bp, Artificial Sequence
  Description of Artificial Sequence: Synthetic oligonucleotide
gaggcggcccttgtggcggag

SEQ ID NO: 20772 - DNA, 22 bp, Artificial Sequence
  Description of Artificial Sequence: Synthetic oligonucleotide
aggcggcccttgtggcggagca

SEQ ID NO: 20773 - DNA, 21 bp, Artificial Sequence
  Description of Artificial Sequence: Synthetic oligonucleotide
ggcggcccttgtggcggagca

SEQ ID NO: 20774 - DNA, 22 bp, Artificial Sequence
  Description of Artificial Sequence: Synthetic oligonucleotide
gcggcccttgtggcggagcagt

SEQ ID NO: 20775 - DNA, 22 bp, Artificial Sequence
  Description of Artificial Sequence: Synthetic oligonucleotide
cggcccttgtggcggagcagtg

SEQ ID NO: 20776 - DNA, 23 bp, Artificial Sequence
  Description of Artificial Sequence: Synthetic oligonucleotide
ggcccttgtggcggagcagtgga

SEQ ID NO: 20777 - DNA, 24 bp, Artificial Sequence
  Description of Artificial Sequence: Synthetic oligonucleotide
gcccttgtggcggagcagtggaga

SEQ ID NO: 20778 - DNA, 24 bp, Artificial Sequence
  Description of Artificial Sequence: Synthetic oligonucleotide
cccttgtggcggagcagtggagag

SEQ ID NO: 20779 - DNA, 24 bp, Artificial Sequence
  Description of Artificial Sequence: Synthetic oligonucleotide
ccttgtggcggagcagtggagagc

SEQ ID NO: 20780 - DNA, 26 bp, Artificial Sequence
  Description of Artificial Sequence: Synthetic oligonucleotide
cttgtggcggagcagtggagagccta

SEQ ID NO: 20781 - DNA, 26 bp, Artificial Sequence
  Description of Artificial Sequence: Synthetic oligonucleotide
ttgtggcggagcagtggagagcctac

SEQ ID NO: 20782 - DNA, 23 bp, Artificial Sequence
  Description of Artificial Sequence: Synthetic oligonucleotide
ttcctccgcgggtaccggcaggt

SEQ ID NO: 20783 - DNA, 22 bp, Artificial Sequence
  Description of Artificial Sequence: Synthetic oligonucleotide
tcctccgcgggtaccggcaggt

SEQ ID NO: 20784 - DNA, 21 bp, Artificial Sequence
  Description of Artificial Sequence: Synthetic oligonucleotide
cctccgcgggtaccggcaggt

SEQ ID NO: 20785 - DNA, 21 bp, Artificial Sequence
  Description of Artificial Sequence: Synthetic oligonucleotide
ctccgcgggtaccggcaggtc

SEQ ID NO: 20786 - DNA, 21 bp, Artificial Sequence
  Description of Artificial Sequence: Synthetic oligonucleotide
tccgcgggtaccggcaggtcg

SEQ ID NO: 20787 - DNA, 20 bp, Artificial Sequence
  Description of Artificial Sequence: Synthetic oligonucleotide
ccgcgggtaccggcaggtcg

SEQ ID NO: 20788 - DNA, 20 bp, Artificial Sequence
  Description of Artificial Sequence: Synthetic oligonucleotide
cgcgggtaccggcaggtcgc

SEQ ID NO: 20789 - DNA, 22 bp, Artificial Sequence
  Description of Artificial Sequence: Synthetic oligonucleotide
gcgggtaccggcaggtcgccta

SEQ ID NO: 20790 - DNA, 22 bp, Artificial Sequence
  Description of Artificial Sequence: Synthetic oligonucleotide
cgggtaccggcaggtcgcctac

SEQ ID NO: 20791 - DNA, 23 bp, Artificial Sequence
  Description of Artificial Sequence: Synthetic oligonucleotide
gggtaccggcaggtcgcctacga

SEQ ID NO: 20792 - DNA, 23 bp, Artificial Sequence
  Description of Artificial Sequence: Synthetic oligonucleotide
ggtaccggcaggtcgcctacgac

SEQ ID NO: 20793 - DNA, 23 bp, Artificial Sequence
  Description of Artificial Sequence: Synthetic oligonucleotide
gtaccggcaggtcgcctacgacg

SEQ ID NO: 20794 - DNA, 23 bp, Artificial Sequence
  Description of Artificial Sequence: Synthetic oligonucleotide
taccggcaggtcgcctacgacgg

SEQ ID NO: 20795 - DNA, 22 bp, Artificial Sequence
  Description of Artificial Sequence: Synthetic oligonucleotide
accggcaggtcgcctacgacgg

SEQ ID NO: 20796 - DNA, 21 bp, Artificial Sequence
  Description of Artificial Sequence: Synthetic oligonucleotide
ccggcaggtcgcctacgacgg

SEQ ID NO: 20797 - DNA, 23 bp, Artificial Sequence
  Description of Artificial Sequence: Synthetic oligonucleotide
cggcaggtcgcctacgacggcaa

SEQ ID NO: 20798 - DNA, 23 bp, Artificial Sequence
  Description of Artificial Sequence: Synthetic oligonucleotide
ggcaggtcgcctacgacggcaag

SEQ ID NO: 20799 - DNA, 27 bp, Artificial Sequence
  Description of Artificial Sequence: Synthetic oligonucleotide
gcaggtcgcctacgacggcaaggatta

SEQ ID NO: 20800 - DNA, 27 bp, Artificial Sequence
  Description of Artificial Sequence: Synthetic oligonucleotide
caggtcgcctacgacggcaaggattac

SEQ ID NO: 20801 - DNA, 29 bp, Artificial Sequence
  Description of Artificial Sequence: Synthetic oligonucleotide
aggtcgcctacgacggcaaggattacatc

SEQ ID NO: 20802 - DNA, 28 bp, Artificial Sequence
  Description of Artificial Sequence: Synthetic oligonucleotide
ggtcgcctacgacggcaaggattacatc

SEQ ID NO: 20803 - DNA, 28 bp, Artificial Sequence
  Description of Artificial Sequence: Synthetic oligonucleotide
gtcgcctacgacggcaaggattacatcg

SEQ ID NO: 20804 - DNA, 23 bp, Artificial Sequence
  Description of Artificial Sequence: Synthetic oligonucleotide
ccagaggatggagccgcgagcca

SEQ ID NO: 20805 - DNA, 24 bp, Artificial Sequence
  Description of Artificial Sequence: Synthetic oligonucleotide
cagaggatggagccgcgagccaga

SEQ ID NO: 20806 - DNA, 24 bp, Artificial Sequence
  Description of Artificial Sequence: Synthetic oligonucleotide
agaggatggagccgcgagccagag

SEQ ID NO: 20807 - DNA, 23 bp, Artificial Sequence
  Description of Artificial Sequence: Synthetic oligonucleotide
gaggatggagccgcgagccagag

SEQ ID NO: 20808 - DNA, 25 bp, Artificial Sequence
  Description of Artificial Sequence: Synthetic oligonucleotide
aggatggagccgcgagccagaggat

SEQ ID NO: 20809 - DNA, 24 bp, Artificial Sequence
  Description of Artificial Sequence: Synthetic oligonucleotide
ggatggagccgcgagccagaggat

SEQ ID NO: 20810 - DNA, 24 bp, Artificial Sequence
  Description of Artificial Sequence: Synthetic oligonucleotide
gatggagccgcgagccagaggatg

SEQ ID NO: 20811 - DNA, 25 bp, Artificial Sequence
  Description of Artificial Sequence: Synthetic oligonucleotide
atggagccgcgagccagaggatgga

SEQ ID NO: 20812 - DNA, 24 bp, Artificial Sequence
  Description of Artificial Sequence: Synthetic oligonucleotide
tggagccgcgagccagaggatgga

SEQ ID NO: 20813 - DNA, 23 bp, Artificial Sequence
  Description of Artificial Sequence: Synthetic oligonucleotide
ggagccgcgagccagaggatgga

SEQ ID NO: 20814 - DNA, 23 bp, Artificial Sequence
  Description of Artificial Sequence: Synthetic oligonucleotide
gagccgcgagccagaggatggag

SEQ ID NO: 20815 - DNA, 23 bp, Artificial Sequence
  Description of Artificial Sequence: Synthetic oligonucleotide
agccgcgagccagaggatggagc

SEQ ID NO: 20816 - DNA, 21 bp, Artificial Sequence
  Description of Artificial Sequence: Synthetic oligonucleotide
cgacgtggggtcggacgggca

SEQ ID NO: 20817 - DNA, 23 bp, Artificial Sequence
  Description of Artificial Sequence: Synthetic oligonucleotide
gacgtggggtcggacgggcactt

SEQ ID NO: 20818 - DNA, 23 bp, Artificial Sequence
  Description of Artificial Sequence: Synthetic oligonucleotide
acgtggggtcggacgggcacttc

SEQ ID NO: 20819 - DNA, 22 bp, Artificial Sequence
  Description of Artificial Sequence: Synthetic oligonucleotide
cgtggggtcggacgggcacttc

SEQ ID NO: 20820 - DNA, 23 bp, Artificial Sequence
  Description of Artificial Sequence: Synthetic oligonucleotide
gtggggtcggacgggcacttcct

SEQ ID NO: 20821 - DNA, 23 bp, Artificial Sequence
  Description of Artificial Sequence: Synthetic oligonucleotide
tggggtcggacgggcacttcctc

SEQ ID NO: 20822 - DNA, 22 bp, Artificial Sequence
  Description of Artificial Sequence: Synthetic oligonucleotide
ggggtcggacgggcacttcctc

SEQ ID NO: 20823 - DNA, 22 bp, Artificial Sequence
  Description of Artificial Sequence: Synthetic oligonucleotide
gggtcggacgggcacttcctcc

SEQ ID NO: 20824 - DNA, 22 bp, Artificial Sequence
  Description of Artificial Sequence: Synthetic oligonucleotide
ggtcggacgggcacttcctccg

SEQ ID NO: 20825 - DNA, 22 bp, Artificial Sequence
  Description of Artificial Sequence: Synthetic oligonucleotide
gtcggacgggcacttcctccgc

SEQ ID NO: 20826 - DNA, 22 bp, Artificial Sequence
  Description of Artificial Sequence: Synthetic oligonucleotide
tcggacgggcacttcctccgcg

SEQ ID NO: 20827 - DNA, 22 bp, Artificial Sequence
  Description of Artificial Sequence: Synthetic oligonucleotide
gggcacttcctccgcgggtacc

SEQ ID NO: 20828 - DNA, 22 bp, Artificial Sequence
  Description of Artificial Sequence: Synthetic oligonucleotide
ggcacttcctccgcgggtaccg

SEQ ID NO: 20829 - DNA, 22 bp, Artificial Sequence
  Description of Artificial Sequence: Synthetic oligonucleotide
gcacttcctccgcgggtaccgg

SEQ ID NO: 20830 - DNA, 23 bp, Artificial Sequence
  Description of Artificial Sequence: Synthetic oligonucleotide
cacttcctccgcgggtaccggca

SEQ ID NO: 20831 - DNA, 23 bp, Artificial Sequence
  Description of Artificial Sequence: Synthetic oligonucleotide
acttcctccgcgggtaccggcag

SEQ ID NO: 20832 - DNA, 23 bp, Artificial Sequence
  Description of Artificial Sequence: Synthetic oligonucleotide
cgagtggacctggggaccctgca

SEQ ID NO: 20833 - DNA, 23 bp, Artificial Sequence
  Description of Artificial Sequence: Synthetic oligonucleotide
gagtggacctggggaccctgcac

SEQ ID NO: 20834 - DNA, 23 bp, Artificial Sequence
  Description of Artificial Sequence: Synthetic oligonucleotide
agtggacctggggaccctgcacg

SEQ ID NO: 20835 - DNA, 22 bp, Artificial Sequence
  Description of Artificial Sequence: Synthetic oligonucleotide
gtggacctggggaccctgcacg

SEQ ID NO: 20836 - DNA, 22 bp, Artificial Sequence
  Description of Artificial Sequence: Synthetic oligonucleotide
tggacctggggaccctgcacgg

SEQ ID NO: 20837 - DNA, 21 bp, Artificial Sequence
  Description of Artificial Sequence: Synthetic oligonucleotide
ggacctggggaccctgcacgg

SEQ ID NO: 20838 - DNA, 23 bp, Artificial Sequence
  Description of Artificial Sequence: Synthetic oligonucleotide
gacctggggaccctgcacggcta

SEQ ID NO: 20839 - DNA, 25 bp, Artificial Sequence
  Description of Artificial Sequence: Synthetic oligonucleotide
acctggggaccctgcacggctacta

SEQ ID NO: 20840 - DNA, 24 bp, Artificial Sequence
  Description of Artificial Sequence: Synthetic oligonucleotide
cctggggaccctgcacggctacta

SEQ ID NO: 20841 - DNA, 26 bp, Artificial Sequence
  Description of Artificial Sequence: Synthetic oligonucleotide
ctggggaccctgcacggctactacaa

SEQ ID NO: 20842 - DNA, 26 bp, Artificial Sequence
  Description of Artificial Sequence: Synthetic oligonucleotide
tggggaccctgcacggctactacaac

SEQ ID NO: 20843 - DNA, 25 bp, Artificial Sequence
  Description of Artificial Sequence: Synthetic oligonucleotide
ggggaccctgcacggctactacaac

SEQ ID NO: 20844 - DNA, 26 bp, Artificial Sequence
  Description of Artificial Sequence: Synthetic oligonucleotide
gggaccctgcacggctactacaacca

SEQ ID NO: 20845 - DNA, 27 bp, Artificial Sequence
  Description of Artificial Sequence: Synthetic oligonucleotide
ggaccctgcacggctactacaaccaga

SEQ ID NO: 20846 - DNA, 27 bp, Artificial Sequence
  Description of Artificial Sequence: Synthetic oligonucleotide
gaccctgcacggctactacaaccagag

SEQ ID NO: 20847 - DNA, 27 bp, Artificial Sequence
  Description of Artificial Sequence: Synthetic oligonucleotide
accctgcacggctactacaaccagagc

SEQ ID NO: 20848 - DNA, 26 bp, Artificial Sequence
  Description of Artificial Sequence: Synthetic oligonucleotide
ccctgcacggctactacaaccagagc

SEQ ID NO: 20849 - DNA, 27 bp, Artificial Sequence
  Description of Artificial Sequence: Synthetic oligonucleotide
cctgcacggctactacaaccagagcga

SEQ ID NO: 20850 - DNA, 27 bp, Artificial Sequence
  Description of Artificial Sequence: Synthetic oligonucleotide
ctgcacggctactacaaccagagcgag

SEQ ID NO: 20851 - DNA, 27 bp, Artificial Sequence
  Description of Artificial Sequence: Synthetic oligonucleotide
tgcacggctactacaaccagagcgagg

SEQ ID NO: 20852 - DNA, 26 bp, Artificial Sequence
  Description of Artificial Sequence: Synthetic oligonucleotide
gcacggctactacaaccagagcgagg

SEQ ID NO: 20853 - DNA, 26 bp, Artificial Sequence
  Description of Artificial Sequence: Synthetic oligonucleotide
cacggctactacaaccagagcgaggc

SEQ ID NO: 20854 - DNA, 26 bp, Artificial Sequence
  Description of Artificial Sequence: Synthetic oligonucleotide
acggctactacaaccagagcgaggcc

SEQ ID NO: 20855 - DNA, 31 bp, Artificial Sequence
  Description of Artificial Sequence: Synthetic oligonucleotide
agtattgggaccggaacacacggaatgtgag

SEQ ID NO: 20856 - DNA, 30 bp, Artificial Sequence
  Description of Artificial Sequence: Synthetic oligonucleotide
gtattgggaccggaacacacggaatgtgag

SEQ ID NO: 20857 - DNA, 30 bp, Artificial Sequence
  Description of Artificial Sequence: Synthetic oligonucleotide
tattgggaccggaacacacggaatgtgagg

SEQ ID NO: 20858 - DNA, 29 bp, Artificial Sequence
  Description of Artificial Sequence: Synthetic oligonucleotide
attgggaccggaacacacggaatgtgagg

SEQ ID NO: 20859 - DNA, 28 bp, Artificial Sequence
  Description of Artificial Sequence: Synthetic oligonucleotide
ttgggaccggaacacacggaatgtgagg

SEQ ID NO: 20860 - DNA, 27 bp, Artificial Sequence
  Description of Artificial Sequence: Synthetic oligonucleotide
tgggaccggaacacacggaatgtgagg

SEQ ID NO: 20861 - DNA, 26 bp, Artificial Sequence
  Description of Artificial Sequence: Synthetic oligonucleotide
gggaccggaacacacggaatgtgagg

SEQ ID NO: 20862 - DNA, 26 bp, Artificial Sequence
  Description of Artificial Sequence: Synthetic oligonucleotide
ggaccggaacacacggaatgtgaggg

SEQ ID NO: 20863 - DNA, 26 bp, Artificial Sequence
  Description of Artificial Sequence: Synthetic oligonucleotide
gaccggaacacacggaatgtgagggc

SEQ ID NO: 20864 - DNA, 26 bp, Artificial Sequence
  Description of Artificial Sequence: Synthetic oligonucleotide
accggaacacacggaatgtgagggcc

SEQ ID NO: 20865 - DNA, 25 bp, Artificial Sequence
  Description of Artificial Sequence: Synthetic oligonucleotide
ccggaacacacggaatgtgagggcc

SEQ ID NO: 20866 - DNA, 26 bp, Artificial Sequence
  Description of Artificial Sequence: Synthetic oligonucleotide
cggaacacacggaatgtgagggccca

SEQ ID NO: 20867 - DNA, 27 bp, Artificial Sequence
  Description of Artificial Sequence: Synthetic oligonucleotide
ggaacacacggaatgtgagggcccagt

SEQ ID NO: 20868 - DNA, 27 bp, Artificial Sequence
  Description of Artificial Sequence: Synthetic oligonucleotide
gaacacacggaatgtgagggcccagtc

SEQ ID NO: 20869 - DNA, 28 bp, Artificial Sequence
  Description of Artificial Sequence: Synthetic oligonucleotide
aacacacggaatgtgagggcccagtcac

SEQ ID NO: 20870 - DNA, 27 bp, Artificial Sequence
  Description of Artificial Sequence: Synthetic oligonucleotide
acacacggaatgtgagggcccagtcac

SEQ ID NO: 20871 - DNA, 27 bp, Artificial Sequence
  Description of Artificial Sequence: Synthetic oligonucleotide
cacacggaatgtgagggcccagtcaca

SEQ ID NO: 20872 - DNA, 27 bp, Artificial Sequence
  Description of Artificial Sequence: Synthetic oligonucleotide
acacggaatgtgagggcccagtcacag

SEQ ID NO: 20873 - DNA, 27 bp, Artificial Sequence
  Description of Artificial Sequence: Synthetic oligonucleotide
cacggaatgtgagggcccagtcacaga

SEQ ID NO: 20874 - DNA, 27 bp, Artificial Sequence
  Description of Artificial Sequence: Synthetic oligonucleotide
acggaatgtgagggcccagtcacagac

SEQ ID NO: 20875 - DNA, 27 bp, Artificial Sequence
  Description of Artificial Sequence: Synthetic oligonucleotide
cggaatgtgagggcccagtcacagact

SEQ ID NO: 20876 - DNA, 27 bp, Artificial Sequence
  Description of Artificial Sequence: Synthetic oligonucleotide
ggaatgtgagggcccagtcacagactg

SEQ ID NO: 20877 - DNA, 28 bp, Artificial Sequence
  Description of Artificial Sequence: Synthetic oligonucleotide
gaatgtgagggcccagtcacagactgac

SEQ ID NO: 20878 - DNA, 28 bp, Artificial Sequence
  Description of Artificial Sequence: Synthetic oligonucleotide
aatgtgagggcccagtcacagactgacc

SEQ ID NO: 20879 - DNA, 27 bp, Artificial Sequence
  Description of Artificial Sequence: Synthetic oligonucleotide
atgtgagggcccagtcacagactgacc

SEQ ID NO: 20880 - DNA, 26 bp, Artificial Sequence
  Description of Artificial Sequence: Synthetic oligonucleotide
tgtgagggcccagtcacagactgacc

SEQ ID NO: 20881 - DNA, 25 bp, Artificial Sequence
  Description of Artificial Sequence: Synthetic oligonucleotide
gtgagggcccagtcacagactgacc

SEQ ID NO: 20882 - DNA, 26 bp, Artificial Sequence
  Description of Artificial Sequence: Synthetic oligonucleotide
tgagggcccagtcacagactgaccga

SEQ ID NO: 20883 - DNA, 25 bp, Artificial Sequence
  Description of Artificial Sequence: Synthetic oligonucleotide
gagggcccagtcacagactgaccga

SEQ ID NO: 20884 - DNA, 26 bp, Artificial Sequence
  Description of Artificial Sequence: Synthetic oligonucleotide
agggcccagtcacagactgaccgagt

SEQ ID NO: 20885 - DNA, 25 bp, Artificial Sequence
  Description of Artificial Sequence: Synthetic oligonucleotide
gggcccagtcacagactgaccgagt

SEQ ID NO: 20886 - DNA, 20 bp, Artificial Sequence
  Description of Artificial Sequence: Synthetic oligonucleotide
gcgcctcctccgcgggtacc

SEQ ID NO: 20887 - DNA, 20 bp, Artificial Sequence
  Description of Artificial Sequence: Synthetic oligonucleotide
cgcctcctccgcgggtaccg

SEQ ID NO: 20888 - DNA, 20 bp, Artificial Sequence
  Description of Artificial Sequence: Synthetic oligonucleotide
gcctcctccgcgggtaccgg

SEQ ID NO: 20889 - DNA, 21 bp, Artificial Sequence
  Description of Artificial Sequence: Synthetic oligonucleotide
cctcctccgcgggtaccggca

SEQ ID NO: 20890 - DNA, 21 bp, Artificial Sequence
  Description of Artificial Sequence: Synthetic oligonucleotide
ctcctccgcgggtaccggcag

SEQ ID NO: 20891 - DNA, 23 bp, Artificial Sequence
  Description of Artificial Sequence: Synthetic oligonucleotide
ggggagccccgcttcatcgccat

SEQ ID NO: 20892 - DNA, 23 bp, Artificial Sequence
  Description of Artificial Sequence: Synthetic oligonucleotide
gggagccccgcttcatcgccatg

SEQ ID NO: 20893 - DNA, 23 bp, Artificial Sequence
  Description of Artificial Sequence: Synthetic oligonucleotide
ggagccccgcttcatcgccatgg

SEQ ID NO: 20894 - DNA, 23 bp, Artificial Sequence
  Description of Artificial Sequence: Synthetic oligonucleotide
gagccccgcttcatcgccatggg

SEQ ID NO: 20895 - DNA, 25 bp, Artificial Sequence
  Description of Artificial Sequence: Synthetic oligonucleotide
agccccgcttcatcgccatgggcta

SEQ ID NO: 20896 - DNA, 24 bp, Artificial Sequence
  Description of Artificial Sequence: Synthetic oligonucleotide
gccccgcttcatcgccatgggcta

SEQ ID NO: 20897 - DNA, 24 bp, Artificial Sequence
  Description of Artificial Sequence: Synthetic oligonucleotide
ccccgcttcatcgccatgggctac

SEQ ID NO: 20898 - DNA, 25 bp, Artificial Sequence
  Description of Artificial Sequence: Synthetic oligonucleotide
cccgcttcatcgccatgggctacgt

SEQ ID NO: 20899 - DNA, 25 bp, Artificial Sequence
  Description of Artificial Sequence: Synthetic oligonucleotide
ccgcttcatcgccatgggctacgtg

SEQ ID NO: 20900 - DNA, 26 bp, Artificial Sequence
  Description of Artificial Sequence: Synthetic oligonucleotide
cgcttcatcgccatgggctacgtgga

SEQ ID NO: 20901 - DNA, 26 bp, Artificial Sequence
  Description of Artificial Sequence: Synthetic oligonucleotide
gcttcatcgccatgggctacgtggac

SEQ ID NO: 20902 - DNA, 27 bp, Artificial Sequence
  Description of Artificial Sequence: Synthetic oligonucleotide
cttcatcgccatgggctacgtggacga

SEQ ID NO: 20903 - DNA, 27 bp, Artificial Sequence
  Description of Artificial Sequence: Synthetic oligonucleotide
ttcatcgccatgggctacgtggacgac

SEQ ID NO: 20904 - DNA, 27 bp, Artificial Sequence
  Description of Artificial Sequence: Synthetic oligonucleotide
tcatcgccatgggctacgtggacgaca

SEQ ID NO: 20905 - DNA, 26 bp, Artificial Sequence
  Description of Artificial Sequence: Synthetic oligonucleotide
catcgccatgggctacgtggacgaca

SEQ ID NO: 20906 - DNA, 26 bp, Artificial Sequence
  Description of Artificial Sequence: Synthetic oligonucleotide
atcgccatgggctacgtggacgacac

SEQ ID NO: 20907 - DNA, 25 bp, Artificial Sequence
  Description of Artificial Sequence: Synthetic oligonucleotide
tcgccatgggctacgtggacgacac

SEQ ID NO: 20908 - DNA, 24 bp, Artificial Sequence
  Description of Artificial Sequence: Synthetic oligonucleotide
cgccatgggctacgtggacgacac

SEQ ID NO: 20909 - DNA, 24 bp, Artificial Sequence
  Description of Artificial Sequence: Synthetic oligonucleotide
gccatgggctacgtggacgacacg

SEQ ID NO: 20910 - DNA, 25 bp, Artificial Sequence
  Description of Artificial Sequence: Synthetic oligonucleotide
ccatgggctacgtggacgacacgca

SEQ ID NO: 20911 - DNA, 27 bp, Artificial Sequence
  Description of Artificial Sequence: Synthetic oligonucleotide
catgggctacgtggacgacacgcagtt

SEQ ID NO: 20912 - DNA, 27 bp, Artificial Sequence
  Description of Artificial Sequence: Synthetic oligonucleotide
atgggctacgtggacgacacgcagttc

SEQ ID NO: 20913 - DNA, 26 bp, Artificial Sequence
  Description of Artificial Sequence: Synthetic oligonucleotide
cagtggagagcctacctggagggcat

SEQ ID NO: 20914 - DNA, 27 bp, Artificial Sequence
  Description of Artificial Sequence: Synthetic oligonucleotide
agtggagagcctacctggagggcatgt

SEQ ID NO: 20915 - DNA, 26 bp, Artificial Sequence
  Description of Artificial Sequence: Synthetic oligonucleotide
gtggagagcctacctggagggcatgt

SEQ ID NO: 20916 - DNA, 26 bp, Artificial Sequence
  Description of Artificial Sequence: Synthetic oligonucleotide
tggagagcctacctggagggcatgtg

SEQ ID NO: 20917 - DNA, 25 bp, Artificial Sequence
  Description of Artificial Sequence: Synthetic oligonucleotide
ggagagcctacctggagggcatgtg

SEQ ID NO: 20918 - DNA, 25 bp, Artificial Sequence
  Description of Artificial Sequence: Synthetic oligonucleotide
gagagcctacctggagggcatgtgc

SEQ ID NO: 20919 - DNA, 26 bp, Artificial Sequence
  Description of Artificial Sequence: Synthetic oligonucleotide
agagcctacctggagggcatgtgcgt

SEQ ID NO: 20920 - DNA, 25 bp, Artificial Sequence
  Description of Artificial Sequence: Synthetic oligonucleotide
gagcctacctggagggcatgtgcgt

SEQ ID NO: 20921 - DNA, 25 bp, Artificial Sequence
  Description of Artificial Sequence: Synthetic oligonucleotide
agcctacctggagggcatgtgcgtg

SEQ ID NO: 20922 - DNA, 24 bp, Artificial Sequence
  Description of Artificial Sequence: Synthetic oligonucleotide
gcctacctggagggcatgtgcgtg

SEQ ID NO: 20923 - DNA, 25 bp, Artificial Sequence
  Description of Artificial Sequence: Synthetic oligonucleotide
cctacctggagggcatgtgcgtgga

SEQ ID NO: 20924 - DNA, 26 bp, Artificial Sequence
  Description of Artificial Sequence: Synthetic oligonucleotide
ctacctggagggcatgtgcgtggagt

SEQ ID NO: 20925 - DNA, 26 bp, Artificial Sequence
  Description of Artificial Sequence: Synthetic oligonucleotide
tacctggagggcatgtgcgtggagtg

SEQ ID NO: 20926 - DNA, 25 bp, Artificial Sequence
  Description of Artificial Sequence: Synthetic oligonucleotide
acctggagggcatgtgcgtggagtg

SEQ ID NO: 20927 - DNA, 24 bp, Artificial Sequence
  Description of Artificial Sequence: Synthetic oligonucleotide
cctggagggcatgtgcgtggagtg

SEQ ID NO: 20928 - DNA, 24 bp, Artificial Sequence
  Description of Artificial Sequence: Synthetic oligonucleotide
ctggagggcatgtgcgtggagtgg

SEQ ID NO: 20929 - DNA, 25 bp, Artificial Sequence
  Description of Artificial Sequence: Synthetic oligonucleotide
tggagggcatgtgcgtggagtggct

SEQ ID NO: 20930 - DNA, 24 bp, Artificial Sequence
  Description of Artificial Sequence: Synthetic oligonucleotide
ggagggcatgtgcgtggagtggct

SEQ ID NO: 20931 - DNA, 24 bp, Artificial Sequence
  Description of Artificial Sequence: Synthetic oligonucleotide
gagggcatgtgcgtggagtggctc

SEQ ID NO: 20932 - DNA, 24 bp, Artificial Sequence
  Description of Artificial Sequence: Synthetic oligonucleotide
agggcatgtgcgtggagtggctcc

SEQ ID NO: 20933 - DNA, 23 bp, Artificial Sequence
  Description of Artificial Sequence: Synthetic oligonucleotide
gggcatgtgcgtggagtggctcc

SEQ ID NO: 20934 - DNA, 23 bp, Artificial Sequence
  Description of Artificial Sequence: Synthetic oligonucleotide
ggcatgtgcgtggagtggctccg

SEQ ID NO: 20935 - DNA, 24 bp, Artificial Sequence
  Description of Artificial Sequence: Synthetic oligonucleotide
gcatgtgcgtggagtggctccgca

SEQ ID NO: 20936 - DNA, 27 bp, Artificial Sequence
  Description of Artificial Sequence: Synthetic oligonucleotide
catgtgcgtggagtggctccgcagata

SEQ ID NO: 20937 - DNA, 27 bp, Artificial Sequence
  Description of Artificial Sequence: Synthetic oligonucleotide
atgtgcgtggagtggctccgcagatac

SEQ ID NO: 20938 - DNA, 27 bp, Artificial Sequence
  Description of Artificial Sequence: Synthetic oligonucleotide
gtcacagactgaccgagtggacctgga

SEQ ID NO: 20939 - DNA, 27 bp, Artificial Sequence
  Description of Artificial Sequence: Synthetic oligonucleotide
tcacagactgaccgagtggacctggag

SEQ ID NO: 20940 - DNA, 27 bp, Artificial Sequence
  Description of Artificial Sequence: Synthetic oligonucleotide
cacagactgaccgagtggacctggaga

SEQ ID NO: 20941 - DNA, 27 bp, Artificial Sequence
  Description of Artificial Sequence: Synthetic oligonucleotide
acagactgaccgagtggacctggagac

SEQ ID NO: 20942 - DNA, 26 bp, Artificial Sequence
  Description of Artificial Sequence: Synthetic oligonucleotide
cagactgaccgagtggacctggagac

SEQ ID NO: 20943 - DNA, 26 bp, Artificial Sequence
  Description of Artificial Sequence: Synthetic oligonucleotide
agactgaccgagtggacctggagacc

SEQ ID NO: 20944 - DNA, 25 bp, Artificial Sequence
  Description of Artificial Sequence: Synthetic oligonucleotide
gactgaccgagtggacctggagacc

SEQ ID NO: 20945 - DNA, 26 bp, Artificial Sequence
  Description of Artificial Sequence: Synthetic oligonucleotide
actgaccgagtggacctggagaccct

SEQ ID NO: 20946 - DNA, 25 bp, Artificial Sequence
  Description of Artificial Sequence: Synthetic oligonucleotide
ctgaccgagtggacctggagaccct

SEQ ID NO: 20947 - DNA, 25 bp, Artificial Sequence
  Description of Artificial Sequence: Synthetic oligonucleotide
tgaccgagtggacctggagaccctg

SEQ ID NO: 20948 - DNA, 24 bp, Artificial Sequence
  Description of Artificial Sequence: Synthetic oligonucleotide
gaccgagtggacctggagaccctg

SEQ ID NO: 20949 - DNA, 24 bp, Artificial Sequence
  Description of Artificial Sequence: Synthetic oligonucleotide
accgagtggacctggagaccctgc

SEQ ID NO: 20950 - DNA, 23 bp, Artificial Sequence
  Description of Artificial Sequence: Synthetic oligonucleotide
ccgagtggacctggagaccctgc

SEQ ID NO: 20951 - DNA, 23 bp, Artificial Sequence
  Description of Artificial Sequence: Synthetic oligonucleotide
cgagtggacctggagaccctgcg

SEQ ID NO: 20952 - DNA, 23 bp, Artificial Sequence
  Description of Artificial Sequence: Synthetic oligonucleotide
gagtggacctggagaccctgcgc

SEQ ID NO: 20953 - DNA, 23 bp, Artificial Sequence
  Description of Artificial Sequence: Synthetic oligonucleotide
agtggacctggagaccctgcgcg

SEQ ID NO: 20954 - DNA, 22 bp, Artificial Sequence
  Description of Artificial Sequence: Synthetic oligonucleotide
gtggacctggagaccctgcgcg

SEQ ID NO: 20955 - DNA, 22 bp, Artificial Sequence
  Description of Artificial Sequence: Synthetic oligonucleotide
tggacctggagaccctgcgcgg

SEQ ID NO: 20956 - DNA, 21 bp, Artificial Sequence
  Description of Artificial Sequence: Synthetic oligonucleotide
ggacctggagaccctgcgcgg

SEQ ID NO: 20957 - DNA, 23 bp, Artificial Sequence
  Description of Artificial Sequence: Synthetic oligonucleotide
gacctggagaccctgcgcggcta

SEQ ID NO: 20958 - DNA, 25 bp, Artificial Sequence
  Description of Artificial Sequence: Synthetic oligonucleotide
acctggagaccctgcgcggctacta

SEQ ID NO: 20959 - DNA, 24 bp, Artificial Sequence
  Description of Artificial Sequence: Synthetic oligonucleotide
cctggagaccctgcgcggctacta

SEQ ID NO: 20960 - DNA, 26 bp, Artificial Sequence
  Description of Artificial Sequence: Synthetic oligonucleotide
ctggagaccctgcgcggctactacaa

SEQ ID NO: 20961 - DNA, 26 bp, Artificial Sequence
  Description of Artificial Sequence: Synthetic oligonucleotide
tggagaccctgcgcggctactacaac

SEQ ID NO: 20962 - DNA, 25 bp, Artificial Sequence
  Description of Artificial Sequence: Synthetic oligonucleotide
ggagaccctgcgcggctactacaac

SEQ ID NO: 20963 - DNA, 26 bp, Artificial Sequence
  Description of Artificial Sequence: Synthetic oligonucleotide
gagaccctgcgcggctactacaacca

SEQ ID NO: 20964 - DNA, 27 bp, Artificial Sequence
  Description of Artificial Sequence: Synthetic oligonucleotide
agaccctgcgcggctactacaaccaga

SEQ ID NO: 20965 - DNA, 34 bp, Artificial Sequence
  Description of Artificial Sequence: Synthetic oligonucleotide
ttctcacaccatccagatgatgtatggctgcaac

SEQ ID NO: 20966 - DNA, 33 bp, Artificial Sequence
  Description of Artificial Sequence: Synthetic oligonucleotide
tctcacaccatccagatgatgtatggctgcaac

SEQ ID NO: 20967 - DNA, 32 bp, Artificial Sequence
  Description of Artificial Sequence: Synthetic oligonucleotide
ctcacaccatccagatgatgtatggctgcaac

SEQ ID NO: 20968 - DNA, 32 bp, Artificial Sequence
  Description of Artificial Sequence: Synthetic oligonucleotide
tcacaccatccagatgatgtatggctgcaacg

SEQ ID NO: 20969 - DNA, 31 bp, Artificial Sequence
  Description of Artificial Sequence: Synthetic oligonucleotide
cacaccatccagatgatgtatggctgcaacg

SEQ ID NO: 20970 - DNA, 32 bp, Artificial Sequence
  Description of Artificial Sequence: Synthetic oligonucleotide
acaccatccagatgatgtatggctgcaacgtg

SEQ ID NO: 20971 - DNA, 31 bp, Artificial Sequence
  Description of Artificial Sequence: Synthetic oligonucleotide
caccatccagatgatgtatggctgcaacgtg

SEQ ID NO: 20972 - DNA, 31 bp, Artificial Sequence
  Description of Artificial Sequence: Synthetic oligonucleotide
accatccagatgatgtatggctgcaacgtgg

SEQ ID NO: 20973 - DNA, 30 bp, Artificial Sequence
  Description of Artificial Sequence: Synthetic oligonucleotide
ccatccagatgatgtatggctgcaacgtgg

SEQ ID NO: 20974 - DNA, 30 bp, Artificial Sequence
  Description of Artificial Sequence: Synthetic oligonucleotide
catccagatgatgtatggctgcaacgtggg

SEQ ID NO: 20975 - DNA, 30 bp, Artificial Sequence
  Description of Artificial Sequence: Synthetic oligonucleotide
atccagatgatgtatggctgcaacgtgggg

SEQ ID NO: 20976 - DNA, 29 bp, Artificial Sequence
  Description of Artificial Sequence: Synthetic oligonucleotide
tccagatgatgtatggctgcaacgtgggg

SEQ ID NO: 20977 - DNA, 28 bp, Artificial Sequence
  Description of Artificial Sequence: Synthetic oligonucleotide
ccagatgatgtatggctgcaacgtgggg

SEQ ID NO: 20978 - DNA, 29 bp, Artificial Sequence
  Description of Artificial Sequence: Synthetic oligonucleotide
cagatgatgtatggctgcaacgtggggtc

SEQ ID NO: 20979 - DNA, 29 bp, Artificial Sequence
  Description of Artificial Sequence: Synthetic oligonucleotide
agatgatgtatggctgcaacgtggggtcg

SEQ ID NO: 20980 - DNA, 28 bp, Artificial Sequence
  Description of Artificial Sequence: Synthetic oligonucleotide
gatgatgtatggctgcaacgtggggtcg

SEQ ID NO: 20981 - DNA, 28 bp, Artificial Sequence
  Description of Artificial Sequence: Synthetic oligonucleotide
atgatgtatggctgcaacgtggggtcgg

SEQ ID NO: 20982 - DNA, 27 bp, Artificial Sequence
  Description of Artificial Sequence: Synthetic oligonucleotide
tgatgtatggctgcaacgtggggtcgg

SEQ ID NO: 20983 - DNA, 27 bp, Artificial Sequence
  Description of Artificial Sequence: Synthetic oligonucleotide
gatgtatggctgcaacgtggggtcgga

SEQ ID NO: 20984 - DNA, 27 bp, Artificial Sequence
  Description of Artificial Sequence: Synthetic oligonucleotide
atgtatggctgcaacgtggggtcggac

SEQ ID NO: 20985 - DNA, 26 bp, Artificial Sequence
  Description of Artificial Sequence: Synthetic oligonucleotide
tgtatggctgcaacgtggggtcggac

SEQ ID NO: 20986 - DNA, 25 bp, Artificial Sequence
  Description of Artificial Sequence: Synthetic oligonucleotide
gtatggctgcaacgtggggtcggac

SEQ ID NO: 20987 - DNA, 25 bp, Artificial Sequence
  Description of Artificial Sequence: Synthetic oligonucleotide
tatggctgcaacgtggggtcggacg

SEQ ID NO: 20988 - DNA, 24 bp, Artificial Sequence
  Description of Artificial Sequence: Synthetic oligonucleotide
atggctgcaacgtggggtcggacg

SEQ ID NO: 20989 - DNA, 23 bp, Artificial Sequence
  Description of Artificial Sequence: Synthetic oligonucleotide
tggctgcaacgtggggtcggacg

SEQ ID NO: 20990 - DNA, 22 bp, Artificial Sequence
  Description of Artificial Sequence: Synthetic oligonucleotide
ggctgcaacgtggggtcggacg

SEQ ID NO: 20991 - DNA, 22 bp, Artificial Sequence
  Description of Artificial Sequence: Synthetic oligonucleotide
gctgcaacgtggggtcggacgg

SEQ ID NO: 20992 - DNA, 22 bp, Artificial Sequence
  Description of Artificial Sequence: Synthetic oligonucleotide
ctgcaacgtggggtcggacggg

SEQ ID NO: 20993 - DNA, 22 bp, Artificial Sequence
  Description of Artificial Sequence: Synthetic oligonucleotide
tgcaacgtggggtcggacgggc

SEQ ID NO: 20994 - DNA, 21 bp, Artificial Sequence
  Description of Artificial Sequence: Synthetic oligonucleotide
gcaacgtggggtcggacgggc

SEQ ID NO: 20995 - DNA, 21 bp, Artificial Sequence
  Description of Artificial Sequence: Synthetic oligonucleotide
caacgtggggtcggacgggcg

SEQ ID NO: 20996 - DNA, 23 bp, Artificial Sequence
  Description of Artificial Sequence: Synthetic oligonucleotide
aacgtggggtcggacgggcgctt

SEQ ID NO: 20997 - DNA, 27 bp, Artificial Sequence
  Description of Artificial Sequence: Synthetic oligonucleotide
ggaccggaacacacggaatgtgaaggg

SEQ ID NO: 20998 - DNA, 27 bp, Artificial Sequence
  Description of Artificial Sequence: Synthetic oligonucleotide
gaccggaacacacggaatgtgaagggc

SEQ ID NO: 20999 - DNA, 27 bp, Artificial Sequence
  Description of Artificial Sequence: Synthetic oligonucleotide
accggaacacacggaatgtgaagggcc

SEQ ID NO: 21000 - DNA, 27 bp, Artificial Sequence
  Description of Artificial Sequence: Synthetic oligonucleotide
ccggaacacacggaatgtgaagggcca

SEQ ID NO: 21001 - DNA, 27 bp, Artificial Sequence
  Description of Artificial Sequence: Synthetic oligonucleotide
cggaacacacggaatgtgaagggccag

SEQ ID NO: 21002 - DNA, 28 bp, Artificial Sequence
  Description of Artificial Sequence: Synthetic oligonucleotide
ggaacacacggaatgtgaagggccagtc

SEQ ID NO: 21003 - DNA, 29 bp, Artificial Sequence
  Description of Artificial Sequence: Synthetic oligonucleotide
gaacacacggaatgtgaagggccagtcac

SEQ ID NO: 21004 - DNA, 30 bp, Artificial Sequence
  Description of Artificial Sequence: Synthetic oligonucleotide
aacacacggaatgtgaagggccagtcacag

SEQ ID NO: 21005 - DNA, 29 bp, Artificial Sequence
  Description of Artificial Sequence: Synthetic oligonucleotide
acacacggaatgtgaagggccagtcacag

SEQ ID NO: 21006 - DNA, 28 bp, Artificial Sequence
  Description of Artificial Sequence: Synthetic oligonucleotide
cacacggaatgtgaagggccagtcacag

SEQ ID NO: 21007 - DNA, 29 bp, Artificial Sequence
  Description of Artificial Sequence: Synthetic oligonucleotide
acacggaatgtgaagggccagtcacagac

SEQ ID NO: 21008 - DNA, 28 bp, Artificial Sequence
  Description of Artificial Sequence: Synthetic oligonucleotide
cacggaatgtgaagggccagtcacagac

SEQ ID NO: 21009 - DNA, 29 bp, Artificial Sequence
  Description of Artificial Sequence: Synthetic oligonucleotide
acggaatgtgaagggccagtcacagactg

SEQ ID NO: 21010 - DNA, 28 bp, Artificial Sequence
  Description of Artificial Sequence: Synthetic oligonucleotide
cggaatgtgaagggccagtcacagactg

SEQ ID NO: 21011 - DNA, 29 bp, Artificial Sequence
  Description of Artificial Sequence: Synthetic oligonucleotide
ggaatgtgaagggccagtcacagactgac

SEQ ID NO: 21012 - DNA, 29 bp, Artificial Sequence
  Description of Artificial Sequence: Synthetic oligonucleotide
gaatgtgaagggccagtcacagactgacc

SEQ ID NO: 21013 - DNA, 29 bp, Artificial Sequence
  Description of Artificial Sequence: Synthetic oligonucleotide
aatgtgaagggccagtcacagactgaccg

SEQ ID NO: 21014 - DNA, 28 bp, Artificial Sequence
  Description of Artificial Sequence: Synthetic oligonucleotide
atgtgaagggccagtcacagactgaccg

SEQ ID NO: 21015 - DNA, 27 bp, Artificial Sequence
  Description of Artificial Sequence: Synthetic oligonucleotide
tgtgaagggccagtcacagactgaccg

SEQ ID NO: 21016 - DNA, 27 bp, Artificial Sequence
  Description of Artificial Sequence: Synthetic oligonucleotide
gtgaagggccagtcacagactgaccga

SEQ ID NO: 21017 - DNA, 27 bp, Artificial Sequence
  Description of Artificial Sequence: Synthetic oligonucleotide
tgaagggccagtcacagactgaccgag

SEQ ID NO: 21018 - DNA, 27 bp, Artificial Sequence
  Description of Artificial Sequence: Synthetic oligonucleotide
gaagggccagtcacagactgaccgagt

SEQ ID NO: 21019 - DNA, 27 bp, Artificial Sequence
  Description of Artificial Sequence: Synthetic oligonucleotide
aagggccagtcacagactgaccgagtg

SEQ ID NO: 21020 - DNA, 26 bp, Artificial Sequence
  Description of Artificial Sequence: Synthetic oligonucleotide
agggccagtcacagactgaccgagtg

SEQ ID NO: 21021 - DNA, 25 bp, Artificial Sequence
  Description of Artificial Sequence: Synthetic oligonucleotide
gggccagtcacagactgaccgagtg

SEQ ID NO: 21022 - DNA, 26 bp, Artificial Sequence
  Description of Artificial Sequence: Synthetic oligonucleotide
ggccagtcacagactgaccgagtgga

SEQ ID NO: 21023 - DNA, 26 bp, Artificial Sequence
  Description of Artificial Sequence: Synthetic oligonucleotide
gccagtcacagactgaccgagtggac

SEQ ID NO: 21024 - DNA, 26 bp, Artificial Sequence
  Description of Artificial Sequence: Synthetic oligonucleotide
accaccaagcacaagtgggaggcggt

SEQ ID NO: 21025 - DNA, 25 bp, Artificial Sequence
  Description of Artificial Sequence: Synthetic oligonucleotide
ccaccaagcacaagtgggaggcggt

SEQ ID NO: 21026 - DNA, 25 bp, Artificial Sequence
  Description of Artificial Sequence: Synthetic oligonucleotide
caccaagcacaagtgggaggcggtc

SEQ ID NO: 21027 - DNA, 27 bp, Artificial Sequence
  Description of Artificial Sequence: Synthetic oligonucleotide
accaagcacaagtgggaggcggtccat

SEQ ID NO: 21028 - DNA, 26 bp, Artificial Sequence
  Description of Artificial Sequence: Synthetic oligonucleotide
ccaagcacaagtgggaggcggtccat

SEQ ID NO: 21029 - DNA, 27 bp, Artificial Sequence
  Description of Artificial Sequence: Synthetic oligonucleotide
caagcacaagtgggaggcggtccatgt

SEQ ID NO: 21030 - DNA, 27 bp, Artificial Sequence
  Description of Artificial Sequence: Synthetic oligonucleotide
aagcacaagtgggaggcggtccatgtg

SEQ ID NO: 21031 - DNA, 26 bp, Artificial Sequence
  Description of Artificial Sequence: Synthetic oligonucleotide
agcacaagtgggaggcggtccatgtg

SEQ ID NO: 21032 - DNA, 25 bp, Artificial Sequence
  Description of Artificial Sequence: Synthetic oligonucleotide
gcacaagtgggaggcggtccatgtg

SEQ ID NO: 21033 - DNA, 25 bp, Artificial Sequence
  Description of Artificial Sequence: Synthetic oligonucleotide
cacaagtgggaggcggtccatgtgg

SEQ ID NO: 21034 - DNA, 25 bp, Artificial Sequence
  Description of Artificial Sequence: Synthetic oligonucleotide
acaagtgggaggcggtccatgtggc

SEQ ID NO: 21035 - DNA, 24 bp, Artificial Sequence
  Description of Artificial Sequence: Synthetic oligonucleotide
aggcggtccatgtggcggagcagt

SEQ ID NO: 21036 - DNA, 23 bp, Artificial Sequence
  Description of Artificial Sequence: Synthetic oligonucleotide
ggcggtccatgtggcggagcagt

SEQ ID NO: 21037 - DNA, 23 bp, Artificial Sequence
  Description of Artificial Sequence: Synthetic oligonucleotide
gcggtccatgtggcggagcagtg

SEQ ID NO: 21038 - DNA, 24 bp, Artificial Sequence
  Description of Artificial Sequence: Synthetic oligonucleotide
cggtccatgtggcggagcagtgga

SEQ ID NO: 21039 - DNA, 25 bp, Artificial Sequence
  Description of Artificial Sequence: Synthetic oligonucleotide
ggtccatgtggcggagcagtggaga

SEQ ID NO: 21040 - DNA, 25 bp, Artificial Sequence
  Description of Artificial Sequence: Synthetic oligonucleotide
gtccatgtggcggagcagtggagag

SEQ ID NO: 21041 - DNA, 25 bp, Artificial Sequence
  Description of Artificial Sequence: Synthetic oligonucleotide
tccatgtggcggagcagtggagagc

SEQ ID NO: 21042 - DNA, 25 bp, Artificial Sequence
  Description of Artificial Sequence: Synthetic oligonucleotide
acctgggcgggctcccactccataa

SEQ ID NO: 21043 - DNA, 24 bp, Artificial Sequence
  Description of Artificial Sequence: Synthetic oligonucleotide
cctgggcgggctcccactccataa

SEQ ID NO: 21044 - DNA, 24 bp, Artificial Sequence
  Description of Artificial Sequence: Synthetic oligonucleotide
ctgggcgggctcccactccataag

SEQ ID NO: 21045 - DNA, 27 bp, Artificial Sequence
  Description of Artificial Sequence: Synthetic oligonucleotide
tgggcgggctcccactccataaggtat

SEQ ID NO: 21046 - DNA, 27 bp, Artificial Sequence
  Description of Artificial Sequence: Synthetic oligonucleotide
gggcgggctcccactccataaggtatt

SEQ ID NO: 21047 - DNA, 28 bp, Artificial Sequence
  Description of Artificial Sequence: Synthetic oligonucleotide
ggcgggctcccactccataaggtatttc

SEQ ID NO: 21048 - DNA, 30 bp, Artificial Sequence
  Description of Artificial Sequence: Synthetic oligonucleotide
gcgggctcccactccataaggtatttctac

SEQ ID NO: 21049 - DNA, 31 bp, Artificial Sequence
  Description of Artificial Sequence: Synthetic oligonucleotide
cgggctcccactccataaggtatttctacac

SEQ ID NO: 21050 - DNA, 31 bp, Artificial Sequence
  Description of Artificial Sequence: Synthetic oligonucleotide
gggctcccactccataaggtatttctacacc

SEQ ID NO: 21051 - DNA, 32 bp, Artificial Sequence
  Description of Artificial Sequence: Synthetic oligonucleotide
ggctcccactccataaggtatttctacacctc

SEQ ID NO: 21052 - DNA, 32 bp, Artificial Sequence
  Description of Artificial Sequence: Synthetic oligonucleotide
gctcccactccataaggtatttctacacctcc

SEQ ID NO: 21053 - DNA, 32 bp, Artificial Sequence
  Description of Artificial Sequence: Synthetic oligonucleotide
ctcccactccataaggtatttctacacctccg

SEQ ID NO: 21054 - DNA, 33 bp, Artificial Sequence
  Description of Artificial Sequence: Synthetic oligonucleotide
tcccactccataaggtatttctacacctccgtg

SEQ ID NO: 21055 - DNA, 32 bp, Artificial Sequence
  Description of Artificial Sequence: Synthetic oligonucleotide
cccactccataaggtatttctacacctccgtg

SEQ ID NO: 21056 - DNA, 33 bp, Artificial Sequence
  Description of Artificial Sequence: Synthetic oligonucleotide
ccactccataaggtatttctacacctccgtgtc

SEQ ID NO: 21057 - DNA, 33 bp, Artificial Sequence
  Description of Artificial Sequence: Synthetic oligonucleotide
cactccataaggtatttctacacctccgtgtcc

SEQ ID NO: 21058 - DNA, 33 bp, Artificial Sequence
  Description of Artificial Sequence: Synthetic oligonucleotide
actccataaggtatttctacacctccgtgtccc

SEQ ID NO: 21059 - DNA, 32 bp, Artificial Sequence
  Description of Artificial Sequence: Synthetic oligonucleotide
ctccataaggtatttctacacctccgtgtccc

SEQ ID NO: 21060 - DNA, 32 bp, Artificial Sequence
  Description of Artificial Sequence: Synthetic oligonucleotide
tccataaggtatttctacacctccgtgtcccg

SEQ ID NO: 21061 - DNA, 31 bp, Artificial Sequence
  Description of Artificial Sequence: Synthetic oligonucleotide
ccataaggtatttctacacctccgtgtcccg

SEQ ID NO: 21062 - DNA, 31 bp, Artificial Sequence
  Description of Artificial Sequence: Synthetic oligonucleotide
cataaggtatttctacacctccgtgtcccgg

SEQ ID NO: 21063 - DNA, 31 bp, Artificial Sequence
  Description of Artificial Sequence: Synthetic oligonucleotide
ataaggtatttctacacctccgtgtcccggc

SEQ ID NO: 21064 - DNA, 30 bp, Artificial Sequence
  Description of Artificial Sequence: Synthetic oligonucleotide
taaggtatttctacacctccgtgtcccggc

SEQ ID NO: 21065 - DNA, 29 bp, Artificial Sequence
  Description of Artificial Sequence: Synthetic oligonucleotide
aaggtatttctacacctccgtgtcccggc

SEQ ID NO: 21066 - DNA, 28 bp, Artificial Sequence
  Description of Artificial Sequence: Synthetic oligonucleotide
tactacaaccagagcgaggccggttctg

SEQ ID NO: 21067 - DNA, 27 bp, Artificial Sequence
  Description of Artificial Sequence: Synthetic oligonucleotide
actacaaccagagcgaggccggttctg

SEQ ID NO: 21068 - DNA, 27 bp, Artificial Sequence
  Description of Artificial Sequence: Synthetic oligonucleotide
ctacaaccagagcgaggccggttctga

SEQ ID NO: 21069 - DNA, 27 bp, Artificial Sequence
  Description of Artificial Sequence: Synthetic oligonucleotide
tacaaccagagcgaggccggttctgac

SEQ ID NO: 21070 - DNA, 27 bp, Artificial Sequence
  Description of Artificial Sequence: Synthetic oligonucleotide
acaaccagagcgaggccggttctgaca

SEQ ID NO: 21071 - DNA, 26 bp, Artificial Sequence
  Description of Artificial Sequence: Synthetic oligonucleotide
caaccagagcgaggccggttctgaca

SEQ ID NO: 21072 - DNA, 26 bp, Artificial Sequence
  Description of Artificial Sequence: Synthetic oligonucleotide
aaccagagcgaggccggttctgacac

SEQ ID NO: 21073 - DNA, 25 bp, Artificial Sequence
  Description of Artificial Sequence: Synthetic oligonucleotide
accagagcgaggccggttctgacac

SEQ ID NO: 21074 - DNA, 24 bp, Artificial Sequence
  Description of Artificial Sequence: Synthetic oligonucleotide
ccagagcgaggccggttctgacac

SEQ ID NO: 21075 - DNA, 26 bp, Artificial Sequence
  Description of Artificial Sequence: Synthetic oligonucleotide
cagagcgaggccggttctgacaccat

SEQ ID NO: 21076 - DNA, 26 bp, Artificial Sequence
  Description of Artificial Sequence: Synthetic oligonucleotide
agagcgaggccggttctgacaccatc

SEQ ID NO: 21077 - DNA, 25 bp, Artificial Sequence
  Description of Artificial Sequence: Synthetic oligonucleotide
gagcgaggccggttctgacaccatc

SEQ ID NO: 21078 - DNA, 26 bp, Artificial Sequence
  Description of Artificial Sequence: Synthetic oligonucleotide
agcgaggccggttctgacaccatcca

SEQ ID NO: 21079 - DNA, 25 bp, Artificial Sequence
  Description of Artificial Sequence: Synthetic oligonucleotide
gcgaggccggttctgacaccatcca

SEQ ID NO: 21080 - DNA, 26 bp, Artificial Sequence
  Description of Artificial Sequence: Synthetic oligonucleotide
cgaggccggttctgacaccatccaga

SEQ ID NO: 21081 - DNA, 26 bp, Artificial Sequence
  Description of Artificial Sequence: Synthetic oligonucleotide
gaggccggttctgacaccatccagag

SEQ ID NO: 21082 - DNA, 27 bp, Artificial Sequence
  Description of Artificial Sequence: Synthetic oligonucleotide
aggccggttctgacaccatccagagga

SEQ ID NO: 21083 - DNA, 27 bp, Artificial Sequence
  Description of Artificial Sequence: Synthetic oligonucleotide
ggccggttctgacaccatccagaggat

SEQ ID NO: 21084 - DNA, 27 bp, Artificial Sequence
  Description of Artificial Sequence: Synthetic oligonucleotide
gccggttctgacaccatccagaggatg

SEQ ID NO: 21085 - DNA, 30 bp, Artificial Sequence
  Description of Artificial Sequence: Synthetic oligonucleotide
ccggttctgacaccatccagaggatgtatg

SEQ ID NO: 21086 - DNA, 30 bp, Artificial Sequence
  Description of Artificial Sequence: Synthetic oligonucleotide
cggttctgacaccatccagaggatgtatgg

SEQ ID NO: 21087 - DNA, 30 bp, Artificial Sequence
  Description of Artificial Sequence: Synthetic oligonucleotide
ggttctgacaccatccagaggatgtatggc

SEQ ID NO: 21088 - DNA, 31 bp, Artificial Sequence
  Description of Artificial Sequence: Synthetic oligonucleotide
gttctgacaccatccagaggatgtatggctg

SEQ ID NO: 21089 - DNA, 31 bp, Artificial Sequence
  Description of Artificial Sequence: Synthetic oligonucleotide
ttctgacaccatccagaggatgtatggctgc

SEQ ID NO: 21090 - DNA, 30 bp, Artificial Sequence
  Description of Artificial Sequence: Synthetic oligonucleotide
tctgacaccatccagaggatgtatggctgc

SEQ ID NO: 21091 - DNA, 29 bp, Artificial Sequence
  Description of Artificial Sequence: Synthetic oligonucleotide
ctgacaccatccagaggatgtatggctgc

SEQ ID NO: 21092 - DNA, 29 bp, Artificial Sequence
  Description of Artificial Sequence: Synthetic oligonucleotide
tgacaccatccagaggatgtatggctgcg

SEQ ID NO: 21093 - DNA, 28 bp, Artificial Sequence
  Description of Artificial Sequence: Synthetic oligonucleotide
gacaccatccagaggatgtatggctgcg

SEQ ID NO: 21094 - DNA, 27 bp, Artificial Sequence
  Description of Artificial Sequence: Synthetic oligonucleotide
aggcccagtcacagactgaccgagtga

SEQ ID NO: 21095 - DNA, 27 bp, Artificial Sequence
  Description of Artificial Sequence: Synthetic oligonucleotide
ggcccagtcacagactgaccgagtgaa

SEQ ID NO: 21096 - DNA, 27 bp, Artificial Sequence
  Description of Artificial Sequence: Synthetic oligonucleotide
gcccagtcacagactgaccgagtgaac

SEQ ID NO: 21097 - DNA, 27 bp, Artificial Sequence
  Description of Artificial Sequence: Synthetic oligonucleotide
cccagtcacagactgaccgagtgaacc

SEQ ID NO: 21098 - DNA, 28 bp, Artificial Sequence
  Description of Artificial Sequence: Synthetic oligonucleotide
ccagtcacagactgaccgagtgaacctg

SEQ ID NO: 21099 - DNA, 28 bp, Artificial Sequence
  Description of Artificial Sequence: Synthetic oligonucleotide
cagtcacagactgaccgagtgaacctgg

SEQ ID NO: 21100 - DNA, 28 bp, Artificial Sequence
  Description of Artificial Sequence: Synthetic oligonucleotide
agtcacagactgaccgagtgaacctggg

SEQ ID NO: 21101 - DNA, 27 bp, Artificial Sequence
  Description of Artificial Sequence: Synthetic oligonucleotide
gtcacagactgaccgagtgaacctggg

SEQ ID NO: 21102 - DNA, 27 bp, Artificial Sequence
  Description of Artificial Sequence: Synthetic oligonucleotide
tcacagactgaccgagtgaacctgggg

SEQ ID NO: 21103 - DNA, 27 bp, Artificial Sequence
  Description of Artificial Sequence: Synthetic oligonucleotide
cacagactgaccgagtgaacctgggga

SEQ ID NO: 21104 - DNA, 27 bp, Artificial Sequence
  Description of Artificial Sequence: Synthetic oligonucleotide
acagactgaccgagtgaacctggggac

SEQ ID NO: 21105 - DNA, 26 bp, Artificial Sequence
  Description of Artificial Sequence: Synthetic oligonucleotide
cagactgaccgagtgaacctggggac

SEQ ID NO: 21106 - DNA, 26 bp, Artificial Sequence
  Description of Artificial Sequence: Synthetic oligonucleotide
agactgaccgagtgaacctggggacc

SEQ ID NO: 21107 - DNA, 25 bp, Artificial Sequence
  Description of Artificial Sequence: Synthetic oligonucleotide
gactgaccgagtgaacctggggacc

SEQ ID NO: 21108 - DNA, 26 bp, Artificial Sequence
  Description of Artificial Sequence: Synthetic oligonucleotide
actgaccgagtgaacctggggaccct

SEQ ID NO: 21109 - DNA, 25 bp, Artificial Sequence
  Description of Artificial Sequence: Synthetic oligonucleotide
ctgaccgagtgaacctggggaccct

SEQ ID NO: 21110 - DNA, 25 bp, Artificial Sequence
  Description of Artificial Sequence: Synthetic oligonucleotide
tgaccgagtgaacctggggaccctg

SEQ ID NO: 21111 - DNA, 24 bp, Artificial Sequence
  Description of Artificial Sequence: Synthetic oligonucleotide
gaccgagtgaacctggggaccctg

SEQ ID NO: 21112 - DNA, 24 bp, Artificial Sequence
  Description of Artificial Sequence: Synthetic oligonucleotide
accgagtgaacctggggaccctgc

SEQ ID NO: 21113 - DNA, 23 bp, Artificial Sequence
  Description of Artificial Sequence: Synthetic oligonucleotide
ccgagtgaacctggggaccctgc

SEQ ID NO: 21114 - DNA, 23 bp, Artificial Sequence
  Description of Artificial Sequence: Synthetic oligonucleotide
cgagtgaacctggggaccctgcg

SEQ ID NO: 21115 - DNA, 23 bp, Artificial Sequence
  Description of Artificial Sequence: Synthetic oligonucleotide
gagtgaacctggggaccctgcgc

SEQ ID NO: 21116 - DNA, 23 bp, Artificial Sequence
  Description of Artificial Sequence: Synthetic oligonucleotide
agtgaacctggggaccctgcgcg

SEQ ID NO: 21117 - DNA, 22 bp, Artificial Sequence
  Description of Artificial Sequence: Synthetic oligonucleotide
gtgaacctggggaccctgcgcg

SEQ ID NO: 21118 - DNA, 22 bp, Artificial Sequence
  Description of Artificial Sequence: Synthetic oligonucleotide
tgaacctggggaccctgcgcgg

SEQ ID NO: 21119 - DNA, 25 bp, Artificial Sequence
  Description of Artificial Sequence: Synthetic oligonucleotide
accgcggtggacatggcagctcaga

SEQ ID NO: 21120 - DNA, 24 bp, Artificial Sequence
  Description of Artificial Sequence: Synthetic oligonucleotide
ccgcggtggacatggcagctcaga

SEQ ID NO: 21121 - DNA, 24 bp, Artificial Sequence
  Description of Artificial Sequence: Synthetic oligonucleotide
cgcggtggacatggcagctcagac

SEQ ID NO: 21122 - DNA, 25 bp, Artificial Sequence
  Description of Artificial Sequence: Synthetic oligonucleotide
gcggtggacatggcagctcagacca

SEQ ID NO: 21123 - DNA, 25 bp, Artificial Sequence
  Description of Artificial Sequence: Synthetic oligonucleotide
cggtggacatggcagctcagaccac

SEQ ID NO: 21124 - DNA, 27 bp, Artificial Sequence
  Description of Artificial Sequence: Synthetic oligonucleotide
ggtggacatggcagctcagaccaccaa

SEQ ID NO: 21125 - DNA, 27 bp, Artificial Sequence
  Description of Artificial Sequence: Synthetic oligonucleotide
gtggacatggcagctcagaccaccaag

SEQ ID NO: 21126 - DNA, 27 bp, Artificial Sequence
  Description of Artificial Sequence: Synthetic oligonucleotide
tggacatggcagctcagaccaccaagc

SEQ ID NO: 21127 - DNA, 30 bp, Artificial Sequence
  Description of Artificial Sequence: Synthetic oligonucleotide
atggcagctcagaccaccaagcacaagtag

SEQ ID NO: 21128 - DNA, 29 bp, Artificial Sequence
  Description of Artificial Sequence: Synthetic oligonucleotide
tggcagctcagaccaccaagcacaagtag

SEQ ID NO: 21129 - DNA, 28 bp, Artificial Sequence
  Description of Artificial Sequence: Synthetic oligonucleotide
ggcagctcagaccaccaagcacaagtag

SEQ ID NO: 21130 - DNA, 30 bp, Artificial Sequence
  Description of Artificial Sequence: Synthetic oligonucleotide
gcagctcagaccaccaagcacaagtagtag

SEQ ID NO: 21131 - DNA, 30 bp, Artificial Sequence
  Description of Artificial Sequence: Synthetic oligonucleotide
cagctcagaccaccaagcacaagtagtagg

SEQ ID NO: 21132 - DNA, 30 bp, Artificial Sequence
  Description of Artificial Sequence: Synthetic oligonucleotide
agctcagaccaccaagcacaagtagtaggc

SEQ ID NO: 21133 - DNA, 29 bp, Artificial Sequence
  Description of Artificial Sequence: Synthetic oligonucleotide
gctcagaccaccaagcacaagtagtaggc

SEQ ID NO: 21134 - DNA, 29 bp, Artificial Sequence
  Description of Artificial Sequence: Synthetic oligonucleotide
ctcagaccaccaagcacaagtagtaggcg

SEQ ID NO: 21135 - DNA, 29 bp, Artificial Sequence
  Description of Artificial Sequence: Synthetic oligonucleotide
tcagaccaccaagcacaagtagtaggcgg

SEQ ID NO: 21136 - DNA, 28 bp, Artificial Sequence
  Description of Artificial Sequence: Synthetic oligonucleotide
cagaccaccaagcacaagtagtaggcgg

SEQ ID NO: 21137 - DNA, 28 bp, Artificial Sequence
  Description of Artificial Sequence: Synthetic oligonucleotide
agaccaccaagcacaagtagtaggcggc

SEQ ID NO: 21138 - DNA, 27 bp, Artificial Sequence
  Description of Artificial Sequence: Synthetic oligonucleotide
gaccaccaagcacaagtagtaggcggc

SEQ ID NO: 21139 - DNA, 27 bp, Artificial Sequence
  Description of Artificial Sequence: Synthetic oligonucleotide
accaccaagcacaagtagtaggcggcc

SEQ ID NO: 21140 - DNA, 26 bp, Artificial Sequence
  Description of Artificial Sequence: Synthetic oligonucleotide
ccaccaagcacaagtagtaggcggcc

SEQ ID NO: 21141 - DNA, 27 bp, Artificial Sequence
  Description of Artificial Sequence: Synthetic oligonucleotide
caccaagcacaagtagtaggcggccca

SEQ ID NO: 21142 - DNA, 28 bp, Artificial Sequence
  Description of Artificial Sequence: Synthetic oligonucleotide
accaagcacaagtagtaggcggcccatg

SEQ ID NO: 21143 - DNA, 27 bp, Artificial Sequence
  Description of Artificial Sequence: Synthetic oligonucleotide
ccaagcacaagtagtaggcggcccatg

SEQ ID NO: 21144 - DNA, 28 bp, Artificial Sequence
  Description of Artificial Sequence: Synthetic oligonucleotide
caagcacaagtagtaggcggcccatgtg

SEQ ID NO: 21145 - DNA, 28 bp, Artificial Sequence
  Description of Artificial Sequence: Synthetic oligonucleotide
aagcacaagtagtaggcggcccatgtgg

SEQ ID NO: 21146 - DNA, 27 bp, Artificial Sequence
  Description of Artificial Sequence: Synthetic oligonucleotide
agcacaagtagtaggcggcccatgtgg

SEQ ID NO: 21147 - DNA, 26 bp, Artificial Sequence
  Description of Artificial Sequence: Synthetic oligonucleotide
gcacaagtagtaggcggcccatgtgg

SEQ ID NO: 21148 - DNA, 26 bp, Artificial Sequence
  Description of Artificial Sequence: Synthetic oligonucleotide
cacaagtagtaggcggcccatgtggc

SEQ ID NO: 21149 - DNA, 26 bp, Artificial Sequence
  Description of Artificial Sequence: Synthetic oligonucleotide
acaagtagtaggcggcccatgtggcg

SEQ ID NO: 21150 - DNA, 25 bp, Artificial Sequence
  Description of Artificial Sequence: Synthetic oligonucleotide
caagtagtaggcggcccatgtggcg

SEQ ID NO: 21151 - DNA, 26 bp, Artificial Sequence
  Description of Artificial Sequence: Synthetic oligonucleotide
aagtagtaggcggcccatgtggcgga

SEQ ID NO: 21152 - DNA, 25 bp, Artificial Sequence
  Description of Artificial Sequence: Synthetic oligonucleotide
agtagtaggcggcccatgtggcgga

SEQ ID NO: 21153 - DNA, 24 bp, Artificial Sequence
  Description of Artificial Sequence: Synthetic oligonucleotide
gtagtaggcggcccatgtggcgga

SEQ ID NO: 21154 - DNA, 24 bp, Artificial Sequence
  Description of Artificial Sequence: Synthetic oligonucleotide
tagtaggcggcccatgtggcggag

SEQ ID NO: 21155 - DNA, 23 bp, Artificial Sequence
  Description of Artificial Sequence: Synthetic oligonucleotide
agtaggcggcccatgtggcggag

SEQ ID NO: 21156 - DNA, 22 bp, Artificial Sequence
  Description of Artificial Sequence: Synthetic oligonucleotide
gtaggcggcccatgtggcggag

SEQ ID NO: 21157 - DNA, 23 bp, Artificial Sequence
  Description of Artificial Sequence: Synthetic oligonucleotide
taggcggcccatgtggcggagca

SEQ ID NO: 21158 - DNA, 30 bp, Artificial Sequence
  Description of Artificial Sequence: Synthetic oligonucleotide
atccagatgatgtatggctgcgacgtggag

SEQ ID NO: 21159 - DNA, 29 bp, Artificial Sequence
  Description of Artificial Sequence: Synthetic oligonucleotide
tccagatgatgtatggctgcgacgtggag

SEQ ID NO: 21160 - DNA, 28 bp, Artificial Sequence
  Description of Artificial Sequence: Synthetic oligonucleotide
ccagatgatgtatggctgcgacgtggag

SEQ ID NO: 21161 - DNA, 29 bp, Artificial Sequence
  Description of Artificial Sequence: Synthetic oligonucleotide
cagatgatgtatggctgcgacgtggagtc

SEQ ID NO: 21162 - DNA, 29 bp, Artificial Sequence
  Description of Artificial Sequence: Synthetic oligonucleotide
agatgatgtatggctgcgacgtggagtcg

SEQ ID NO: 21163 - DNA, 28 bp, Artificial Sequence
  Description of Artificial Sequence: Synthetic oligonucleotide
gatgatgtatggctgcgacgtggagtcg

SEQ ID NO: 21164 - DNA, 28 bp, Artificial Sequence
  Description of Artificial Sequence: Synthetic oligonucleotide
atgatgtatggctgcgacgtggagtcgg

SEQ ID NO: 21165 - DNA, 27 bp, Artificial Sequence
  Description of Artificial Sequence: Synthetic oligonucleotide
tgatgtatggctgcgacgtggagtcgg

SEQ ID NO: 21166 - DNA, 27 bp, Artificial Sequence
  Description of Artificial Sequence: Synthetic oligonucleotide
gatgtatggctgcgacgtggagtcgga

SEQ ID NO: 21167 - DNA, 27 bp, Artificial Sequence
  Description of Artificial Sequence: Synthetic oligonucleotide
atgtatggctgcgacgtggagtcggac

SEQ ID NO: 21168 - DNA, 26 bp, Artificial Sequence
  Description of Artificial Sequence: Synthetic oligonucleotide
tgtatggctgcgacgtggagtcggac

SEQ ID NO: 21169 - DNA, 25 bp, Artificial Sequence
  Description of Artificial Sequence: Synthetic oligonucleotide
gtatggctgcgacgtggagtcggac

SEQ ID NO: 21170 - DNA, 25 bp, Artificial Sequence
  Description of Artificial Sequence: Synthetic oligonucleotide
tatggctgcgacgtggagtcggacg

SEQ ID NO: 21171 - DNA, 24 bp, Artificial Sequence
  Description of Artificial Sequence: Synthetic oligonucleotide
atggctgcgacgtggagtcggacg

SEQ ID NO: 21172 - DNA, 23 bp, Artificial Sequence
  Description of Artificial Sequence: Synthetic oligonucleotide
tggctgcgacgtggagtcggacg

SEQ ID NO: 21173 - DNA, 22 bp, Artificial Sequence
  Description of Artificial Sequence: Synthetic oligonucleotide
ggctgcgacgtggagtcggacg

SEQ ID NO: 21174 - DNA, 22 bp, Artificial Sequence
  Description of Artificial Sequence: Synthetic oligonucleotide
gctgcgacgtggagtcggacgg

SEQ ID NO: 21175 - DNA, 22 bp, Artificial Sequence
  Description of Artificial Sequence: Synthetic oligonucleotide
ctgcgacgtggagtcggacggg

SEQ ID NO: 21176 - DNA, 22 bp, Artificial Sequence
  Description of Artificial Sequence: Synthetic oligonucleotide
tgcgacgtggagtcggacgggc

SEQ ID NO: 21177 - DNA, 21 bp, Artificial Sequence
  Description of Artificial Sequence: Synthetic oligonucleotide
gcgacgtggagtcggacgggc

SEQ ID NO: 21178 - DNA, 21 bp, Artificial Sequence
  Description of Artificial Sequence: Synthetic oligonucleotide
cgacgtggagtcggacgggcg

SEQ ID NO: 21179 - DNA, 23 bp, Artificial Sequence
  Description of Artificial Sequence: Synthetic oligonucleotide
gacgtggagtcggacgggcgctt

SEQ ID NO: 21180 - DNA, 23 bp, Artificial Sequence
  Description of Artificial Sequence: Synthetic oligonucleotide
acgtggagtcggacgggcgcttc

SEQ ID NO: 21181 - DNA, 22 bp, Artificial Sequence
  Description of Artificial Sequence: Synthetic oligonucleotide
cgtggagtcggacgggcgcttc

SEQ ID NO: 21182 - DNA, 23 bp, Artificial Sequence
  Description of Artificial Sequence: Synthetic oligonucleotide
gtggagtcggacgggcgcttcct

SEQ ID NO: 21183 - DNA, 23 bp, Artificial Sequence
  Description of Artificial Sequence: Synthetic oligonucleotide
tggagtcggacgggcgcttcctc

SEQ ID NO: 21184 - DNA, 22 bp, Artificial Sequence
  Description of Artificial Sequence: Synthetic oligonucleotide
ggagtcggacgggcgcttcctc

SEQ ID NO: 21185 - DNA, 22 bp, Artificial Sequence
  Description of Artificial Sequence: Synthetic oligonucleotide
gagtcggacgggcgcttcctcc

SEQ ID NO: 21186 - DNA, 22 bp, Artificial Sequence
  Description of Artificial Sequence: Synthetic oligonucleotide
agtcggacgggcgcttcctccg

SEQ ID NO: 21187 - DNA, 22 bp, Artificial Sequence
  Description of Artificial Sequence: Synthetic oligonucleotide
gccctggccctgacccagacca

SEQ ID NO: 21188 - DNA, 22 bp, Artificial Sequence
  Description of Artificial Sequence: Synthetic oligonucleotide
ccctggccctgacccagaccag

SEQ ID NO: 21189 - DNA, 22 bp, Artificial Sequence
  Description of Artificial Sequence: Synthetic oligonucleotide
cctggccctgacccagaccagg

SEQ ID NO: 21190 - DNA, 22 bp, Artificial Sequence
  Description of Artificial Sequence: Synthetic oligonucleotide
ctggccctgacccagaccaggg

SEQ ID NO: 21191 - DNA, 22 bp, Artificial Sequence
  Description of Artificial Sequence: Synthetic oligonucleotide
tggccctgacccagaccagggc

SEQ ID NO: 21192 - DNA, 21 bp, Artificial Sequence
  Description of Artificial Sequence: Synthetic oligonucleotide
ggccctgacccagaccagggc

SEQ ID NO: 21193 - DNA, 21 bp, Artificial Sequence
  Description of Artificial Sequence: Synthetic oligonucleotide
gccctgacccagaccagggcg

SEQ ID NO: 21194 - DNA, 21 bp, Artificial Sequence
  Description of Artificial Sequence: Synthetic oligonucleotide
ccctgacccagaccagggcgg

SEQ ID NO: 21195 - DNA, 21 bp, Artificial Sequence
  Description of Artificial Sequence: Synthetic oligonucleotide
cctgacccagaccagggcggg

SEQ ID NO: 21196 - DNA, 22 bp, Artificial Sequence
  Description of Artificial Sequence: Synthetic oligonucleotide
ctgacccagaccagggcgggct

SEQ ID NO: 21197 - DNA, 22 bp, Artificial Sequence
  Description of Artificial Sequence: Synthetic oligonucleotide
tgacccagaccagggcgggctc

SEQ ID NO: 21198 - DNA, 21 bp, Artificial Sequence
  Description of Artificial Sequence: Synthetic oligonucleotide
gacccagaccagggcgggctc

SEQ ID NO: 21199 - DNA, 21 bp, Artificial Sequence
  Description of Artificial Sequence: Synthetic oligonucleotide
acccagaccagggcgggctcc

SEQ ID NO: 21200 - DNA, 20 bp, Artificial Sequence
  Description of Artificial Sequence: Synthetic oligonucleotide
cccagaccagggcgggctcc

SEQ ID NO: 21201 - DNA, 21 bp, Artificial Sequence
  Description of Artificial Sequence: Synthetic oligonucleotide
ccagaccagggcgggctccca

SEQ ID NO: 21202 - DNA, 22 bp, Artificial Sequence
  Description of Artificial Sequence: Synthetic oligonucleotide
cagaccagggcgggctcccact

SEQ ID NO: 21203 - DNA, 22 bp, Artificial Sequence
  Description of Artificial Sequence: Synthetic oligonucleotide
agaccagggcgggctcccactc

SEQ ID NO: 21204 - DNA, 21 bp, Artificial Sequence
  Description of Artificial Sequence: Synthetic oligonucleotide
gaccagggcgggctcccactc

SEQ ID NO: 21205 - DNA, 23 bp, Artificial Sequence
  Description of Artificial Sequence: Synthetic oligonucleotide
accagggcgggctcccactccat

SEQ ID NO: 21206 - DNA, 22 bp, Artificial Sequence
  Description of Artificial Sequence: Synthetic oligonucleotide
ccagggcgggctcccactccat

SEQ ID NO: 21207 - DNA, 23 bp, Artificial Sequence
  Description of Artificial Sequence: Synthetic oligonucleotide
cagggcgggctcccactccatga

SEQ ID NO: 21208 - DNA, 23 bp, Artificial Sequence
  Description of Artificial Sequence: Synthetic oligonucleotide
agggcgggctcccactccatgag

SEQ ID NO: 21209 - DNA, 26 bp, Artificial Sequence
  Description of Artificial Sequence: Synthetic oligonucleotide
tcacagactgaccgagtggacctggc

SEQ ID NO: 21210 - DNA, 25 bp, Artificial Sequence
  Description of Artificial Sequence: Synthetic oligonucleotide
cacagactgaccgagtggacctggc

SEQ ID NO: 21211 - DNA, 26 bp, Artificial Sequence
  Description of Artificial Sequence: Synthetic oligonucleotide
acagactgaccgagtggacctggcga

SEQ ID NO: 21212 - DNA, 25 bp, Artificial Sequence
  Description of Artificial Sequence: Synthetic oligonucleotide
cagactgaccgagtggacctggcga

SEQ ID NO: 21213 - DNA, 25 bp, Artificial Sequence
  Description of Artificial Sequence: Synthetic oligonucleotide
agactgaccgagtggacctggcgac

SEQ ID NO: 21214 - DNA, 24 bp, Artificial Sequence
  Description of Artificial Sequence: Synthetic oligonucleotide
gactgaccgagtggacctggcgac

SEQ ID NO: 21215 - DNA, 24 bp, Artificial Sequence
  Description of Artificial Sequence: Synthetic oligonucleotide
actgaccgagtggacctggcgacc

SEQ ID NO: 21216 - DNA, 23 bp, Artificial Sequence
  Description of Artificial Sequence: Synthetic oligonucleotide
ctgaccgagtggacctggcgacc

SEQ ID NO: 21217 - DNA, 24 bp, Artificial Sequence
  Description of Artificial Sequence: Synthetic oligonucleotide
tgaccgagtggacctggcgaccct

SEQ ID NO: 21218 - DNA, 23 bp, Artificial Sequence
  Description of Artificial Sequence: Synthetic oligonucleotide
gaccgagtggacctggcgaccct

SEQ ID NO: 21219 - DNA, 23 bp, Artificial Sequence
  Description of Artificial Sequence: Synthetic oligonucleotide
accgagtggacctggcgaccctg

SEQ ID NO: 21220 - DNA, 22 bp, Artificial Sequence
  Description of Artificial Sequence: Synthetic oligonucleotide
ccgagtggacctggcgaccctg

SEQ ID NO: 21221 - DNA, 22 bp, Artificial Sequence
  Description of Artificial Sequence: Synthetic oligonucleotide
cgagtggacctggcgaccctgc

SEQ ID NO: 21222 - DNA, 22 bp, Artificial Sequence
  Description of Artificial Sequence: Synthetic oligonucleotide
gagtggacctggcgaccctgcg

SEQ ID NO: 21223 - DNA, 22 bp, Artificial Sequence
  Description of Artificial Sequence: Synthetic oligonucleotide
agtggacctggcgaccctgcgc

SEQ ID NO: 21224 - DNA, 21 bp, Artificial Sequence
  Description of Artificial Sequence: Synthetic oligonucleotide
gtggacctggcgaccctgcgc

SEQ ID NO: 21225 - DNA, 21 bp, Artificial Sequence
  Description of Artificial Sequence: Synthetic oligonucleotide
tggacctggcgaccctgcgcg

SEQ ID NO: 21226 - DNA, 20 bp, Artificial Sequence
  Description of Artificial Sequence: Synthetic oligonucleotide
ggacctggcgaccctgcgcg

SEQ ID NO: 21227 - DNA, 20 bp, Artificial Sequence
  Description of Artificial Sequence: Synthetic oligonucleotide
gacctggcgaccctgcgcgg

SEQ ID NO: 21228 - DNA, 22 bp, Artificial Sequence
  Description of Artificial Sequence: Synthetic oligonucleotide
acctggcgaccctgcgcggcta

SEQ ID NO: 21229 - DNA, 21 bp, Artificial Sequence
  Description of Artificial Sequence: Synthetic oligonucleotide
cctggcgaccctgcgcggcta

SEQ ID NO: 21230 - DNA, 23 bp, Artificial Sequence
  Description of Artificial Sequence: Synthetic oligonucleotide
ctggcgaccctgcgcggctacta

SEQ ID NO: 21231 - DNA, 25 bp, Artificial Sequence
  Description of Artificial Sequence: Synthetic oligonucleotide
tggcgaccctgcgcggctactacaa

SEQ ID NO: 21232 - DNA, 24 bp, Artificial Sequence
  Description of Artificial Sequence: Synthetic oligonucleotide
ggcgaccctgcgcggctactacaa

SEQ ID NO: 21233 - DNA, 24 bp, Artificial Sequence
  Description of Artificial Sequence: Synthetic oligonucleotide
gcgaccctgcgcggctactacaac

SEQ ID NO: 21234 - DNA, 25 bp, Artificial Sequence
  Description of Artificial Sequence: Synthetic oligonucleotide
cgaccctgcgcggctactacaacca

SEQ ID NO: 21235 - DNA, 28 bp, Artificial Sequence
  Description of Artificial Sequence: Synthetic oligonucleotide
acacggaatgtgaaggcccactcacagg

SEQ ID NO: 21236 - DNA, 27 bp, Artificial Sequence
  Description of Artificial Sequence: Synthetic oligonucleotide
cacggaatgtgaaggcccactcacagg

SEQ ID NO: 21237 - DNA, 27 bp, Artificial Sequence
  Description of Artificial Sequence: Synthetic oligonucleotide
acggaatgtgaaggcccactcacaggc

SEQ ID NO: 21238 - DNA, 27 bp, Artificial Sequence
  Description of Artificial Sequence: Synthetic oligonucleotide
cggaatgtgaaggcccactcacaggct

SEQ ID NO: 21239 - DNA, 27 bp, Artificial Sequence
  Description of Artificial Sequence: Synthetic oligonucleotide
ggaatgtgaaggcccactcacaggctg

SEQ ID NO: 21240 - DNA, 28 bp, Artificial Sequence
  Description of Artificial Sequence: Synthetic oligonucleotide
gaatgtgaaggcccactcacaggctgac

SEQ ID NO: 21241 - DNA, 28 bp, Artificial Sequence
  Description of Artificial Sequence: Synthetic oligonucleotide
aatgtgaaggcccactcacaggctgacc

SEQ ID NO: 21242 - DNA, 27 bp, Artificial Sequence
  Description of Artificial Sequence: Synthetic oligonucleotide
atgtgaaggcccactcacaggctgacc

SEQ ID NO: 21243 - DNA, 26 bp, Artificial Sequence
  Description of Artificial Sequence: Synthetic oligonucleotide
tgtgaaggcccactcacaggctgacc

SEQ ID NO: 21244 - DNA, 26 bp, Artificial Sequence
  Description of Artificial Sequence: Synthetic oligonucleotide
aaggcccactcacaggctgaccgagt

SEQ ID NO: 21245 - DNA, 25 bp, Artificial Sequence
  Description of Artificial Sequence: Synthetic oligonucleotide
aggcccactcacaggctgaccgagt

SEQ ID NO: 21246 - DNA, 24 bp, Artificial Sequence
  Description of Artificial Sequence: Synthetic oligonucleotide
ggcccactcacaggctgaccgagt

SEQ ID NO: 21247 - DNA, 24 bp, Artificial Sequence
  Description of Artificial Sequence: Synthetic oligonucleotide
gcccactcacaggctgaccgagtg

SEQ ID NO: 21248 - DNA, 25 bp, Artificial Sequence
  Description of Artificial Sequence: Synthetic oligonucleotide
cccactcacaggctgaccgagtgga

SEQ ID NO: 21249 - DNA, 25 bp, Artificial Sequence
  Description of Artificial Sequence: Synthetic oligonucleotide
ccactcacaggctgaccgagtggac

SEQ ID NO: 21250 - DNA, 26 bp, Artificial Sequence
  Description of Artificial Sequence: Synthetic oligonucleotide
cactcacaggctgaccgagtggacct

SEQ ID NO: 21251 - DNA, 26 bp, Artificial Sequence
  Description of Artificial Sequence: Synthetic oligonucleotide
actcacaggctgaccgagtggacctg

SEQ ID NO: 21252 - DNA, 25 bp, Artificial Sequence
  Description of Artificial Sequence: Synthetic oligonucleotide
ctcacaggctgaccgagtggacctg

SEQ ID NO: 21253 - DNA, 25 bp, Artificial Sequence
  Description of Artificial Sequence: Synthetic oligonucleotide
tcacaggctgaccgagtggacctgg

SEQ ID NO: 21254 - DNA, 24 bp, Artificial Sequence
  Description of Artificial Sequence: Synthetic oligonucleotide
cacaggctgaccgagtggacctgg

SEQ ID NO: 21255 - DNA, 24 bp, Artificial Sequence
  Description of Artificial Sequence: Synthetic oligonucleotide
acaggctgaccgagtggacctggg

SEQ ID NO: 21256 - DNA, 23 bp, Artificial Sequence
  Description of Artificial Sequence: Synthetic oligonucleotide
caggctgaccgagtggacctggg

SEQ ID NO: 21257 - DNA, 24 bp, Artificial Sequence
  Description of Artificial Sequence: Synthetic oligonucleotide
aggctgaccgagtggacctgggga

SEQ ID NO: 21258 - DNA, 23 bp, Artificial Sequence
  Description of Artificial Sequence: Synthetic oligonucleotide
ggctgaccgagtggacctgggga

SEQ ID NO: 21259 - DNA, 23 bp, Artificial Sequence
  Description of Artificial Sequence: Synthetic oligonucleotide
gctgaccgagtggacctggggac

SEQ ID NO: 21260 - DNA, 22 bp, Artificial Sequence
  Description of Artificial Sequence: Synthetic oligonucleotide
cagcgcaagtgggaggcggcca

SEQ ID NO: 21261 - DNA, 23 bp, Artificial Sequence
  Description of Artificial Sequence: Synthetic oligonucleotide
agcgcaagtgggaggcggccagt

SEQ ID NO: 21262 - DNA, 22 bp, Artificial Sequence
  Description of Artificial Sequence: Synthetic oligonucleotide
gcgcaagtgggaggcggccagt

SEQ ID NO: 21263 - DNA, 23 bp, Artificial Sequence
  Description of Artificial Sequence: Synthetic oligonucleotide
cgcaagtgggaggcggccagtgt

SEQ ID NO: 21264 - DNA, 23 bp, Artificial Sequence
  Description of Artificial Sequence: Synthetic oligonucleotide
gcaagtgggaggcggccagtgtg

SEQ ID NO: 21265 - DNA, 23 bp, Artificial Sequence
  Description of Artificial Sequence: Synthetic oligonucleotide
caagtgggaggcggccagtgtgg

SEQ ID NO: 21266 - DNA, 23 bp, Artificial Sequence
  Description of Artificial Sequence: Synthetic oligonucleotide
aagtgggaggcggccagtgtggc

SEQ ID NO: 21267 - DNA, 22 bp, Artificial Sequence
  Description of Artificial Sequence: Synthetic oligonucleotide
agtgggaggcggccagtgtggc

SEQ ID NO: 21268 - DNA, 21 bp, Artificial Sequence
  Description of Artificial Sequence: Synthetic oligonucleotide
gtgggaggcggccagtgtggc

SEQ ID NO: 21269 - DNA, 21 bp, Artificial Sequence
  Description of Artificial Sequence: Synthetic oligonucleotide
tgggaggcggccagtgtggcg

SEQ ID NO: 21270 - DNA, 20 bp, Artificial Sequence
  Description of Artificial Sequence: Synthetic oligonucleotide
gggaggcggccagtgtggcg

SEQ ID NO: 21271 - DNA, 21 bp, Artificial Sequence
  Description of Artificial Sequence: Synthetic oligonucleotide
ggaggcggccagtgtggcgga

SEQ ID NO: 21272 - DNA, 21 bp, Artificial Sequence
  Description of Artificial Sequence: Synthetic oligonucleotide
gaggcggccagtgtggcggag

SEQ ID NO: 21273 - DNA, 22 bp, Artificial Sequence
  Description of Artificial Sequence: Synthetic oligonucleotide
aggcggccagtgtggcggagca

SEQ ID NO: 21274 - DNA, 21 bp, Artificial Sequence
  Description of Artificial Sequence: Synthetic oligonucleotide
ggcggccagtgtggcggagca

SEQ ID NO: 21275 - DNA, 23 bp, Artificial Sequence
  Description of Artificial Sequence: Synthetic oligonucleotide
gcggccagtgtggcggagcagtt

SEQ ID NO: 21276 - DNA, 24 bp, Artificial Sequence
  Description of Artificial Sequence: Synthetic oligonucleotide
cggccagtgtggcggagcagttga

SEQ ID NO: 21277 - DNA, 25 bp, Artificial Sequence
  Description of Artificial Sequence: Synthetic oligonucleotide
ggccagtgtggcggagcagttgaga

SEQ ID NO: 21278 - DNA, 25 bp, Artificial Sequence
  Description of Artificial Sequence: Synthetic oligonucleotide
gccagtgtggcggagcagttgagag

SEQ ID NO: 21279 - DNA, 25 bp, Artificial Sequence
  Description of Artificial Sequence: Synthetic oligonucleotide
ccagtgtggcggagcagttgagagc

SEQ ID NO: 21280 - DNA, 27 bp, Artificial Sequence
  Description of Artificial Sequence: Synthetic oligonucleotide
cagtgtggcggagcagttgagagccta

SEQ ID NO: 21281 - DNA, 27 bp, Artificial Sequence
  Description of Artificial Sequence: Synthetic oligonucleotide
agtgtggcggagcagttgagagcctac

SEQ ID NO: 21282 - DNA, 24 bp, Artificial Sequence
  Description of Artificial Sequence: Synthetic oligonucleotide
acgccgcgagccagaggatggagt

SEQ ID NO: 21283 - DNA, 23 bp, Artificial Sequence
  Description of Artificial Sequence: Synthetic oligonucleotide
cgccgcgagccagaggatggagt

SEQ ID NO: 21284 - DNA, 23 bp, Artificial Sequence
  Description of Artificial Sequence: Synthetic oligonucleotide
gccgcgagccagaggatggagtc

SEQ ID NO: 21285 - DNA, 23 bp, Artificial Sequence
  Description of Artificial Sequence: Synthetic oligonucleotide
ccgcgagccagaggatggagtcg

SEQ ID NO: 21286 - DNA, 23 bp, Artificial Sequence
  Description of Artificial Sequence: Synthetic oligonucleotide
cgcgagccagaggatggagtcgc

SEQ ID NO: 21287 - DNA, 23 bp, Artificial Sequence
  Description of Artificial Sequence: Synthetic oligonucleotide
gcgagccagaggatggagtcgcg

SEQ ID NO: 21288 - DNA, 23 bp, Artificial Sequence
  Description of Artificial Sequence: Synthetic oligonucleotide
cgagccagaggatggagtcgcgg

SEQ ID NO: 21289 - DNA, 23 bp, Artificial Sequence
  Description of Artificial Sequence: Synthetic oligonucleotide
gagccagaggatggagtcgcggg

SEQ ID NO: 21290 - DNA, 23 bp, Artificial Sequence
  Description of Artificial Sequence: Synthetic oligonucleotide
agccagaggatggagtcgcgggc

SEQ ID NO: 21291 - DNA, 22 bp, Artificial Sequence
  Description of Artificial Sequence: Synthetic oligonucleotide
gccagaggatggagtcgcgggc

SEQ ID NO: 21292 - DNA, 22 bp, Artificial Sequence
  Description of Artificial Sequence: Synthetic oligonucleotide
ccagaggatggagtcgcgggcg

SEQ ID NO: 21293 - DNA, 22 bp, Artificial Sequence
  Description of Artificial Sequence: Synthetic oligonucleotide
cagaggatggagtcgcgggcgc

SEQ ID NO: 21294 - DNA, 22 bp, Artificial Sequence
  Description of Artificial Sequence: Synthetic oligonucleotide
agaggatggagtcgcgggcgcc

SEQ ID NO: 21295 - DNA, 21 bp, Artificial Sequence
  Description of Artificial Sequence: Synthetic oligonucleotide
gaggatggagtcgcgggcgcc

SEQ ID NO: 21296 - DNA, 22 bp, Artificial Sequence
  Description of Artificial Sequence: Synthetic oligonucleotide
aggatggagtcgcgggcgccgt

SEQ ID NO: 21297 - DNA, 21 bp, Artificial Sequence
  Description of Artificial Sequence: Synthetic oligonucleotide
ggatggagtcgcgggcgccgt

SEQ ID NO: 21298 - DNA, 21 bp, Artificial Sequence
  Description of Artificial Sequence: Synthetic oligonucleotide
gatggagtcgcgggcgccgtg

SEQ ID NO: 21299 - DNA, 24 bp, Artificial Sequence
  Description of Artificial Sequence: Synthetic oligonucleotide
atggagtcgcgggcgccgtggata

SEQ ID NO: 21300 - DNA, 23 bp, Artificial Sequence
  Description of Artificial Sequence: Synthetic oligonucleotide
tggagtcgcgggcgccgtggata

SEQ ID NO: 21301 - DNA, 22 bp, Artificial Sequence
  Description of Artificial Sequence: Synthetic oligonucleotide
ggagtcgcgggcgccgtggata

SEQ ID NO: 21302 - DNA, 23 bp, Artificial Sequence
  Description of Artificial Sequence: Synthetic oligonucleotide
gagtcgcgggcgccgtggataga

SEQ ID NO: 21303 - DNA, 23 bp, Artificial Sequence
  Description of Artificial Sequence: Synthetic oligonucleotide
agtcgcgggcgccgtggatagag

SEQ ID NO: 21304 - DNA, 22 bp, Artificial Sequence
  Description of Artificial Sequence: Synthetic oligonucleotide
gtcgcgggcgccgtggatagag

SEQ ID NO: 21305 - DNA, 23 bp, Artificial Sequence
  Description of Artificial Sequence: Synthetic oligonucleotide
tcgcgggcgccgtggatagagca

SEQ ID NO: 21306 - DNA, 27 bp, Artificial Sequence
  Description of Artificial Sequence: Synthetic oligonucleotide
agagcgaggccggttctcacaccatga

SEQ ID NO: 21307 - DNA, 27 bp, Artificial Sequence
  Description of Artificial Sequence: Synthetic oligonucleotide
gagcgaggccggttctcacaccatgat

SEQ ID NO: 21308 - DNA, 27 bp, Artificial Sequence
  Description of Artificial Sequence: Synthetic oligonucleotide
agcgaggccggttctcacaccatgatg

SEQ ID NO: 21309 - DNA, 27 bp, Artificial Sequence
  Description of Artificial Sequence: Synthetic oligonucleotide
gcgaggccggttctcacaccatgatgt

SEQ ID NO: 21310 - DNA, 29 bp, Artificial Sequence
  Description of Artificial Sequence: Synthetic oligonucleotide
cgaggccggttctcacaccatgatgtatg

SEQ ID NO: 21311 - DNA, 29 bp, Artificial Sequence
  Description of Artificial Sequence: Synthetic oligonucleotide
gaggccggttctcacaccatgatgtatgg

SEQ ID NO: 21312 - DNA, 29 bp, Artificial Sequence
  Description of Artificial Sequence: Synthetic oligonucleotide
aggccggttctcacaccatgatgtatggc

SEQ ID NO: 21313 - DNA, 28 bp, Artificial Sequence
  Description of Artificial Sequence: Synthetic oligonucleotide
ggccggttctcacaccatgatgtatggc

SEQ ID NO: 21314 - DNA, 29 bp, Artificial Sequence
  Description of Artificial Sequence: Synthetic oligonucleotide
gccggttctcacaccatgatgtatggctg

SEQ ID NO: 21315 - DNA, 29 bp, Artificial Sequence
  Description of Artificial Sequence: Synthetic oligonucleotide
ccggttctcacaccatgatgtatggctgc

SEQ ID NO: 21316 - DNA, 29 bp, Artificial Sequence
  Description of Artificial Sequence: Synthetic oligonucleotide
cggttctcacaccatgatgtatggctgcg

SEQ ID NO: 21317 - DNA, 30 bp, Artificial Sequence
  Description of Artificial Sequence: Synthetic oligonucleotide
ggttctcacaccatgatgtatggctgcgac

SEQ ID NO: 21318 - DNA, 30 bp, Artificial Sequence
  Description of Artificial Sequence: Synthetic oligonucleotide
gttctcacaccatgatgtatggctgcgacg

SEQ ID NO: 21319 - DNA, 31 bp, Artificial Sequence
  Description of Artificial Sequence: Synthetic oligonucleotide
ttctcacaccatgatgtatggctgcgacgtg

SEQ ID NO: 21320 - DNA, 30 bp, Artificial Sequence
  Description of Artificial Sequence: Synthetic oligonucleotide
tctcacaccatgatgtatggctgcgacgtg

SEQ ID NO: 21321 - DNA, 29 bp, Artificial Sequence
  Description of Artificial Sequence: Synthetic oligonucleotide
ctcacaccatgatgtatggctgcgacgtg

SEQ ID NO: 21322 - DNA, 29 bp, Artificial Sequence
  Description of Artificial Sequence: Synthetic oligonucleotide
tcacaccatgatgtatggctgcgacgtgg

SEQ ID NO: 21323 - DNA, 28 bp, Artificial Sequence
  Description of Artificial Sequence: Synthetic oligonucleotide
cacaccatgatgtatggctgcgacgtgg

SEQ ID NO: 21324 - DNA, 28 bp, Artificial Sequence
  Description of Artificial Sequence: Synthetic oligonucleotide
acaccatgatgtatggctgcgacgtggg

SEQ ID NO: 21325 - DNA, 27 bp, Artificial Sequence
  Description of Artificial Sequence: Synthetic oligonucleotide
caccatgatgtatggctgcgacgtggg

SEQ ID NO: 21326 - DNA, 27 bp, Artificial Sequence
  Description of Artificial Sequence: Synthetic oligonucleotide
accatgatgtatggctgcgacgtgggg

SEQ ID NO: 21327 - DNA, 26 bp, Artificial Sequence
  Description of Artificial Sequence: Synthetic oligonucleotide
ccatgatgtatggctgcgacgtgggg

SEQ ID NO: 21328 - DNA, 26 bp, Artificial Sequence
  Description of Artificial Sequence: Synthetic oligonucleotide
catgatgtatggctgcgacgtggggc

SEQ ID NO: 21329 - DNA, 24 bp, Artificial Sequence
  Description of Artificial Sequence: Synthetic oligonucleotide
atggagccgcgggcgccgtgaata

SEQ ID NO: 21330 - DNA, 23 bp, Artificial Sequence
  Description of Artificial Sequence: Synthetic oligonucleotide
tggagccgcgggcgccgtgaata

SEQ ID NO: 21331 - DNA, 22 bp, Artificial Sequence
  Description of Artificial Sequence: Synthetic oligonucleotide
ggagccgcgggcgccgtgaata

SEQ ID NO: 21332 - DNA, 23 bp, Artificial Sequence
  Description of Artificial Sequence: Synthetic oligonucleotide
gagccgcgggcgccgtgaataga

SEQ ID NO: 21333 - DNA, 23 bp, Artificial Sequence
  Description of Artificial Sequence: Synthetic oligonucleotide
agccgcgggcgccgtgaatagag

SEQ ID NO: 21334 - DNA, 22 bp, Artificial Sequence
  Description of Artificial Sequence: Synthetic oligonucleotide
gccgcgggcgccgtgaatagag

SEQ ID NO: 21335 - DNA, 23 bp, Artificial Sequence
  Description of Artificial Sequence: Synthetic oligonucleotide
ccgcgggcgccgtgaatagagca

SEQ ID NO: 21336 - DNA, 23 bp, Artificial Sequence
  Description of Artificial Sequence: Synthetic oligonucleotide
cgcgggcgccgtgaatagagcag

SEQ ID NO: 21337 - DNA, 24 bp, Artificial Sequence
  Description of Artificial Sequence: Synthetic oligonucleotide
gcgggcgccgtgaatagagcagga

SEQ ID NO: 21338 - DNA, 24 bp, Artificial Sequence
  Description of Artificial Sequence: Synthetic oligonucleotide
cgggcgccgtgaatagagcaggag

SEQ ID NO: 21339 - DNA, 24 bp, Artificial Sequence
  Description of Artificial Sequence: Synthetic oligonucleotide
gggcgccgtgaatagagcaggagg

SEQ ID NO: 21340 - DNA, 24 bp, Artificial Sequence
  Description of Artificial Sequence: Synthetic oligonucleotide
ggcgccgtgaatagagcaggaggg

SEQ ID NO: 21341 - DNA, 24 bp, Artificial Sequence
  Description of Artificial Sequence: Synthetic oligonucleotide
gcgccgtgaatagagcaggagggg

SEQ ID NO: 21342 - DNA, 24 bp, Artificial Sequence
  Description of Artificial Sequence: Synthetic oligonucleotide
cgccgtgaatagagcaggaggggc

SEQ ID NO: 21343 - DNA, 24 bp, Artificial Sequence
  Description of Artificial Sequence: Synthetic oligonucleotide
gccgtgaatagagcaggaggggcc

SEQ ID NO: 21344 - DNA, 24 bp, Artificial Sequence
  Description of Artificial Sequence: Synthetic oligonucleotide
ccgtgaatagagcaggaggggccg

SEQ ID NO: 21345 - DNA, 25 bp, Artificial Sequence
  Description of Artificial Sequence: Synthetic oligonucleotide
cgtgaatagagcaggaggggccgga

SEQ ID NO: 21346 - DNA, 27 bp, Artificial Sequence
  Description of Artificial Sequence: Synthetic oligonucleotide
gtgaatagagcaggaggggccggagta

SEQ ID NO: 21347 - DNA, 29 bp, Artificial Sequence
  Description of Artificial Sequence: Synthetic oligonucleotide
tgaatagagcaggaggggccggagtattg

SEQ ID NO: 21348 - DNA, 28 bp, Artificial Sequence
  Description of Artificial Sequence: Synthetic oligonucleotide
gaatagagcaggaggggccggagtattg

SEQ ID NO: 21349 - DNA, 28 bp, Artificial Sequence
  Description of Artificial Sequence: Synthetic oligonucleotide
aatagagcaggaggggccggagtattgg

SEQ ID NO: 21350 - DNA, 23 bp, Artificial Sequence
  Description of Artificial Sequence: Synthetic oligonucleotide
atggccgtcatgccgccccgaac

SEQ ID NO: 21351 - DNA, 22 bp, Artificial Sequence
  Description of Artificial Sequence: Synthetic oligonucleotide
tggccgtcatgccgccccgaac

SEQ ID NO: 21352 - DNA, 21 bp, Artificial Sequence
  Description of Artificial Sequence: Synthetic oligonucleotide
ggccgtcatgccgccccgaac

SEQ ID NO: 21353 - DNA, 21 bp, Artificial Sequence
  Description of Artificial Sequence: Synthetic oligonucleotide
gccgtcatgccgccccgaacc

SEQ ID NO: 21354 - DNA, 22 bp, Artificial Sequence
  Description of Artificial Sequence: Synthetic oligonucleotide
ccgtcatgccgccccgaaccct

SEQ ID NO: 21355 - DNA, 22 bp, Artificial Sequence
  Description of Artificial Sequence: Synthetic oligonucleotide
cgtcatgccgccccgaaccctc

SEQ ID NO: 21356 - DNA, 23 bp, Artificial Sequence
  Description of Artificial Sequence: Synthetic oligonucleotide
gtcatgccgccccgaaccctcct

SEQ ID NO: 21357 - DNA, 23 bp, Artificial Sequence
  Description of Artificial Sequence: Synthetic oligonucleotide
tcatgccgccccgaaccctcctc

SEQ ID NO: 21358 - DNA, 22 bp, Artificial Sequence
  Description of Artificial Sequence: Synthetic oligonucleotide
catgccgccccgaaccctcctc

SEQ ID NO: 21359 - DNA, 23 bp, Artificial Sequence
  Description of Artificial Sequence: Synthetic oligonucleotide
atgccgccccgaaccctcctcct

SEQ ID NO: 21360 - DNA, 22 bp, Artificial Sequence
  Description of Artificial Sequence: Synthetic oligonucleotide
tgccgccccgaaccctcctcct

SEQ ID NO: 21361 - DNA, 21 bp, Artificial Sequence
  Description of Artificial Sequence: Synthetic oligonucleotide
gccgccccgaaccctcctcct

SEQ ID NO: 21362 - DNA, 21 bp, Artificial Sequence
  Description of Artificial Sequence: Synthetic oligonucleotide
ccgccccgaaccctcctcctg

SEQ ID NO: 21363 - DNA, 30 bp, Artificial Sequence
  Description of Artificial Sequence: Synthetic oligonucleotide
gcaggctcccactccatgaggtatttcttc

SEQ ID NO: 21364 - DNA, 31 bp, Artificial Sequence
  Description of Artificial Sequence: Synthetic oligonucleotide
caggctcccactccatgaggtatttcttcac

SEQ ID NO: 21365 - DNA, 33 bp, Artificial Sequence
  Description of Artificial Sequence: Synthetic oligonucleotide
aggctcccactccatgaggtatttcttcacatc

SEQ ID NO: 21366 - DNA, 27 bp, Artificial Sequence
  Description of Artificial Sequence: Synthetic oligonucleotide
tcatcgcagtgggctacgtggacgact

SEQ ID NO: 21367 - DNA, 26 bp, Artificial Sequence
  Description of Artificial Sequence: Synthetic oligonucleotide
catcgcagtgggctacgtggacgact

SEQ ID NO: 21368 - DNA, 26 bp, Artificial Sequence
  Description of Artificial Sequence: Synthetic oligonucleotide
atcgcagtgggctacgtggacgactc

SEQ ID NO: 21369 - DNA, 25 bp, Artificial Sequence
  Description of Artificial Sequence: Synthetic oligonucleotide
tcgcagtgggctacgtggacgactc

SEQ ID NO: 21370 - DNA, 24 bp, Artificial Sequence
  Description of Artificial Sequence: Synthetic oligonucleotide
cgcagtgggctacgtggacgactc

SEQ ID NO: 21371 - DNA, 24 bp, Artificial Sequence
  Description of Artificial Sequence: Synthetic oligonucleotide
gcagtgggctacgtggacgactcg

SEQ ID NO: 21372 - DNA, 25 bp, Artificial Sequence
  Description of Artificial Sequence: Synthetic oligonucleotide
cagtgggctacgtggacgactcgca

SEQ ID NO: 21373 - DNA, 27 bp, Artificial Sequence
  Description of Artificial Sequence: Synthetic oligonucleotide
agtgggctacgtggacgactcgcagtt

SEQ ID NO: 21374 - DNA, 26 bp, Artificial Sequence
  Description of Artificial Sequence: Synthetic oligonucleotide
gtgggctacgtggacgactcgcagtt

SEQ ID NO: 21375 - DNA, 26 bp, Artificial Sequence
  Description of Artificial Sequence: Synthetic oligonucleotide
tgggctacgtggacgactcgcagttc

SEQ ID NO: 21376 - DNA, 25 bp, Artificial Sequence
  Description of Artificial Sequence: Synthetic oligonucleotide
gggctacgtggacgactcgcagttc

SEQ ID NO: 21377 - DNA, 26 bp, Artificial Sequence
  Description of Artificial Sequence: Synthetic oligonucleotide
ggctacgtggacgactcgcagttcgt

SEQ ID NO: 21378 - DNA, 26 bp, Artificial Sequence
  Description of Artificial Sequence: Synthetic oligonucleotide
gctacgtggacgactcgcagttcgtg

SEQ ID NO: 21379 - DNA, 27 bp, Artificial Sequence
  Description of Artificial Sequence: Synthetic oligonucleotide
ctacgtggacgactcgcagttcgtgca

SEQ ID NO: 21380 - DNA, 27 bp, Artificial Sequence
  Description of Artificial Sequence: Synthetic oligonucleotide
tacgtggacgactcgcagttcgtgcag

SEQ ID NO: 21381 - DNA, 27 bp, Artificial Sequence
  Description of Artificial Sequence: Synthetic oligonucleotide
acgtggacgactcgcagttcgtgcagt

SEQ ID NO: 21382 - DNA, 27 bp, Artificial Sequence
  Description of Artificial Sequence: Synthetic oligonucleotide
cgtggacgactcgcagttcgtgcagtt

SEQ ID NO: 21383 - DNA, 27 bp, Artificial Sequence
  Description of Artificial Sequence: Synthetic oligonucleotide
gtggacgactcgcagttcgtgcagttc

SEQ ID NO: 21384 - DNA, 27 bp, Artificial Sequence
  Description of Artificial Sequence: Synthetic oligonucleotide
tggacgactcgcagttcgtgcagttcg

SEQ ID NO: 21385 - DNA, 27 bp, Artificial Sequence
  Description of Artificial Sequence: Synthetic oligonucleotide
ggacgactcgcagttcgtgcagttcga

SEQ ID NO: 21386 - DNA, 27 bp, Artificial Sequence
  Description of Artificial Sequence: Synthetic oligonucleotide
gacgactcgcagttcgtgcagttcgac

SEQ ID NO: 21387 - DNA, 28 bp, Artificial Sequence
  Description of Artificial Sequence: Synthetic oligonucleotide
acgactcgcagttcgtgcagttcgacag

SEQ ID NO: 21388 - DNA, 27 bp, Artificial Sequence
  Description of Artificial Sequence: Synthetic oligonucleotide
cgactcgcagttcgtgcagttcgacag

SEQ ID NO: 21389 - DNA, 27 bp, Artificial Sequence
  Description of Artificial Sequence: Synthetic oligonucleotide
gactcgcagttcgtgcagttcgacagc

SEQ ID NO: 21390 - DNA, 27 bp, Artificial Sequence
  Description of Artificial Sequence: Synthetic oligonucleotide
actcgcagttcgtgcagttcgacagcg

SEQ ID NO: 21391 - DNA, 27 bp, Artificial Sequence
  Description of Artificial Sequence: Synthetic oligonucleotide
ctcgcagttcgtgcagttcgacagcga

SEQ ID NO: 21392 - DNA, 27 bp, Artificial Sequence
  Description of Artificial Sequence: Synthetic oligonucleotide
tcgcagttcgtgcagttcgacagcgac

SEQ ID NO: 21393 - DNA, 26 bp, Artificial Sequence
  Description of Artificial Sequence: Synthetic oligonucleotide
cgcagttcgtgcagttcgacagcgac

SEQ ID NO: 21394 - DNA, 26 bp, Artificial Sequence
  Description of Artificial Sequence: Synthetic oligonucleotide
gcagttcgtgcagttcgacagcgacg

SEQ ID NO: 21395 - DNA, 26 bp, Artificial Sequence
  Description of Artificial Sequence: Synthetic oligonucleotide
cagttcgtgcagttcgacagcgacgc

SEQ ID NO: 21396 - DNA, 26 bp, Artificial Sequence
  Description of Artificial Sequence: Synthetic oligonucleotide
agttcgtgcagttcgacagcgacgcc

SEQ ID NO: 21397 - DNA, 25 bp, Artificial Sequence
  Description of Artificial Sequence: Synthetic oligonucleotide
gttcgtgcagttcgacagcgacgcc

SEQ ID NO: 21398 - DNA, 25 bp, Artificial Sequence
  Description of Artificial Sequence: Synthetic oligonucleotide
ttcgtgcagttcgacagcgacgccg

SEQ ID NO: 21399 - DNA, 24 bp, Artificial Sequence
  Description of Artificial Sequence: Synthetic oligonucleotide
tcgtgcagttcgacagcgacgccg

SEQ ID NO: 21400 - DNA, 23 bp, Artificial Sequence
  Description of Artificial Sequence: Synthetic oligonucleotide
cgtgcagttcgacagcgacgccg

SEQ ID NO: 21401 - DNA, 23 bp, Artificial Sequence
  Description of Artificial Sequence: Synthetic oligonucleotide
gtgcagttcgacagcgacgccgc

SEQ ID NO: 21402 - DNA, 24 bp, Artificial Sequence
  Description of Artificial Sequence: Synthetic oligonucleotide
tgcagttcgacagcgacgccgcga

SEQ ID NO: 21403 - DNA, 23 bp, Artificial Sequence
  Description of Artificial Sequence: Synthetic oligonucleotide
gcagttcgacagcgacgccgcga

SEQ ID NO: 21404 - DNA, 23 bp, Artificial Sequence
  Description of Artificial Sequence: Synthetic oligonucleotide
cagttcgacagcgacgccgcgag

SEQ ID NO: 21405 - DNA, 23 bp, Artificial Sequence
  Description of Artificial Sequence: Synthetic oligonucleotide
agttcgacagcgacgccgcgagc

SEQ ID NO: 21406 - DNA, 24 bp, Artificial Sequence
  Description of Artificial Sequence: Synthetic oligonucleotide
ggcgccgtggatagagcaggagga

SEQ ID NO: 21407 - DNA, 24 bp, Artificial Sequence
  Description of Artificial Sequence: Synthetic oligonucleotide
gcgccgtggatagagcaggaggag

SEQ ID NO: 21408 - DNA, 24 bp, Artificial Sequence
  Description of Artificial Sequence: Synthetic oligonucleotide
cgccgtggatagagcaggaggagc

SEQ ID NO: 21409 - DNA, 24 bp, Artificial Sequence
  Description of Artificial Sequence: Synthetic oligonucleotide
gccgtggatagagcaggaggagcc

SEQ ID NO: 21410 - DNA, 24 bp, Artificial Sequence
  Description of Artificial Sequence: Synthetic oligonucleotide
ccgtggatagagcaggaggagccg

SEQ ID NO: 21411 - DNA, 25 bp, Artificial Sequence
  Description of Artificial Sequence: Synthetic oligonucleotide
cgtggatagagcaggaggagccgga

SEQ ID NO: 21412 - DNA, 27 bp, Artificial Sequence
  Description of Artificial Sequence: Synthetic oligonucleotide
gtggatagagcaggaggagccggagta

SEQ ID NO: 21413 - DNA, 29 bp, Artificial Sequence
  Description of Artificial Sequence: Synthetic oligonucleotide
tggatagagcaggaggagccggagtattg

SEQ ID NO: 21414 - DNA, 28 bp, Artificial Sequence
  Description of Artificial Sequence: Synthetic oligonucleotide
ggatagagcaggaggagccggagtattg

SEQ ID NO: 21415 - DNA, 28 bp, Artificial Sequence
  Description of Artificial Sequence: Synthetic oligonucleotide
gatagagcaggaggagccggagtattgg

SEQ ID NO: 21416 - DNA, 28 bp, Artificial Sequence
  Description of Artificial Sequence: Synthetic oligonucleotide
atagagcaggaggagccggagtattggg

SEQ ID NO: 21417 - DNA, 27 bp, Artificial Sequence
  Description of Artificial Sequence: Synthetic oligonucleotide
tagagcaggaggagccggagtattggg

SEQ ID NO: 21418 - DNA, 27 bp, Artificial Sequence
  Description of Artificial Sequence: Synthetic oligonucleotide
agagcaggaggagccggagtattggga

SEQ ID NO: 21419 - DNA, 26 bp, Artificial Sequence
  Description of Artificial Sequence: Synthetic oligonucleotide
gagcaggaggagccggagtattggga

SEQ ID NO: 21420 - DNA, 26 bp, Artificial Sequence
  Description of Artificial Sequence: Synthetic oligonucleotide
agcaggaggagccggagtattgggac

SEQ ID NO: 21421 - DNA, 25 bp, Artificial Sequence
  Description of Artificial Sequence: Synthetic oligonucleotide
gcaggaggagccggagtattgggac

SEQ ID NO: 21422 - DNA, 26 bp, Artificial Sequence
  Description of Artificial Sequence: Synthetic oligonucleotide
caggaggagccggagtattgggacga

SEQ ID NO: 21423 - DNA, 26 bp, Artificial Sequence
  Description of Artificial Sequence: Synthetic oligonucleotide
aggaggagccggagtattgggacgag

SEQ ID NO: 21424 - DNA, 25 bp, Artificial Sequence
  Description of Artificial Sequence: Synthetic oligonucleotide
ggaggagccggagtattgggacgag

SEQ ID NO: 21425 - DNA, 26 bp, Artificial Sequence
  Description of Artificial Sequence: Synthetic oligonucleotide
gaggagccggagtattgggacgagga

SEQ ID NO: 21426 - DNA, 27 bp, Artificial Sequence
  Description of Artificial Sequence: Synthetic oligonucleotide
aggagccggagtattgggacgaggaga

SEQ ID NO: 21427 - DNA, 26 bp, Artificial Sequence
  Description of Artificial Sequence: Synthetic oligonucleotide
ggagccggagtattgggacgaggaga

SEQ ID NO: 21428 - DNA, 27 bp, Artificial Sequence
  Description of Artificial Sequence: Synthetic oligonucleotide
gagccggagtattgggacgaggagaca

SEQ ID NO: 21429 - DNA, 27 bp, Artificial Sequence
  Description of Artificial Sequence: Synthetic oligonucleotide
agccggagtattgggacgaggagacac

SEQ ID NO: 21430 - DNA, 27 bp, Artificial Sequence
  Description of Artificial Sequence: Synthetic oligonucleotide
gaggagacacggaatgtgaaggcccac

SEQ ID NO: 21431 - DNA, 31 bp, Artificial Sequence
  Description of Artificial Sequence: Synthetic oligonucleotide
acggaatgtgaaggcccactcacagactaac

SEQ ID NO: 21432 - DNA, 30 bp, Artificial Sequence
  Description of Artificial Sequence: Synthetic oligonucleotide
cggaatgtgaaggcccactcacagactaac

SEQ ID NO: 21433 - DNA, 30 bp, Artificial Sequence
  Description of Artificial Sequence: Synthetic oligonucleotide
ggaatgtgaaggcccactcacagactaacc

SEQ ID NO: 21434 - DNA, 30 bp, Artificial Sequence
  Description of Artificial Sequence: Synthetic oligonucleotide
gaatgtgaaggcccactcacagactaaccg

SEQ ID NO: 21435 - DNA, 31 bp, Artificial Sequence
  Description of Artificial Sequence: Synthetic oligonucleotide
aatgtgaaggcccactcacagactaaccgag

SEQ ID NO: 21436 - DNA, 30 bp, Artificial Sequence
  Description of Artificial Sequence: Synthetic oligonucleotide
atgtgaaggcccactcacagactaaccgag

SEQ ID NO: 21437 - DNA, 29 bp, Artificial Sequence
  Description of Artificial Sequence: Synthetic oligonucleotide
tgtgaaggcccactcacagactaaccgag

SEQ ID NO: 21438 - DNA, 28 bp, Artificial Sequence
  Description of Artificial Sequence: Synthetic oligonucleotide
gtgaaggcccactcacagactaaccgag

SEQ ID NO: 21439 - DNA, 28 bp, Artificial Sequence
  Description of Artificial Sequence: Synthetic oligonucleotide
tgaaggcccactcacagactaaccgagc

SEQ ID NO: 21440 - DNA, 27 bp, Artificial Sequence
  Description of Artificial Sequence: Synthetic oligonucleotide
gaaggcccactcacagactaaccgagc

SEQ ID NO: 21441 - DNA, 27 bp, Artificial Sequence
  Description of Artificial Sequence: Synthetic oligonucleotide
aaggcccactcacagactaaccgagcg

SEQ ID NO: 21442 - DNA, 27 bp, Artificial Sequence
  Description of Artificial Sequence: Synthetic oligonucleotide
aggcccactcacagactaaccgagcga

SEQ ID NO: 21443 - DNA, 27 bp, Artificial Sequence
  Description of Artificial Sequence: Synthetic oligonucleotide
ggcccactcacagactaaccgagcgaa

SEQ ID NO: 21444 - DNA, 27 bp, Artificial Sequence
  Description of Artificial Sequence: Synthetic oligonucleotide
gcccactcacagactaaccgagcgaac

SEQ ID NO: 21445 - DNA, 27 bp, Artificial Sequence
  Description of Artificial Sequence: Synthetic oligonucleotide
cccactcacagactaaccgagcgaacc

SEQ ID NO: 21446 - DNA, 28 bp, Artificial Sequence
  Description of Artificial Sequence: Synthetic oligonucleotide
ccactcacagactaaccgagcgaacctg

SEQ ID NO: 21447 - DNA, 28 bp, Artificial Sequence
  Description of Artificial Sequence: Synthetic oligonucleotide
cactcacagactaaccgagcgaacctgg

SEQ ID NO: 21448 - DNA, 28 bp, Artificial Sequence
  Description of Artificial Sequence: Synthetic oligonucleotide
actcacagactaaccgagcgaacctggg

SEQ ID NO: 21449 - DNA, 27 bp, Artificial Sequence
  Description of Artificial Sequence: Synthetic oligonucleotide
ctcacagactaaccgagcgaacctggg

SEQ ID NO: 21450 - DNA, 27 bp, Artificial Sequence
  Description of Artificial Sequence: Synthetic oligonucleotide
tcacagactaaccgagcgaacctgggg

SEQ ID NO: 21451 - DNA, 27 bp, Artificial Sequence
  Description of Artificial Sequence: Synthetic oligonucleotide
cacagactaaccgagcgaacctgggga

SEQ ID NO: 21452 - DNA, 27 bp, Artificial Sequence
  Description of Artificial Sequence: Synthetic oligonucleotide
acagactaaccgagcgaacctggggac

SEQ ID NO: 21453 - DNA, 26 bp, Artificial Sequence
  Description of Artificial Sequence: Synthetic oligonucleotide
cagactaaccgagcgaacctggggac

SEQ ID NO: 21454 - DNA, 26 bp, Artificial Sequence
  Description of Artificial Sequence: Synthetic oligonucleotide
agactaaccgagcgaacctggggacc

SEQ ID NO: 21455 - DNA, 25 bp, Artificial Sequence
  Description of Artificial Sequence: Synthetic oligonucleotide
gactaaccgagcgaacctggggacc

SEQ ID NO: 21456 - DNA, 26 bp, Artificial Sequence
  Description of Artificial Sequence: Synthetic oligonucleotide
actaaccgagcgaacctggggaccct

SEQ ID NO: 21457 - DNA, 25 bp, Artificial Sequence
  Description of Artificial Sequence: Synthetic oligonucleotide
ctaaccgagcgaacctggggaccct

SEQ ID NO: 21458 - DNA, 25 bp, Artificial Sequence
  Description of Artificial Sequence: Synthetic oligonucleotide
taaccgagcgaacctggggaccctg

SEQ ID NO: 21459 - DNA, 24 bp, Artificial Sequence
  Description of Artificial Sequence: Synthetic oligonucleotide
aaccgagcgaacctggggaccctg

SEQ ID NO: 21460 - DNA, 25 bp, Artificial Sequence
  Description of Artificial Sequence: Synthetic oligonucleotide
agctgagagcctacctggagggcga

SEQ ID NO: 21461 - DNA, 24 bp, Artificial Sequence
  Description of Artificial Sequence: Synthetic oligonucleotide
gctgagagcctacctggagggcga

SEQ ID NO: 21462 - DNA, 25 bp, Artificial Sequence
  Description of Artificial Sequence: Synthetic oligonucleotide
ctgagagcctacctggagggcgagt

SEQ ID NO: 21463 - DNA, 27 bp, Artificial Sequence
  Description of Artificial Sequence: Synthetic oligonucleotide
ttccagaagtgggcggctgtggtggta

SEQ ID NO: 21464 - DNA, 26 bp, Artificial Sequence
  Description of Artificial Sequence: Synthetic oligonucleotide
tccagaagtgggcggctgtggtggta

SEQ ID NO: 21465 - DNA, 25 bp, Artificial Sequence
  Description of Artificial Sequence: Synthetic oligonucleotide
ccagaagtgggcggctgtggtggta

SEQ ID NO: 21466 - DNA, 25 bp, Artificial Sequence
  Description of Artificial Sequence: Synthetic oligonucleotide
cagaagtgggcggctgtggtggtac

SEQ ID NO: 21467 - DNA, 27 bp, Artificial Sequence
  Description of Artificial Sequence: Synthetic oligonucleotide
agaagtgggcggctgtggtggtacctt

SEQ ID NO: 21468 - DNA, 26 bp, Artificial Sequence
  Description of Artificial Sequence: Synthetic oligonucleotide
gaagtgggcggctgtggtggtacctt

SEQ ID NO: 21469 - DNA, 27 bp, Artificial Sequence
  Description of Artificial Sequence: Synthetic oligonucleotide
aagtgggcggctgtggtggtaccttct

SEQ ID NO: 21470 - DNA, 26 bp, Artificial Sequence
  Description of Artificial Sequence: Synthetic oligonucleotide
agtgggcggctgtggtggtaccttct

SEQ ID NO: 21471 - DNA, 25 bp, Artificial Sequence
  Description of Artificial Sequence: Synthetic oligonucleotide
gtgggcggctgtggtggtaccttct

SEQ ID NO: 21472 - DNA, 25 bp, Artificial Sequence
  Description of Artificial Sequence: Synthetic oligonucleotide
tgggcggctgtggtggtaccttctg

SEQ ID NO: 21473 - DNA, 24 bp, Artificial Sequence
  Description of Artificial Sequence: Synthetic oligonucleotide
gggcggctgtggtggtaccttctg

SEQ ID NO: 21474 - DNA, 27 bp, Artificial Sequence
  Description of Artificial Sequence: Synthetic oligonucleotide
ggcggctgtggtggtaccttctggaaa

SEQ ID NO: 21475 - DNA, 27 bp, Artificial Sequence
  Description of Artificial Sequence: Synthetic oligonucleotide
gcggctgtggtggtaccttctggaaag

SEQ ID NO: 21476 - DNA, 27 bp, Artificial Sequence
  Description of Artificial Sequence: Synthetic oligonucleotide
cggctgtggtggtaccttctggaaagg

SEQ ID NO: 21477 - DNA, 28 bp, Artificial Sequence
  Description of Artificial Sequence: Synthetic oligonucleotide
ggctgtggtggtaccttctggaaaggag

SEQ ID NO: 21478 - DNA, 30 bp, Artificial Sequence
  Description of Artificial Sequence: Synthetic oligonucleotide
gctgtggtggtaccttctggaaaggagaag

SEQ ID NO: 21479 - DNA, 31 bp, Artificial Sequence
  Description of Artificial Sequence: Synthetic oligonucleotide
ctgtggtggtaccttctggaaaggagaagag

SEQ ID NO: 21480 - DNA, 34 bp, Artificial Sequence
  Description of Artificial Sequence: Synthetic oligonucleotide
tgtggtggtaccttctggaaaggagaagagatac

SEQ ID NO: 21481 - DNA, 33 bp, Artificial Sequence
  Description of Artificial Sequence: Synthetic oligonucleotide
gtggtggtaccttctggaaaggagaagagatac

SEQ ID NO: 21482 - DNA, 34 bp, Artificial Sequence
  Description of Artificial Sequence: Synthetic oligonucleotide
tggtggtaccttctggaaaggagaagagatacac

SEQ ID NO: 21483 - DNA, 33 bp, Artificial Sequence
  Description of Artificial Sequence: Synthetic oligonucleotide
ggtggtaccttctggaaaggagaagagatacac

SEQ ID NO: 21484 - DNA, 33 bp, Artificial Sequence
  Description of Artificial Sequence: Synthetic oligonucleotide
gtggtaccttctggaaaggagaagagatacacc

SEQ ID NO: 21485 - DNA, 34 bp, Artificial Sequence
  Description of Artificial Sequence: Synthetic oligonucleotide
tggtaccttctggaaaggagaagagatacacctg

SEQ ID NO: 21486 - DNA, 33 bp, Artificial Sequence
  Description of Artificial Sequence: Synthetic oligonucleotide
ggtaccttctggaaaggagaagagatacacctg

SEQ ID NO: 21487 - DNA, 33 bp, Artificial Sequence
  Description of Artificial Sequence: Synthetic oligonucleotide
gtaccttctggaaaggagaagagatacacctgc

SEQ ID NO: 21488 - DNA, 33 bp, Artificial Sequence
  Description of Artificial Sequence: Synthetic oligonucleotide
taccttctggaaaggagaagagatacacctgcc

SEQ ID NO: 21489 - DNA, 32 bp, Artificial Sequence
  Description of Artificial Sequence: Synthetic oligonucleotide
accttctggaaaggagaagagatacacctgcc

SEQ ID NO: 21490 - DNA, 31 bp, Artificial Sequence
  Description of Artificial Sequence: Synthetic oligonucleotide
ccttctggaaaggagaagagatacacctgcc

SEQ ID NO: 21491 - DNA, 33 bp, Artificial Sequence
  Description of Artificial Sequence: Synthetic oligonucleotide
cttctggaaaggagaagagatacacctgccatg

SEQ ID NO: 21492 - DNA, 34 bp, Artificial Sequence
  Description of Artificial Sequence: Synthetic oligonucleotide
ttctggaaaggagaagagatacacctgccatgtg

SEQ ID NO: 21493 - DNA, 33 bp, Artificial Sequence
  Description of Artificial Sequence: Synthetic oligonucleotide
tctggaaaggagaagagatacacctgccatgtg

SEQ ID NO: 21494 - DNA, 32 bp, Artificial Sequence
  Description of Artificial Sequence: Synthetic oligonucleotide
ctggaaaggagaagagatacacctgccatgtg

SEQ ID NO: 21495 - DNA, 32 bp, Artificial Sequence
  Description of Artificial Sequence: Synthetic oligonucleotide
tggaaaggagaagagatacacctgccatgtgc

SEQ ID NO: 21496 - DNA, 31 bp, Artificial Sequence
  Description of Artificial Sequence: Synthetic oligonucleotide
ggaaaggagaagagatacacctgccatgtgc

SEQ ID NO: 21497 - DNA, 32 bp, Artificial Sequence
  Description of Artificial Sequence: Synthetic oligonucleotide
gaaaggagaagagatacacctgccatgtgcag

SEQ ID NO: 21498 - DNA, 32 bp, Artificial Sequence
  Description of Artificial Sequence: Synthetic oligonucleotide
aaaggagaagagatacacctgccatgtgcagc

SEQ ID NO: 21499 - DNA, 31 bp, Artificial Sequence
  Description of Artificial Sequence: Synthetic oligonucleotide
aaggagaagagatacacctgccatgtgcagc

SEQ ID NO: 21500 - DNA, 30 bp, Artificial Sequence
  Description of Artificial Sequence: Synthetic oligonucleotide
aggagaagagatacacctgccatgtgcagc

SEQ ID NO: 21501 - DNA, 29 bp, Artificial Sequence
  Description of Artificial Sequence: Synthetic oligonucleotide
ggagaagagatacacctgccatgtgcagc

SEQ ID NO: 21502 - DNA, 31 bp, Artificial Sequence
  Description of Artificial Sequence: Synthetic oligonucleotide
gagaagagatacacctgccatgtgcagcatg

SEQ ID NO: 21503 - DNA, 32 bp, Artificial Sequence
  Description of Artificial Sequence: Synthetic oligonucleotide
agaagagatacacctgccatgtgcagcatgag

SEQ ID NO: 21504 - DNA, 31 bp, Artificial Sequence
  Description of Artificial Sequence: Synthetic oligonucleotide
gaagagatacacctgccatgtgcagcatgag

SEQ ID NO: 21505 - DNA, 31 bp, Artificial Sequence
  Description of Artificial Sequence: Synthetic oligonucleotide
aagagatacacctgccatgtgcagcatgagg

SEQ ID NO: 21506 - DNA, 27 bp, Artificial Sequence
  Description of Artificial Sequence: Synthetic oligonucleotide
atgggagccatcttcccagcccaccat

SEQ ID NO: 21507 - DNA, 26 bp, Artificial Sequence
  Description of Artificial Sequence: Synthetic oligonucleotide
tgggagccatcttcccagcccaccat

SEQ ID NO: 21508 - DNA, 25 bp, Artificial Sequence
  Description of Artificial Sequence: Synthetic oligonucleotide
gggagccatcttcccagcccaccat

SEQ ID NO: 21509 - DNA, 25 bp, Artificial Sequence
  Description of Artificial Sequence: Synthetic oligonucleotide
ggagccatcttcccagcccaccatc

SEQ ID NO: 21510 - DNA, 25 bp, Artificial Sequence
  Description of Artificial Sequence: Synthetic oligonucleotide
gagccatcttcccagcccaccatcc

SEQ ID NO: 21511 - DNA, 25 bp, Artificial Sequence
  Description of Artificial Sequence: Synthetic oligonucleotide
agccatcttcccagcccaccatccc

SEQ ID NO: 21512 - DNA, 24 bp, Artificial Sequence
  Description of Artificial Sequence: Synthetic oligonucleotide
gccatcttcccagcccaccatccc

SEQ ID NO: 21513 - DNA, 27 bp, Artificial Sequence
  Description of Artificial Sequence: Synthetic oligonucleotide
ccatcttcccagcccaccatccccatt

SEQ ID NO: 21514 - DNA, 27 bp, Artificial Sequence
  Description of Artificial Sequence: Synthetic oligonucleotide
catcttcccagcccaccatccccattg

SEQ ID NO: 21515 - DNA, 28 bp, Artificial Sequence
  Description of Artificial Sequence: Synthetic oligonucleotide
atcttcccagcccaccatccccattgtg

SEQ ID NO: 21516 - DNA, 27 bp, Artificial Sequence
  Description of Artificial Sequence: Synthetic oligonucleotide
tcttcccagcccaccatccccattgtg

SEQ ID NO: 21517 - DNA, 26 bp, Artificial Sequence
  Description of Artificial Sequence: Synthetic oligonucleotide
cttcccagcccaccatccccattgtg

SEQ ID NO: 21518 - DNA, 26 bp, Artificial Sequence
  Description of Artificial Sequence: Synthetic oligonucleotide
ttcccagcccaccatccccattgtgg

SEQ ID NO: 21519 - DNA, 25 bp, Artificial Sequence
  Description of Artificial Sequence: Synthetic oligonucleotide
tcccagcccaccatccccattgtgg

SEQ ID NO: 21520 - DNA, 24 bp, Artificial Sequence
  Description of Artificial Sequence: Synthetic oligonucleotide
cccagcccaccatccccattgtgg

SEQ ID NO: 21521 - DNA, 24 bp, Artificial Sequence
  Description of Artificial Sequence: Synthetic oligonucleotide
ccagcccaccatccccattgtggg

SEQ ID NO: 21522 - DNA, 26 bp, Artificial Sequence
  Description of Artificial Sequence: Synthetic oligonucleotide
cagcccaccatccccattgtgggcat

SEQ ID NO: 21523 - DNA, 27 bp, Artificial Sequence
  Description of Artificial Sequence: Synthetic oligonucleotide
agcccaccatccccattgtgggcatca

SEQ ID NO: 21524 - DNA, 27 bp, Artificial Sequence
  Description of Artificial Sequence: Synthetic oligonucleotide
gcccaccatccccattgtgggcatcat

SEQ ID NO: 21525 - DNA, 28 bp, Artificial Sequence
  Description of Artificial Sequence: Synthetic oligonucleotide
cccaccatccccattgtgggcatcattg

SEQ ID NO: 21526 - DNA, 28 bp, Artificial Sequence
  Description of Artificial Sequence: Synthetic oligonucleotide
ccaccatccccattgtgggcatcattgc

SEQ ID NO: 21527 - DNA, 29 bp, Artificial Sequence
  Description of Artificial Sequence: Synthetic oligonucleotide
caccatccccattgtgggcatcattgctg

SEQ ID NO: 21528 - DNA, 29 bp, Artificial Sequence
  Description of Artificial Sequence: Synthetic oligonucleotide
accatccccattgtgggcatcattgctgg

SEQ ID NO: 21529 - DNA, 28 bp, Artificial Sequence
  Description of Artificial Sequence: Synthetic oligonucleotide
ccatccccattgtgggcatcattgctgg

SEQ ID NO: 21530 - DNA, 28 bp, Artificial Sequence
  Description of Artificial Sequence: Synthetic oligonucleotide
catccccattgtgggcatcattgctggc

SEQ ID NO: 21531 - DNA, 28 bp, Artificial Sequence
  Description of Artificial Sequence: Synthetic oligonucleotide
atccccattgtgggcatcattgctggcc

SEQ ID NO: 21532 - DNA, 27 bp, Artificial Sequence
  Description of Artificial Sequence: Synthetic oligonucleotide
tccccattgtgggcatcattgctggcc

SEQ ID NO: 21533 - DNA, 27 bp, Artificial Sequence
  Description of Artificial Sequence: Synthetic oligonucleotide
ccccattgtgggcatcattgctggcct

SEQ ID NO: 21534 - DNA, 27 bp, Artificial Sequence
  Description of Artificial Sequence: Synthetic oligonucleotide
cccattgtgggcatcattgctggcctg

SEQ ID NO: 21535 - DNA, 27 bp, Artificial Sequence
  Description of Artificial Sequence: Synthetic oligonucleotide
ccattgtgggcatcattgctggcctgg

SEQ ID NO: 21536 - DNA, 29 bp, Artificial Sequence
  Description of Artificial Sequence: Synthetic oligonucleotide
cattgtgggcatcattgctggcctggttc

SEQ ID NO: 21537 - DNA, 30 bp, Artificial Sequence
  Description of Artificial Sequence: Synthetic oligonucleotide
attgtgggcatcattgctggcctggttctc

SEQ ID NO: 21538 - DNA, 29 bp, Artificial Sequence
  Description of Artificial Sequence: Synthetic oligonucleotide
ttgtgggcatcattgctggcctggttctc

SEQ ID NO: 21539 - DNA, 28 bp, Artificial Sequence
  Description of Artificial Sequence: Synthetic oligonucleotide
tgtgggcatcattgctggcctggttctc

SEQ ID NO: 21540 - DNA, 27 bp, Artificial Sequence
  Description of Artificial Sequence: Synthetic oligonucleotide
gcctggttctccttggagctgtgatcg

SEQ ID NO: 21541 - DNA, 27 bp, Artificial Sequence
  Description of Artificial Sequence: Synthetic oligonucleotide
cctggttctccttggagctgtgatcgc

SEQ ID NO: 21542 - DNA, 28 bp, Artificial Sequence
  Description of Artificial Sequence: Synthetic oligonucleotide
ctggttctccttggagctgtgatcgctg

SEQ ID NO: 21543 - DNA, 28 bp, Artificial Sequence
  Description of Artificial Sequence: Synthetic oligonucleotide
tggttctccttggagctgtgatcgctgg

SEQ ID NO: 21544 - DNA, 27 bp, Artificial Sequence
  Description of Artificial Sequence: Synthetic oligonucleotide
ggttctccttggagctgtgatcgctgg

SEQ ID NO: 21545 - DNA, 28 bp, Artificial Sequence
  Description of Artificial Sequence: Synthetic oligonucleotide
gttctccttggagctgtgatcgctggag

SEQ ID NO: 21546 - DNA, 28 bp, Artificial Sequence
  Description of Artificial Sequence: Synthetic oligonucleotide
ttctccttggagctgtgatcgctggagc

SEQ ID NO: 21547 - DNA, 27 bp, Artificial Sequence
  Description of Artificial Sequence: Synthetic oligonucleotide
tctccttggagctgtgatcgctggagc

SEQ ID NO: 21548 - DNA, 27 bp, Artificial Sequence
  Description of Artificial Sequence: Synthetic oligonucleotide
ctccttggagctgtgatcgctggagct

SEQ ID NO: 21549 - DNA, 27 bp, Artificial Sequence
  Description of Artificial Sequence: Synthetic oligonucleotide
tccttggagctgtgatcgctggagctg

SEQ ID NO: 21550 - DNA, 27 bp, Artificial Sequence
  Description of Artificial Sequence: Synthetic oligonucleotide
ccttggagctgtgatcgctggagctgt

SEQ ID NO: 21551 - DNA, 27 bp, Artificial Sequence
  Description of Artificial Sequence: Synthetic oligonucleotide
cttggagctgtgatcgctggagctgtg

SEQ ID NO: 21552 - DNA, 25 bp, Artificial Sequence
  Description of Artificial Sequence: Synthetic oligonucleotide
tgatcgctggagctgtggtcgctgc

SEQ ID NO: 21553 - DNA, 24 bp, Artificial Sequence
  Description of Artificial Sequence: Synthetic oligonucleotide
gatcgctggagctgtggtcgctgc

SEQ ID NO: 21554 - DNA, 24 bp, Artificial Sequence
  Description of Artificial Sequence: Synthetic oligonucleotide
atcgctggagctgtggtcgctgcc

SEQ ID NO: 21555 - DNA, 23 bp, Artificial Sequence
  Description of Artificial Sequence: Synthetic oligonucleotide
tcgctggagctgtggtcgctgcc

SEQ ID NO: 21556 - DNA, 22 bp, Artificial Sequence
  Description of Artificial Sequence: Synthetic oligonucleotide
cgctggagctgtggtcgctgcc

SEQ ID NO: 21557 - DNA, 23 bp, Artificial Sequence
  Description of Artificial Sequence: Synthetic oligonucleotide
gctggagctgtggtcgctgccgt

SEQ ID NO: 21558 - DNA, 27 bp, Artificial Sequence
  Description of Artificial Sequence: Synthetic oligonucleotide
tgtggtcgctgccgtgatgtggaggaa

SEQ ID NO: 21559 - DNA, 26 bp, Artificial Sequence
  Description of Artificial Sequence: Synthetic oligonucleotide
gtggtcgctgccgtgatgtggaggaa

SEQ ID NO: 21560 - DNA, 27 bp, Artificial Sequence
  Description of Artificial Sequence: Synthetic oligonucleotide
tggtcgctgccgtgatgtggaggaaga

SEQ ID NO: 21561 - DNA, 27 bp, Artificial Sequence
  Description of Artificial Sequence: Synthetic oligonucleotide
ggtcgctgccgtgatgtggaggaagaa

SEQ ID NO: 21562 - DNA, 27 bp, Artificial Sequence
  Description of Artificial Sequence: Synthetic oligonucleotide
gtcgctgccgtgatgtggaggaagaag

SEQ ID NO: 21563 - DNA, 28 bp, Artificial Sequence
  Description of Artificial Sequence: Synthetic oligonucleotide
tcgctgccgtgatgtggaggaagaagag

SEQ ID NO: 21564 - DNA, 27 bp, Artificial Sequence
  Description of Artificial Sequence: Synthetic oligonucleotide
cgctgccgtgatgtggaggaagaagag

SEQ ID NO: 21565 - DNA, 27 bp, Artificial Sequence
  Description of Artificial Sequence: Synthetic oligonucleotide
gctgccgtgatgtggaggaagaagagc

SEQ ID NO: 21566 - DNA, 28 bp, Artificial Sequence
  Description of Artificial Sequence: Synthetic oligonucleotide
ctgccgtgatgtggaggaagaagagctc

SEQ ID NO: 21567 - DNA, 29 bp, Artificial Sequence
  Description of Artificial Sequence: Synthetic oligonucleotide
tgccgtgatgtggaggaagaagagctcag

SEQ ID NO: 21568 - DNA, 28 bp, Artificial Sequence
  Description of Artificial Sequence: Synthetic oligonucleotide
gccgtgatgtggaggaagaagagctcag

SEQ ID NO: 21569 - DNA, 31 bp, Artificial Sequence
  Description of Artificial Sequence: Synthetic oligonucleotide
ccgtgatgtggaggaagaagagctcagttag

SEQ ID NO: 21570 - DNA, 35 bp, Artificial Sequence
  Description of Artificial Sequence: Synthetic oligonucleotide
cgtgatgtggaggaagaagagctcagttagaaaag

SEQ ID NO: 21571 - DNA, 35 bp, Artificial Sequence
  Description of Artificial Sequence: Synthetic oligonucleotide
gtgatgtggaggaagaagagctcagttagaaaagg

SEQ ID NO: 21572 - DNA, 36 bp, Artificial Sequence
  Description of Artificial Sequence: Synthetic oligonucleotide
tgatgtggaggaagaagagctcagttagaaaaggag

SEQ ID NO: 21573 - DNA, 35 bp, Artificial Sequence
  Description of Artificial Sequence: Synthetic oligonucleotide
gatgtggaggaagaagagctcagttagaaaaggag

SEQ ID NO: 21574 - DNA, 35 bp, Artificial Sequence
  Description of Artificial Sequence: Synthetic oligonucleotide
atgtggaggaagaagagctcagttagaaaaggagg

SEQ ID NO: 21575 - DNA, 34 bp, Artificial Sequence
  Description of Artificial Sequence: Synthetic oligonucleotide
tgtggaggaagaagagctcagttagaaaaggagg

SEQ ID NO: 21576 - DNA, 33 bp, Artificial Sequence
  Description of Artificial Sequence: Synthetic oligonucleotide
gtggaggaagaagagctcagttagaaaaggagg

SEQ ID NO: 21577 - DNA, 33 bp, Artificial Sequence
  Description of Artificial Sequence: Synthetic oligonucleotide
tggaggaagaagagctcagttagaaaaggaggg

SEQ ID NO: 21578 - DNA, 32 bp, Artificial Sequence
  Description of Artificial Sequence: Synthetic oligonucleotide
ggaggaagaagagctcagttagaaaaggaggg

SEQ ID NO: 21579 - DNA, 33 bp, Artificial Sequence
  Description of Artificial Sequence: Synthetic oligonucleotide
gaggaagaagagctcagttagaaaaggagggag

SEQ ID NO: 21580 - DNA, 33 bp, Artificial Sequence
  Description of Artificial Sequence: Synthetic oligonucleotide
aggaagaagagctcagttagaaaaggagggagc

SEQ ID NO: 21581 - DNA, 32 bp, Artificial Sequence
  Description of Artificial Sequence: Synthetic oligonucleotide
ggaagaagagctcagttagaaaaggagggagc

SEQ ID NO: 21582 - DNA, 34 bp, Artificial Sequence
  Description of Artificial Sequence: Synthetic oligonucleotide
gaagaagagctcagttagaaaaggagggagctac

SEQ ID NO: 21583 - DNA, 35 bp, Artificial Sequence
  Description of Artificial Sequence: Synthetic oligonucleotide
aagaagagctcagttagaaaaggagggagctactc

SEQ ID NO: 21584 - DNA, 34 bp, Artificial Sequence
  Description of Artificial Sequence: Synthetic oligonucleotide
agaagagctcagttagaaaaggagggagctactc

SEQ ID NO: 21585 - DNA, 33 bp, Artificial Sequence
  Description of Artificial Sequence: Synthetic oligonucleotide
gaagagctcagttagaaaaggagggagctactc

SEQ ID NO: 21586 - DNA, 34 bp, Artificial Sequence
  Description of Artificial Sequence: Synthetic oligonucleotide
aagagctcagttagaaaaggagggagctactctc

SEQ ID NO: 21587 - DNA, 33 bp, Artificial Sequence
  Description of Artificial Sequence: Synthetic oligonucleotide
agagctcagttagaaaaggagggagctactctc

SEQ ID NO: 21588 - DNA, 32 bp, Artificial Sequence
  Description of Artificial Sequence: Synthetic oligonucleotide
gagctcagttagaaaaggagggagctactctc

SEQ ID NO: 21589 - DNA, 33 bp, Artificial Sequence
  Description of Artificial Sequence: Synthetic oligonucleotide
agctcagttagaaaaggagggagctactctcag

SEQ ID NO: 21590 - DNA, 32 bp, Artificial Sequence
  Description of Artificial Sequence: Synthetic oligonucleotide
gctcagttagaaaaggagggagctactctcag

SEQ ID NO: 21591 - DNA, 32 bp, Artificial Sequence
  Description of Artificial Sequence: Synthetic oligonucleotide
ctcagttagaaaaggagggagctactctcagg

SEQ ID NO: 21592 - DNA, 32 bp, Artificial Sequence
  Description of Artificial Sequence: Synthetic oligonucleotide
tcagttagaaaaggagggagctactctcaggc

SEQ ID NO: 21593 - DNA, 31 bp, Artificial Sequence
  Description of Artificial Sequence: Synthetic oligonucleotide
cagttagaaaaggagggagctactctcaggc

SEQ ID NO: 21594 - DNA, 32 bp, Artificial Sequence
  Description of Artificial Sequence: Synthetic oligonucleotide
agttagaaaaggagggagctactctcaggctg

SEQ ID NO: 21595 - DNA, 31 bp, Artificial Sequence
  Description of Artificial Sequence: Synthetic oligonucleotide
gttagaaaaggagggagctactctcaggctg

SEQ ID NO: 21596 - DNA, 31 bp, Artificial Sequence
  Description of Artificial Sequence: Synthetic oligonucleotide
ttagaaaaggagggagctactctcaggctgc

SEQ ID NO: 21597 - DNA, 23 bp, Artificial Sequence
  Description of Artificial Sequence: Synthetic oligonucleotide
cgagcccctcaccctgagatggg

SEQ ID NO: 21598 - DNA, 24 bp, Artificial Sequence
  Description of Artificial Sequence: Synthetic oligonucleotide
atgctggtcatggcgccccgaacc

SEQ ID NO: 21599 - DNA, 23 bp, Artificial Sequence
  Description of Artificial Sequence: Synthetic oligonucleotide
tgctggtcatggcgccccgaacc

SEQ ID NO: 21600 - DNA, 22 bp, Artificial Sequence
  Description of Artificial Sequence: Synthetic oligonucleotide
gctggtcatggcgccccgaacc

SEQ ID NO: 21601 - DNA, 23 bp, Artificial Sequence
  Description of Artificial Sequence: Synthetic oligonucleotide
ctggtcatggcgccccgaaccgt

SEQ ID NO: 21602 - DNA, 23 bp, Artificial Sequence
  Description of Artificial Sequence: Synthetic oligonucleotide
tggtcatggcgccccgaaccgtc

SEQ ID NO: 21603 - DNA, 22 bp, Artificial Sequence
  Description of Artificial Sequence: Synthetic oligonucleotide
ggtcatggcgccccgaaccgtc

SEQ ID NO: 21604 - DNA, 23 bp, Artificial Sequence
  Description of Artificial Sequence: Synthetic oligonucleotide
gtcatggcgccccgaaccgtcct

SEQ ID NO: 21605 - DNA, 23 bp, Artificial Sequence
  Description of Artificial Sequence: Synthetic oligonucleotide
tcatggcgccccgaaccgtcctc

SEQ ID NO: 21606 - DNA, 22 bp, Artificial Sequence
  Description of Artificial Sequence: Synthetic oligonucleotide
catggcgccccgaaccgtcctc

SEQ ID NO: 21607 - DNA, 23 bp, Artificial Sequence
  Description of Artificial Sequence: Synthetic oligonucleotide
atggcgccccgaaccgtcctcct

SEQ ID NO: 21608 - DNA, 22 bp, Artificial Sequence
  Description of Artificial Sequence: Synthetic oligonucleotide
tggcgccccgaaccgtcctcct

SEQ ID NO: 21609 - DNA, 21 bp, Artificial Sequence
  Description of Artificial Sequence: Synthetic oligonucleotide
ggcgccccgaaccgtcctcct

SEQ ID NO: 21610 - DNA, 21 bp, Artificial Sequence
  Description of Artificial Sequence: Synthetic oligonucleotide
gcgccccgaaccgtcctcctg

SEQ ID NO: 21611 - DNA, 22 bp, Artificial Sequence
  Description of Artificial Sequence: Synthetic oligonucleotide
cgccccgaaccgtcctcctgct

SEQ ID NO: 21612 - DNA, 22 bp, Artificial Sequence
  Description of Artificial Sequence: Synthetic oligonucleotide
gccccgaaccgtcctcctgctg

SEQ ID NO: 21613 - DNA, 23 bp, Artificial Sequence
  Description of Artificial Sequence: Synthetic oligonucleotide
ccccgaaccgtcctcctgctgct

SEQ ID NO: 21614 - DNA, 24 bp, Artificial Sequence
  Description of Artificial Sequence: Synthetic oligonucleotide
cccgaaccgtcctcctgctgctct

SEQ ID NO: 21615 - DNA, 24 bp, Artificial Sequence
  Description of Artificial Sequence: Synthetic oligonucleotide
ccgaaccgtcctcctgctgctctc

SEQ ID NO: 21616 - DNA, 24 bp, Artificial Sequence
  Description of Artificial Sequence: Synthetic oligonucleotide
cgaaccgtcctcctgctgctctcg

SEQ ID NO: 21617 - DNA, 24 bp, Artificial Sequence
  Description of Artificial Sequence: Synthetic oligonucleotide
gaaccgtcctcctgctgctctcgg

SEQ ID NO: 21618 - DNA, 24 bp, Artificial Sequence
  Description of Artificial Sequence: Synthetic oligonucleotide
aaccgtcctcctgctgctctcggc

SEQ ID NO: 21619 - DNA, 23 bp, Artificial Sequence
  Description of Artificial Sequence: Synthetic oligonucleotide
accgtcctcctgctgctctcggc

SEQ ID NO: 21620 - DNA, 22 bp, Artificial Sequence
  Description of Artificial Sequence: Synthetic oligonucleotide
ccgtcctcctgctgctctcggc

SEQ ID NO: 21621 - DNA, 22 bp, Artificial Sequence
  Description of Artificial Sequence: Synthetic oligonucleotide
cgtcctcctgctgctctcggcg

SEQ ID NO: 21622 - DNA, 22 bp, Artificial Sequence
  Description of Artificial Sequence: Synthetic oligonucleotide
gtcctcctgctgctctcggcgg

SEQ ID NO: 21623 - DNA, 22 bp, Artificial Sequence
  Description of Artificial Sequence: Synthetic oligonucleotide
tcctcctgctgctctcggcggc

SEQ ID NO: 21624 - DNA, 21 bp, Artificial Sequence
  Description of Artificial Sequence: Synthetic oligonucleotide
cctcctgctgctctcggcggc

SEQ ID NO: 21625 - DNA, 21 bp, Artificial Sequence
  Description of Artificial Sequence: Synthetic oligonucleotide
ctcctgctgctctcggcggcc

SEQ ID NO: 21626 - DNA, 22 bp, Artificial Sequence
  Description of Artificial Sequence: Synthetic oligonucleotide
tcctgctgctctcggcggccct

SEQ ID NO: 21627 - DNA, 21 bp, Artificial Sequence
  Description of Artificial Sequence: Synthetic oligonucleotide
cctgctgctctcggcggccct

SEQ ID NO: 21628 - DNA, 21 bp, Artificial Sequence
  Description of Artificial Sequence: Synthetic oligonucleotide
ctgctgctctcggcggccctg

SEQ ID NO: 21629 - DNA, 21 bp, Artificial Sequence
  Description of Artificial Sequence: Synthetic oligonucleotide
tgctgctctcggcggccctgg

SEQ ID NO: 21630 - DNA, 20 bp, Artificial Sequence
  Description of Artificial Sequence: Synthetic oligonucleotide
gctgctctcggcggccctgg

SEQ ID NO: 21631 - DNA, 20 bp, Artificial Sequence
  Description of Artificial Sequence: Synthetic oligonucleotide
ctgctctcggcggccctggc

SEQ ID NO: 21632 - DNA, 20 bp, Artificial Sequence
  Description of Artificial Sequence: Synthetic oligonucleotide
tgctctcggcggccctggcc

SEQ ID NO: 21633 - DNA, 20 bp, Artificial Sequence
  Description of Artificial Sequence: Synthetic oligonucleotide
gctctcggcggccctggcct

SEQ ID NO: 21634 - DNA, 20 bp, Artificial Sequence
  Description of Artificial Sequence: Synthetic oligonucleotide
ctctcggcggccctggccct

SEQ ID NO: 21635 - DNA, 21 bp, Artificial Sequence
  Description of Artificial Sequence: Synthetic oligonucleotide
tctcggcggccctggccctga

SEQ ID NO: 21636 - DNA, 20 bp, Artificial Sequence
  Description of Artificial Sequence: Synthetic oligonucleotide
ctcggcggccctggccctga

SEQ ID NO: 21637 - DNA, 20 bp, Artificial Sequence
  Description of Artificial Sequence: Synthetic oligonucleotide
tcggcggccctggccctgac

SEQ ID NO: 21638 - DNA, 20 bp, Artificial Sequence
  Description of Artificial Sequence: Synthetic oligonucleotide
cggcggccctggccctgact

SEQ ID NO: 21639 - DNA, 20 bp, Artificial Sequence
  Description of Artificial Sequence: Synthetic oligonucleotide
ggcggccctggccctgacct

SEQ ID NO: 21640 - DNA, 20 bp, Artificial Sequence
  Description of Artificial Sequence: Synthetic oligonucleotide
gcggccctggccctgaccga

SEQ ID NO: 21641 - DNA, 21 bp, Artificial Sequence
  Description of Artificial Sequence: Synthetic oligonucleotide
cggccctggccctgaccgaga

SEQ ID NO: 21642 - DNA, 21 bp, Artificial Sequence
  Description of Artificial Sequence: Synthetic oligonucleotide
ggccctggccctgaccgagac

SEQ ID NO: 21643 - DNA, 22 bp, Artificial Sequence
  Description of Artificial Sequence: Synthetic oligonucleotide
gccctggccctgaccgagacct

SEQ ID NO: 21644 - DNA, 22 bp, Artificial Sequence
  Description of Artificial Sequence: Synthetic oligonucleotide
ccctggccctgaccgagacctg

SEQ ID NO: 21645 - DNA, 22 bp, Artificial Sequence
  Description of Artificial Sequence: Synthetic oligonucleotide
cctggccctgaccgagacctgg

SEQ ID NO: 21646 - DNA, 22 bp, Artificial Sequence
  Description of Artificial Sequence: Synthetic oligonucleotide
ctggccctgaccgagacctggg

SEQ ID NO: 21647 - DNA, 22 bp, Artificial Sequence
  Description of Artificial Sequence: Synthetic oligonucleotide
tggccctgaccgagacctgggc

SEQ ID NO: 21648 - DNA, 21 bp, Artificial Sequence
  Description of Artificial Sequence: Synthetic oligonucleotide
ggccctgaccgagacctgggc

SEQ ID NO: 21649 - DNA, 21 bp, Artificial Sequence
  Description of Artificial Sequence: Synthetic oligonucleotide
gccctgaccgagacctgggcc

SEQ ID NO: 21650 - DNA, 21 bp, Artificial Sequence
  Description of Artificial Sequence: Synthetic oligonucleotide
ccctgaccgagacctgggccg

SEQ ID NO: 21651 - DNA, 21 bp, Artificial Sequence
  Description of Artificial Sequence: Synthetic oligonucleotide
cctgaccgagacctgggccgg

SEQ ID NO: 21652 - DNA, 22 bp, Artificial Sequence
  Description of Artificial Sequence: Synthetic oligonucleotide
ctgaccgagacctgggccggct

SEQ ID NO: 21653 - DNA, 22 bp, Artificial Sequence
  Description of Artificial Sequence: Synthetic oligonucleotide
tgaccgagacctgggccggctc

SEQ ID NO: 21654 - DNA, 21 bp, Artificial Sequence
  Description of Artificial Sequence: Synthetic oligonucleotide
gaccgagacctgggccggctc

SEQ ID NO: 21655 - DNA, 21 bp, Artificial Sequence
  Description of Artificial Sequence: Synthetic oligonucleotide
accgagacctgggccggctcc

SEQ ID NO: 21656 - DNA, 20 bp, Artificial Sequence
  Description of Artificial Sequence: Synthetic oligonucleotide
ccgagacctgggccggctcc

SEQ ID NO: 21657 - DNA, 21 bp, Artificial Sequence
  Description of Artificial Sequence: Synthetic oligonucleotide
cgagacctgggccggctccca

SEQ ID NO: 21658 - DNA, 22 bp, Artificial Sequence
  Description of Artificial Sequence: Synthetic oligonucleotide
gagacctgggccggctcccact

SEQ ID NO: 21659 - DNA, 22 bp, Artificial Sequence
  Description of Artificial Sequence: Synthetic oligonucleotide
agacctgggccggctcccactc

SEQ ID NO: 21660 - DNA, 21 bp, Artificial Sequence
  Description of Artificial Sequence: Synthetic oligonucleotide
gacctgggccggctcccactc

SEQ ID NO: 21661 - DNA, 23 bp, Artificial Sequence
  Description of Artificial Sequence: Synthetic oligonucleotide
acctgggccggctcccactccat

SEQ ID NO: 21662 - DNA, 22 bp, Artificial Sequence
  Description of Artificial Sequence: Synthetic oligonucleotide
cctgggccggctcccactccat

SEQ ID NO: 21663 - DNA, 23 bp, Artificial Sequence
  Description of Artificial Sequence: Synthetic oligonucleotide
ctgggccggctcccactccatga

SEQ ID NO: 21664 - DNA, 23 bp, Artificial Sequence
  Description of Artificial Sequence: Synthetic oligonucleotide
tgggccggctcccactccatgag

SEQ ID NO: 21665 - DNA, 22 bp, Artificial Sequence
  Description of Artificial Sequence: Synthetic oligonucleotide
gggccggctcccactccatgag

SEQ ID NO: 21666 - DNA, 27 bp, Artificial Sequence
  Description of Artificial Sequence: Synthetic oligonucleotide
ggccggctcccactccatgaggtattt

SEQ ID NO: 21667 - DNA, 27 bp, Artificial Sequence
  Description of Artificial Sequence: Synthetic oligonucleotide
gccggctcccactccatgaggtatttc

SEQ ID NO: 21668 - DNA, 29 bp, Artificial Sequence
  Description of Artificial Sequence: Synthetic oligonucleotide
ccggctcccactccatgaggtatttctac

SEQ ID NO: 21669 - DNA, 30 bp, Artificial Sequence
  Description of Artificial Sequence: Synthetic oligonucleotide
cggctcccactccatgaggtatttctacac

SEQ ID NO: 21670 - DNA, 27 bp, Artificial Sequence
  Description of Artificial Sequence: Synthetic oligonucleotide
atctcagtgggctacgtggacgacacc

SEQ ID NO: 21671 - DNA, 26 bp, Artificial Sequence
  Description of Artificial Sequence: Synthetic oligonucleotide
tctcagtgggctacgtggacgacacc

SEQ ID NO: 21672 - DNA, 25 bp, Artificial Sequence
  Description of Artificial Sequence: Synthetic oligonucleotide
ctcagtgggctacgtggacgacacc

SEQ ID NO: 21673 - DNA, 26 bp, Artificial Sequence
  Description of Artificial Sequence: Synthetic oligonucleotide
tcagtgggctacgtggacgacaccca

SEQ ID NO: 21674 - DNA, 25 bp, Artificial Sequence
  Description of Artificial Sequence: Synthetic oligonucleotide
cagtgggctacgtggacgacaccca

SEQ ID NO: 21675 - DNA, 27 bp, Artificial Sequence
  Description of Artificial Sequence: Synthetic oligonucleotide
agtgggctacgtggacgacacccagtt

SEQ ID NO: 21676 - DNA, 26 bp, Artificial Sequence
  Description of Artificial Sequence: Synthetic oligonucleotide
gtgggctacgtggacgacacccagtt

SEQ ID NO: 21677 - DNA, 26 bp, Artificial Sequence
  Description of Artificial Sequence: Synthetic oligonucleotide
tgggctacgtggacgacacccagttc

SEQ ID NO: 21678 - DNA, 25 bp, Artificial Sequence
  Description of Artificial Sequence: Synthetic oligonucleotide
gggctacgtggacgacacccagttc

SEQ ID NO: 21679 - DNA, 26 bp, Artificial Sequence
  Description of Artificial Sequence: Synthetic oligonucleotide
ggctacgtggacgacacccagttcgt

SEQ ID NO: 21680 - DNA, 27 bp, Artificial Sequence
  Description of Artificial Sequence: Synthetic oligonucleotide
gctacgtggacgacacccagttcgtga

SEQ ID NO: 21681 - DNA, 27 bp, Artificial Sequence
  Description of Artificial Sequence: Synthetic oligonucleotide
ctacgtggacgacacccagttcgtgag

SEQ ID NO: 21682 - DNA, 27 bp, Artificial Sequence
  Description of Artificial Sequence: Synthetic oligonucleotide
tacgtggacgacacccagttcgtgagg

SEQ ID NO: 21683 - DNA, 27 bp, Artificial Sequence
  Description of Artificial Sequence: Synthetic oligonucleotide
acgtggacgacacccagttcgtgaggt

SEQ ID NO: 21684 - DNA, 27 bp, Artificial Sequence
  Description of Artificial Sequence: Synthetic oligonucleotide
cgtggacgacacccagttcgtgaggtt

SEQ ID NO: 21685 - DNA, 27 bp, Artificial Sequence
  Description of Artificial Sequence: Synthetic oligonucleotide
gtggacgacacccagttcgtgaggttc

SEQ ID NO: 21686 - DNA, 27 bp, Artificial Sequence
  Description of Artificial Sequence: Synthetic oligonucleotide
tggacgacacccagttcgtgaggttcg

SEQ ID NO: 21687 - DNA, 27 bp, Artificial Sequence
  Description of Artificial Sequence: Synthetic oligonucleotide
ggacgacacccagttcgtgaggttcga

SEQ ID NO: 21688 - DNA, 27 bp, Artificial Sequence
  Description of Artificial Sequence: Synthetic oligonucleotide
gacgacacccagttcgtgaggttcgac

SEQ ID NO: 21689 - DNA, 28 bp, Artificial Sequence
  Description of Artificial Sequence: Synthetic oligonucleotide
acgacacccagttcgtgaggttcgacag

SEQ ID NO: 21690 - DNA, 27 bp, Artificial Sequence
  Description of Artificial Sequence: Synthetic oligonucleotide
cgacacccagttcgtgaggttcgacag

SEQ ID NO: 21691 - DNA, 27 bp, Artificial Sequence
  Description of Artificial Sequence: Synthetic oligonucleotide
gacacccagttcgtgaggttcgacagc

SEQ ID NO: 21692 - DNA, 27 bp, Artificial Sequence
  Description of Artificial Sequence: Synthetic oligonucleotide
acacccagttcgtgaggttcgacagcg

SEQ ID NO: 21693 - DNA, 27 bp, Artificial Sequence
  Description of Artificial Sequence: Synthetic oligonucleotide
cacccagttcgtgaggttcgacagcga

SEQ ID NO: 21694 - DNA, 27 bp, Artificial Sequence
  Description of Artificial Sequence: Synthetic oligonucleotide
acccagttcgtgaggttcgacagcgac

SEQ ID NO: 21695 - DNA, 26 bp, Artificial Sequence
  Description of Artificial Sequence: Synthetic oligonucleotide
cccagttcgtgaggttcgacagcgac

SEQ ID NO: 21696 - DNA, 26 bp, Artificial Sequence
  Description of Artificial Sequence: Synthetic oligonucleotide
ccagttcgtgaggttcgacagcgacg

SEQ ID NO: 21697 - DNA, 26 bp, Artificial Sequence
  Description of Artificial Sequence: Synthetic oligonucleotide
cagttcgtgaggttcgacagcgacgc

SEQ ID NO: 21698 - DNA, 26 bp, Artificial Sequence
  Description of Artificial Sequence: Synthetic oligonucleotide
agttcgtgaggttcgacagcgacgcc

SEQ ID NO: 21699 - DNA, 25 bp, Artificial Sequence
  Description of Artificial Sequence: Synthetic oligonucleotide
gttcgtgaggttcgacagcgacgcc

SEQ ID NO: 21700 - DNA, 25 bp, Artificial Sequence
  Description of Artificial Sequence: Synthetic oligonucleotide
ttcgtgaggttcgacagcgacgccg

SEQ ID NO: 21701 - DNA, 24 bp, Artificial Sequence
  Description of Artificial Sequence: Synthetic oligonucleotide
tcgtgaggttcgacagcgacgccg

SEQ ID NO: 21702 - DNA, 23 bp, Artificial Sequence
  Description of Artificial Sequence: Synthetic oligonucleotide
cgtgaggttcgacagcgacgccg

SEQ ID NO: 21703 - DNA, 23 bp, Artificial Sequence
  Description of Artificial Sequence: Synthetic oligonucleotide
gtgaggttcgacagcgacgccgc

SEQ ID NO: 21704 - DNA, 24 bp, Artificial Sequence
  Description of Artificial Sequence: Synthetic oligonucleotide
tgaggttcgacagcgacgccgcga

SEQ ID NO: 21705 - DNA, 23 bp, Artificial Sequence
  Description of Artificial Sequence: Synthetic oligonucleotide
gaggttcgacagcgacgccgcga

SEQ ID NO: 21706 - DNA, 24 bp, Artificial Sequence
  Description of Artificial Sequence: Synthetic oligonucleotide
aggttcgacagcgacgccgcgagt

SEQ ID NO: 21707 - DNA, 23 bp, Artificial Sequence
  Description of Artificial Sequence: Synthetic oligonucleotide
ggttcgacagcgacgccgcgagt

SEQ ID NO: 21708 - DNA, 23 bp, Artificial Sequence
  Description of Artificial Sequence: Synthetic oligonucleotide
gttcgacagcgacgccgcgagtc

SEQ ID NO: 21709 - DNA, 23 bp, Artificial Sequence
  Description of Artificial Sequence: Synthetic oligonucleotide
ttcgacagcgacgccgcgagtcc

SEQ ID NO: 21710 - DNA, 22 bp, Artificial Sequence
  Description of Artificial Sequence: Synthetic oligonucleotide
tcgacagcgacgccgcgagtcc

SEQ ID NO: 21711 - DNA, 21 bp, Artificial Sequence
  Description of Artificial Sequence: Synthetic oligonucleotide
cgacagcgacgccgcgagtcc

SEQ ID NO: 21712 - DNA, 22 bp, Artificial Sequence
  Description of Artificial Sequence: Synthetic oligonucleotide
gacagcgacgccgcgagtccga

SEQ ID NO: 21713 - DNA, 23 bp, Artificial Sequence
  Description of Artificial Sequence: Synthetic oligonucleotide
acagcgacgccgcgagtccgaga

SEQ ID NO: 21714 - DNA, 22 bp, Artificial Sequence
  Description of Artificial Sequence: Synthetic oligonucleotide
cagcgacgccgcgagtccgaga

SEQ ID NO: 21715 - DNA, 23 bp, Artificial Sequence
  Description of Artificial Sequence: Synthetic oligonucleotide
agcgacgccgcgagtccgagaga

SEQ ID NO: 21716 - DNA, 22 bp, Artificial Sequence
  Description of Artificial Sequence: Synthetic oligonucleotide
gcgacgccgcgagtccgagaga

SEQ ID NO: 21717 - DNA, 22 bp, Artificial Sequence
  Description of Artificial Sequence: Synthetic oligonucleotide
cgacgccgcgagtccgagagag

SEQ ID NO: 21718 - DNA, 23 bp, Artificial Sequence
  Description of Artificial Sequence: Synthetic oligonucleotide
gacgccgcgagtccgagagagga

SEQ ID NO: 21719 - DNA, 23 bp, Artificial Sequence
  Description of Artificial Sequence: Synthetic oligonucleotide
acgccgcgagtccgagagaggag

SEQ ID NO: 21720 - DNA, 22 bp, Artificial Sequence
  Description of Artificial Sequence: Synthetic oligonucleotide
cgccgcgagtccgagagaggag

SEQ ID NO: 21721 - DNA, 22 bp, Artificial Sequence
  Description of Artificial Sequence: Synthetic oligonucleotide
gccgcgagtccgagagaggagc

SEQ ID NO: 21722 - DNA, 22 bp, Artificial Sequence
  Description of Artificial Sequence: Synthetic oligonucleotide
ccgcgagtccgagagaggagcc

SEQ ID NO: 21723 - DNA, 22 bp, Artificial Sequence
  Description of Artificial Sequence: Synthetic oligonucleotide
cgcgagtccgagagaggagccg

SEQ ID NO: 21724 - DNA, 22 bp, Artificial Sequence
  Description of Artificial Sequence: Synthetic oligonucleotide
gcgagtccgagagaggagccgc

SEQ ID NO: 21725 - DNA, 22 bp, Artificial Sequence
  Description of Artificial Sequence: Synthetic oligonucleotide
cgagtccgagagaggagccgcg

SEQ ID NO: 21726 - DNA, 22 bp, Artificial Sequence
  Description of Artificial Sequence: Synthetic oligonucleotide
gagtccgagagaggagccgcgg

SEQ ID NO: 21727 - DNA, 22 bp, Artificial Sequence
  Description of Artificial Sequence: Synthetic oligonucleotide
agtccgagagaggagccgcggg

SEQ ID NO: 21728 - DNA, 21 bp, Artificial Sequence
  Description of Artificial Sequence: Synthetic oligonucleotide
gtccgagagaggagccgcggg

SEQ ID NO: 21729 - DNA, 21 bp, Artificial Sequence
  Description of Artificial Sequence: Synthetic oligonucleotide
tccgagagaggagccgcgggc

SEQ ID NO: 21730 - DNA, 20 bp, Artificial Sequence
  Description of Artificial Sequence: Synthetic oligonucleotide
ccgagagaggagccgcgggc

SEQ ID NO: 21731 - DNA, 20 bp, Artificial Sequence
  Description of Artificial Sequence: Synthetic oligonucleotide
cgagagaggagccgcgggcg

SEQ ID NO: 21732 - DNA, 20 bp, Artificial Sequence
  Description of Artificial Sequence: Synthetic oligonucleotide
gagagaggagccgcgggcgc

SEQ ID NO: 21733 - DNA, 20 bp, Artificial Sequence
  Description of Artificial Sequence: Synthetic oligonucleotide
agagaggagccgcgggcgcc

SEQ ID NO: 21734 - DNA, 20 bp, Artificial Sequence
  Description of Artificial Sequence: Synthetic oligonucleotide
gagaggagccgcgggcgcct

SEQ ID NO: 21735 - DNA, 20 bp, Artificial Sequence
  Description of Artificial Sequence: Synthetic oligonucleotide
agaggagccgcgggcgccgt

SEQ ID NO: 21736 - DNA, 20 bp, Artificial Sequence
  Description of Artificial Sequence: Synthetic oligonucleotide
gaggagccgcgggcgccgtt

SEQ ID NO: 21737 - DNA, 20 bp, Artificial Sequence
  Description of Artificial Sequence: Synthetic oligonucleotide
aggagccgcgggcgccgtgt

SEQ ID NO: 21738 - DNA, 27 bp, Artificial Sequence
  Description of Artificial Sequence: Synthetic oligonucleotide
gccggagtattgggaccggaacacaca

SEQ ID NO: 21739 - DNA, 27 bp, Artificial Sequence
  Description of Artificial Sequence: Synthetic oligonucleotide
ccggagtattgggaccggaacacacag

SEQ ID NO: 21740 - DNA, 29 bp, Artificial Sequence
  Description of Artificial Sequence: Synthetic oligonucleotide
cggagtattgggaccggaacacacagatc

SEQ ID NO: 21741 - DNA, 31 bp, Artificial Sequence
  Description of Artificial Sequence: Synthetic oligonucleotide
ggagtattgggaccggaacacacagatctac

SEQ ID NO: 21742 - DNA, 33 bp, Artificial Sequence
  Description of Artificial Sequence: Synthetic oligonucleotide
gagtattgggaccggaacacacagatctacaag

SEQ ID NO: 21743 - DNA, 33 bp, Artificial Sequence
  Description of Artificial Sequence: Synthetic oligonucleotide
agtattgggaccggaacacacagatctacaagg

SEQ ID NO: 21744 - DNA, 32 bp, Artificial Sequence
  Description of Artificial Sequence: Synthetic oligonucleotide
gtattgggaccggaacacacagatctacaagg

SEQ ID NO: 21745 - DNA, 32 bp, Artificial Sequence
  Description of Artificial Sequence: Synthetic oligonucleotide
tattgggaccggaacacacagatctacaaggc

SEQ ID NO: 21746 - DNA, 31 bp, Artificial Sequence
  Description of Artificial Sequence: Synthetic oligonucleotide
attgggaccggaacacacagatctacaaggc

SEQ ID NO: 21747 - DNA, 30 bp, Artificial Sequence
  Description of Artificial Sequence: Synthetic oligonucleotide
ttgggaccggaacacacagatctacaaggc

SEQ ID NO: 21748 - DNA, 29 bp, Artificial Sequence
  Description of Artificial Sequence: Synthetic oligonucleotide
tgggaccggaacacacagatctacaaggc

SEQ ID NO: 21749 - DNA, 28 bp, Artificial Sequence
  Description of Artificial Sequence: Synthetic oligonucleotide
gggaccggaacacacagatctacaaggc

SEQ ID NO: 21750 - DNA, 28 bp, Artificial Sequence
  Description of Artificial Sequence: Synthetic oligonucleotide
ggaccggaacacacagatctacaaggcc

SEQ ID NO: 21751 - DNA, 28 bp, Artificial Sequence
  Description of Artificial Sequence: Synthetic oligonucleotide
gaccggaacacacagatctacaaggccc

SEQ ID NO: 21752 - DNA, 29 bp, Artificial Sequence
  Description of Artificial Sequence: Synthetic oligonucleotide
accggaacacacagatctacaaggcccag

SEQ ID NO: 21753 - DNA, 28 bp, Artificial Sequence
  Description of Artificial Sequence: Synthetic oligonucleotide
ccggaacacacagatctacaaggcccag

SEQ ID NO: 21754 - DNA, 28 bp, Artificial Sequence
  Description of Artificial Sequence: Synthetic oligonucleotide
cggaacacacagatctacaaggcccagg

SEQ ID NO: 21755 - DNA, 28 bp, Artificial Sequence
  Description of Artificial Sequence: Synthetic oligonucleotide
ggaacacacagatctacaaggcccaggc

SEQ ID NO: 21756 - DNA, 29 bp, Artificial Sequence
  Description of Artificial Sequence: Synthetic oligonucleotide
gaacacacagatctacaaggcccaggcac

SEQ ID NO: 21757 - DNA, 30 bp, Artificial Sequence
  Description of Artificial Sequence: Synthetic oligonucleotide
aacacacagatctacaaggcccaggcacag

SEQ ID NO: 21758 - DNA, 29 bp, Artificial Sequence
  Description of Artificial Sequence: Synthetic oligonucleotide
acacacagatctacaaggcccaggcacag

SEQ ID NO: 21759 - DNA, 28 bp, Artificial Sequence
  Description of Artificial Sequence: Synthetic oligonucleotide
cacacagatctacaaggcccaggcacag

SEQ ID NO: 21760 - DNA, 29 bp, Artificial Sequence
  Description of Artificial Sequence: Synthetic oligonucleotide
acacagatctacaaggcccaggcacagac

SEQ ID NO: 21761 - DNA, 28 bp, Artificial Sequence
  Description of Artificial Sequence: Synthetic oligonucleotide
cacagatctacaaggcccaggcacagac

SEQ ID NO: 21762 - DNA, 29 bp, Artificial Sequence
  Description of Artificial Sequence: Synthetic oligonucleotide
acagatctacaaggcccaggcacagactg

SEQ ID NO: 21763 - DNA, 28 bp, Artificial Sequence
  Description of Artificial Sequence: Synthetic oligonucleotide
cagatctacaaggcccaggcacagactg

SEQ ID NO: 21764 - DNA, 29 bp, Artificial Sequence
  Description of Artificial Sequence: Synthetic oligonucleotide
agatctacaaggcccaggcacagactgac

SEQ ID NO: 21765 - DNA, 28 bp, Artificial Sequence
  Description of Artificial Sequence: Synthetic oligonucleotide
gatctacaaggcccaggcacagactgac

SEQ ID NO: 21766 - DNA, 28 bp, Artificial Sequence
  Description of Artificial Sequence: Synthetic oligonucleotide
atctacaaggcccaggcacagactgacc

SEQ ID NO: 21767 - DNA, 27 bp, Artificial Sequence
  Description of Artificial Sequence: Synthetic oligonucleotide
tctacaaggcccaggcacagactgacc

SEQ ID NO: 21768 - DNA, 26 bp, Artificial Sequence
  Description of Artificial Sequence: Synthetic oligonucleotide
ctacaaggcccaggcacagactgacc

SEQ ID NO: 21769 - DNA, 27 bp, Artificial Sequence
  Description of Artificial Sequence: Synthetic oligonucleotide
tacaaggcccaggcacagactgaccga

SEQ ID NO: 21770 - DNA, 26 bp, Artificial Sequence
  Description of Artificial Sequence: Synthetic oligonucleotide
acaaggcccaggcacagactgaccga

SEQ ID NO: 21771 - DNA, 25 bp, Artificial Sequence
  Description of Artificial Sequence: Synthetic oligonucleotide
caaggcccaggcacagactgaccga

SEQ ID NO: 21772 - DNA, 25 bp, Artificial Sequence
  Description of Artificial Sequence: Synthetic oligonucleotide
gcccaggcacagactgaccgagaga

SEQ ID NO: 21773 - DNA, 25 bp, Artificial Sequence
  Description of Artificial Sequence: Synthetic oligonucleotide
cccaggcacagactgaccgagagag

SEQ ID NO: 21774 - DNA, 25 bp, Artificial Sequence
  Description of Artificial Sequence: Synthetic oligonucleotide
ccaggcacagactgaccgagagagc

SEQ ID NO: 21775 - DNA, 26 bp, Artificial Sequence
  Description of Artificial Sequence: Synthetic oligonucleotide
caggcacagactgaccgagagagcct

SEQ ID NO: 21776 - DNA, 26 bp, Artificial Sequence
  Description of Artificial Sequence: Synthetic oligonucleotide
aggcacagactgaccgagagagcctg

SEQ ID NO: 21777 - DNA, 25 bp, Artificial Sequence
  Description of Artificial Sequence: Synthetic oligonucleotide
ggcacagactgaccgagagagcctg

SEQ ID NO: 21778 - DNA, 25 bp, Artificial Sequence
  Description of Artificial Sequence: Synthetic oligonucleotide
gcacagactgaccgagagagcctgc

SEQ ID NO: 21779 - DNA, 27 bp, Artificial Sequence
  Description of Artificial Sequence: Synthetic oligonucleotide
acagactgaccgagagagcctgcggaa

SEQ ID NO: 21780 - DNA, 26 bp, Artificial Sequence
  Description of Artificial Sequence: Synthetic oligonucleotide
cagactgaccgagagagcctgcggaa

SEQ ID NO: 21781 - DNA, 26 bp, Artificial Sequence
  Description of Artificial Sequence: Synthetic oligonucleotide
agactgaccgagagagcctgcggaac

SEQ ID NO: 21782 - DNA, 25 bp, Artificial Sequence
  Description of Artificial Sequence: Synthetic oligonucleotide
gactgaccgagagagcctgcggaac

SEQ ID NO: 21783 - DNA, 26 bp, Artificial Sequence
  Description of Artificial Sequence: Synthetic oligonucleotide
actgaccgagagagcctgcggaacct

SEQ ID NO: 21784 - DNA, 25 bp, Artificial Sequence
  Description of Artificial Sequence: Synthetic oligonucleotide
ctgaccgagagagcctgcggaacct

SEQ ID NO: 21785 - DNA, 25 bp, Artificial Sequence
  Description of Artificial Sequence: Synthetic oligonucleotide
tgaccgagagagcctgcggaacctg

SEQ ID NO: 21786 - DNA, 24 bp, Artificial Sequence
  Description of Artificial Sequence: Synthetic oligonucleotide
gaccgagagagcctgcggaacctg

SEQ ID NO: 21787 - DNA, 24 bp, Artificial Sequence
  Description of Artificial Sequence: Synthetic oligonucleotide
accgagagagcctgcggaacctgc

SEQ ID NO: 21788 - DNA, 23 bp, Artificial Sequence
  Description of Artificial Sequence: Synthetic oligonucleotide
ccgagagagcctgcggaacctgc

SEQ ID NO: 21789 - DNA, 23 bp, Artificial Sequence
  Description of Artificial Sequence: Synthetic oligonucleotide
cgagagagcctgcggaacctgcg

SEQ ID NO: 21790 - DNA, 23 bp, Artificial Sequence
  Description of Artificial Sequence: Synthetic oligonucleotide
gagagagcctgcggaacctgcgc

SEQ ID NO: 21791 - DNA, 23 bp, Artificial Sequence
  Description of Artificial Sequence: Synthetic oligonucleotide
agagagcctgcggaacctgcgcg

SEQ ID NO: 21792 - DNA, 22 bp, Artificial Sequence
  Description of Artificial Sequence: Synthetic oligonucleotide
gagagcctgcggaacctgcgcg

SEQ ID NO: 21793 - DNA, 22 bp, Artificial Sequence
  Description of Artificial Sequence: Synthetic oligonucleotide
agagcctgcggaacctgcgcgg

SEQ ID NO: 21794 - DNA, 21 bp, Artificial Sequence
  Description of Artificial Sequence: Synthetic oligonucleotide
gagcctgcggaacctgcgcgg

SEQ ID NO: 21795 - DNA, 23 bp, Artificial Sequence
  Description of Artificial Sequence: Synthetic oligonucleotide
agcctgcggaacctgcgcggcta

SEQ ID NO: 21796 - DNA, 22 bp, Artificial Sequence
  Description of Artificial Sequence: Synthetic oligonucleotide
gcctgcggaacctgcgcggcta

SEQ ID NO: 21797 - DNA, 24 bp, Artificial Sequence
  Description of Artificial Sequence: Synthetic oligonucleotide
cctgcggaacctgcgcggctacta

SEQ ID NO: 21798 - DNA, 26 bp, Artificial Sequence
  Description of Artificial Sequence: Synthetic oligonucleotide
ctgcggaacctgcgcggctactacaa

SEQ ID NO: 21799 - DNA, 26 bp, Artificial Sequence
  Description of Artificial Sequence: Synthetic oligonucleotide
tgcggaacctgcgcggctactacaac

SEQ ID NO: 21800 - DNA, 25 bp, Artificial Sequence
  Description of Artificial Sequence: Synthetic oligonucleotide
gcggaacctgcgcggctactacaac

SEQ ID NO: 21801 - DNA, 26 bp, Artificial Sequence
  Description of Artificial Sequence: Synthetic oligonucleotide
cggaacctgcgcggctactacaacca

SEQ ID NO: 21802 - DNA, 27 bp, Artificial Sequence
  Description of Artificial Sequence: Synthetic oligonucleotide
ggaacctgcgcggctactacaaccaga

SEQ ID NO: 21803 - DNA, 27 bp, Artificial Sequence
  Description of Artificial Sequence: Synthetic oligonucleotide
gaacctgcgcggctactacaaccagag

SEQ ID NO: 21804 - DNA, 27 bp, Artificial Sequence
  Description of Artificial Sequence: Synthetic oligonucleotide
aacctgcgcggctactacaaccagagc

SEQ ID NO: 21805 - DNA, 26 bp, Artificial Sequence
  Description of Artificial Sequence: Synthetic oligonucleotide
acctgcgcggctactacaaccagagc

SEQ ID NO: 21806 - DNA, 23 bp, Artificial Sequence
  Description of Artificial Sequence: Synthetic oligonucleotide
agcgaggccgggtctcacaccct

SEQ ID NO: 21807 - DNA, 22 bp, Artificial Sequence
  Description of Artificial Sequence: Synthetic oligonucleotide
gcgaggccgggtctcacaccct

SEQ ID NO: 21808 - DNA, 22 bp, Artificial Sequence
  Description of Artificial Sequence: Synthetic oligonucleotide
cgaggccgggtctcacaccctc

SEQ ID NO: 21809 - DNA, 23 bp, Artificial Sequence
  Description of Artificial Sequence: Synthetic oligonucleotide
gaggccgggtctcacaccctcca

SEQ ID NO: 21810 - DNA, 24 bp, Artificial Sequence
  Description of Artificial Sequence: Synthetic oligonucleotide
aggccgggtctcacaccctccaga

SEQ ID NO: 21811 - DNA, 23 bp, Artificial Sequence
  Description of Artificial Sequence: Synthetic oligonucleotide
ggccgggtctcacaccctccaga

SEQ ID NO: 21812 - DNA, 23 bp, Artificial Sequence
  Description of Artificial Sequence: Synthetic oligonucleotide
gccgggtctcacaccctccagag

SEQ ID NO: 21813 - DNA, 25 bp, Artificial Sequence
  Description of Artificial Sequence: Synthetic oligonucleotide
ccgggtctcacaccctccagagcat

SEQ ID NO: 21814 - DNA, 27 bp, Artificial Sequence
  Description of Artificial Sequence: Synthetic oligonucleotide
cgggtctcacaccctccagagcatgta

SEQ ID NO: 21815 - DNA, 27 bp, Artificial Sequence
  Description of Artificial Sequence: Synthetic oligonucleotide
gggtctcacaccctccagagcatgtac

SEQ ID NO: 21816 - DNA, 27 bp, Artificial Sequence
  Description of Artificial Sequence: Synthetic oligonucleotide
ggtctcacaccctccagagcatgtacg

SEQ ID NO: 21817 - DNA, 27 bp, Artificial Sequence
  Description of Artificial Sequence: Synthetic oligonucleotide
gtctcacaccctccagagcatgtacgg

SEQ ID NO: 21818 - DNA, 27 bp, Artificial Sequence
  Description of Artificial Sequence: Synthetic oligonucleotide
tctcacaccctccagagcatgtacggc

SEQ ID NO: 21819 - DNA, 27 bp, Artificial Sequence
  Description of Artificial Sequence: Synthetic oligonucleotide
ctcacaccctccagagcatgtacggct

SEQ ID NO: 21820 - DNA, 27 bp, Artificial Sequence
  Description of Artificial Sequence: Synthetic oligonucleotide
tcacaccctccagagcatgtacggctg

SEQ ID NO: 21821 - DNA, 26 bp, Artificial Sequence
  Description of Artificial Sequence: Synthetic oligonucleotide
cacaccctccagagcatgtacggctg

SEQ ID NO: 21822 - DNA, 26 bp, Artificial Sequence
  Description of Artificial Sequence: Synthetic oligonucleotide
acaccctccagagcatgtacggctgc

SEQ ID NO: 21823 - DNA, 25 bp, Artificial Sequence
  Description of Artificial Sequence: Synthetic oligonucleotide
caccctccagagcatgtacggctgc

SEQ ID NO: 21824 - DNA, 26 bp, Artificial Sequence
  Description of Artificial Sequence: Synthetic oligonucleotide
accctccagagcatgtacggctgcga

SEQ ID NO: 21825 - DNA, 25 bp, Artificial Sequence
  Description of Artificial Sequence: Synthetic oligonucleotide
ccctccagagcatgtacggctgcga

SEQ ID NO: 21826 - DNA, 25 bp, Artificial Sequence
  Description of Artificial Sequence: Synthetic oligonucleotide
cctccagagcatgtacggctgcgac

SEQ ID NO: 21827 - DNA, 26 bp, Artificial Sequence
  Description of Artificial Sequence: Synthetic oligonucleotide
ctccagagcatgtacggctgcgacgt

SEQ ID NO: 21828 - DNA, 26 bp, Artificial Sequence
  Description of Artificial Sequence: Synthetic oligonucleotide
tccagagcatgtacggctgcgacgtg

SEQ ID NO: 21829 - DNA, 25 bp, Artificial Sequence
  Description of Artificial Sequence: Synthetic oligonucleotide
ccagagcatgtacggctgcgacgtg

SEQ ID NO: 21830 - DNA, 25 bp, Artificial Sequence
  Description of Artificial Sequence: Synthetic oligonucleotide
cagagcatgtacggctgcgacgtgg

SEQ ID NO: 21831 - DNA, 25 bp, Artificial Sequence
  Description of Artificial Sequence: Synthetic oligonucleotide
agagcatgtacggctgcgacgtggg

SEQ ID NO: 21832 - DNA, 24 bp, Artificial Sequence
  Description of Artificial Sequence: Synthetic oligonucleotide
gagcatgtacggctgcgacgtggg

SEQ ID NO: 21833 - DNA, 24 bp, Artificial Sequence
  Description of Artificial Sequence: Synthetic oligonucleotide
agcatgtacggctgcgacgtgggg

SEQ ID NO: 21834 - DNA, 23 bp, Artificial Sequence
  Description of Artificial Sequence: Synthetic oligonucleotide
gcatgtacggctgcgacgtgggg

SEQ ID NO: 21835 - DNA, 23 bp, Artificial Sequence
  Description of Artificial Sequence: Synthetic oligonucleotide
catgtacggctgcgacgtggggc

SEQ ID NO: 21836 - DNA, 23 bp, Artificial Sequence
  Description of Artificial Sequence: Synthetic oligonucleotide
atgtacggctgcgacgtggggcc

SEQ ID NO: 21837 - DNA, 22 bp, Artificial Sequence
  Description of Artificial Sequence: Synthetic oligonucleotide
tgtacggctgcgacgtggggcc

SEQ ID NO: 21838 - DNA, 21 bp, Artificial Sequence
  Description of Artificial Sequence: Synthetic oligonucleotide
gtacggctgcgacgtggggcc

SEQ ID NO: 21839 - DNA, 21 bp, Artificial Sequence
  Description of Artificial Sequence: Synthetic oligonucleotide
tacggctgcgacgtggggccg

SEQ ID NO: 21840 - DNA, 20 bp, Artificial Sequence
  Description of Artificial Sequence: Synthetic oligonucleotide
acggctgcgacgtggggccg

SEQ ID NO: 21841 - DNA, 20 bp, Artificial Sequence
  Description of Artificial Sequence: Synthetic oligonucleotide
cggctgcgacgtggggccgt

SEQ ID NO: 21842 - DNA, 20 bp, Artificial Sequence
  Description of Artificial Sequence: Synthetic oligonucleotide
gggcgcctcctccgcgggtt

SEQ ID NO: 21843 - DNA, 20 bp, Artificial Sequence
  Description of Artificial Sequence: Synthetic oligonucleotide
ggcgcctcctccgcgggcat

SEQ ID NO: 21844 - DNA, 21 bp, Artificial Sequence
  Description of Artificial Sequence: Synthetic oligonucleotide
gcgcctcctccgcgggcatga

SEQ ID NO: 21845 - DNA, 21 bp, Artificial Sequence
  Description of Artificial Sequence: Synthetic oligonucleotide
cgcctcctccgcgggcatgac

SEQ ID NO: 21846 - DNA, 22 bp, Artificial Sequence
  Description of Artificial Sequence: Synthetic oligonucleotide
gcctcctccgcgggcatgacca

SEQ ID NO: 21847 - DNA, 24 bp, Artificial Sequence
  Description of Artificial Sequence: Synthetic oligonucleotide
cctcctccgcgggcatgaccagta

SEQ ID NO: 21848 - DNA, 24 bp, Artificial Sequence
  Description of Artificial Sequence: Synthetic oligonucleotide
ctcctccgcgggcatgaccagtac

SEQ ID NO: 21849 - DNA, 21 bp, Artificial Sequence
  Description of Artificial Sequence: Synthetic oligonucleotide
gacctgcgctcctggaccgcc

SEQ ID NO: 21850 - DNA, 21 bp, Artificial Sequence
  Description of Artificial Sequence: Synthetic oligonucleotide
acctgcgctcctggaccgccg

SEQ ID NO: 21851 - DNA, 20 bp, Artificial Sequence
  Description of Artificial Sequence: Synthetic oligonucleotide
cctgcgctcctggaccgccg

SEQ ID NO: 21852 - DNA, 20 bp, Artificial Sequence
  Description of Artificial Sequence: Synthetic oligonucleotide
ctgcgctcctggaccgccgc

SEQ ID NO: 21853 - DNA, 20 bp, Artificial Sequence
  Description of Artificial Sequence: Synthetic oligonucleotide
tgcgctcctggaccgccgcg

SEQ ID NO: 21854 - DNA, 20 bp, Artificial Sequence
  Description of Artificial Sequence: Synthetic oligonucleotide
gcgctcctggaccgccgcgt

SEQ ID NO: 21855 - DNA, 20 bp, Artificial Sequence
  Description of Artificial Sequence: Synthetic oligonucleotide
cgctcctggaccgccgcgga

SEQ ID NO: 21856 - DNA, 21 bp, Artificial Sequence
  Description of Artificial Sequence: Synthetic oligonucleotide
gctcctggaccgccgcggaca

SEQ ID NO: 21857 - DNA, 21 bp, Artificial Sequence
  Description of Artificial Sequence: Synthetic oligonucleotide
ctcctggaccgccgcggacac

SEQ ID NO: 21858 - DNA, 21 bp, Artificial Sequence
  Description of Artificial Sequence: Synthetic oligonucleotide
tcctggaccgccgcggacacg

SEQ ID NO: 21859 - DNA, 20 bp, Artificial Sequence
  Description of Artificial Sequence: Synthetic oligonucleotide
cctggaccgccgcggacacg

SEQ ID NO: 21860 - DNA, 20 bp, Artificial Sequence
  Description of Artificial Sequence: Synthetic oligonucleotide
ctggaccgccgcggacacgg

SEQ ID NO: 21861 - DNA, 20 bp, Artificial Sequence
  Description of Artificial Sequence: Synthetic oligonucleotide
tggaccgccgcggacacggc

SEQ ID NO: 21862 - DNA, 20 bp, Artificial Sequence
  Description of Artificial Sequence: Synthetic oligonucleotide
ggaccgccgcggacacggct

SEQ ID NO: 21863 - DNA, 20 bp, Artificial Sequence
  Description of Artificial Sequence: Synthetic oligonucleotide
gaccgccgcggacacggcgt

SEQ ID NO: 21864 - DNA, 20 bp, Artificial Sequence
  Description of Artificial Sequence: Synthetic oligonucleotide
accgccgcggacacggcggt

SEQ ID NO: 21865 - DNA, 20 bp, Artificial Sequence
  Description of Artificial Sequence: Synthetic oligonucleotide
ccgccgcggacacggcggtt

SEQ ID NO: 21866 - DNA, 20 bp, Artificial Sequence
  Description of Artificial Sequence: Synthetic oligonucleotide
cgccgcggacacggcggctt

SEQ ID NO: 21867 - DNA, 20 bp, Artificial Sequence
  Description of Artificial Sequence: Synthetic oligonucleotide
gccgcggacacggcggctca

SEQ ID NO: 21868 - DNA, 22 bp, Artificial Sequence
  Description of Artificial Sequence: Synthetic oligonucleotide
ccgcggacacggcggctcagat

SEQ ID NO: 21869 - DNA, 23 bp, Artificial Sequence
  Description of Artificial Sequence: Synthetic oligonucleotide
cgcggacacggcggctcagatca

SEQ ID NO: 21870 - DNA, 20 bp, Artificial Sequence
  Description of Artificial Sequence: Synthetic oligonucleotide
ggcccgtgaggcggagcagc

SEQ ID NO: 21871 - DNA, 20 bp, Artificial Sequence
  Description of Artificial Sequence: Synthetic oligonucleotide
gcccgtgaggcggagcagcg

SEQ ID NO: 21872 - DNA, 21 bp, Artificial Sequence
  Description of Artificial Sequence: Synthetic oligonucleotide
cccgtgaggcggagcagcgga

SEQ ID NO: 21873 - DNA, 22 bp, Artificial Sequence
  Description of Artificial Sequence: Synthetic oligonucleotide
ccgtgaggcggagcagcggaga

SEQ ID NO: 21874 - DNA, 22 bp, Artificial Sequence
  Description of Artificial Sequence: Synthetic oligonucleotide
cgtgaggcggagcagcggagag

SEQ ID NO: 21875 - DNA, 22 bp, Artificial Sequence
  Description of Artificial Sequence: Synthetic oligonucleotide
gtgaggcggagcagcggagagc

SEQ ID NO: 21876 - DNA, 23 bp, Artificial Sequence
  Description of Artificial Sequence: Synthetic oligonucleotide
cggagagcctacctggagggcga

SEQ ID NO: 21877 - DNA, 27 bp, Artificial Sequence
  Description of Artificial Sequence: Synthetic oligonucleotide
cgcagatacctggagaacgggaaggac

SEQ ID NO: 21878 - DNA, 29 bp, Artificial Sequence
  Description of Artificial Sequence: Synthetic oligonucleotide
gcagatacctggagaacgggaaggacaag

SEQ ID NO: 21879 - DNA, 29 bp, Artificial Sequence
  Description of Artificial Sequence: Synthetic oligonucleotide
cagatacctggagaacgggaaggacaagc

SEQ ID NO: 21880 - DNA, 30 bp, Artificial Sequence
  Description of Artificial Sequence: Synthetic oligonucleotide
agatacctggagaacgggaaggacaagctg

SEQ ID NO: 21881 - DNA, 29 bp, Artificial Sequence
  Description of Artificial Sequence: Synthetic oligonucleotide
gatacctggagaacgggaaggacaagctg

SEQ ID NO: 21882 - DNA, 29 bp, Artificial Sequence
  Description of Artificial Sequence: Synthetic oligonucleotide
atacctggagaacgggaaggacaagctgg

SEQ ID NO: 21883 - DNA, 28 bp, Artificial Sequence
  Description of Artificial Sequence: Synthetic oligonucleotide
tacctggagaacgggaaggacaagctgg

SEQ ID NO: 21884 - DNA, 27 bp, Artificial Sequence
  Description of Artificial Sequence: Synthetic oligonucleotide
acctggagaacgggaaggacaagctgg

SEQ ID NO: 21885 - DNA, 27 bp, Artificial Sequence
  Description of Artificial Sequence: Synthetic oligonucleotide
cctggagaacgggaaggacaagctgga

SEQ ID NO: 21886 - DNA, 27 bp, Artificial Sequence
  Description of Artificial Sequence: Synthetic oligonucleotide
ctggagaacgggaaggacaagctggag

SEQ ID NO: 21887 - DNA, 27 bp, Artificial Sequence
  Description of Artificial Sequence: Synthetic oligonucleotide
tggagaacgggaaggacaagctggagc

SEQ ID NO: 21888 - DNA, 26 bp, Artificial Sequence
  Description of Artificial Sequence: Synthetic oligonucleotide
ggagaacgggaaggacaagctggagc

SEQ ID NO: 21889 - DNA, 26 bp, Artificial Sequence
  Description of Artificial Sequence: Synthetic oligonucleotide
gagaacgggaaggacaagctggagcg

SEQ ID NO: 21890 - DNA, 26 bp, Artificial Sequence
  Description of Artificial Sequence: Synthetic oligonucleotide
agaacgggaaggacaagctggagcgc

SEQ ID NO: 21891 - DNA, 25 bp, Artificial Sequence
  Description of Artificial Sequence: Synthetic oligonucleotide
gaacgggaaggacaagctggagcgc

SEQ ID NO: 21892 - DNA, 25 bp, Artificial Sequence
  Description of Artificial Sequence: Synthetic oligonucleotide
aacgggaaggacaagctggagcgcg

SEQ ID NO: 21893 - DNA, 24 bp, Artificial Sequence
  Description of Artificial Sequence: Synthetic oligonucleotide
acgggaaggacaagctggagcgcg

SEQ ID NO: 21894 - DNA, 23 bp, Artificial Sequence
  Description of Artificial Sequence: Synthetic oligonucleotide
cgggaaggacaagctggagcgcg

SEQ ID NO: 21895 - DNA, 24 bp, Artificial Sequence
  Description of Artificial Sequence: Synthetic oligonucleotide
gggaaggacaagctggagcgcgct

SEQ ID NO: 21896 - DNA, 25 bp, Artificial Sequence
  Description of Artificial Sequence: Synthetic oligonucleotide
ggaaggacaagctggagcgcgctga

SEQ ID NO: 21897 - DNA, 25 bp, Artificial Sequence
  Description of Artificial Sequence: Synthetic oligonucleotide
gaaggacaagctggagcgcgctgac

SEQ ID NO: 21898 - DNA, 25 bp, Artificial Sequence
  Description of Artificial Sequence: Synthetic oligonucleotide
aaggacaagctggagcgcgctgacc

SEQ ID NO: 21899 - DNA, 24 bp, Artificial Sequence
  Description of Artificial Sequence: Synthetic oligonucleotide
aggacaagctggagcgcgctgacc

SEQ ID NO: 21900 - DNA, 23 bp, Artificial Sequence
  Description of Artificial Sequence: Synthetic oligonucleotide
ggacaagctggagcgcgctgacc

SEQ ID NO: 21901 - DNA, 23 bp, Artificial Sequence
  Description of Artificial Sequence: Synthetic oligonucleotide
gacaagctggagcgcgctgaccc

SEQ ID NO: 21902 - DNA, 23 bp, Artificial Sequence
  Description of Artificial Sequence: Synthetic oligonucleotide
acaagctggagcgcgctgacccc

SEQ ID NO: 21903 - DNA, 22 bp, Artificial Sequence
  Description of Artificial Sequence: Synthetic oligonucleotide
caagctggagcgcgctgacccc

SEQ ID NO: 21904 - DNA, 22 bp, Artificial Sequence
  Description of Artificial Sequence: Synthetic oligonucleotide
aagctggagcgcgctgaccccc

SEQ ID NO: 21905 - DNA, 21 bp, Artificial Sequence
  Description of Artificial Sequence: Synthetic oligonucleotide
agctggagcgcgctgaccccc

SEQ ID NO: 21906 - DNA, 20 bp, Artificial Sequence
  Description of Artificial Sequence: Synthetic oligonucleotide
gctggagcgcgctgaccccc

SEQ ID NO: 21907 - DNA, 23 bp, Artificial Sequence
  Description of Artificial Sequence: Synthetic oligonucleotide
ctggagcgcgctgaccccccaaa

SEQ ID NO: 21908 - DNA, 24 bp, Artificial Sequence
  Description of Artificial Sequence: Synthetic oligonucleotide
tggagcgcgctgaccccccaaaga

SEQ ID NO: 21909 - DNA, 23 bp, Artificial Sequence
  Description of Artificial Sequence: Synthetic oligonucleotide
ggagcgcgctgaccccccaaaga

SEQ ID NO: 21910 - DNA, 24 bp, Artificial Sequence
  Description of Artificial Sequence: Synthetic oligonucleotide
gagcgcgctgaccccccaaagaca

SEQ ID NO: 21911 - DNA, 25 bp, Artificial Sequence
  Description of Artificial Sequence: Synthetic oligonucleotide
agcgcgctgaccccccaaagacaca

SEQ ID NO: 21912 - DNA, 24 bp, Artificial Sequence
  Description of Artificial Sequence: Synthetic oligonucleotide
gcgcgctgaccccccaaagacaca

SEQ ID NO: 21913 - DNA, 24 bp, Artificial Sequence
  Description of Artificial Sequence: Synthetic oligonucleotide
cgcgctgaccccccaaagacacac

SEQ ID NO: 21914 - DNA, 25 bp, Artificial Sequence
  Description of Artificial Sequence: Synthetic oligonucleotide
gcgctgaccccccaaagacacacgt

SEQ ID NO: 21915 - DNA, 26 bp, Artificial Sequence
  Description of Artificial Sequence: Synthetic oligonucleotide
cgctgaccccccaaagacacacgtga

SEQ ID NO: 21916 - DNA, 26 bp, Artificial Sequence
  Description of Artificial Sequence: Synthetic oligonucleotide
gctgaccccccaaagacacacgtgac

SEQ ID NO: 21917 - DNA, 26 bp, Artificial Sequence
  Description of Artificial Sequence: Synthetic oligonucleotide
ctgaccccccaaagacacacgtgacc

SEQ ID NO: 21918 - DNA, 27 bp, Artificial Sequence
  Description of Artificial Sequence: Synthetic oligonucleotide
tgaccccccaaagacacacgtgaccca

SEQ ID NO: 21919 - DNA, 26 bp, Artificial Sequence
  Description of Artificial Sequence: Synthetic oligonucleotide
gaccccccaaagacacacgtgaccca

SEQ ID NO: 21920 - DNA, 26 bp, Artificial Sequence
  Description of Artificial Sequence: Synthetic oligonucleotide
accccccaaagacacacgtgacccac

SEQ ID NO: 21921 - DNA, 25 bp, Artificial Sequence
  Description of Artificial Sequence: Synthetic oligonucleotide
ccccccaaagacacacgtgacccac

SEQ ID NO: 21922 - DNA, 26 bp, Artificial Sequence
  Description of Artificial Sequence: Synthetic oligonucleotide
cccccaaagacacacgtgacccacca

SEQ ID NO: 21923 - DNA, 26 bp, Artificial Sequence
  Description of Artificial Sequence: Synthetic oligonucleotide
ccccaaagacacacgtgacccaccac

SEQ ID NO: 21924 - DNA, 26 bp, Artificial Sequence
  Description of Artificial Sequence: Synthetic oligonucleotide
cccaaagacacacgtgacccaccacc

SEQ ID NO: 21925 - DNA, 26 bp, Artificial Sequence
  Description of Artificial Sequence: Synthetic oligonucleotide
ccaaagacacacgtgacccaccaccc

SEQ ID NO: 21926 - DNA, 27 bp, Artificial Sequence
  Description of Artificial Sequence: Synthetic oligonucleotide
caaagacacacgtgacccaccacccca

SEQ ID NO: 21927 - DNA, 28 bp, Artificial Sequence
  Description of Artificial Sequence: Synthetic oligonucleotide
aaagacacacgtgacccaccaccccatc

SEQ ID NO: 21928 - DNA, 27 bp, Artificial Sequence
  Description of Artificial Sequence: Synthetic oligonucleotide
aagacacacgtgacccaccaccccatc

SEQ ID NO: 21929 - DNA, 27 bp, Artificial Sequence
  Description of Artificial Sequence: Synthetic oligonucleotide
agacacacgtgacccaccaccccatct

SEQ ID NO: 21930 - DNA, 26 bp, Artificial Sequence
  Description of Artificial Sequence: Synthetic oligonucleotide
gacacacgtgacccaccaccccatct

SEQ ID NO: 21931 - DNA, 27 bp, Artificial Sequence
  Description of Artificial Sequence: Synthetic oligonucleotide
acacacgtgacccaccaccccatctct

SEQ ID NO: 21932 - DNA, 26 bp, Artificial Sequence
  Description of Artificial Sequence: Synthetic oligonucleotide
cacacgtgacccaccaccccatctct

SEQ ID NO: 21933 - DNA, 27 bp, Artificial Sequence
  Description of Artificial Sequence: Synthetic oligonucleotide
acacgtgacccaccaccccatctctga

SEQ ID NO: 21934 - DNA, 26 bp, Artificial Sequence
  Description of Artificial Sequence: Synthetic oligonucleotide
cacgtgacccaccaccccatctctga

SEQ ID NO: 21935 - DNA, 26 bp, Artificial Sequence
  Description of Artificial Sequence: Synthetic oligonucleotide
acgtgacccaccaccccatctctgac

SEQ ID NO: 21936 - DNA, 25 bp, Artificial Sequence
  Description of Artificial Sequence: Synthetic oligonucleotide
cgtgacccaccaccccatctctgac

SEQ ID NO: 21937 - DNA, 27 bp, Artificial Sequence
  Description of Artificial Sequence: Synthetic oligonucleotide
gtgacccaccaccccatctctgaccat

SEQ ID NO: 21938 - DNA, 24 bp, Artificial Sequence
  Description of Artificial Sequence: Synthetic oligonucleotide
cctgaggtgctgggccctgggttt

SEQ ID NO: 21939 - DNA, 26 bp, Artificial Sequence
  Description of Artificial Sequence: Synthetic oligonucleotide
ctgaggtgctgggccctgggtttcta

SEQ ID NO: 21940 - DNA, 26 bp, Artificial Sequence
  Description of Artificial Sequence: Synthetic oligonucleotide
tgaggtgctgggccctgggtttctac

SEQ ID NO: 21941 - DNA, 25 bp, Artificial Sequence
  Description of Artificial Sequence: Synthetic oligonucleotide
gaggtgctgggccctgggtttctac

SEQ ID NO: 21942 - DNA, 25 bp, Artificial Sequence
  Description of Artificial Sequence: Synthetic oligonucleotide
aggtgctgggccctgggtttctacc

SEQ ID NO: 21943 - DNA, 24 bp, Artificial Sequence
  Description of Artificial Sequence: Synthetic oligonucleotide
ggtgctgggccctgggtttctacc

SEQ ID NO: 21944 - DNA, 25 bp, Artificial Sequence
  Description of Artificial Sequence: Synthetic oligonucleotide
gtgctgggccctgggtttctaccct

SEQ ID NO: 21945 - DNA, 25 bp, Artificial Sequence
  Description of Artificial Sequence: Synthetic oligonucleotide
tgctgggccctgggtttctaccctg

SEQ ID NO: 21946 - DNA, 24 bp, Artificial Sequence
  Description of Artificial Sequence: Synthetic oligonucleotide
gctgggccctgggtttctaccctg

SEQ ID NO: 21947 - DNA, 24 bp, Artificial Sequence
  Description of Artificial Sequence: Synthetic oligonucleotide
ctgggccctgggtttctaccctgc

SEQ ID NO: 21948 - DNA, 24 bp, Artificial Sequence
  Description of Artificial Sequence: Synthetic oligonucleotide
tgggccctgggtttctaccctgcg

SEQ ID NO: 21949 - DNA, 23 bp, Artificial Sequence
  Description of Artificial Sequence: Synthetic oligonucleotide
gggccctgggtttctaccctgcg

SEQ ID NO: 21950 - DNA, 24 bp, Artificial Sequence
  Description of Artificial Sequence: Synthetic oligonucleotide
ggccctgggtttctaccctgcgga

SEQ ID NO: 21951 - DNA, 26 bp, Artificial Sequence
  Description of Artificial Sequence: Synthetic oligonucleotide
gccctgggtttctaccctgcggagat

SEQ ID NO: 21952 - DNA, 27 bp, Artificial Sequence
  Description of Artificial Sequence: Synthetic oligonucleotide
ccctgggtttctaccctgcggagatca

SEQ ID NO: 21953 - DNA, 27 bp, Artificial Sequence
  Description of Artificial Sequence: Synthetic oligonucleotide
cctgggtttctaccctgcggagatcac

SEQ ID NO: 21954 - DNA, 28 bp, Artificial Sequence
  Description of Artificial Sequence: Synthetic oligonucleotide
ctgggtttctaccctgcggagatcacac

SEQ ID NO: 21955 - DNA, 29 bp, Artificial Sequence
  Description of Artificial Sequence: Synthetic oligonucleotide
tgggtttctaccctgcggagatcacactg

SEQ ID NO: 21956 - DNA, 28 bp, Artificial Sequence
  Description of Artificial Sequence: Synthetic oligonucleotide
gggtttctaccctgcggagatcacactg

SEQ ID NO: 21957 - DNA, 29 bp, Artificial Sequence
  Description of Artificial Sequence: Synthetic oligonucleotide
ggtttctaccctgcggagatcacactgac

SEQ ID NO: 21958 - DNA, 29 bp, Artificial Sequence
  Description of Artificial Sequence: Synthetic oligonucleotide
gtttctaccctgcggagatcacactgacc

SEQ ID NO: 21959 - DNA, 30 bp, Artificial Sequence
  Description of Artificial Sequence: Synthetic oligonucleotide
tttctaccctgcggagatcacactgacctg

SEQ ID NO: 21960 - DNA, 24 bp, Artificial Sequence
  Description of Artificial Sequence: Synthetic oligonucleotide
acactgacctggcagcgggatggc

SEQ ID NO: 21961 - DNA, 23 bp, Artificial Sequence
  Description of Artificial Sequence: Synthetic oligonucleotide
cactgacctggcagcgggatggc

SEQ ID NO: 21962 - DNA, 24 bp, Artificial Sequence
  Description of Artificial Sequence: Synthetic oligonucleotide
actgacctggcagcgggatggcga

SEQ ID NO: 21963 - DNA, 23 bp, Artificial Sequence
  Description of Artificial Sequence: Synthetic oligonucleotide
ctgacctggcagcgggatggcga

SEQ ID NO: 21964 - DNA, 23 bp, Artificial Sequence
  Description of Artificial Sequence: Synthetic oligonucleotide
tgacctggcagcgggatggcgag

SEQ ID NO: 21965 - DNA, 22 bp, Artificial Sequence
  Description of Artificial Sequence: Synthetic oligonucleotide
gacctggcagcgggatggcgag

SEQ ID NO: 21966 - DNA, 23 bp, Artificial Sequence
  Description of Artificial Sequence: Synthetic oligonucleotide
acctggcagcgggatggcgagga

SEQ ID NO: 21967 - DNA, 22 bp, Artificial Sequence
  Description of Artificial Sequence: Synthetic oligonucleotide
cctggcagcgggatggcgagga

SEQ ID NO: 21968 - DNA, 22 bp, Artificial Sequence
  Description of Artificial Sequence: Synthetic oligonucleotide
ctggcagcgggatggcgaggac

SEQ ID NO: 21969 - DNA, 25 bp, Artificial Sequence
  Description of Artificial Sequence: Synthetic oligonucleotide
tggcagcgggatggcgaggaccaaa

SEQ ID NO: 21970 - DNA, 24 bp, Artificial Sequence
  Description of Artificial Sequence: Synthetic oligonucleotide
ggcagcgggatggcgaggaccaaa

SEQ ID NO: 21971 - DNA, 25 bp, Artificial Sequence
  Description of Artificial Sequence: Synthetic oligonucleotide
gcagcgggatggcgaggaccaaact

SEQ ID NO: 21972 - DNA, 26 bp, Artificial Sequence
  Description of Artificial Sequence: Synthetic oligonucleotide
cagcgggatggcgaggaccaaactca

SEQ ID NO: 21973 - DNA, 26 bp, Artificial Sequence
  Description of Artificial Sequence: Synthetic oligonucleotide
agcgggatggcgaggaccaaactcag

SEQ ID NO: 21974 - DNA, 25 bp, Artificial Sequence
  Description of Artificial Sequence: Synthetic oligonucleotide
gcgggatggcgaggaccaaactcag

SEQ ID NO: 21975 - DNA, 26 bp, Artificial Sequence
  Description of Artificial Sequence: Synthetic oligonucleotide
cgggatggcgaggaccaaactcagga

SEQ ID NO: 21976 - DNA, 27 bp, Artificial Sequence
  Description of Artificial Sequence: Synthetic oligonucleotide
gggatggcgaggaccaaactcaggaca

SEQ ID NO: 21977 - DNA, 27 bp, Artificial Sequence
  Description of Artificial Sequence: Synthetic oligonucleotide
ggatggcgaggaccaaactcaggacac

SEQ ID NO: 21978 - DNA, 28 bp, Artificial Sequence
  Description of Artificial Sequence: Synthetic oligonucleotide
gatggcgaggaccaaactcaggacactg

SEQ ID NO: 21979 - DNA, 29 bp, Artificial Sequence
  Description of Artificial Sequence: Synthetic oligonucleotide
atggcgaggaccaaactcaggacactgag

SEQ ID NO: 21980 - DNA, 28 bp, Artificial Sequence
  Description of Artificial Sequence: Synthetic oligonucleotide
tggcgaggaccaaactcaggacactgag

SEQ ID NO: 21981 - DNA, 27 bp, Artificial Sequence
  Description of Artificial Sequence: Synthetic oligonucleotide
ggcgaggaccaaactcaggacactgag

SEQ ID NO: 21982 - DNA, 27 bp, Artificial Sequence
  Description of Artificial Sequence: Synthetic oligonucleotide
gcgaggaccaaactcaggacactgagc

SEQ ID NO: 21983 - DNA, 29 bp, Artificial Sequence
  Description of Artificial Sequence: Synthetic oligonucleotide
cgaggaccaaactcaggacactgagcttg

SEQ ID NO: 21984 - DNA, 30 bp, Artificial Sequence
  Description of Artificial Sequence: Synthetic oligonucleotide
gaggaccaaactcaggacactgagcttgtg

SEQ ID NO: 21985 - DNA, 30 bp, Artificial Sequence
  Description of Artificial Sequence: Synthetic oligonucleotide
aggaccaaactcaggacactgagcttgtgg

SEQ ID NO: 21986 - DNA, 29 bp, Artificial Sequence
  Description of Artificial Sequence: Synthetic oligonucleotide
ggaccaaactcaggacactgagcttgtgg

SEQ ID NO: 21987 - DNA, 30 bp, Artificial Sequence
  Description of Artificial Sequence: Synthetic oligonucleotide
gaccaaactcaggacactgagcttgtggag

SEQ ID NO: 21988 - DNA, 31 bp, Artificial Sequence
  Description of Artificial Sequence: Synthetic oligonucleotide
accaaactcaggacactgagcttgtggagac

SEQ ID NO: 21989 - DNA, 30 bp, Artificial Sequence
  Description of Artificial Sequence: Synthetic oligonucleotide
ccaaactcaggacactgagcttgtggagac

SEQ ID NO: 21990 - DNA, 30 bp, Artificial Sequence
  Description of Artificial Sequence: Synthetic oligonucleotide
caaactcaggacactgagcttgtggagacc

SEQ ID NO: 21991 - DNA, 31 bp, Artificial Sequence
  Description of Artificial Sequence: Synthetic oligonucleotide
aaactcaggacactgagcttgtggagaccag

SEQ ID NO: 21992 - DNA, 30 bp, Artificial Sequence
  Description of Artificial Sequence: Synthetic oligonucleotide
aactcaggacactgagcttgtggagaccag

SEQ ID NO: 21993 - DNA, 29 bp, Artificial Sequence
  Description of Artificial Sequence: Synthetic oligonucleotide
actcaggacactgagcttgtggagaccag

SEQ ID NO: 21994 - DNA, 28 bp, Artificial Sequence
  Description of Artificial Sequence: Synthetic oligonucleotide
ctcaggacactgagcttgtggagaccag

SEQ ID NO: 21995 - DNA, 29 bp, Artificial Sequence
  Description of Artificial Sequence: Synthetic oligonucleotide
tcaggacactgagcttgtggagaccagac

SEQ ID NO: 21996 - DNA, 28 bp, Artificial Sequence
  Description of Artificial Sequence: Synthetic oligonucleotide
caggacactgagcttgtggagaccagac

SEQ ID NO: 21997 - DNA, 28 bp, Artificial Sequence
  Description of Artificial Sequence: Synthetic oligonucleotide
aggacactgagcttgtggagaccagacc

SEQ ID NO: 21998 - DNA, 27 bp, Artificial Sequence
  Description of Artificial Sequence: Synthetic oligonucleotide
ggacactgagcttgtggagaccagacc

SEQ ID NO: 21999 - DNA, 28 bp, Artificial Sequence
  Description of Artificial Sequence: Synthetic oligonucleotide
gacactgagcttgtggagaccagaccag

SEQ ID NO: 22000 - DNA, 28 bp, Artificial Sequence
  Description of Artificial Sequence: Synthetic oligonucleotide
acactgagcttgtggagaccagaccagc

SEQ ID NO: 22001 - DNA, 27 bp, Artificial Sequence
  Description of Artificial Sequence: Synthetic oligonucleotide
cactgagcttgtggagaccagaccagc

SEQ ID NO: 22002 - DNA, 28 bp, Artificial Sequence
  Description of Artificial Sequence: Synthetic oligonucleotide
actgagcttgtggagaccagaccagcag

SEQ ID NO: 22003 - DNA, 27 bp, Artificial Sequence
  Description of Artificial Sequence: Synthetic oligonucleotide
ctgagcttgtggagaccagaccagcag

SEQ ID NO: 22004 - DNA, 27 bp, Artificial Sequence
  Description of Artificial Sequence: Synthetic oligonucleotide
tgagcttgtggagaccagaccagcagg

SEQ ID NO: 22005 - DNA, 27 bp, Artificial Sequence
  Description of Artificial Sequence: Synthetic oligonucleotide
gagcttgtggagaccagaccagcagga

SEQ ID NO: 22006 - DNA, 27 bp, Artificial Sequence
  Description of Artificial Sequence: Synthetic oligonucleotide
agcttgtggagaccagaccagcaggag

SEQ ID NO: 22007 - DNA, 27 bp, Artificial Sequence
  Description of Artificial Sequence: Synthetic oligonucleotide
gcttgtggagaccagaccagcaggaga

SEQ ID NO: 22008 - DNA, 29 bp, Artificial Sequence
  Description of Artificial Sequence: Synthetic oligonucleotide
cttgtggagaccagaccagcaggagatag

SEQ ID NO: 22009 - DNA, 31 bp, Artificial Sequence
  Description of Artificial Sequence: Synthetic oligonucleotide
ttgtggagaccagaccagcaggagatagaac

SEQ ID NO: 22010 - DNA, 30 bp, Artificial Sequence
  Description of Artificial Sequence: Synthetic oligonucleotide
tgtggagaccagaccagcaggagatagaac

SEQ ID NO: 22011 - DNA, 29 bp, Artificial Sequence
  Description of Artificial Sequence: Synthetic oligonucleotide
gtggagaccagaccagcaggagatagaac

SEQ ID NO: 22012 - DNA, 29 bp, Artificial Sequence
  Description of Artificial Sequence: Synthetic oligonucleotide
tggagaccagaccagcaggagatagaacc

SEQ ID NO: 22013 - DNA, 28 bp, Artificial Sequence
  Description of Artificial Sequence: Synthetic oligonucleotide
ggagaccagaccagcaggagatagaacc

SEQ ID NO: 22014 - DNA, 30 bp, Artificial Sequence
  Description of Artificial Sequence: Synthetic oligonucleotide
gagaccagaccagcaggagatagaaccttc

SEQ ID NO: 22015 - DNA, 30 bp, Artificial Sequence
  Description of Artificial Sequence: Synthetic oligonucleotide
agaccagaccagcaggagatagaaccttcc

SEQ ID NO: 22016 - DNA, 29 bp, Artificial Sequence
  Description of Artificial Sequence: Synthetic oligonucleotide
gaccagaccagcaggagatagaaccttcc

SEQ ID NO: 22017 - DNA, 30 bp, Artificial Sequence
  Description of Artificial Sequence: Synthetic oligonucleotide
accagaccagcaggagatagaaccttccag

SEQ ID NO: 22018 - DNA, 29 bp, Artificial Sequence
  Description of Artificial Sequence: Synthetic oligonucleotide
ccagaccagcaggagatagaaccttccag

SEQ ID NO: 22019 - DNA, 31 bp, Artificial Sequence
  Description of Artificial Sequence: Synthetic oligonucleotide
cagaccagcaggagatagaaccttccagaag

SEQ ID NO: 22020 - DNA, 32 bp, Artificial Sequence
  Description of Artificial Sequence: Synthetic oligonucleotide
agaccagcaggagatagaaccttccagaagtg

SEQ ID NO: 22021 - DNA, 31 bp, Artificial Sequence
  Description of Artificial Sequence: Synthetic oligonucleotide
gaccagcaggagatagaaccttccagaagtg

SEQ ID NO: 22022 - DNA, 31 bp, Artificial Sequence
  Description of Artificial Sequence: Synthetic oligonucleotide
accagcaggagatagaaccttccagaagtgg

SEQ ID NO: 22023 - DNA, 30 bp, Artificial Sequence
  Description of Artificial Sequence: Synthetic oligonucleotide
ccagcaggagatagaaccttccagaagtgg

SEQ ID NO: 22024 - DNA, 30 bp, Artificial Sequence
  Description of Artificial Sequence: Synthetic oligonucleotide
cagcaggagatagaaccttccagaagtggg

SEQ ID NO: 22025 - DNA, 30 bp, Artificial Sequence
  Description of Artificial Sequence: Synthetic oligonucleotide
agcaggagatagaaccttccagaagtgggc

SEQ ID NO: 22026 - DNA, 29 bp, Artificial Sequence
  Description of Artificial Sequence: Synthetic oligonucleotide
gcaggagatagaaccttccagaagtgggc

SEQ ID NO: 22027 - DNA, 30 bp, Artificial Sequence
  Description of Artificial Sequence: Synthetic oligonucleotide
caggagatagaaccttccagaagtgggcag

SEQ ID NO: 22028 - DNA, 30 bp, Artificial Sequence
  Description of Artificial Sequence: Synthetic oligonucleotide
aggagatagaaccttccagaagtgggcagc

SEQ ID NO: 22029 - DNA, 29 bp, Artificial Sequence
  Description of Artificial Sequence: Synthetic oligonucleotide
ggagatagaaccttccagaagtgggcagc

SEQ ID NO: 22030 - DNA, 30 bp, Artificial Sequence
  Description of Artificial Sequence: Synthetic oligonucleotide
gagatagaaccttccagaagtgggcagctg

SEQ ID NO: 22031 - DNA, 31 bp, Artificial Sequence
  Description of Artificial Sequence: Synthetic oligonucleotide
agatagaaccttccagaagtgggcagctgtg

SEQ ID NO: 22032 - DNA, 30 bp, Artificial Sequence
  Description of Artificial Sequence: Synthetic oligonucleotide
gatagaaccttccagaagtgggcagctgtg

SEQ ID NO: 22033 - DNA, 30 bp, Artificial Sequence
  Description of Artificial Sequence: Synthetic oligonucleotide
atagaaccttccagaagtgggcagctgtgg

SEQ ID NO: 22034 - DNA, 29 bp, Artificial Sequence
  Description of Artificial Sequence: Synthetic oligonucleotide
tagaaccttccagaagtgggcagctgtgg

SEQ ID NO: 22035 - DNA, 28 bp, Artificial Sequence
  Description of Artificial Sequence: Synthetic oligonucleotide
agaaccttccagaagtgggcagctgtgg

SEQ ID NO: 22036 - DNA, 27 bp, Artificial Sequence
  Description of Artificial Sequence: Synthetic oligonucleotide
ttccagaagtgggcagctgtggtggtg

SEQ ID NO: 22037 - DNA, 26 bp, Artificial Sequence
  Description of Artificial Sequence: Synthetic oligonucleotide
tccagaagtgggcagctgtggtggtg

SEQ ID NO: 22038 - DNA, 25 bp, Artificial Sequence
  Description of Artificial Sequence: Synthetic oligonucleotide
ccagaagtgggcagctgtggtggtg

SEQ ID NO: 22039 - DNA, 25 bp, Artificial Sequence
  Description of Artificial Sequence: Synthetic oligonucleotide
cagaagtgggcagctgtggtggtgc

SEQ ID NO: 22040 - DNA, 27 bp, Artificial Sequence
  Description of Artificial Sequence: Synthetic oligonucleotide
agaagtgggcagctgtggtggtgcctt

SEQ ID NO: 22041 - DNA, 26 bp, Artificial Sequence
  Description of Artificial Sequence: Synthetic oligonucleotide
gaagtgggcagctgtggtggtgcctt

SEQ ID NO: 22042 - DNA, 27 bp, Artificial Sequence
  Description of Artificial Sequence: Synthetic oligonucleotide
aagtgggcagctgtggtggtgccttct

SEQ ID NO: 22043 - DNA, 26 bp, Artificial Sequence
  Description of Artificial Sequence: Synthetic oligonucleotide
agtgggcagctgtggtggtgccttct

SEQ ID NO: 22044 - DNA, 25 bp, Artificial Sequence
  Description of Artificial Sequence: Synthetic oligonucleotide
gtgggcagctgtggtggtgccttct

SEQ ID NO: 22045 - DNA, 25 bp, Artificial Sequence
  Description of Artificial Sequence: Synthetic oligonucleotide
tgggcagctgtggtggtgccttctg

SEQ ID NO: 22046 - DNA, 24 bp, Artificial Sequence
  Description of Artificial Sequence: Synthetic oligonucleotide
gggcagctgtggtggtgccttctg

SEQ ID NO: 22047 - DNA, 25 bp, Artificial Sequence
  Description of Artificial Sequence: Synthetic oligonucleotide
ggcagctgtggtggtgccttctgga

SEQ ID NO: 22048 - DNA, 27 bp, Artificial Sequence
  Description of Artificial Sequence: Synthetic oligonucleotide
gcagctgtggtggtgccttctggagaa

SEQ ID NO: 22049 - DNA, 27 bp, Artificial Sequence
  Description of Artificial Sequence: Synthetic oligonucleotide
cagctgtggtggtgccttctggagaag

SEQ ID NO: 22050 - DNA, 28 bp, Artificial Sequence
  Description of Artificial Sequence: Synthetic oligonucleotide
agctgtggtggtgccttctggagaagag

SEQ ID NO: 22051 - DNA, 27 bp, Artificial Sequence
  Description of Artificial Sequence: Synthetic oligonucleotide
gctgtggtggtgccttctggagaagag

SEQ ID NO: 22052 - DNA, 27 bp, Artificial Sequence
  Description of Artificial Sequence: Synthetic oligonucleotide
ctgtggtggtgccttctggagaagagc

SEQ ID NO: 22053 - DNA, 28 bp, Artificial Sequence
  Description of Artificial Sequence: Synthetic oligonucleotide
tgtggtggtgccttctggagaagagcag

SEQ ID NO: 22054 - DNA, 27 bp, Artificial Sequence
  Description of Artificial Sequence: Synthetic oligonucleotide
gtggtggtgccttctggagaagagcag

SEQ ID NO: 22055 - DNA, 28 bp, Artificial Sequence
  Description of Artificial Sequence: Synthetic oligonucleotide
tggtggtgccttctggagaagagcagag

SEQ ID NO: 22056 - DNA, 27 bp, Artificial Sequence
  Description of Artificial Sequence: Synthetic oligonucleotide
ggtggtgccttctggagaagagcagag

SEQ ID NO: 22057 - DNA, 30 bp, Artificial Sequence
  Description of Artificial Sequence: Synthetic oligonucleotide
gtggtgccttctggagaagagcagagatac

SEQ ID NO: 22058 - DNA, 31 bp, Artificial Sequence
  Description of Artificial Sequence: Synthetic oligonucleotide
tggtgccttctggagaagagcagagatacac

SEQ ID NO: 22059 - DNA, 30 bp, Artificial Sequence
  Description of Artificial Sequence: Synthetic oligonucleotide
ggtgccttctggagaagagcagagatacac

SEQ ID NO: 22060 - DNA, 32 bp, Artificial Sequence
  Description of Artificial Sequence: Synthetic oligonucleotide
gtgccttctggagaagagcagagatacacatg

SEQ ID NO: 22061 - DNA, 32 bp, Artificial Sequence
  Description of Artificial Sequence: Synthetic oligonucleotide
tgccttctggagaagagcagagatacacatgc

SEQ ID NO: 22062 - DNA, 31 bp, Artificial Sequence
  Description of Artificial Sequence: Synthetic oligonucleotide
gccttctggagaagagcagagatacacatgc

SEQ ID NO: 22063 - DNA, 31 bp, Artificial Sequence
  Description of Artificial Sequence: Synthetic oligonucleotide
ccttctggagaagagcagagatacacatgcc

SEQ ID NO: 22064 - DNA, 33 bp, Artificial Sequence
  Description of Artificial Sequence: Synthetic oligonucleotide
cttctggagaagagcagagatacacatgccatg

SEQ ID NO: 22065 - DNA, 35 bp, Artificial Sequence
  Description of Artificial Sequence: Synthetic oligonucleotide
ttctggagaagagcagagatacacatgccatgtac

SEQ ID NO: 22066 - DNA, 34 bp, Artificial Sequence
  Description of Artificial Sequence: Synthetic oligonucleotide
tctggagaagagcagagatacacatgccatgtac

SEQ ID NO: 22067 - DNA, 33 bp, Artificial Sequence
  Description of Artificial Sequence: Synthetic oligonucleotide
ctggagaagagcagagatacacatgccatgtac

SEQ ID NO: 22068 - DNA, 34 bp, Artificial Sequence
  Description of Artificial Sequence: Synthetic oligonucleotide
tggagaagagcagagatacacatgccatgtacag

SEQ ID NO: 22069 - DNA, 33 bp, Artificial Sequence
  Description of Artificial Sequence: Synthetic oligonucleotide
ggagaagagcagagatacacatgccatgtacag

SEQ ID NO: 22070 - DNA, 33 bp, Artificial Sequence
  Description of Artificial Sequence: Synthetic oligonucleotide
gagaagagcagagatacacatgccatgtacagc

SEQ ID NO: 22071 - DNA, 35 bp, Artificial Sequence
  Description of Artificial Sequence: Synthetic oligonucleotide
agaagagcagagatacacatgccatgtacagcatg

SEQ ID NO: 22072 - DNA, 34 bp, Artificial Sequence
  Description of Artificial Sequence: Synthetic oligonucleotide
gaagagcagagatacacatgccatgtacagcatg

SEQ ID NO: 22073 - DNA, 35 bp, Artificial Sequence
  Description of Artificial Sequence: Synthetic oligonucleotide
aagagcagagatacacatgccatgtacagcatgag

SEQ ID NO: 22074 - DNA, 34 bp, Artificial Sequence
  Description of Artificial Sequence: Synthetic oligonucleotide
agagcagagatacacatgccatgtacagcatgag

SEQ ID NO: 22075 - DNA, 33 bp, Artificial Sequence
  Description of Artificial Sequence: Synthetic oligonucleotide
gagcagagatacacatgccatgtacagcatgag

SEQ ID NO: 22076 - DNA, 33 bp, Artificial Sequence
  Description of Artificial Sequence: Synthetic oligonucleotide
agcagagatacacatgccatgtacagcatgagg

SEQ ID NO: 22077 - DNA, 32 bp, Artificial Sequence
  Description of Artificial Sequence: Synthetic oligonucleotide
gcagagatacacatgccatgtacagcatgagg

SEQ ID NO: 22078 - DNA, 32 bp, Artificial Sequence
  Description of Artificial Sequence: Synthetic oligonucleotide
cagagatacacatgccatgtacagcatgaggg

SEQ ID NO: 22079 - DNA, 32 bp, Artificial Sequence
  Description of Artificial Sequence: Synthetic oligonucleotide
agagatacacatgccatgtacagcatgagggg

SEQ ID NO: 22080 - DNA, 31 bp, Artificial Sequence
  Description of Artificial Sequence: Synthetic oligonucleotide
gagatacacatgccatgtacagcatgagggg

SEQ ID NO: 22081 - DNA, 31 bp, Artificial Sequence
  Description of Artificial Sequence: Synthetic oligonucleotide
agatacacatgccatgtacagcatgaggggc

SEQ ID NO: 22082 - DNA, 30 bp, Artificial Sequence
  Description of Artificial Sequence: Synthetic oligonucleotide
gatacacatgccatgtacagcatgaggggc

SEQ ID NO: 22083 - DNA, 31 bp, Artificial Sequence
  Description of Artificial Sequence: Synthetic oligonucleotide
atacacatgccatgtacagcatgaggggctg

SEQ ID NO: 22084 - DNA, 30 bp, Artificial Sequence
  Description of Artificial Sequence: Synthetic oligonucleotide
tacacatgccatgtacagcatgaggggctg

SEQ ID NO: 22085 - DNA, 29 bp, Artificial Sequence
  Description of Artificial Sequence: Synthetic oligonucleotide
acacatgccatgtacagcatgaggggctg

SEQ ID NO: 22086 - DNA, 28 bp, Artificial Sequence
  Description of Artificial Sequence: Synthetic oligonucleotide
cacatgccatgtacagcatgaggggctg

SEQ ID NO: 22087 - DNA, 28 bp, Artificial Sequence
  Description of Artificial Sequence: Synthetic oligonucleotide
acatgccatgtacagcatgaggggctgc

SEQ ID NO: 22088 - DNA, 27 bp, Artificial Sequence
  Description of Artificial Sequence: Synthetic oligonucleotide
catgccatgtacagcatgaggggctgc

SEQ ID NO: 22089 - DNA, 27 bp, Artificial Sequence
  Description of Artificial Sequence: Synthetic oligonucleotide
atgccatgtacagcatgaggggctgcc

SEQ ID NO: 22090 - DNA, 26 bp, Artificial Sequence
  Description of Artificial Sequence: Synthetic oligonucleotide
tgccatgtacagcatgaggggctgcc

SEQ ID NO: 22091 - DNA, 25 bp, Artificial Sequence
  Description of Artificial Sequence: Synthetic oligonucleotide
gccatgtacagcatgaggggctgcc

SEQ ID NO: 22092 - DNA, 27 bp, Artificial Sequence
  Description of Artificial Sequence: Synthetic oligonucleotide
ccatgtacagcatgaggggctgccgaa

SEQ ID NO: 22093 - DNA, 27 bp, Artificial Sequence
  Description of Artificial Sequence: Synthetic oligonucleotide
catgtacagcatgaggggctgccgaag

SEQ ID NO: 22094 - DNA, 27 bp, Artificial Sequence
  Description of Artificial Sequence: Synthetic oligonucleotide
atgtacagcatgaggggctgccgaagc

SEQ ID NO: 22095 - DNA, 26 bp, Artificial Sequence
  Description of Artificial Sequence: Synthetic oligonucleotide
tgtacagcatgaggggctgccgaagc

SEQ ID NO: 22096 - DNA, 25 bp, Artificial Sequence
  Description of Artificial Sequence: Synthetic oligonucleotide
gtacagcatgaggggctgccgaagc

SEQ ID NO: 22097 - DNA, 25 bp, Artificial Sequence
  Description of Artificial Sequence: Synthetic oligonucleotide
tacagcatgaggggctgccgaagcc

SEQ ID NO: 22098 - DNA, 24 bp, Artificial Sequence
  Description of Artificial Sequence: Synthetic oligonucleotide
acagcatgaggggctgccgaagcc

SEQ ID NO: 22099 - DNA, 23 bp, Artificial Sequence
  Description of Artificial Sequence: Synthetic oligonucleotide
cagcatgaggggctgccgaagcc

SEQ ID NO: 22100 - DNA, 23 bp, Artificial Sequence
  Description of Artificial Sequence: Synthetic oligonucleotide
agcatgaggggctgccgaagccc

SEQ ID NO: 22101 - DNA, 22 bp, Artificial Sequence
  Description of Artificial Sequence: Synthetic oligonucleotide
gcatgaggggctgccgaagccc

SEQ ID NO: 22102 - DNA, 23 bp, Artificial Sequence
  Description of Artificial Sequence: Synthetic oligonucleotide
catgaggggctgccgaagcccct

SEQ ID NO: 22103 - DNA, 24 bp, Artificial Sequence
  Description of Artificial Sequence: Synthetic oligonucleotide
atgaggggctgccgaagcccctca

SEQ ID NO: 22104 - DNA, 23 bp, Artificial Sequence
  Description of Artificial Sequence: Synthetic oligonucleotide
tgaggggctgccgaagcccctca

SEQ ID NO: 22105 - DNA, 22 bp, Artificial Sequence
  Description of Artificial Sequence: Synthetic oligonucleotide
gaggggctgccgaagcccctca

SEQ ID NO: 22106 - DNA, 22 bp, Artificial Sequence
  Description of Artificial Sequence: Synthetic oligonucleotide
aggggctgccgaagcccctcac

SEQ ID NO: 22107 - DNA, 21 bp, Artificial Sequence
  Description of Artificial Sequence: Synthetic oligonucleotide
ggggctgccgaagcccctcac

SEQ ID NO: 22108 - DNA, 21 bp, Artificial Sequence
  Description of Artificial Sequence: Synthetic oligonucleotide
gggctgccgaagcccctcacc

SEQ ID NO: 22109 - DNA, 22 bp, Artificial Sequence
  Description of Artificial Sequence: Synthetic oligonucleotide
ggctgccgaagcccctcaccct

SEQ ID NO: 22110 - DNA, 23 bp, Artificial Sequence
  Description of Artificial Sequence: Synthetic oligonucleotide
gctgccgaagcccctcaccctga

SEQ ID NO: 22111 - DNA, 25 bp, Artificial Sequence
  Description of Artificial Sequence: Synthetic oligonucleotide
ctgccgaagcccctcaccctgagat

SEQ ID NO: 22112 - DNA, 25 bp, Artificial Sequence
  Description of Artificial Sequence: Synthetic oligonucleotide
tgccgaagcccctcaccctgagatg

SEQ ID NO: 22113 - DNA, 24 bp, Artificial Sequence
  Description of Artificial Sequence: Synthetic oligonucleotide
gccgaagcccctcaccctgagatg

SEQ ID NO: 22114 - DNA, 24 bp, Artificial Sequence
  Description of Artificial Sequence: Synthetic oligonucleotide
ccgaagcccctcaccctgagatgg

SEQ ID NO: 22115 - DNA, 25 bp, Artificial Sequence
  Description of Artificial Sequence: Synthetic oligonucleotide
cgaagcccctcaccctgagatggga

SEQ ID NO: 22116 - DNA, 25 bp, Artificial Sequence
  Description of Artificial Sequence: Synthetic oligonucleotide
gaagcccctcaccctgagatgggag

SEQ ID NO: 22117 - DNA, 26 bp, Artificial Sequence
  Description of Artificial Sequence: Synthetic oligonucleotide
cctgagatgggagccgtcttcccagt

SEQ ID NO: 22118 - DNA, 26 bp, Artificial Sequence
  Description of Artificial Sequence: Synthetic oligonucleotide
ctgagatgggagccgtcttcccagtc

SEQ ID NO: 22119 - DNA, 27 bp, Artificial Sequence
  Description of Artificial Sequence: Synthetic oligonucleotide
tgagatgggagccgtcttcccagtcca

SEQ ID NO: 22120 - DNA, 26 bp, Artificial Sequence
  Description of Artificial Sequence: Synthetic oligonucleotide
gagatgggagccgtcttcccagtcca

SEQ ID NO: 22121 - DNA, 26 bp, Artificial Sequence
  Description of Artificial Sequence: Synthetic oligonucleotide
agatgggagccgtcttcccagtccac

SEQ ID NO: 22122 - DNA, 25 bp, Artificial Sequence
  Description of Artificial Sequence: Synthetic oligonucleotide
gatgggagccgtcttcccagtccac

SEQ ID NO: 22123 - DNA, 25 bp, Artificial Sequence
  Description of Artificial Sequence: Synthetic oligonucleotide
atgggagccgtcttcccagtccacc

SEQ ID NO: 22124 - DNA, 24 bp, Artificial Sequence
  Description of Artificial Sequence: Synthetic oligonucleotide
tgggagccgtcttcccagtccacc

SEQ ID NO: 22125 - DNA, 23 bp, Artificial Sequence
  Description of Artificial Sequence: Synthetic oligonucleotide
gggagccgtcttcccagtccacc

SEQ ID NO: 22126 - DNA, 24 bp, Artificial Sequence
  Description of Artificial Sequence: Synthetic oligonucleotide
ggagccgtcttcccagtccaccgt

SEQ ID NO: 22127 - DNA, 24 bp, Artificial Sequence
  Description of Artificial Sequence: Synthetic oligonucleotide
gagccgtcttcccagtccaccgtc

SEQ ID NO: 22128 - DNA, 24 bp, Artificial Sequence
  Description of Artificial Sequence: Synthetic oligonucleotide
agccgtcttcccagtccaccgtcc

SEQ ID NO: 22129 - DNA, 23 bp, Artificial Sequence
  Description of Artificial Sequence: Synthetic oligonucleotide
gccgtcttcccagtccaccgtcc

SEQ ID NO: 22130 - DNA, 23 bp, Artificial Sequence
  Description of Artificial Sequence: Synthetic oligonucleotide
ccgtcttcccagtccaccgtccc

SEQ ID NO: 22131 - DNA, 25 bp, Artificial Sequence
  Description of Artificial Sequence: Synthetic oligonucleotide
cgtcttcccagtccaccgtccccat

SEQ ID NO: 22132 - DNA, 25 bp, Artificial Sequence
  Description of Artificial Sequence: Synthetic oligonucleotide
gtcttcccagtccaccgtccccatc

SEQ ID NO: 22133 - DNA, 26 bp, Artificial Sequence
  Description of Artificial Sequence: Synthetic oligonucleotide
tcttcccagtccaccgtccccatcgt

SEQ ID NO: 22134 - DNA, 25 bp, Artificial Sequence
  Description of Artificial Sequence: Synthetic oligonucleotide
cttcccagtccaccgtccccatcgt

SEQ ID NO: 22135 - DNA, 25 bp, Artificial Sequence
  Description of Artificial Sequence: Synthetic oligonucleotide
ttcccagtccaccgtccccatcgtg

SEQ ID NO: 22136 - DNA, 24 bp, Artificial Sequence
  Description of Artificial Sequence: Synthetic oligonucleotide
tcccagtccaccgtccccatcgtg

SEQ ID NO: 22137 - DNA, 23 bp, Artificial Sequence
  Description of Artificial Sequence: Synthetic oligonucleotide
cccagtccaccgtccccatcgtg

SEQ ID NO: 22138 - DNA, 23 bp, Artificial Sequence
  Description of Artificial Sequence: Synthetic oligonucleotide
ccagtccaccgtccccatcgtgg

SEQ ID NO: 22139 - DNA, 23 bp, Artificial Sequence
  Description of Artificial Sequence: Synthetic oligonucleotide
cagtccaccgtccccatcgtggg

SEQ ID NO: 22140 - DNA, 26 bp, Artificial Sequence
  Description of Artificial Sequence: Synthetic oligonucleotide
agtccaccgtccccatcgtgggcatt

SEQ ID NO: 22141 - DNA, 25 bp, Artificial Sequence
  Description of Artificial Sequence: Synthetic oligonucleotide
gtccaccgtccccatcgtgggcatt

SEQ ID NO: 22142 - DNA, 27 bp, Artificial Sequence
  Description of Artificial Sequence: Synthetic oligonucleotide
tccaccgtccccatcgtgggcattgtt

SEQ ID NO: 22143 - DNA, 26 bp, Artificial Sequence
  Description of Artificial Sequence: Synthetic oligonucleotide
ccaccgtccccatcgtgggcattgtt

SEQ ID NO: 22144 - DNA, 26 bp, Artificial Sequence
  Description of Artificial Sequence: Synthetic oligonucleotide
caccgtccccatcgtgggcattgttg

SEQ ID NO: 22145 - DNA, 27 bp, Artificial Sequence
  Description of Artificial Sequence: Synthetic oligonucleotide
accgtccccatcgtgggcattgttgct

SEQ ID NO: 22146 - DNA, 26 bp, Artificial Sequence
  Description of Artificial Sequence: Synthetic oligonucleotide
ccgtccccatcgtgggcattgttgct

SEQ ID NO: 22147 - DNA, 26 bp, Artificial Sequence
  Description of Artificial Sequence: Synthetic oligonucleotide
cgtccccatcgtgggcattgttgctg

SEQ ID NO: 22148 - DNA, 26 bp, Artificial Sequence
  Description of Artificial Sequence: Synthetic oligonucleotide
gtccccatcgtgggcattgttgctgg

SEQ ID NO: 22149 - DNA, 26 bp, Artificial Sequence
  Description of Artificial Sequence: Synthetic oligonucleotide
tccccatcgtgggcattgttgctggc

SEQ ID NO: 22150 - DNA, 25 bp, Artificial Sequence
  Description of Artificial Sequence: Synthetic oligonucleotide
ccccatcgtgggcattgttgctggc

SEQ ID NO: 22151 - DNA, 26 bp, Artificial Sequence
  Description of Artificial Sequence: Synthetic oligonucleotide
cccatcgtgggcattgttgctggcct

SEQ ID NO: 22152 - DNA, 26 bp, Artificial Sequence
  Description of Artificial Sequence: Synthetic oligonucleotide
ccatcgtgggcattgttgctggcctg

SEQ ID NO: 22153 - DNA, 26 bp, Artificial Sequence
  Description of Artificial Sequence: Synthetic oligonucleotide
catcgtgggcattgttgctggcctgg

SEQ ID NO: 22154 - DNA, 27 bp, Artificial Sequence
  Description of Artificial Sequence: Synthetic oligonucleotide
atcgtgggcattgttgctggcctggct

SEQ ID NO: 22155 - DNA, 26 bp, Artificial Sequence
  Description of Artificial Sequence: Synthetic oligonucleotide
tcgtgggcattgttgctggcctggct

SEQ ID NO: 22156 - DNA, 25 bp, Artificial Sequence
  Description of Artificial Sequence: Synthetic oligonucleotide
cgtgggcattgttgctggcctggct

SEQ ID NO: 22157 - DNA, 26 bp, Artificial Sequence
  Description of Artificial Sequence: Synthetic oligonucleotide
gtgggcattgttgctggcctggctgt

SEQ ID NO: 22158 - DNA, 26 bp, Artificial Sequence
  Description of Artificial Sequence: Synthetic oligonucleotide
tgggcattgttgctggcctggctgtc

SEQ ID NO: 22159 - DNA, 25 bp, Artificial Sequence
  Description of Artificial Sequence: Synthetic oligonucleotide
gggcattgttgctggcctggctgtc

SEQ ID NO: 22160 - DNA, 27 bp, Artificial Sequence
  Description of Artificial Sequence: Synthetic oligonucleotide
ggcattgttgctggcctggctgtccta

SEQ ID NO: 22161 - DNA, 27 bp, Artificial Sequence
  Description of Artificial Sequence: Synthetic oligonucleotide
gcattgttgctggcctggctgtcctag

SEQ ID NO: 22162 - DNA, 27 bp, Artificial Sequence
  Description of Artificial Sequence: Synthetic oligonucleotide
cattgttgctggcctggctgtcctagc

SEQ ID NO: 22163 - DNA, 28 bp, Artificial Sequence
  Description of Artificial Sequence: Synthetic oligonucleotide
attgttgctggcctggctgtcctagcag

SEQ ID NO: 22164 - DNA, 27 bp, Artificial Sequence
  Description of Artificial Sequence: Synthetic oligonucleotide
ttgttgctggcctggctgtcctagcag

SEQ ID NO: 22165 - DNA, 27 bp, Artificial Sequence
  Description of Artificial Sequence: Synthetic oligonucleotide
tgttgctggcctggctgtcctagcagt

SEQ ID NO: 22166 - DNA, 27 bp, Artificial Sequence
  Description of Artificial Sequence: Synthetic oligonucleotide
gttgctggcctggctgtcctagcagtt

SEQ ID NO: 22167 - DNA, 27 bp, Artificial Sequence
  Description of Artificial Sequence: Synthetic oligonucleotide
ttgctggcctggctgtcctagcagttg

SEQ ID NO: 22168 - DNA, 27 bp, Artificial Sequence
  Description of Artificial Sequence: Synthetic oligonucleotide
tgctggcctggctgtcctagcagttgt

SEQ ID NO: 22169 - DNA, 26 bp, Artificial Sequence
  Description of Artificial Sequence: Synthetic oligonucleotide
gctggcctggctgtcctagcagttgt

SEQ ID NO: 22170 - DNA, 26 bp, Artificial Sequence
  Description of Artificial Sequence: Synthetic oligonucleotide
ctggcctggctgtcctagcagttgtg

SEQ ID NO: 22171 - DNA, 27 bp, Artificial Sequence
  Description of Artificial Sequence: Synthetic oligonucleotide
tggcctggctgtcctagcagttgtggt

SEQ ID NO: 22172 - DNA, 26 bp, Artificial Sequence
  Description of Artificial Sequence: Synthetic oligonucleotide
ggcctggctgtcctagcagttgtggt

SEQ ID NO: 22173 - DNA, 27 bp, Artificial Sequence
  Description of Artificial Sequence: Synthetic oligonucleotide
gcctggctgtcctagcagttgtggtca

SEQ ID NO: 22174 - DNA, 28 bp, Artificial Sequence
  Description of Artificial Sequence: Synthetic oligonucleotide
cctggctgtcctagcagttgtggtcatc

SEQ ID NO: 22175 - DNA, 28 bp, Artificial Sequence
  Description of Artificial Sequence: Synthetic oligonucleotide
ctggctgtcctagcagttgtggtcatcg

SEQ ID NO: 22176 - DNA, 28 bp, Artificial Sequence
  Description of Artificial Sequence: Synthetic oligonucleotide
tggctgtcctagcagttgtggtcatcgg

SEQ ID NO: 22177 - DNA, 27 bp, Artificial Sequence
  Description of Artificial Sequence: Synthetic oligonucleotide
ggctgtcctagcagttgtggtcatcgg

SEQ ID NO: 22178 - DNA, 28 bp, Artificial Sequence
  Description of Artificial Sequence: Synthetic oligonucleotide
gctgtcctagcagttgtggtcatcggag

SEQ ID NO: 22179 - DNA, 28 bp, Artificial Sequence
  Description of Artificial Sequence: Synthetic oligonucleotide
ctgtcctagcagttgtggtcatcggagc

SEQ ID NO: 22180 - DNA, 29 bp, Artificial Sequence
  Description of Artificial Sequence: Synthetic oligonucleotide
tgtcctagcagttgtggtcatcggagctg

SEQ ID NO: 22181 - DNA, 28 bp, Artificial Sequence
  Description of Artificial Sequence: Synthetic oligonucleotide
gtcctagcagttgtggtcatcggagctg

SEQ ID NO: 22182 - DNA, 29 bp, Artificial Sequence
  Description of Artificial Sequence: Synthetic oligonucleotide
tcctagcagttgtggtcatcggagctgtg

SEQ ID NO: 22183 - DNA, 28 bp, Artificial Sequence
  Description of Artificial Sequence: Synthetic oligonucleotide
cctagcagttgtggtcatcggagctgtg

SEQ ID NO: 22184 - DNA, 28 bp, Artificial Sequence
  Description of Artificial Sequence: Synthetic oligonucleotide
ctagcagttgtggtcatcggagctgtgg

SEQ ID NO: 22185 - DNA, 29 bp, Artificial Sequence
  Description of Artificial Sequence: Synthetic oligonucleotide
tagcagttgtggtcatcggagctgtggtc

SEQ ID NO: 22186 - DNA, 28 bp, Artificial Sequence
  Description of Artificial Sequence: Synthetic oligonucleotide
agcagttgtggtcatcggagctgtggtc

SEQ ID NO: 22187 - DNA, 27 bp, Artificial Sequence
  Description of Artificial Sequence: Synthetic oligonucleotide
gcagttgtggtcatcggagctgtggtc

SEQ ID NO: 22188 - DNA, 27 bp, Artificial Sequence
  Description of Artificial Sequence: Synthetic oligonucleotide
cagttgtggtcatcggagctgtggtcg

SEQ ID NO: 22189 - DNA, 27 bp, Artificial Sequence
  Description of Artificial Sequence: Synthetic oligonucleotide
agttgtggtcatcggagctgtggtcgc

SEQ ID NO: 22190 - DNA, 27 bp, Artificial Sequence
  Description of Artificial Sequence: Synthetic oligonucleotide
gttgtggtcatcggagctgtggtcgct

SEQ ID NO: 22191 - DNA, 27 bp, Artificial Sequence
  Description of Artificial Sequence: Synthetic oligonucleotide
ttgtggtcatcggagctgtggtcgctg

SEQ ID NO: 22192 - DNA, 26 bp, Artificial Sequence
  Description of Artificial Sequence: Synthetic oligonucleotide
tgtggtcatcggagctgtggtcgctg

SEQ ID NO: 22193 - DNA, 25 bp, Artificial Sequence
  Description of Artificial Sequence: Synthetic oligonucleotide
gtggtcatcggagctgtggtcgctg

SEQ ID NO: 22194 - DNA, 26 bp, Artificial Sequence
  Description of Artificial Sequence: Synthetic oligonucleotide
tggtcatcggagctgtggtcgctgct

SEQ ID NO: 22195 - DNA, 25 bp, Artificial Sequence
  Description of Artificial Sequence: Synthetic oligonucleotide
ggtcatcggagctgtggtcgctgct

SEQ ID NO: 22196 - DNA, 26 bp, Artificial Sequence
  Description of Artificial Sequence: Synthetic oligonucleotide
gtcatcggagctgtggtcgctgctgt

SEQ ID NO: 22197 - DNA, 27 bp, Artificial Sequence
  Description of Artificial Sequence: Synthetic oligonucleotide
tcatcggagctgtggtcgctgctgtga

SEQ ID NO: 22198 - DNA, 27 bp, Artificial Sequence
  Description of Artificial Sequence: Synthetic oligonucleotide
catcggagctgtggtcgctgctgtgat

SEQ ID NO: 22199 - DNA, 27 bp, Artificial Sequence
  Description of Artificial Sequence: Synthetic oligonucleotide
atcggagctgtggtcgctgctgtgatg

SEQ ID NO: 22200 - DNA, 27 bp, Artificial Sequence
  Description of Artificial Sequence: Synthetic oligonucleotide
tcggagctgtggtcgctgctgtgatgt

SEQ ID NO: 22201 - DNA, 26 bp, Artificial Sequence
  Description of Artificial Sequence: Synthetic oligonucleotide
cggagctgtggtcgctgctgtgatgt

SEQ ID NO: 22202 - DNA, 27 bp, Artificial Sequence
  Description of Artificial Sequence: Synthetic oligonucleotide
ggagctgtggtcgctgctgtgatgtgt

SEQ ID NO: 22203 - DNA, 28 bp, Artificial Sequence
  Description of Artificial Sequence: Synthetic oligonucleotide
gagctgtggtcgctgctgtgatgtgtag

SEQ ID NO: 22204 - DNA, 28 bp, Artificial Sequence
  Description of Artificial Sequence: Synthetic oligonucleotide
agctgtggtcgctgctgtgatgtgtagg

SEQ ID NO: 22205 - DNA, 27 bp, Artificial Sequence
  Description of Artificial Sequence: Synthetic oligonucleotide
gctgtggtcgctgctgtgatgtgtagg

SEQ ID NO: 22206 - DNA, 28 bp, Artificial Sequence
  Description of Artificial Sequence: Synthetic oligonucleotide
ctgtggtcgctgctgtgatgtgtaggag

SEQ ID NO: 22207 - DNA, 28 bp, Artificial Sequence
  Description of Artificial Sequence: Synthetic oligonucleotide
tgtggtcgctgctgtgatgtgtaggagg

SEQ ID NO: 22208 - DNA, 27 bp, Artificial Sequence
  Description of Artificial Sequence: Synthetic oligonucleotide
gtggtcgctgctgtgatgtgtaggagg

SEQ ID NO: 22209 - DNA, 29 bp, Artificial Sequence
  Description of Artificial Sequence: Synthetic oligonucleotide
tggtcgctgctgtgatgtgtaggaggaag

SEQ ID NO: 22210 - DNA, 28 bp, Artificial Sequence
  Description of Artificial Sequence: Synthetic oligonucleotide
ggtcgctgctgtgatgtgtaggaggaag

SEQ ID NO: 22211 - DNA, 29 bp, Artificial Sequence
  Description of Artificial Sequence: Synthetic oligonucleotide
gtcgctgctgtgatgtgtaggaggaagag

SEQ ID NO: 22212 - DNA, 31 bp, Artificial Sequence
  Description of Artificial Sequence: Synthetic oligonucleotide
tcgctgctgtgatgtgtaggaggaagagttc

SEQ ID NO: 22213 - DNA, 30 bp, Artificial Sequence
  Description of Artificial Sequence: Synthetic oligonucleotide
cgctgctgtgatgtgtaggaggaagagttc

SEQ ID NO: 22214 - DNA, 31 bp, Artificial Sequence
  Description of Artificial Sequence: Synthetic oligonucleotide
gctgctgtgatgtgtaggaggaagagttcag

SEQ ID NO: 22215 - DNA, 31 bp, Artificial Sequence
  Description of Artificial Sequence: Synthetic oligonucleotide
ctgctgtgatgtgtaggaggaagagttcagg

SEQ ID NO: 22216 - DNA, 32 bp, Artificial Sequence
  Description of Artificial Sequence: Synthetic oligonucleotide
tgctgtgatgtgtaggaggaagagttcaggtg

SEQ ID NO: 22217 - DNA, 31 bp, Artificial Sequence
  Description of Artificial Sequence: Synthetic oligonucleotide
gctgtgatgtgtaggaggaagagttcaggtg

SEQ ID NO: 22218 - DNA, 31 bp, Artificial Sequence
  Description of Artificial Sequence: Synthetic oligonucleotide
ctgtgatgtgtaggaggaagagttcaggtgg

SEQ ID NO: 22219 - DNA, 35 bp, Artificial Sequence
  Description of Artificial Sequence: Synthetic oligonucleotide
tgtgatgtgtaggaggaagagttcaggtggaaaag

SEQ ID NO: 22220 - DNA, 34 bp, Artificial Sequence
  Description of Artificial Sequence: Synthetic oligonucleotide
gtgatgtgtaggaggaagagttcaggtggaaaag

SEQ ID NO: 22221 - DNA, 34 bp, Artificial Sequence
  Description of Artificial Sequence: Synthetic oligonucleotide
tgatgtgtaggaggaagagttcaggtggaaaagg

SEQ ID NO: 22222 - DNA, 33 bp, Artificial Sequence
  Description of Artificial Sequence: Synthetic oligonucleotide
gatgtgtaggaggaagagttcaggtggaaaagg

SEQ ID NO: 22223 - DNA, 34 bp, Artificial Sequence
  Description of Artificial Sequence: Synthetic oligonucleotide
atgtgtaggaggaagagttcaggtggaaaaggag

SEQ ID NO: 22224 - DNA, 33 bp, Artificial Sequence
  Description of Artificial Sequence: Synthetic oligonucleotide
tgtgtaggaggaagagttcaggtggaaaaggag

SEQ ID NO: 22225 - DNA, 32 bp, Artificial Sequence
  Description of Artificial Sequence: Synthetic oligonucleotide
gtgtaggaggaagagttcaggtggaaaaggag

SEQ ID NO: 22226 - DNA, 32 bp, Artificial Sequence
  Description of Artificial Sequence: Synthetic oligonucleotide
tgtaggaggaagagttcaggtggaaaaggagg

SEQ ID NO: 22227 - DNA, 31 bp, Artificial Sequence
  Description of Artificial Sequence: Synthetic oligonucleotide
gtaggaggaagagttcaggtggaaaaggagg

SEQ ID NO: 22228 - DNA, 31 bp, Artificial Sequence
  Description of Artificial Sequence: Synthetic oligonucleotide
taggaggaagagttcaggtggaaaaggaggg

SEQ ID NO: 22229 - DNA, 30 bp, Artificial Sequence
  Description of Artificial Sequence: Synthetic oligonucleotide
aggaggaagagttcaggtggaaaaggaggg

SEQ ID NO: 22230 - DNA, 29 bp, Artificial Sequence
  Description of Artificial Sequence: Synthetic oligonucleotide
ggaggaagagttcaggtggaaaaggaggg

SEQ ID NO: 22231 - DNA, 30 bp, Artificial Sequence
  Description of Artificial Sequence: Synthetic oligonucleotide
gaggaagagttcaggtggaaaaggagggag

SEQ ID NO: 22232 - DNA, 30 bp, Artificial Sequence
  Description of Artificial Sequence: Synthetic oligonucleotide
aggaagagttcaggtggaaaaggagggagc

SEQ ID NO: 22233 - DNA, 29 bp, Artificial Sequence
  Description of Artificial Sequence: Synthetic oligonucleotide
ggaagagttcaggtggaaaaggagggagc

SEQ ID NO: 22234 - DNA, 31 bp, Artificial Sequence
  Description of Artificial Sequence: Synthetic oligonucleotide
gaagagttcaggtggaaaaggagggagctac

SEQ ID NO: 22235 - DNA, 32 bp, Artificial Sequence
  Description of Artificial Sequence: Synthetic oligonucleotide
aagagttcaggtggaaaaggagggagctactc

SEQ ID NO: 22236 - DNA, 31 bp, Artificial Sequence
  Description of Artificial Sequence: Synthetic oligonucleotide
agagttcaggtggaaaaggagggagctactc

SEQ ID NO: 22237 - DNA, 30 bp, Artificial Sequence
  Description of Artificial Sequence: Synthetic oligonucleotide
gagttcaggtggaaaaggagggagctactc

SEQ ID NO: 22238 - DNA, 31 bp, Artificial Sequence
  Description of Artificial Sequence: Synthetic oligonucleotide
agttcaggtggaaaaggagggagctactctc

SEQ ID NO: 22239 - DNA, 30 bp, Artificial Sequence
  Description of Artificial Sequence: Synthetic oligonucleotide
gttcaggtggaaaaggagggagctactctc

SEQ ID NO: 22240 - DNA, 31 bp, Artificial Sequence
  Description of Artificial Sequence: Synthetic oligonucleotide
ttcaggtggaaaaggagggagctactctcag

SEQ ID NO: 22241 - DNA, 30 bp, Artificial Sequence
  Description of Artificial Sequence: Synthetic oligonucleotide
tcaggtggaaaaggagggagctactctcag

SEQ ID NO: 22242 - DNA, 29 bp, Artificial Sequence
  Description of Artificial Sequence: Synthetic oligonucleotide
caggtggaaaaggagggagctactctcag

SEQ ID NO: 22243 - DNA, 29 bp, Artificial Sequence
  Description of Artificial Sequence: Synthetic oligonucleotide
aggtggaaaaggagggagctactctcagg

SEQ ID NO: 22244 - DNA, 28 bp, Artificial Sequence
  Description of Artificial Sequence: Synthetic oligonucleotide
ggtggaaaaggagggagctactctcagg

SEQ ID NO: 22245 - DNA, 28 bp, Artificial Sequence
  Description of Artificial Sequence: Synthetic oligonucleotide
gtggaaaaggagggagctactctcaggc

SEQ ID NO: 22246 - DNA, 29 bp, Artificial Sequence
  Description of Artificial Sequence: Synthetic oligonucleotide
tggaaaaggagggagctactctcaggctg

SEQ ID NO: 22247 - DNA, 28 bp, Artificial Sequence
  Description of Artificial Sequence: Synthetic oligonucleotide
ggaaaaggagggagctactctcaggctg

SEQ ID NO: 22248 - DNA, 28 bp, Artificial Sequence
  Description of Artificial Sequence: Synthetic oligonucleotide
aaaaggagggagctactctcaggctgcg

SEQ ID NO: 22249 - DNA, 27 bp, Artificial Sequence
  Description of Artificial Sequence: Synthetic oligonucleotide
aaaggagggagctactctcaggctgcg

SEQ ID NO: 22250 - DNA, 27 bp, Artificial Sequence
  Description of Artificial Sequence: Synthetic oligonucleotide
aaggagggagctactctcaggctgcgt

SEQ ID NO: 22251 - DNA, 26 bp, Artificial Sequence
  Description of Artificial Sequence: Synthetic oligonucleotide
aggagggagctactctcaggctgcgt

SEQ ID NO: 22252 - DNA, 25 bp, Artificial Sequence
  Description of Artificial Sequence: Synthetic oligonucleotide
ggagggagctactctcaggctgcgt

SEQ ID NO: 22253 - DNA, 25 bp, Artificial Sequence
  Description of Artificial Sequence: Synthetic oligonucleotide
gagggagctactctcaggctgcgtg

SEQ ID NO: 22254 - DNA, 26 bp, Artificial Sequence
  Description of Artificial Sequence: Synthetic oligonucleotide
agggagctactctcaggctgcgtgca

SEQ ID NO: 22255 - DNA, 25 bp, Artificial Sequence
  Description of Artificial Sequence: Synthetic oligonucleotide
gggagctactctcaggctgcgtgca

SEQ ID NO: 22256 - DNA, 25 bp, Artificial Sequence
  Description of Artificial Sequence: Synthetic oligonucleotide
ggagctactctcaggctgcgtgcag

SEQ ID NO: 22257 - DNA, 25 bp, Artificial Sequence
  Description of Artificial Sequence: Synthetic oligonucleotide
gagctactctcaggctgcgtgcagc

SEQ ID NO: 22258 - DNA, 26 bp, Artificial Sequence
  Description of Artificial Sequence: Synthetic oligonucleotide
agctactctcaggctgcgtgcagcga

SEQ ID NO: 22259 - DNA, 25 bp, Artificial Sequence
  Description of Artificial Sequence: Synthetic oligonucleotide
gctactctcaggctgcgtgcagcga

SEQ ID NO: 22260 - DNA, 26 bp, Artificial Sequence
  Description of Artificial Sequence: Synthetic oligonucleotide
ctactctcaggctgcgtgcagcgaca

SEQ ID NO: 22261 - DNA, 27 bp, Artificial Sequence
  Description of Artificial Sequence: Synthetic oligonucleotide
tactctcaggctgcgtgcagcgacagt

SEQ ID NO: 22262 - DNA, 26 bp, Artificial Sequence
  Description of Artificial Sequence: Synthetic oligonucleotide
actctcaggctgcgtgcagcgacagt

SEQ ID NO: 22263 - DNA, 25 bp, Artificial Sequence
  Description of Artificial Sequence: Synthetic oligonucleotide
ctctcaggctgcgtgcagcgacagt

SEQ ID NO: 22264 - DNA, 25 bp, Artificial Sequence
  Description of Artificial Sequence: Synthetic oligonucleotide
tctcaggctgcgtgcagcgacagtg

SEQ ID NO: 22265 - DNA, 24 bp, Artificial Sequence
  Description of Artificial Sequence: Synthetic oligonucleotide
ctcaggctgcgtgcagcgacagtg

SEQ ID NO: 22266 - DNA, 24 bp, Artificial Sequence
  Description of Artificial Sequence: Synthetic oligonucleotide
tcaggctgcgtgcagcgacagtgc

SEQ ID NO: 22267 - DNA, 23 bp, Artificial Sequence
  Description of Artificial Sequence: Synthetic oligonucleotide
caggctgcgtgcagcgacagtgc

SEQ ID NO: 22268 - DNA, 23 bp, Artificial Sequence
  Description of Artificial Sequence: Synthetic oligonucleotide
aggctgcgtgcagcgacagtgcc

SEQ ID NO: 22269 - DNA, 22 bp, Artificial Sequence
  Description of Artificial Sequence: Synthetic oligonucleotide
ggctgcgtgcagcgacagtgcc

SEQ ID NO: 22270 - DNA, 23 bp, Artificial Sequence
  Description of Artificial Sequence: Synthetic oligonucleotide
gctgcgtgcagcgacagtgccca

SEQ ID NO: 22271 - DNA, 23 bp, Artificial Sequence
  Description of Artificial Sequence: Synthetic oligonucleotide
ctgcgtgcagcgacagtgcccag

SEQ ID NO: 22272 - DNA, 23 bp, Artificial Sequence
  Description of Artificial Sequence: Synthetic oligonucleotide
tgcgtgcagcgacagtgcccagg

SEQ ID NO: 22273 - DNA, 22 bp, Artificial Sequence
  Description of Artificial Sequence: Synthetic oligonucleotide
gcgtgcagcgacagtgcccagg

SEQ ID NO: 22274 - DNA, 22 bp, Artificial Sequence
  Description of Artificial Sequence: Synthetic oligonucleotide
cgtgcagcgacagtgcccaggg

SEQ ID NO: 22275 - DNA, 23 bp, Artificial Sequence
  Description of Artificial Sequence: Synthetic oligonucleotide
gtgcagcgacagtgcccagggct

SEQ ID NO: 22276 - DNA, 24 bp, Artificial Sequence
  Description of Artificial Sequence: Synthetic oligonucleotide
tgcagcgacagtgcccagggctct

SEQ ID NO: 22277 - DNA, 23 bp, Artificial Sequence
  Description of Artificial Sequence: Synthetic oligonucleotide
gcagcgacagtgcccagggctct

SEQ ID NO: 22278 - DNA, 25 bp, Artificial Sequence
  Description of Artificial Sequence: Synthetic oligonucleotide
cagcgacagtgcccagggctctgat

SEQ ID NO: 22279 - DNA, 26 bp, Artificial Sequence
  Description of Artificial Sequence: Synthetic oligonucleotide
agcgacagtgcccagggctctgatgt

SEQ ID NO: 22280 - DNA, 25 bp, Artificial Sequence
  Description of Artificial Sequence: Synthetic oligonucleotide
gcgacagtgcccagggctctgatgt

SEQ ID NO: 22281 - DNA, 26 bp, Artificial Sequence
  Description of Artificial Sequence: Synthetic oligonucleotide
cgacagtgcccagggctctgatgtgt

SEQ ID NO: 22282 - DNA, 23 bp, Artificial Sequence
  Description of Artificial Sequence: Synthetic oligonucleotide
gagtgcgtggagtggctccgcag

SEQ ID NO: 22283 - DNA, 25 bp, Artificial Sequence
  Description of Artificial Sequence: Synthetic oligonucleotide
agtgcgtggagtggctccgcaggta

SEQ ID NO: 22284 - DNA, 24 bp, Artificial Sequence
  Description of Artificial Sequence: Synthetic oligonucleotide
gtgcgtggagtggctccgcaggta

SEQ ID NO: 22285 - DNA, 24 bp, Artificial Sequence
  Description of Artificial Sequence: Synthetic oligonucleotide
tgcgtggagtggctccgcaggtac

SEQ ID NO: 22286 - DNA, 23 bp, Artificial Sequence
  Description of Artificial Sequence: Synthetic oligonucleotide
gcgtggagtggctccgcaggtac

SEQ ID NO: 22287 - DNA, 24 bp, Artificial Sequence
  Description of Artificial Sequence: Synthetic oligonucleotide
cgtggagtggctccgcaggtacct

SEQ ID NO: 22288 - DNA, 24 bp, Artificial Sequence
  Description of Artificial Sequence: Synthetic oligonucleotide
gtggagtggctccgcaggtacctg

SEQ ID NO: 22289 - DNA, 25 bp, Artificial Sequence
  Description of Artificial Sequence: Synthetic oligonucleotide
tggagtggctccgcaggtacctgga

SEQ ID NO: 22290 - DNA, 24 bp, Artificial Sequence
  Description of Artificial Sequence: Synthetic oligonucleotide
ggagtggctccgcaggtacctgga

SEQ ID NO: 22291 - DNA, 26 bp, Artificial Sequence
  Description of Artificial Sequence: Synthetic oligonucleotide
gagtggctccgcaggtacctggagaa

SEQ ID NO: 22292 - DNA, 26 bp, Artificial Sequence
  Description of Artificial Sequence: Synthetic oligonucleotide
agtggctccgcaggtacctggagaac

SEQ ID NO: 22293 - DNA, 25 bp, Artificial Sequence
  Description of Artificial Sequence: Synthetic oligonucleotide
gtggctccgcaggtacctggagaac

SEQ ID NO: 22294 - DNA, 25 bp, Artificial Sequence
  Description of Artificial Sequence: Synthetic oligonucleotide
tggctccgcaggtacctggagaacg

SEQ ID NO: 22295 - DNA, 24 bp, Artificial Sequence
  Description of Artificial Sequence: Synthetic oligonucleotide
ggctccgcaggtacctggagaacg

SEQ ID NO: 22296 - DNA, 24 bp, Artificial Sequence
  Description of Artificial Sequence: Synthetic oligonucleotide
gctccgcaggtacctggagaacgg

SEQ ID NO: 22297 - DNA, 26 bp, Artificial Sequence
  Description of Artificial Sequence: Synthetic oligonucleotide
ctccgcaggtacctggagaacgggaa

SEQ ID NO: 22298 - DNA, 26 bp, Artificial Sequence
  Description of Artificial Sequence: Synthetic oligonucleotide
tccgcaggtacctggagaacgggaag

SEQ ID NO: 22299 - DNA, 25 bp, Artificial Sequence
  Description of Artificial Sequence: Synthetic oligonucleotide
ccgcaggtacctggagaacgggaag

SEQ ID NO: 22300 - DNA, 26 bp, Artificial Sequence
  Description of Artificial Sequence: Synthetic oligonucleotide
cgcaggtacctggagaacgggaagga

SEQ ID NO: 22301 - DNA, 27 bp, Artificial Sequence
  Description of Artificial Sequence: Synthetic oligonucleotide
gcaggtacctggagaacgggaaggaca

SEQ ID NO: 22302 - DNA, 28 bp, Artificial Sequence
  Description of Artificial Sequence: Synthetic oligonucleotide
caggtacctggagaacgggaaggacaag

SEQ ID NO: 22303 - DNA, 28 bp, Artificial Sequence
  Description of Artificial Sequence: Synthetic oligonucleotide
aggtacctggagaacgggaaggacaagc

SEQ ID NO: 22304 - DNA, 27 bp, Artificial Sequence
  Description of Artificial Sequence: Synthetic oligonucleotide
ggtacctggagaacgggaaggacaagc

SEQ ID NO: 22305 - DNA, 28 bp, Artificial Sequence
  Description of Artificial Sequence: Synthetic oligonucleotide
gtacctggagaacgggaaggacaagctg

SEQ ID NO: 22306 - DNA, 27 bp, Artificial Sequence
  Description of Artificial Sequence: Synthetic oligonucleotide
gctacgtggacgacacgcagttcgtga

SEQ ID NO: 22307 - DNA, 27 bp, Artificial Sequence
  Description of Artificial Sequence: Synthetic oligonucleotide
ctacgtggacgacacgcagttcgtgag

SEQ ID NO: 22308 - DNA, 27 bp, Artificial Sequence
  Description of Artificial Sequence: Synthetic oligonucleotide
tacgtggacgacacgcagttcgtgagg

SEQ ID NO: 22309 - DNA, 27 bp, Artificial Sequence
  Description of Artificial Sequence: Synthetic oligonucleotide
acgtggacgacacgcagttcgtgaggt

SEQ ID NO: 22310 - DNA, 27 bp, Artificial Sequence
  Description of Artificial Sequence: Synthetic oligonucleotide
cgtggacgacacgcagttcgtgaggtt

SEQ ID NO: 22311 - DNA, 27 bp, Artificial Sequence
  Description of Artificial Sequence: Synthetic oligonucleotide
gtggacgacacgcagttcgtgaggttc

SEQ ID NO: 22312 - DNA, 27 bp, Artificial Sequence
  Description of Artificial Sequence: Synthetic oligonucleotide
tggacgacacgcagttcgtgaggttcg

SEQ ID NO: 22313 - DNA, 27 bp, Artificial Sequence
  Description of Artificial Sequence: Synthetic oligonucleotide
ggacgacacgcagttcgtgaggttcga

SEQ ID NO: 22314 - DNA, 27 bp, Artificial Sequence
  Description of Artificial Sequence: Synthetic oligonucleotide
gacgacacgcagttcgtgaggttcgac

SEQ ID NO: 22315 - DNA, 28 bp, Artificial Sequence
  Description of Artificial Sequence: Synthetic oligonucleotide
acgacacgcagttcgtgaggttcgacag

SEQ ID NO: 22316 - DNA, 27 bp, Artificial Sequence
  Description of Artificial Sequence: Synthetic oligonucleotide
cgacacgcagttcgtgaggttcgacag

SEQ ID NO: 22317 - DNA, 27 bp, Artificial Sequence
  Description of Artificial Sequence: Synthetic oligonucleotide
gacacgcagttcgtgaggttcgacagc

SEQ ID NO: 22318 - DNA, 27 bp, Artificial Sequence
  Description of Artificial Sequence: Synthetic oligonucleotide
acacgcagttcgtgaggttcgacagcg

SEQ ID NO: 22319 - DNA, 27 bp, Artificial Sequence
  Description of Artificial Sequence: Synthetic oligonucleotide
cacgcagttcgtgaggttcgacagcga

SEQ ID NO: 22320 - DNA, 27 bp, Artificial Sequence
  Description of Artificial Sequence: Synthetic oligonucleotide
acgcagttcgtgaggttcgacagcgac

SEQ ID NO: 22321 - DNA, 26 bp, Artificial Sequence
  Description of Artificial Sequence: Synthetic oligonucleotide
cgcagttcgtgaggttcgacagcgac

SEQ ID NO: 22322 - DNA, 26 bp, Artificial Sequence
  Description of Artificial Sequence: Synthetic oligonucleotide
gcagttcgtgaggttcgacagcgacg

SEQ ID NO: 22323 - DNA, 24 bp, Artificial Sequence
  Description of Artificial Sequence: Synthetic oligonucleotide
ggaaggacaagctggagcgcgctg

SEQ ID NO: 22324 - DNA, 25 bp, Artificial Sequence
  Description of Artificial Sequence: Synthetic oligonucleotide
caggaggggcctgagtattgggacc

SEQ ID NO: 22325 - DNA, 25 bp, Artificial Sequence
  Description of Artificial Sequence: Synthetic oligonucleotide
aggaggggcctgagtattgggaccg

SEQ ID NO: 22326 - DNA, 24 bp, Artificial Sequence
  Description of Artificial Sequence: Synthetic oligonucleotide
ggaggggcctgagtattgggaccg

SEQ ID NO: 22327 - DNA, 26 bp, Artificial Sequence
  Description of Artificial Sequence: Synthetic oligonucleotide
gaggggcctgagtattgggaccggaa

SEQ ID NO: 22328 - DNA, 27 bp, Artificial Sequence
  Description of Artificial Sequence: Synthetic oligonucleotide
aggggcctgagtattgggaccggaaca

SEQ ID NO: 22329 - DNA, 26 bp, Artificial Sequence
  Description of Artificial Sequence: Synthetic oligonucleotide
ggggcctgagtattgggaccggaaca

SEQ ID NO: 22330 - DNA, 27 bp, Artificial Sequence
  Description of Artificial Sequence: Synthetic oligonucleotide
gggcctgagtattgggaccggaacaca

SEQ ID NO: 22331 - DNA, 27 bp, Artificial Sequence
  Description of Artificial Sequence: Synthetic oligonucleotide
ggcctgagtattgggaccggaacacac

SEQ ID NO: 22332 - DNA, 28 bp, Artificial Sequence
  Description of Artificial Sequence: Synthetic oligonucleotide
gcctgagtattgggaccggaacacacag

SEQ ID NO: 22333 - DNA, 30 bp, Artificial Sequence
  Description of Artificial Sequence: Synthetic oligonucleotide
cctgagtattgggaccggaacacacagatc

SEQ ID NO: 22334 - DNA, 32 bp, Artificial Sequence
  Description of Artificial Sequence: Synthetic oligonucleotide
ctgagtattgggaccggaacacacagatctac

SEQ ID NO: 22335 - DNA, 34 bp, Artificial Sequence
  Description of Artificial Sequence: Synthetic oligonucleotide
tgagtattgggaccggaacacacagatctacaag

SEQ ID NO: 22336 - DNA, 23 bp, Artificial Sequence
  Description of Artificial Sequence: Synthetic oligonucleotide
ccgcggagagccccgcttcatct

SEQ ID NO: 22337 - DNA, 24 bp, Artificial Sequence
  Description of Artificial Sequence: Synthetic oligonucleotide
cgcggagagccccgcttcatctca

SEQ ID NO: 22338 - DNA, 25 bp, Artificial Sequence
  Description of Artificial Sequence: Synthetic oligonucleotide
gcggagagccccgcttcatctcagt

SEQ ID NO: 22339 - DNA, 25 bp, Artificial Sequence
  Description of Artificial Sequence: Synthetic oligonucleotide
cggagagccccgcttcatctcagtg

SEQ ID NO: 22340 - DNA, 25 bp, Artificial Sequence
  Description of Artificial Sequence: Synthetic oligonucleotide
ggagagccccgcttcatctcagtgg

SEQ ID NO: 22341 - DNA, 25 bp, Artificial Sequence
  Description of Artificial Sequence: Synthetic oligonucleotide
gagagccccgcttcatctcagtggg

SEQ ID NO: 22342 - DNA, 27 bp, Artificial Sequence
  Description of Artificial Sequence: Synthetic oligonucleotide
agagccccgcttcatctcagtgggcta

SEQ ID NO: 22343 - DNA, 24 bp, Artificial Sequence
  Description of Artificial Sequence: Synthetic oligonucleotide
cgaagcccctcaccctgagatggg

SEQ ID NO: 22344 - DNA, 26 bp, Artificial Sequence
  Description of Artificial Sequence: Synthetic oligonucleotide
agcgcgctgaccccccaaagacacat

SEQ ID NO: 22345 - DNA, 25 bp, Artificial Sequence
  Description of Artificial Sequence: Synthetic oligonucleotide
gcgcgctgaccccccaaagacacat

SEQ ID NO: 22346 - DNA, 26 bp, Artificial Sequence
  Description of Artificial Sequence: Synthetic oligonucleotide
cgcgctgaccccccaaagacacatgt

SEQ ID NO: 22347 - DNA, 27 bp, Artificial Sequence
  Description of Artificial Sequence: Synthetic oligonucleotide
gcgctgaccccccaaagacacatgtga

SEQ ID NO: 22348 - DNA, 27 bp, Artificial Sequence
  Description of Artificial Sequence: Synthetic oligonucleotide
cgctgaccccccaaagacacatgtgac

SEQ ID NO: 22349 - DNA, 27 bp, Artificial Sequence
  Description of Artificial Sequence: Synthetic oligonucleotide
gctgaccccccaaagacacatgtgacc

SEQ ID NO: 22350 - DNA, 27 bp, Artificial Sequence
  Description of Artificial Sequence: Synthetic oligonucleotide
ctgaccccccaaagacacatgtgaccc

SEQ ID NO: 22351 - DNA, 28 bp, Artificial Sequence
  Description of Artificial Sequence: Synthetic oligonucleotide
tgaccccccaaagacacatgtgacccac

SEQ ID NO: 22352 - DNA, 27 bp, Artificial Sequence
  Description of Artificial Sequence: Synthetic oligonucleotide
gaccccccaaagacacatgtgacccac

SEQ ID NO: 22353 - DNA, 27 bp, Artificial Sequence
  Description of Artificial Sequence: Synthetic oligonucleotide
accccccaaagacacatgtgacccacc

SEQ ID NO: 22354 - DNA, 27 bp, Artificial Sequence
  Description of Artificial Sequence: Synthetic oligonucleotide
ccccccaaagacacatgtgacccacca

SEQ ID NO: 22355 - DNA, 27 bp, Artificial Sequence
  Description of Artificial Sequence: Synthetic oligonucleotide
cccccaaagacacatgtgacccaccac

SEQ ID NO: 22356 - DNA, 27 bp, Artificial Sequence
  Description of Artificial Sequence: Synthetic oligonucleotide
ccccaaagacacatgtgacccaccacc

SEQ ID NO: 22357 - DNA, 27 bp, Artificial Sequence
  Description of Artificial Sequence: Synthetic oligonucleotide
cccaaagacacatgtgacccaccaccc

SEQ ID NO: 22358 - DNA, 27 bp, Artificial Sequence
  Description of Artificial Sequence: Synthetic oligonucleotide
ccaaagacacatgtgacccaccacccc

SEQ ID NO: 22359 - DNA, 29 bp, Artificial Sequence
  Description of Artificial Sequence: Synthetic oligonucleotide
caaagacacatgtgacccaccaccccatc

SEQ ID NO: 22360 - DNA, 30 bp, Artificial Sequence
  Description of Artificial Sequence: Synthetic oligonucleotide
aaagacacatgtgacccaccaccccatctc

SEQ ID NO: 22361 - DNA, 29 bp, Artificial Sequence
  Description of Artificial Sequence: Synthetic oligonucleotide
aagacacatgtgacccaccaccccatctc

SEQ ID NO: 22362 - DNA, 28 bp, Artificial Sequence
  Description of Artificial Sequence: Synthetic oligonucleotide
agacacatgtgacccaccaccccatctc

SEQ ID NO: 22363 - DNA, 27 bp, Artificial Sequence
  Description of Artificial Sequence: Synthetic oligonucleotide
gacacatgtgacccaccaccccatctc

SEQ ID NO: 22364 - DNA, 28 bp, Artificial Sequence
  Description of Artificial Sequence: Synthetic oligonucleotide
acacatgtgacccaccaccccatctctg

SEQ ID NO: 22365 - DNA, 27 bp, Artificial Sequence
  Description of Artificial Sequence: Synthetic oligonucleotide
cacatgtgacccaccaccccatctctg

SEQ ID NO: 22366 - DNA, 28 bp, Artificial Sequence
  Description of Artificial Sequence: Synthetic oligonucleotide
acatgtgacccaccaccccatctctgac

SEQ ID NO: 22367 - DNA, 27 bp, Artificial Sequence
  Description of Artificial Sequence: Synthetic oligonucleotide
catgtgacccaccaccccatctctgac

SEQ ID NO: 22368 - DNA, 27 bp, Artificial Sequence
  Description of Artificial Sequence: Synthetic oligonucleotide
atgtgacccaccaccccatctctgacc

SEQ ID NO: 22369 - DNA, 27 bp, Artificial Sequence
  Description of Artificial Sequence: Synthetic oligonucleotide
tgtgacccaccaccccatctctgacca

SEQ ID NO: 22370 - DNA, 27 bp, Artificial Sequence
  Description of Artificial Sequence: Synthetic oligonucleotide
gatggcgaggaccaaactcaggacacc

SEQ ID NO: 22371 - DNA, 27 bp, Artificial Sequence
  Description of Artificial Sequence: Synthetic oligonucleotide
atggcgaggaccaaactcaggacaccg

SEQ ID NO: 22372 - DNA, 27 bp, Artificial Sequence
  Description of Artificial Sequence: Synthetic oligonucleotide
tggcgaggaccaaactcaggacaccga

SEQ ID NO: 22373 - DNA, 26 bp, Artificial Sequence
  Description of Artificial Sequence: Synthetic oligonucleotide
ggcgaggaccaaactcaggacaccga

SEQ ID NO: 22374 - DNA, 26 bp, Artificial Sequence
  Description of Artificial Sequence: Synthetic oligonucleotide
gcgaggaccaaactcaggacaccgag

SEQ ID NO: 22375 - DNA, 27 bp, Artificial Sequence
  Description of Artificial Sequence: Synthetic oligonucleotide
cgaggaccaaactcaggacaccgagct

SEQ ID NO: 22376 - DNA, 28 bp, Artificial Sequence
  Description of Artificial Sequence: Synthetic oligonucleotide
gaggaccaaactcaggacaccgagcttg

SEQ ID NO: 22377 - DNA, 29 bp, Artificial Sequence
  Description of Artificial Sequence: Synthetic oligonucleotide
aggaccaaactcaggacaccgagcttgtg

SEQ ID NO: 22378 - DNA, 28 bp, Artificial Sequence
  Description of Artificial Sequence: Synthetic oligonucleotide
ggaccaaactcaggacaccgagcttgtg

SEQ ID NO: 22379 - DNA, 28 bp, Artificial Sequence
  Description of Artificial Sequence: Synthetic oligonucleotide
gaccaaactcaggacaccgagcttgtgg

SEQ ID NO: 22380 - DNA, 29 bp, Artificial Sequence
  Description of Artificial Sequence: Synthetic oligonucleotide
accaaactcaggacaccgagcttgtggag

SEQ ID NO: 22381 - DNA, 28 bp, Artificial Sequence
  Description of Artificial Sequence: Synthetic oligonucleotide
ccaaactcaggacaccgagcttgtggag

SEQ ID NO: 22382 - DNA, 29 bp, Artificial Sequence
  Description of Artificial Sequence: Synthetic oligonucleotide
caaactcaggacaccgagcttgtggagac

SEQ ID NO: 22383 - DNA, 29 bp, Artificial Sequence
  Description of Artificial Sequence: Synthetic oligonucleotide
aaactcaggacaccgagcttgtggagacc

SEQ ID NO: 22384 - DNA, 28 bp, Artificial Sequence
  Description of Artificial Sequence: Synthetic oligonucleotide
aactcaggacaccgagcttgtggagacc

SEQ ID NO: 22385 - DNA, 27 bp, Artificial Sequence
  Description of Artificial Sequence: Synthetic oligonucleotide
actcaggacaccgagcttgtggagacc

SEQ ID NO: 22386 - DNA, 27 bp, Artificial Sequence
  Description of Artificial Sequence: Synthetic oligonucleotide
ctcaggacaccgagcttgtggagacca

SEQ ID NO: 22387 - DNA, 27 bp, Artificial Sequence
  Description of Artificial Sequence: Synthetic oligonucleotide
tcaggacaccgagcttgtggagaccag

SEQ ID NO: 22388 - DNA, 27 bp, Artificial Sequence
  Description of Artificial Sequence: Synthetic oligonucleotide
caggacaccgagcttgtggagaccaga

SEQ ID NO: 22389 - DNA, 27 bp, Artificial Sequence
  Description of Artificial Sequence: Synthetic oligonucleotide
aggacaccgagcttgtggagaccagac

SEQ ID NO: 22390 - DNA, 26 bp, Artificial Sequence
  Description of Artificial Sequence: Synthetic oligonucleotide
ggacaccgagcttgtggagaccagac

SEQ ID NO: 22391 - DNA, 27 bp, Artificial Sequence
  Description of Artificial Sequence: Synthetic oligonucleotide
gacaccgagcttgtggagaccagacca

SEQ ID NO: 22392 - DNA, 27 bp, Artificial Sequence
  Description of Artificial Sequence: Synthetic oligonucleotide
acaccgagcttgtggagaccagaccag

SEQ ID NO: 22393 - DNA, 26 bp, Artificial Sequence
  Description of Artificial Sequence: Synthetic oligonucleotide
caccgagcttgtggagaccagaccag

SEQ ID NO: 22394 - DNA, 27 bp, Artificial Sequence
  Description of Artificial Sequence: Synthetic oligonucleotide
accgagcttgtggagaccagaccagca

SEQ ID NO: 22395 - DNA, 26 bp, Artificial Sequence
  Description of Artificial Sequence: Synthetic oligonucleotide
ccgagcttgtggagaccagaccagca

SEQ ID NO: 22396 - DNA, 26 bp, Artificial Sequence
  Description of Artificial Sequence: Synthetic oligonucleotide
cgagcttgtggagaccagaccagcag

SEQ ID NO: 22397 - DNA, 26 bp, Artificial Sequence
  Description of Artificial Sequence: Synthetic oligonucleotide
atcgccctgaatgaggacctgcgctc

SEQ ID NO: 22398 - DNA, 25 bp, Artificial Sequence
  Description of Artificial Sequence: Synthetic oligonucleotide
tcgccctgaatgaggacctgcgctc

SEQ ID NO: 22399 - DNA, 24 bp, Artificial Sequence
  Description of Artificial Sequence: Synthetic oligonucleotide
cgccctgaatgaggacctgcgctc

SEQ ID NO: 22400 - DNA, 25 bp, Artificial Sequence
  Description of Artificial Sequence: Synthetic oligonucleotide
gccctgaatgaggacctgcgctcct

SEQ ID NO: 22401 - DNA, 25 bp, Artificial Sequence
  Description of Artificial Sequence: Synthetic oligonucleotide
ccctgaatgaggacctgcgctcctg

SEQ ID NO: 22402 - DNA, 26 bp, Artificial Sequence
  Description of Artificial Sequence: Synthetic oligonucleotide
cctgaatgaggacctgcgctcctgga

SEQ ID NO: 22403 - DNA, 26 bp, Artificial Sequence
  Description of Artificial Sequence: Synthetic oligonucleotide
ctgaatgaggacctgcgctcctggac

SEQ ID NO: 22404 - DNA, 26 bp, Artificial Sequence
  Description of Artificial Sequence: Synthetic oligonucleotide
tgaatgaggacctgcgctcctggacc

SEQ ID NO: 22405 - DNA, 25 bp, Artificial Sequence
  Description of Artificial Sequence: Synthetic oligonucleotide
gaatgaggacctgcgctcctggacc

SEQ ID NO: 22406 - DNA, 25 bp, Artificial Sequence
  Description of Artificial Sequence: Synthetic oligonucleotide
aatgaggacctgcgctcctggaccg

SEQ ID NO: 22407 - DNA, 24 bp, Artificial Sequence
  Description of Artificial Sequence: Synthetic oligonucleotide
atgaggacctgcgctcctggaccg

SEQ ID NO: 22408 - DNA, 23 bp, Artificial Sequence
  Description of Artificial Sequence: Synthetic oligonucleotide
tgaggacctgcgctcctggaccg

SEQ ID NO: 22409 - DNA, 22 bp, Artificial Sequence
  Description of Artificial Sequence: Synthetic oligonucleotide
cgcgagtccgagagaggagccc

SEQ ID NO: 22410 - DNA, 22 bp, Artificial Sequence
  Description of Artificial Sequence: Synthetic oligonucleotide
gcgagtccgagagaggagcccc

SEQ ID NO: 22411 - DNA, 22 bp, Artificial Sequence
  Description of Artificial Sequence: Synthetic oligonucleotide
cgagtccgagagaggagccccg

SEQ ID NO: 22412 - DNA, 22 bp, Artificial Sequence
  Description of Artificial Sequence: Synthetic oligonucleotide
gagtccgagagaggagccccgg

SEQ ID NO: 22413 - DNA, 22 bp, Artificial Sequence
  Description of Artificial Sequence: Synthetic oligonucleotide
agtccgagagaggagccccggg

SEQ ID NO: 22414 - DNA, 21 bp, Artificial Sequence
  Description of Artificial Sequence: Synthetic oligonucleotide
gtccgagagaggagccccggg

SEQ ID NO: 22415 - DNA, 21 bp, Artificial Sequence
  Description of Artificial Sequence: Synthetic oligonucleotide
tccgagagaggagccccgggc

SEQ ID NO: 22416 - DNA, 20 bp, Artificial Sequence
  Description of Artificial Sequence: Synthetic oligonucleotide
ccgagagaggagccccgggc

SEQ ID NO: 22417 - DNA, 20 bp, Artificial Sequence
  Description of Artificial Sequence: Synthetic oligonucleotide
cgagagaggagccccgggcg

SEQ ID NO: 22418 - DNA, 20 bp, Artificial Sequence
  Description of Artificial Sequence: Synthetic oligonucleotide
gagagaggagccccgggcgc

SEQ ID NO: 22419 - DNA, 20 bp, Artificial Sequence
  Description of Artificial Sequence: Synthetic oligonucleotide
agagaggagccccgggcgcc

SEQ ID NO: 22420 - DNA, 20 bp, Artificial Sequence
  Description of Artificial Sequence: Synthetic oligonucleotide
gagaggagccccgggcgcct

SEQ ID NO: 22421 - DNA, 20 bp, Artificial Sequence
  Description of Artificial Sequence: Synthetic oligonucleotide
agaggagccccgggcgccgt

SEQ ID NO: 22422 - DNA, 20 bp, Artificial Sequence
  Description of Artificial Sequence: Synthetic oligonucleotide
gaggagccccgggcgccgtt

SEQ ID NO: 22423 - DNA, 20 bp, Artificial Sequence
  Description of Artificial Sequence: Synthetic oligonucleotide
aggagccccgggcgccgtgt

SEQ ID NO: 22424 - DNA, 20 bp, Artificial Sequence
  Description of Artificial Sequence: Synthetic oligonucleotide
ggagccccgggcgccgtgtt

SEQ ID NO: 22425 - DNA, 21 bp, Artificial Sequence
  Description of Artificial Sequence: Synthetic oligonucleotide
gagccccgggcgccgtggata

SEQ ID NO: 22426 - DNA, 22 bp, Artificial Sequence
  Description of Artificial Sequence: Synthetic oligonucleotide
agccccgggcgccgtggataga

SEQ ID NO: 22427 - DNA, 21 bp, Artificial Sequence
  Description of Artificial Sequence: Synthetic oligonucleotide
gccccgggcgccgtggataga

SEQ ID NO: 22428 - DNA, 21 bp, Artificial Sequence
  Description of Artificial Sequence: Synthetic oligonucleotide
ccccgggcgccgtggatagag

SEQ ID NO: 22429 - DNA, 22 bp, Artificial Sequence
  Description of Artificial Sequence: Synthetic oligonucleotide
cccgggcgccgtggatagagca

SEQ ID NO: 22430 - DNA, 22 bp, Artificial Sequence
  Description of Artificial Sequence: Synthetic oligonucleotide
ccgggcgccgtggatagagcag

SEQ ID NO: 22431 - DNA, 27 bp, Artificial Sequence
  Description of Artificial Sequence: Synthetic oligonucleotide
caccccatctctgaccatgaggccaca

SEQ ID NO: 22432 - DNA, 27 bp, Artificial Sequence
  Description of Artificial Sequence: Synthetic oligonucleotide
accccatctctgaccatgaggccacac

SEQ ID NO: 22433 - DNA, 27 bp, Artificial Sequence
  Description of Artificial Sequence: Synthetic oligonucleotide
ccccatctctgaccatgaggccacact

SEQ ID NO: 22434 - DNA, 27 bp, Artificial Sequence
  Description of Artificial Sequence: Synthetic oligonucleotide
cccatctctgaccatgaggccacactg

SEQ ID NO: 22435 - DNA, 28 bp, Artificial Sequence
  Description of Artificial Sequence: Synthetic oligonucleotide
ccatctctgaccatgaggccacactgag

SEQ ID NO: 22436 - DNA, 28 bp, Artificial Sequence
  Description of Artificial Sequence: Synthetic oligonucleotide
catctctgaccatgaggccacactgagg

SEQ ID NO: 22437 - DNA, 29 bp, Artificial Sequence
  Description of Artificial Sequence: Synthetic oligonucleotide
atctctgaccatgaggccacactgaggtg

SEQ ID NO: 22438 - DNA, 28 bp, Artificial Sequence
  Description of Artificial Sequence: Synthetic oligonucleotide
tctctgaccatgaggccacactgaggtg

SEQ ID NO: 22439 - DNA, 27 bp, Artificial Sequence
  Description of Artificial Sequence: Synthetic oligonucleotide
ctctgaccatgaggccacactgaggtg

SEQ ID NO: 22440 - DNA, 27 bp, Artificial Sequence
  Description of Artificial Sequence: Synthetic oligonucleotide
tctgaccatgaggccacactgaggtgc

SEQ ID NO: 22441 - DNA, 27 bp, Artificial Sequence
  Description of Artificial Sequence: Synthetic oligonucleotide
ctgaccatgaggccacactgaggtgct

SEQ ID NO: 22442 - DNA, 27 bp, Artificial Sequence
  Description of Artificial Sequence: Synthetic oligonucleotide
tgaccatgaggccacactgaggtgctg

SEQ ID NO: 22443 - DNA, 26 bp, Artificial Sequence
  Description of Artificial Sequence: Synthetic oligonucleotide
gaccatgaggccacactgaggtgctg

SEQ ID NO: 22444 - DNA, 26 bp, Artificial Sequence
  Description of Artificial Sequence: Synthetic oligonucleotide
accatgaggccacactgaggtgctgg

SEQ ID NO: 22445 - DNA, 25 bp, Artificial Sequence
  Description of Artificial Sequence: Synthetic oligonucleotide
ccatgaggccacactgaggtgctgg

SEQ ID NO: 22446 - DNA, 25 bp, Artificial Sequence
  Description of Artificial Sequence: Synthetic oligonucleotide
catgaggccacactgaggtgctggg

SEQ ID NO: 22447 - DNA, 25 bp, Artificial Sequence
  Description of Artificial Sequence: Synthetic oligonucleotide
atgaggccacactgaggtgctgggc

SEQ ID NO: 22448 - DNA, 24 bp, Artificial Sequence
  Description of Artificial Sequence: Synthetic oligonucleotide
tgaggccacactgaggtgctgggc

SEQ ID NO: 22449 - DNA, 23 bp, Artificial Sequence
  Description of Artificial Sequence: Synthetic oligonucleotide
gaggccacactgaggtgctgggc

SEQ ID NO: 22450 - DNA, 23 bp, Artificial Sequence
  Description of Artificial Sequence: Synthetic oligonucleotide
aggccacactgaggtgctgggcc

SEQ ID NO: 22451 - DNA, 22 bp, Artificial Sequence
  Description of Artificial Sequence: Synthetic oligonucleotide
ggccacactgaggtgctgggcc

SEQ ID NO: 22452 - DNA, 23 bp, Artificial Sequence
  Description of Artificial Sequence: Synthetic oligonucleotide
gccacactgaggtgctgggccct

SEQ ID NO: 22453 - DNA, 23 bp, Artificial Sequence
  Description of Artificial Sequence: Synthetic oligonucleotide
ccacactgaggtgctgggccctg

SEQ ID NO: 22454 - DNA, 23 bp, Artificial Sequence
  Description of Artificial Sequence: Synthetic oligonucleotide
cacactgaggtgctgggccctgg

SEQ ID NO: 22455 - DNA, 26 bp, Artificial Sequence
  Description of Artificial Sequence: Synthetic oligonucleotide
acactgaggtgctgggccctgggttt

SEQ ID NO: 22456 - DNA, 25 bp, Artificial Sequence
  Description of Artificial Sequence: Synthetic oligonucleotide
cactgaggtgctgggccctgggttt

SEQ ID NO: 22457 - DNA, 27 bp, Artificial Sequence
  Description of Artificial Sequence: Synthetic oligonucleotide
actgaggtgctgggccctgggtttcta

SEQ ID NO: 22458 - DNA, 20 bp, Artificial Sequence
  Description of Artificial Sequence: Synthetic oligonucleotide
gccggacgggcgcctccttc

SEQ ID NO: 22459 - DNA, 20 bp, Artificial Sequence
  Description of Artificial Sequence: Synthetic oligonucleotide
ccggacgggcgcctccttcg

SEQ ID NO: 22460 - DNA, 20 bp, Artificial Sequence
  Description of Artificial Sequence: Synthetic oligonucleotide
cggacgggcgcctccttcgc

SEQ ID NO: 22461 - DNA, 20 bp, Artificial Sequence
  Description of Artificial Sequence: Synthetic oligonucleotide
ggacgggcgcctccttcgcg

SEQ ID NO: 22462 - DNA, 20 bp, Artificial Sequence
  Description of Artificial Sequence: Synthetic oligonucleotide
gacgggcgcctccttcgcgg

SEQ ID NO: 22463 - DNA, 20 bp, Artificial Sequence
  Description of Artificial Sequence: Synthetic oligonucleotide
acgggcgcctccttcgcggg

SEQ ID NO: 22464 - DNA, 20 bp, Artificial Sequence
  Description of Artificial Sequence: Synthetic oligonucleotide
cgggcgcctccttcgcgggt

SEQ ID NO: 22465 - DNA, 21 bp, Artificial Sequence
  Description of Artificial Sequence: Synthetic oligonucleotide
gggcgcctccttcgcgggcat

SEQ ID NO: 22466 - DNA, 22 bp, Artificial Sequence
  Description of Artificial Sequence: Synthetic oligonucleotide
ggcgcctccttcgcgggcatga

SEQ ID NO: 22467 - DNA, 22 bp, Artificial Sequence
  Description of Artificial Sequence: Synthetic oligonucleotide
gcgcctccttcgcgggcatgac

SEQ ID NO: 22468 - DNA, 23 bp, Artificial Sequence
  Description of Artificial Sequence: Synthetic oligonucleotide
cgcctccttcgcgggcatgacca

SEQ ID NO: 22469 - DNA, 25 bp, Artificial Sequence
  Description of Artificial Sequence: Synthetic oligonucleotide
gcctccttcgcgggcatgaccagta

SEQ ID NO: 22470 - DNA, 25 bp, Artificial Sequence
  Description of Artificial Sequence: Synthetic oligonucleotide
cctccttcgcgggcatgaccagtac

SEQ ID NO: 22471 - DNA, 25 bp, Artificial Sequence
  Description of Artificial Sequence: Synthetic oligonucleotide
ctccttcgcgggcatgaccagtacg

SEQ ID NO: 22472 - DNA, 25 bp, Artificial Sequence
  Description of Artificial Sequence: Synthetic oligonucleotide
tccttcgcgggcatgaccagtacgc

SEQ ID NO: 22473 - DNA, 24 bp, Artificial Sequence
  Description of Artificial Sequence: Synthetic oligonucleotide
ccttcgcgggcatgaccagtacgc

SEQ ID NO: 22474 - DNA, 26 bp, Artificial Sequence
  Description of Artificial Sequence: Synthetic oligonucleotide
cttcgcgggcatgaccagtacgccta

SEQ ID NO: 22475 - DNA, 26 bp, Artificial Sequence
  Description of Artificial Sequence: Synthetic oligonucleotide
ttcgcgggcatgaccagtacgcctac

SEQ ID NO: 22476 - DNA, 25 bp, Artificial Sequence
  Description of Artificial Sequence: Synthetic oligonucleotide
tcgcgggcatgaccagtacgcctac

SEQ ID NO: 22477 - DNA, 28 bp, Artificial Sequence
  Description of Artificial Sequence: Synthetic oligonucleotide
catgaccagtacgcctacgacggcaaag

SEQ ID NO: 22478 - DNA, 32 bp, Artificial Sequence
  Description of Artificial Sequence: Synthetic oligonucleotide
atgaccagtacgcctacgacggcaaagattac

SEQ ID NO: 22479 - DNA, 31 bp, Artificial Sequence
  Description of Artificial Sequence: Synthetic oligonucleotide
tgaccagtacgcctacgacggcaaagattac

SEQ ID NO: 22480 - DNA, 30 bp, Artificial Sequence
  Description of Artificial Sequence: Synthetic oligonucleotide
gaccagtacgcctacgacggcaaagattac

SEQ ID NO: 22481 - DNA, 32 bp, Artificial Sequence
  Description of Artificial Sequence: Synthetic oligonucleotide
accagtacgcctacgacggcaaagattacatc

SEQ ID NO: 22482 - DNA, 31 bp, Artificial Sequence
  Description of Artificial Sequence: Synthetic oligonucleotide
ccagtacgcctacgacggcaaagattacatc

SEQ ID NO: 22483 - DNA, 31 bp, Artificial Sequence
  Description of Artificial Sequence: Synthetic oligonucleotide
cagtacgcctacgacggcaaagattacatcg

SEQ ID NO: 22484 - DNA, 31 bp, Artificial Sequence
  Description of Artificial Sequence: Synthetic oligonucleotide
agtacgcctacgacggcaaagattacatcgc

SEQ ID NO: 22485 - DNA, 30 bp, Artificial Sequence
  Description of Artificial Sequence: Synthetic oligonucleotide
gtacgcctacgacggcaaagattacatcgc

SEQ ID NO: 22486 - DNA, 30 bp, Artificial Sequence
  Description of Artificial Sequence: Synthetic oligonucleotide
tacgcctacgacggcaaagattacatcgcc

SEQ ID NO: 22487 - DNA, 29 bp, Artificial Sequence
  Description of Artificial Sequence: Synthetic oligonucleotide
acgcctacgacggcaaagattacatcgcc

SEQ ID NO: 22488 - DNA, 28 bp, Artificial Sequence
  Description of Artificial Sequence: Synthetic oligonucleotide
cgcctacgacggcaaagattacatcgcc

SEQ ID NO: 22489 - DNA, 28 bp, Artificial Sequence
  Description of Artificial Sequence: Synthetic oligonucleotide
gcctacgacggcaaagattacatcgccc

SEQ ID NO: 22490 - DNA, 29 bp, Artificial Sequence
  Description of Artificial Sequence: Synthetic oligonucleotide
cctacgacggcaaagattacatcgccctg

SEQ ID NO: 22491 - DNA, 31 bp, Artificial Sequence
  Description of Artificial Sequence: Synthetic oligonucleotide
ctacgacggcaaagattacatcgccctgaac

SEQ ID NO: 22492 - DNA, 31 bp, Artificial Sequence
  Description of Artificial Sequence: Synthetic oligonucleotide
tacgacggcaaagattacatcgccctgaacg

SEQ ID NO: 22493 - DNA, 30 bp, Artificial Sequence
  Description of Artificial Sequence: Synthetic oligonucleotide
acgacggcaaagattacatcgccctgaacg

SEQ ID NO: 22494 - DNA, 29 bp, Artificial Sequence
  Description of Artificial Sequence: Synthetic oligonucleotide
cgacggcaaagattacatcgccctgaacg

SEQ ID NO: 22495 - DNA, 30 bp, Artificial Sequence
  Description of Artificial Sequence: Synthetic oligonucleotide
gacggcaaagattacatcgccctgaacgag

SEQ ID NO: 22496 - DNA, 30 bp, Artificial Sequence
  Description of Artificial Sequence: Synthetic oligonucleotide
acggcaaagattacatcgccctgaacgagg

SEQ ID NO: 22497 - DNA, 29 bp, Artificial Sequence
  Description of Artificial Sequence: Synthetic oligonucleotide
cggcaaagattacatcgccctgaacgagg

SEQ ID NO: 22498 - DNA, 30 bp, Artificial Sequence
  Description of Artificial Sequence: Synthetic oligonucleotide
ggcaaagattacatcgccctgaacgaggac

SEQ ID NO: 22499 - DNA, 30 bp, Artificial Sequence
  Description of Artificial Sequence: Synthetic oligonucleotide
gcaaagattacatcgccctgaacgaggacc

SEQ ID NO: 22500 - DNA, 31 bp, Artificial Sequence
  Description of Artificial Sequence: Synthetic oligonucleotide
caaagattacatcgccctgaacgaggacctg

SEQ ID NO: 22501 - DNA, 31 bp, Artificial Sequence
  Description of Artificial Sequence: Synthetic oligonucleotide
aaagattacatcgccctgaacgaggacctgc

SEQ ID NO: 22502 - DNA, 30 bp, Artificial Sequence
  Description of Artificial Sequence: Synthetic oligonucleotide
aagattacatcgccctgaacgaggacctgc

SEQ ID NO: 22503 - DNA, 29 bp, Artificial Sequence
  Description of Artificial Sequence: Synthetic oligonucleotide
agattacatcgccctgaacgaggacctgc

SEQ ID NO: 22504 - DNA, 20 bp, Artificial Sequence
  Description of Artificial Sequence: Synthetic oligonucleotide
acgtggggccggatgggcgc

SEQ ID NO: 22505 - DNA, 20 bp, Artificial Sequence
  Description of Artificial Sequence: Synthetic oligonucleotide
cgtggggccggatgggcgct

SEQ ID NO: 22506 - DNA, 20 bp, Artificial Sequence
  Description of Artificial Sequence: Synthetic oligonucleotide
gtggggccggatgggcgcct

SEQ ID NO: 22507 - DNA, 20 bp, Artificial Sequence
  Description of Artificial Sequence: Synthetic oligonucleotide
tggggccggatgggcgcctc

SEQ ID NO: 22508 - DNA, 20 bp, Artificial Sequence
  Description of Artificial Sequence: Synthetic oligonucleotide
ggggccggatgggcgcctct

SEQ ID NO: 22509 - DNA, 20 bp, Artificial Sequence
  Description of Artificial Sequence: Synthetic oligonucleotide
gggccggatgggcgcctcct

SEQ ID NO: 22510 - DNA, 20 bp, Artificial Sequence
  Description of Artificial Sequence: Synthetic oligonucleotide
ggccggatgggcgcctcctc

SEQ ID NO: 22511 - DNA, 20 bp, Artificial Sequence
  Description of Artificial Sequence: Synthetic oligonucleotide
gccggatgggcgcctcctcc

SEQ ID NO: 22512 - DNA, 20 bp, Artificial Sequence
  Description of Artificial Sequence: Synthetic oligonucleotide
ccggatgggcgcctcctccg

SEQ ID NO: 22513 - DNA, 20 bp, Artificial Sequence
  Description of Artificial Sequence: Synthetic oligonucleotide
cggatgggcgcctcctccgc

SEQ ID NO: 22514 - DNA, 20 bp, Artificial Sequence
  Description of Artificial Sequence: Synthetic oligonucleotide
ggatgggcgcctcctccgcg

SEQ ID NO: 22515 - DNA, 20 bp, Artificial Sequence
  Description of Artificial Sequence: Synthetic oligonucleotide
gatgggcgcctcctccgcgg

SEQ ID NO: 22516 - DNA, 20 bp, Artificial Sequence
  Description of Artificial Sequence: Synthetic oligonucleotide
atgggcgcctcctccgcggg

SEQ ID NO: 22517 - DNA, 20 bp, Artificial Sequence
  Description of Artificial Sequence: Synthetic oligonucleotide
tgggcgcctcctccgcgggt

SEQ ID NO: 22518 - DNA, 21 bp, Artificial Sequence
  Description of Artificial Sequence: Synthetic oligonucleotide
tcctggaccgccgcggacacc

SEQ ID NO: 22519 - DNA, 20 bp, Artificial Sequence
  Description of Artificial Sequence: Synthetic oligonucleotide
cctggaccgccgcggacacc

SEQ ID NO: 22520 - DNA, 20 bp, Artificial Sequence
  Description of Artificial Sequence: Synthetic oligonucleotide
ctggaccgccgcggacaccg

SEQ ID NO: 22521 - DNA, 20 bp, Artificial Sequence
  Description of Artificial Sequence: Synthetic oligonucleotide
tggaccgccgcggacaccgc

SEQ ID NO: 22522 - DNA, 20 bp, Artificial Sequence
  Description of Artificial Sequence: Synthetic oligonucleotide
ggaccgccgcggacaccgct

SEQ ID NO: 22523 - DNA, 20 bp, Artificial Sequence
  Description of Artificial Sequence: Synthetic oligonucleotide
gaccgccgcggacaccgcgt

SEQ ID NO: 22524 - DNA, 20 bp, Artificial Sequence
  Description of Artificial Sequence: Synthetic oligonucleotide
accgccgcggacaccgcggt

SEQ ID NO: 22525 - DNA, 20 bp, Artificial Sequence
  Description of Artificial Sequence: Synthetic oligonucleotide
ccgccgcggacaccgcggtt

SEQ ID NO: 22526 - DNA, 20 bp, Artificial Sequence
  Description of Artificial Sequence: Synthetic oligonucleotide
cgccgcggacaccgcggctt

SEQ ID NO: 22527 - DNA, 20 bp, Artificial Sequence
  Description of Artificial Sequence: Synthetic oligonucleotide
gccgcggacaccgcggctca

SEQ ID NO: 22528 - DNA, 22 bp, Artificial Sequence
  Description of Artificial Sequence: Synthetic oligonucleotide
ccgcggacaccgcggctcagat

SEQ ID NO: 22529 - DNA, 23 bp, Artificial Sequence
  Description of Artificial Sequence: Synthetic oligonucleotide
cgcggacaccgcggctcagatca

SEQ ID NO: 22530 - DNA, 23 bp, Artificial Sequence
  Description of Artificial Sequence: Synthetic oligonucleotide
cggacaccgcggctcagatcacc

SEQ ID NO: 22531 - DNA, 24 bp, Artificial Sequence
  Description of Artificial Sequence: Synthetic oligonucleotide
ggacaccgcggctcagatcaccca

SEQ ID NO: 22532 - DNA, 24 bp, Artificial Sequence
  Description of Artificial Sequence: Synthetic oligonucleotide
gacaccgcggctcagatcacccag

SEQ ID NO: 22533 - DNA, 24 bp, Artificial Sequence
  Description of Artificial Sequence: Synthetic oligonucleotide
acaccgcggctcagatcacccagc

SEQ ID NO: 22534 - DNA, 23 bp, Artificial Sequence
  Description of Artificial Sequence: Synthetic oligonucleotide
caccgcggctcagatcacccagc

SEQ ID NO: 22535 - DNA, 23 bp, Artificial Sequence
  Description of Artificial Sequence: Synthetic oligonucleotide
accgcggctcagatcacccagcg

SEQ ID NO: 22536 - DNA, 22 bp, Artificial Sequence
  Description of Artificial Sequence: Synthetic oligonucleotide
ccgcggctcagatcacccagcg

SEQ ID NO: 22537 - DNA, 24 bp, Artificial Sequence
  Description of Artificial Sequence: Synthetic oligonucleotide
cgcggctcagatcacccagcgcaa

SEQ ID NO: 22538 - DNA, 21 bp, Artificial Sequence
  Description of Artificial Sequence: Synthetic oligonucleotide
gctcctggaccgcggcggaca

SEQ ID NO: 22539 - DNA, 21 bp, Artificial Sequence
  Description of Artificial Sequence: Synthetic oligonucleotide
ctcctggaccgcggcggacac

SEQ ID NO: 22540 - DNA, 21 bp, Artificial Sequence
  Description of Artificial Sequence: Synthetic oligonucleotide
tcctggaccgcggcggacacg

SEQ ID NO: 22541 - DNA, 20 bp, Artificial Sequence
  Description of Artificial Sequence: Synthetic oligonucleotide
cctggaccgcggcggacacg

SEQ ID NO: 22542 - DNA, 20 bp, Artificial Sequence
  Description of Artificial Sequence: Synthetic oligonucleotide
ctggaccgcggcggacacgg

SEQ ID NO: 22543 - DNA, 24 bp, Artificial Sequence
  Description of Artificial Sequence: Synthetic oligonucleotide
cagcggagagcctacctggagggt

SEQ ID NO: 22544 - DNA, 25 bp, Artificial Sequence
  Description of Artificial Sequence: Synthetic oligonucleotide
agcggagagcctacctggagggtga

SEQ ID NO: 22545 - DNA, 24 bp, Artificial Sequence
  Description of Artificial Sequence: Synthetic oligonucleotide
gcggagagcctacctggagggtga

SEQ ID NO: 22546 - DNA, 25 bp, Artificial Sequence
  Description of Artificial Sequence: Synthetic oligonucleotide
cggagagcctacctggagggtgagt

SEQ ID NO: 22547 - DNA, 25 bp, Artificial Sequence
  Description of Artificial Sequence: Synthetic oligonucleotide
ggagagcctacctggagggtgagtg

SEQ ID NO: 22548 - DNA, 25 bp, Artificial Sequence
  Description of Artificial Sequence: Synthetic oligonucleotide
gagagcctacctggagggtgagtgc

SEQ ID NO: 22549 - DNA, 26 bp, Artificial Sequence
  Description of Artificial Sequence: Synthetic oligonucleotide
agagcctacctggagggtgagtgcgt

SEQ ID NO: 22550 - DNA, 25 bp, Artificial Sequence
  Description of Artificial Sequence: Synthetic oligonucleotide
gagcctacctggagggtgagtgcgt

SEQ ID NO: 22551 - DNA, 25 bp, Artificial Sequence
  Description of Artificial Sequence: Synthetic oligonucleotide
agcctacctggagggtgagtgcgtg

SEQ ID NO: 22552 - DNA, 24 bp, Artificial Sequence
  Description of Artificial Sequence: Synthetic oligonucleotide
gcctacctggagggtgagtgcgtg

SEQ ID NO: 22553 - DNA, 25 bp, Artificial Sequence
  Description of Artificial Sequence: Synthetic oligonucleotide
cctacctggagggtgagtgcgtgga

SEQ ID NO: 22554 - DNA, 26 bp, Artificial Sequence
  Description of Artificial Sequence: Synthetic oligonucleotide
ctacctggagggtgagtgcgtggagt

SEQ ID NO: 22555 - DNA, 26 bp, Artificial Sequence
  Description of Artificial Sequence: Synthetic oligonucleotide
tacctggagggtgagtgcgtggagtg

SEQ ID NO: 22556 - DNA, 25 bp, Artificial Sequence
  Description of Artificial Sequence: Synthetic oligonucleotide
acctggagggtgagtgcgtggagtg

SEQ ID NO: 22557 - DNA, 24 bp, Artificial Sequence
  Description of Artificial Sequence: Synthetic oligonucleotide
cctggagggtgagtgcgtggagtg

SEQ ID NO: 22558 - DNA, 24 bp, Artificial Sequence
  Description of Artificial Sequence: Synthetic oligonucleotide
ctggagggtgagtgcgtggagtgg

SEQ ID NO: 22559 - DNA, 25 bp, Artificial Sequence
  Description of Artificial Sequence: Synthetic oligonucleotide
tggagggtgagtgcgtggagtggct

SEQ ID NO: 22560 - DNA, 24 bp, Artificial Sequence
  Description of Artificial Sequence: Synthetic oligonucleotide
ggagggtgagtgcgtggagtggct

SEQ ID NO: 22561 - DNA, 24 bp, Artificial Sequence
  Description of Artificial Sequence: Synthetic oligonucleotide
gagggtgagtgcgtggagtggctc

SEQ ID NO: 22562 - DNA, 24 bp, Artificial Sequence
  Description of Artificial Sequence: Synthetic oligonucleotide
agggtgagtgcgtggagtggctcc

SEQ ID NO: 22563 - DNA, 23 bp, Artificial Sequence
  Description of Artificial Sequence: Synthetic oligonucleotide
gggtgagtgcgtggagtggctcc

SEQ ID NO: 22564 - DNA, 23 bp, Artificial Sequence
  Description of Artificial Sequence: Synthetic oligonucleotide
ggtgagtgcgtggagtggctccg

SEQ ID NO: 22565 - DNA, 24 bp, Artificial Sequence
  Description of Artificial Sequence: Synthetic oligonucleotide
gtgagtgcgtggagtggctccgca

SEQ ID NO: 22566 - DNA, 27 bp, Artificial Sequence
  Description of Artificial Sequence: Synthetic oligonucleotide
tgagtgcgtggagtggctccgcagata

SEQ ID NO: 22567 - DNA, 27 bp, Artificial Sequence
  Description of Artificial Sequence: Synthetic oligonucleotide
cctgcggaacctgcgcggctactataa

SEQ ID NO: 22568 - DNA, 27 bp, Artificial Sequence
  Description of Artificial Sequence: Synthetic oligonucleotide
ctgcggaacctgcgcggctactataac

SEQ ID NO: 22569 - DNA, 27 bp, Artificial Sequence
  Description of Artificial Sequence: Synthetic oligonucleotide
tgcggaacctgcgcggctactataacc

SEQ ID NO: 22570 - DNA, 27 bp, Artificial Sequence
  Description of Artificial Sequence: Synthetic oligonucleotide
gcggaacctgcgcggctactataacca

SEQ ID NO: 22571 - DNA, 27 bp, Artificial Sequence
  Description of Artificial Sequence: Synthetic oligonucleotide
cggaacctgcgcggctactataaccag

SEQ ID NO: 22572 - DNA, 28 bp, Artificial Sequence
  Description of Artificial Sequence: Synthetic oligonucleotide
ggaacctgcgcggctactataaccagag

SEQ ID NO: 22573 - DNA, 28 bp, Artificial Sequence
  Description of Artificial Sequence: Synthetic oligonucleotide
gaacctgcgcggctactataaccagagc

SEQ ID NO: 22574 - DNA, 28 bp, Artificial Sequence
  Description of Artificial Sequence: Synthetic oligonucleotide
aacctgcgcggctactataaccagagcg

SEQ ID NO: 22575 - DNA, 27 bp, Artificial Sequence
  Description of Artificial Sequence: Synthetic oligonucleotide
acctgcgcggctactataaccagagcg

SEQ ID NO: 22576 - DNA, 27 bp, Artificial Sequence
  Description of Artificial Sequence: Synthetic oligonucleotide
cctgcgcggctactataaccagagcga

SEQ ID NO: 22577 - DNA, 27 bp, Artificial Sequence
  Description of Artificial Sequence: Synthetic oligonucleotide
ctgcgcggctactataaccagagcgag

SEQ ID NO: 22578 - DNA, 27 bp, Artificial Sequence
  Description of Artificial Sequence: Synthetic oligonucleotide
tgcgcggctactataaccagagcgagg

SEQ ID NO: 22579 - DNA, 26 bp, Artificial Sequence
  Description of Artificial Sequence: Synthetic oligonucleotide
gcgcggctactataaccagagcgagg

SEQ ID NO: 22580 - DNA, 26 bp, Artificial Sequence
  Description of Artificial Sequence: Synthetic oligonucleotide
cgcggctactataaccagagcgaggc

SEQ ID NO: 22581 - DNA, 26 bp, Artificial Sequence
  Description of Artificial Sequence: Synthetic oligonucleotide
gcggctactataaccagagcgaggcc

SEQ ID NO: 22582 - DNA, 26 bp, Artificial Sequence
  Description of Artificial Sequence: Synthetic oligonucleotide
cggctactataaccagagcgaggccg

SEQ ID NO: 22583 - DNA, 26 bp, Artificial Sequence
  Description of Artificial Sequence: Synthetic oligonucleotide
ggctactataaccagagcgaggccgg

SEQ ID NO: 22584 - DNA, 27 bp, Artificial Sequence
  Description of Artificial Sequence: Synthetic oligonucleotide
gctactataaccagagcgaggccgggt

SEQ ID NO: 22585 - DNA, 27 bp, Artificial Sequence
  Description of Artificial Sequence: Synthetic oligonucleotide
ctactataaccagagcgaggccgggtc

SEQ ID NO: 22586 - DNA, 28 bp, Artificial Sequence
  Description of Artificial Sequence: Synthetic oligonucleotide
tactataaccagagcgaggccgggtctc

SEQ ID NO: 22587 - DNA, 27 bp, Artificial Sequence
  Description of Artificial Sequence: Synthetic oligonucleotide
actataaccagagcgaggccgggtctc

SEQ ID NO: 22588 - DNA, 27 bp, Artificial Sequence
  Description of Artificial Sequence: Synthetic oligonucleotide
ctataaccagagcgaggccgggtctca

SEQ ID NO: 22589 - DNA, 27 bp, Artificial Sequence
  Description of Artificial Sequence: Synthetic oligonucleotide
tataaccagagcgaggccgggtctcac

SEQ ID NO: 22590 - DNA, 27 bp, Artificial Sequence
  Description of Artificial Sequence: Synthetic oligonucleotide
ataaccagagcgaggccgggtctcaca

SEQ ID NO: 22591 - DNA, 26 bp, Artificial Sequence
  Description of Artificial Sequence: Synthetic oligonucleotide
taaccagagcgaggccgggtctcaca

SEQ ID NO: 22592 - DNA, 27 bp, Artificial Sequence
  Description of Artificial Sequence: Synthetic oligonucleotide
tctcacaccctccagagcatgtacggg

SEQ ID NO: 22593 - DNA, 27 bp, Artificial Sequence
  Description of Artificial Sequence: Synthetic oligonucleotide
ctcacaccctccagagcatgtacgggt

SEQ ID NO: 22594 - DNA, 27 bp, Artificial Sequence
  Description of Artificial Sequence: Synthetic oligonucleotide
tcacaccctccagagcatgtacgggtg

SEQ ID NO: 22595 - DNA, 26 bp, Artificial Sequence
  Description of Artificial Sequence: Synthetic oligonucleotide
cacaccctccagagcatgtacgggtg

SEQ ID NO: 22596 - DNA, 26 bp, Artificial Sequence
  Description of Artificial Sequence: Synthetic oligonucleotide
acaccctccagagcatgtacgggtgc

SEQ ID NO: 22597 - DNA, 25 bp, Artificial Sequence
  Description of Artificial Sequence: Synthetic oligonucleotide
caccctccagagcatgtacgggtgc

SEQ ID NO: 22598 - DNA, 26 bp, Artificial Sequence
  Description of Artificial Sequence: Synthetic oligonucleotide
accctccagagcatgtacgggtgcga

SEQ ID NO: 22599 - DNA, 25 bp, Artificial Sequence
  Description of Artificial Sequence: Synthetic oligonucleotide
ccctccagagcatgtacgggtgcga

SEQ ID NO: 22600 - DNA, 25 bp, Artificial Sequence
  Description of Artificial Sequence: Synthetic oligonucleotide
cctccagagcatgtacgggtgcgac

SEQ ID NO: 22601 - DNA, 26 bp, Artificial Sequence
  Description of Artificial Sequence: Synthetic oligonucleotide
ctccagagcatgtacgggtgcgacgt

SEQ ID NO: 22602 - DNA, 26 bp, Artificial Sequence
  Description of Artificial Sequence: Synthetic oligonucleotide
tccagagcatgtacgggtgcgacgtg

SEQ ID NO: 22603 - DNA, 25 bp, Artificial Sequence
  Description of Artificial Sequence: Synthetic oligonucleotide
ccagagcatgtacgggtgcgacgtg

SEQ ID NO: 22604 - DNA, 25 bp, Artificial Sequence
  Description of Artificial Sequence: Synthetic oligonucleotide
cagagcatgtacgggtgcgacgtgg

SEQ ID NO: 22605 - DNA, 25 bp, Artificial Sequence
  Description of Artificial Sequence: Synthetic oligonucleotide
agagcatgtacgggtgcgacgtggg

SEQ ID NO: 22606 - DNA, 24 bp, Artificial Sequence
  Description of Artificial Sequence: Synthetic oligonucleotide
gagcatgtacgggtgcgacgtggg

SEQ ID NO: 22607 - DNA, 24 bp, Artificial Sequence
  Description of Artificial Sequence: Synthetic oligonucleotide
agcatgtacgggtgcgacgtgggg

SEQ ID NO: 22608 - DNA, 23 bp, Artificial Sequence
  Description of Artificial Sequence: Synthetic oligonucleotide
gcatgtacgggtgcgacgtgggg

SEQ ID NO: 22609 - DNA, 23 bp, Artificial Sequence
  Description of Artificial Sequence: Synthetic oligonucleotide
catgtacgggtgcgacgtggggc

SEQ ID NO: 22610 - DNA, 23 bp, Artificial Sequence
  Description of Artificial Sequence: Synthetic oligonucleotide
atgtacgggtgcgacgtggggcc

SEQ ID NO: 22611 - DNA, 22 bp, Artificial Sequence
  Description of Artificial Sequence: Synthetic oligonucleotide
tgtacgggtgcgacgtggggcc

SEQ ID NO: 22612 - DNA, 21 bp, Artificial Sequence
  Description of Artificial Sequence: Synthetic oligonucleotide
gtacgggtgcgacgtggggcc

SEQ ID NO: 22613 - DNA, 21 bp, Artificial Sequence
  Description of Artificial Sequence: Synthetic oligonucleotide
tacgggtgcgacgtggggccg

SEQ ID NO: 22614 - DNA, 20 bp, Artificial Sequence
  Description of Artificial Sequence: Synthetic oligonucleotide
acgggtgcgacgtggggccg

SEQ ID NO: 22615 - DNA, 20 bp, Artificial Sequence
  Description of Artificial Sequence: Synthetic oligonucleotide
cgggtgcgacgtggggccgt

SEQ ID NO: 22616 - DNA, 20 bp, Artificial Sequence
  Description of Artificial Sequence: Synthetic oligonucleotide
gggtgcgacgtggggccgga

SEQ ID NO: 22617 - DNA, 20 bp, Artificial Sequence
  Description of Artificial Sequence: Synthetic oligonucleotide
ggtgcgacgtggggccggac

SEQ ID NO: 22618 - DNA, 20 bp, Artificial Sequence
  Description of Artificial Sequence: Synthetic oligonucleotide
gtgcgacgtggggccggacg

SEQ ID NO: 22619 - DNA, 20 bp, Artificial Sequence
  Description of Artificial Sequence: Synthetic oligonucleotide
ggacgggcgcctcctccgtg

SEQ ID NO: 22620 - DNA, 20 bp, Artificial Sequence
  Description of Artificial Sequence: Synthetic oligonucleotide
gacgggcgcctcctccgtgg

SEQ ID NO: 22621 - DNA, 20 bp, Artificial Sequence
  Description of Artificial Sequence: Synthetic oligonucleotide
acgggcgcctcctccgtggg

SEQ ID NO: 22622 - DNA, 20 bp, Artificial Sequence
  Description of Artificial Sequence: Synthetic oligonucleotide
cgggcgcctcctccgtgggt

SEQ ID NO: 22623 - DNA, 21 bp, Artificial Sequence
  Description of Artificial Sequence: Synthetic oligonucleotide
gggcgcctcctccgtgggcat

SEQ ID NO: 22624 - DNA, 22 bp, Artificial Sequence
  Description of Artificial Sequence: Synthetic oligonucleotide
ggcgcctcctccgtgggcatga

SEQ ID NO: 22625 - DNA, 22 bp, Artificial Sequence
  Description of Artificial Sequence: Synthetic oligonucleotide
gcgcctcctccgtgggcatgac

SEQ ID NO: 22626 - DNA, 23 bp, Artificial Sequence
  Description of Artificial Sequence: Synthetic oligonucleotide
cgcctcctccgtgggcatgacca

SEQ ID NO: 22627 - DNA, 25 bp, Artificial Sequence
  Description of Artificial Sequence: Synthetic oligonucleotide
gcctcctccgtgggcatgaccagta

SEQ ID NO: 22628 - DNA, 25 bp, Artificial Sequence
  Description of Artificial Sequence: Synthetic oligonucleotide
cctcctccgtgggcatgaccagtac

SEQ ID NO: 22629 - DNA, 25 bp, Artificial Sequence
  Description of Artificial Sequence: Synthetic oligonucleotide
ctcctccgtgggcatgaccagtacg

SEQ ID NO: 22630 - DNA, 25 bp, Artificial Sequence
  Description of Artificial Sequence: Synthetic oligonucleotide
tcctccgtgggcatgaccagtacgc

SEQ ID NO: 22631 - DNA, 24 bp, Artificial Sequence
  Description of Artificial Sequence: Synthetic oligonucleotide
cctccgtgggcatgaccagtacgc

SEQ ID NO: 22632 - DNA, 26 bp, Artificial Sequence
  Description of Artificial Sequence: Synthetic oligonucleotide
ctccgtgggcatgaccagtacgccta

SEQ ID NO: 22633 - DNA, 26 bp, Artificial Sequence
  Description of Artificial Sequence: Synthetic oligonucleotide
tccgtgggcatgaccagtacgcctac

SEQ ID NO: 22634 - DNA, 25 bp, Artificial Sequence
  Description of Artificial Sequence: Synthetic oligonucleotide
ccgtgggcatgaccagtacgcctac

SEQ ID NO: 22635 - DNA, 26 bp, Artificial Sequence
  Description of Artificial Sequence: Synthetic oligonucleotide
cgtgggcatgaccagtacgcctacga

SEQ ID NO: 22636 - DNA, 26 bp, Artificial Sequence
  Description of Artificial Sequence: Synthetic oligonucleotide
gtgggcatgaccagtacgcctacgac

SEQ ID NO: 22637 - DNA, 26 bp, Artificial Sequence
  Description of Artificial Sequence: Synthetic oligonucleotide
tgggcatgaccagtacgcctacgacg

SEQ ID NO: 22638 - DNA, 26 bp, Artificial Sequence
  Description of Artificial Sequence: Synthetic oligonucleotide
gctacgtggacgacacccagttcgtg

SEQ ID NO: 22639 - DNA, 26 bp, Artificial Sequence
  Description of Artificial Sequence: Synthetic oligonucleotide
ctacgtggacgacacccagttcgtgc

SEQ ID NO: 22640 - DNA, 26 bp, Artificial Sequence
  Description of Artificial Sequence: Synthetic oligonucleotide
tacgtggacgacacccagttcgtgcg

SEQ ID NO: 22641 - DNA, 25 bp, Artificial Sequence
  Description of Artificial Sequence: Synthetic oligonucleotide
acgtggacgacacccagttcgtgcg

SEQ ID NO: 22642 - DNA, 24 bp, Artificial Sequence
  Description of Artificial Sequence: Synthetic oligonucleotide
cgtggacgacacccagttcgtgcg

SEQ ID NO: 22643 - DNA, 26 bp, Artificial Sequence
  Description of Artificial Sequence: Synthetic oligonucleotide
gtggacgacacccagttcgtgcggtt

SEQ ID NO: 22644 - DNA, 26 bp, Artificial Sequence
  Description of Artificial Sequence: Synthetic oligonucleotide
tggacgacacccagttcgtgcggttc

SEQ ID NO: 22645 - DNA, 25 bp, Artificial Sequence
  Description of Artificial Sequence: Synthetic oligonucleotide
ggacgacacccagttcgtgcggttc

SEQ ID NO: 22646 - DNA, 26 bp, Artificial Sequence
  Description of Artificial Sequence: Synthetic oligonucleotide
gacgacacccagttcgtgcggttcga

SEQ ID NO: 22647 - DNA, 27 bp, Artificial Sequence
  Description of Artificial Sequence: Synthetic oligonucleotide
acgacacccagttcgtgcggttcgaca

SEQ ID NO: 22648 - DNA, 26 bp, Artificial Sequence
  Description of Artificial Sequence: Synthetic oligonucleotide
cgacacccagttcgtgcggttcgaca

SEQ ID NO: 22649 - DNA, 26 bp, Artificial Sequence
  Description of Artificial Sequence: Synthetic oligonucleotide
gacacccagttcgtgcggttcgacag

SEQ ID NO: 22650 - DNA, 26 bp, Artificial Sequence
  Description of Artificial Sequence: Synthetic oligonucleotide
acacccagttcgtgcggttcgacagc

SEQ ID NO: 22651 - DNA, 25 bp, Artificial Sequence
  Description of Artificial Sequence: Synthetic oligonucleotide
cacccagttcgtgcggttcgacagc

SEQ ID NO: 22652 - DNA, 26 bp, Artificial Sequence
  Description of Artificial Sequence: Synthetic oligonucleotide
acccagttcgtgcggttcgacagcga

SEQ ID NO: 22653 - DNA, 25 bp, Artificial Sequence
  Description of Artificial Sequence: Synthetic oligonucleotide
cccagttcgtgcggttcgacagcga

SEQ ID NO: 22654 - DNA, 25 bp, Artificial Sequence
  Description of Artificial Sequence: Synthetic oligonucleotide
ccagttcgtgcggttcgacagcgac

SEQ ID NO: 22655 - DNA, 21 bp, Artificial Sequence
  Description of Artificial Sequence: Synthetic oligonucleotide
ctgcgctcctggaccgccgca

SEQ ID NO: 22656 - DNA, 22 bp, Artificial Sequence
  Description of Artificial Sequence: Synthetic oligonucleotide
tgcgctcctggaccgccgcaga

SEQ ID NO: 22657 - DNA, 21 bp, Artificial Sequence
  Description of Artificial Sequence: Synthetic oligonucleotide
gcgctcctggaccgccgcaga

SEQ ID NO: 22658 - DNA, 22 bp, Artificial Sequence
  Description of Artificial Sequence: Synthetic oligonucleotide
cgctcctggaccgccgcagaca

SEQ ID NO: 22659 - DNA, 22 bp, Artificial Sequence
  Description of Artificial Sequence: Synthetic oligonucleotide
gctcctggaccgccgcagacac

SEQ ID NO: 22660 - DNA, 22 bp, Artificial Sequence
  Description of Artificial Sequence: Synthetic oligonucleotide
ctcctggaccgccgcagacacg

SEQ ID NO: 22661 - DNA, 22 bp, Artificial Sequence
  Description of Artificial Sequence: Synthetic oligonucleotide
tcctggaccgccgcagacacgg

SEQ ID NO: 22662 - DNA, 21 bp, Artificial Sequence
  Description of Artificial Sequence: Synthetic oligonucleotide
cctggaccgccgcagacacgg

SEQ ID NO: 22663 - DNA, 21 bp, Artificial Sequence
  Description of Artificial Sequence: Synthetic oligonucleotide
ctggaccgccgcagacacggc

SEQ ID NO: 22664 - DNA, 21 bp, Artificial Sequence
  Description of Artificial Sequence: Synthetic oligonucleotide
tggaccgccgcagacacggcg

SEQ ID NO: 22665 - DNA, 20 bp, Artificial Sequence
  Description of Artificial Sequence: Synthetic oligonucleotide
ggaccgccgcagacacggcg

SEQ ID NO: 22666 - DNA, 20 bp, Artificial Sequence
  Description of Artificial Sequence: Synthetic oligonucleotide
gaccgccgcagacacggcgg

SEQ ID NO: 22667 - DNA, 21 bp, Artificial Sequence
  Description of Artificial Sequence: Synthetic oligonucleotide
accgccgcagacacggcggct

SEQ ID NO: 22668 - DNA, 20 bp, Artificial Sequence
  Description of Artificial Sequence: Synthetic oligonucleotide
ccgccgcagacacggcggct

SEQ ID NO: 22669 - DNA, 21 bp, Artificial Sequence
  Description of Artificial Sequence: Synthetic oligonucleotide
cgccgcagacacggcggctca

SEQ ID NO: 22670 - DNA, 23 bp, Artificial Sequence
  Description of Artificial Sequence: Synthetic oligonucleotide
gccgcagacacggcggctcagat

SEQ ID NO: 22671 - DNA, 24 bp, Artificial Sequence
  Description of Artificial Sequence: Synthetic oligonucleotide
ccgcagacacggcggctcagatca

SEQ ID NO: 22672 - DNA, 24 bp, Artificial Sequence
  Description of Artificial Sequence: Synthetic oligonucleotide
cgcagacacggcggctcagatcac

SEQ ID NO: 22673 - DNA, 24 bp, Artificial Sequence
  Description of Artificial Sequence: Synthetic oligonucleotide
gcagacacggcggctcagatcacc

SEQ ID NO: 22674 - DNA, 25 bp, Artificial Sequence
  Description of Artificial Sequence: Synthetic oligonucleotide
cagacacggcggctcagatcaccca

SEQ ID NO: 22675 - DNA, 25 bp, Artificial Sequence
  Description of Artificial Sequence: Synthetic oligonucleotide
agacacggcggctcagatcacccag

SEQ ID NO: 22676 - DNA, 34 bp, Artificial Sequence
  Description of Artificial Sequence: Synthetic oligonucleotide
agtattgggaccggaacacacagatctacaagac

SEQ ID NO: 22677 - DNA, 33 bp, Artificial Sequence
  Description of Artificial Sequence: Synthetic oligonucleotide
gtattgggaccggaacacacagatctacaagac

SEQ ID NO: 22678 - DNA, 33 bp, Artificial Sequence
  Description of Artificial Sequence: Synthetic oligonucleotide
tattgggaccggaacacacagatctacaagacc

SEQ ID NO: 22679 - DNA, 32 bp, Artificial Sequence
  Description of Artificial Sequence: Synthetic oligonucleotide
attgggaccggaacacacagatctacaagacc

SEQ ID NO: 22680 - DNA, 31 bp, Artificial Sequence
  Description of Artificial Sequence: Synthetic oligonucleotide
ttgggaccggaacacacagatctacaagacc

SEQ ID NO: 22681 - DNA, 30 bp, Artificial Sequence
  Description of Artificial Sequence: Synthetic oligonucleotide
tgggaccggaacacacagatctacaagacc

SEQ ID NO: 22682 - DNA, 29 bp, Artificial Sequence
  Description of Artificial Sequence: Synthetic oligonucleotide
gggaccggaacacacagatctacaagacc

SEQ ID NO: 22683 - DNA, 31 bp, Artificial Sequence
  Description of Artificial Sequence: Synthetic oligonucleotide
ggaccggaacacacagatctacaagaccaac

SEQ ID NO: 22684 - DNA, 32 bp, Artificial Sequence
  Description of Artificial Sequence: Synthetic oligonucleotide
gaccggaacacacagatctacaagaccaacac

SEQ ID NO: 22685 - DNA, 33 bp, Artificial Sequence
  Description of Artificial Sequence: Synthetic oligonucleotide
accggaacacacagatctacaagaccaacacac

SEQ ID NO: 22686 - DNA, 32 bp, Artificial Sequence
  Description of Artificial Sequence: Synthetic oligonucleotide
ccggaacacacagatctacaagaccaacacac

SEQ ID NO: 22687 - DNA, 33 bp, Artificial Sequence
  Description of Artificial Sequence: Synthetic oligonucleotide
cggaacacacagatctacaagaccaacacacag

SEQ ID NO: 22688 - DNA, 34 bp, Artificial Sequence
  Description of Artificial Sequence: Synthetic oligonucleotide
ggaacacacagatctacaagaccaacacacagac

SEQ ID NO: 22689 - DNA, 35 bp, Artificial Sequence
  Description of Artificial Sequence: Synthetic oligonucleotide
gaacacacagatctacaagaccaacacacagactg

SEQ ID NO: 22690 - DNA, 36 bp, Artificial Sequence
  Description of Artificial Sequence: Synthetic oligonucleotide
aacacacagatctacaagaccaacacacagactgac

SEQ ID NO: 22691 - DNA, 35 bp, Artificial Sequence
  Description of Artificial Sequence: Synthetic oligonucleotide
acacacagatctacaagaccaacacacagactgac

SEQ ID NO: 22692 - DNA, 34 bp, Artificial Sequence
  Description of Artificial Sequence: Synthetic oligonucleotide
cacacagatctacaagaccaacacacagactgac

SEQ ID NO: 22693 - DNA, 34 bp, Artificial Sequence
  Description of Artificial Sequence: Synthetic oligonucleotide
acacagatctacaagaccaacacacagactgacc

SEQ ID NO: 22694 - DNA, 33 bp, Artificial Sequence
  Description of Artificial Sequence: Synthetic oligonucleotide
cacagatctacaagaccaacacacagactgacc

SEQ ID NO: 22695 - DNA, 33 bp, Artificial Sequence
  Description of Artificial Sequence: Synthetic oligonucleotide
acagatctacaagaccaacacacagactgaccg

SEQ ID NO: 22696 - DNA, 32 bp, Artificial Sequence
  Description of Artificial Sequence: Synthetic oligonucleotide
cagatctacaagaccaacacacagactgaccg

SEQ ID NO: 22697 - DNA, 33 bp, Artificial Sequence
  Description of Artificial Sequence: Synthetic oligonucleotide
agatctacaagaccaacacacagactgaccgag

SEQ ID NO: 22698 - DNA, 32 bp, Artificial Sequence
  Description of Artificial Sequence: Synthetic oligonucleotide
gatctacaagaccaacacacagactgaccgag

SEQ ID NO: 22699 - DNA, 33 bp, Artificial Sequence
  Description of Artificial Sequence: Synthetic oligonucleotide
atctacaagaccaacacacagactgaccgagag

SEQ ID NO: 22700 - DNA, 32 bp, Artificial Sequence
  Description of Artificial Sequence: Synthetic oligonucleotide
tctacaagaccaacacacagactgaccgagag

SEQ ID NO: 22701 - DNA, 31 bp, Artificial Sequence
  Description of Artificial Sequence: Synthetic oligonucleotide
ctacaagaccaacacacagactgaccgagag

SEQ ID NO: 22702 - DNA, 32 bp, Artificial Sequence
  Description of Artificial Sequence: Synthetic oligonucleotide
tacaagaccaacacacagactgaccgagagag

SEQ ID NO: 22703 - DNA, 31 bp, Artificial Sequence
  Description of Artificial Sequence: Synthetic oligonucleotide
acaagaccaacacacagactgaccgagagag

SEQ ID NO: 22704 - DNA, 30 bp, Artificial Sequence
  Description of Artificial Sequence: Synthetic oligonucleotide
caagaccaacacacagactgaccgagagag

SEQ ID NO: 22705 - DNA, 30 bp, Artificial Sequence
  Description of Artificial Sequence: Synthetic oligonucleotide
aagaccaacacacagactgaccgagagagc

SEQ ID NO: 22706 - DNA, 29 bp, Artificial Sequence
  Description of Artificial Sequence: Synthetic oligonucleotide
agaccaacacacagactgaccgagagagc

SEQ ID NO: 22707 - DNA, 28 bp, Artificial Sequence
  Description of Artificial Sequence: Synthetic oligonucleotide
gaccaacacacagactgaccgagagagc

SEQ ID NO: 22708 - DNA, 28 bp, Artificial Sequence
  Description of Artificial Sequence: Synthetic oligonucleotide
accaacacacagactgaccgagagagcc

SEQ ID NO: 22709 - DNA, 27 bp, Artificial Sequence
  Description of Artificial Sequence: Synthetic oligonucleotide
ccaacacacagactgaccgagagagcc

SEQ ID NO: 22710 - DNA, 28 bp, Artificial Sequence
  Description of Artificial Sequence: Synthetic oligonucleotide
caacacacagactgaccgagagagcctg

SEQ ID NO: 22711 - DNA, 28 bp, Artificial Sequence
  Description of Artificial Sequence: Synthetic oligonucleotide
aacacacagactgaccgagagagcctgc

SEQ ID NO: 22712 - DNA, 27 bp, Artificial Sequence
  Description of Artificial Sequence: Synthetic oligonucleotide
acacacagactgaccgagagagcctgc

SEQ ID NO: 22713 - DNA, 26 bp, Artificial Sequence
  Description of Artificial Sequence: Synthetic oligonucleotide
cacacagactgaccgagagagcctgc

SEQ ID NO: 22714 - DNA, 26 bp, Artificial Sequence
  Description of Artificial Sequence: Synthetic oligonucleotide
acacagactgaccgagagagcctgcg

SEQ ID NO: 22715 - DNA, 21 bp, Artificial Sequence
  Description of Artificial Sequence: Synthetic oligonucleotide
ggcccgtgaggcggagcagga

SEQ ID NO: 22716 - DNA, 22 bp, Artificial Sequence
  Description of Artificial Sequence: Synthetic oligonucleotide
gcccgtgaggcggagcaggaca

SEQ ID NO: 22717 - DNA, 23 bp, Artificial Sequence
  Description of Artificial Sequence: Synthetic oligonucleotide
cccgtgaggcggagcaggacaga

SEQ ID NO: 22718 - DNA, 23 bp, Artificial Sequence
  Description of Artificial Sequence: Synthetic oligonucleotide
ccgtgaggcggagcaggacagag

SEQ ID NO: 22719 - DNA, 23 bp, Artificial Sequence
  Description of Artificial Sequence: Synthetic oligonucleotide
cgtgaggcggagcaggacagagc

SEQ ID NO: 22720 - DNA, 25 bp, Artificial Sequence
  Description of Artificial Sequence: Synthetic oligonucleotide
gtgaggcggagcaggacagagccta

SEQ ID NO: 22721 - DNA, 25 bp, Artificial Sequence
  Description of Artificial Sequence: Synthetic oligonucleotide
tgaggcggagcaggacagagcctac

SEQ ID NO: 22722 - DNA, 24 bp, Artificial Sequence
  Description of Artificial Sequence: Synthetic oligonucleotide
gaggcggagcaggacagagcctac

SEQ ID NO: 22723 - DNA, 25 bp, Artificial Sequence
  Description of Artificial Sequence: Synthetic oligonucleotide
aggcggagcaggacagagcctacct

SEQ ID NO: 22724 - DNA, 24 bp, Artificial Sequence
  Description of Artificial Sequence: Synthetic oligonucleotide
ggcggagcaggacagagcctacct

SEQ ID NO: 22725 - DNA, 24 bp, Artificial Sequence
  Description of Artificial Sequence: Synthetic oligonucleotide
gcggagcaggacagagcctacctg

SEQ ID NO: 22726 - DNA, 25 bp, Artificial Sequence
  Description of Artificial Sequence: Synthetic oligonucleotide
cggagcaggacagagcctacctgga

SEQ ID NO: 22727 - DNA, 25 bp, Artificial Sequence
  Description of Artificial Sequence: Synthetic oligonucleotide
ggagcaggacagagcctacctggag

SEQ ID NO: 22728 - DNA, 25 bp, Artificial Sequence
  Description of Artificial Sequence: Synthetic oligonucleotide
gagcaggacagagcctacctggagg

SEQ ID NO: 22729 - DNA, 25 bp, Artificial Sequence
  Description of Artificial Sequence: Synthetic oligonucleotide
agcaggacagagcctacctggaggg

SEQ ID NO: 22730 - DNA, 24 bp, Artificial Sequence
  Description of Artificial Sequence: Synthetic oligonucleotide
gcaggacagagcctacctggaggg

SEQ ID NO: 22731 - DNA, 24 bp, Artificial Sequence
  Description of Artificial Sequence: Synthetic oligonucleotide
caggacagagcctacctggagggc

SEQ ID NO: 22732 - DNA, 25 bp, Artificial Sequence
  Description of Artificial Sequence: Synthetic oligonucleotide
aggacagagcctacctggagggcga

SEQ ID NO: 22733 - DNA, 24 bp, Artificial Sequence
  Description of Artificial Sequence: Synthetic oligonucleotide
ggacagagcctacctggagggcga

SEQ ID NO: 22734 - DNA, 25 bp, Artificial Sequence
  Description of Artificial Sequence: Synthetic oligonucleotide
gacagagcctacctggagggcgagt

SEQ ID NO: 22735 - DNA, 25 bp, Artificial Sequence
  Description of Artificial Sequence: Synthetic oligonucleotide
acagagcctacctggagggcgagtg

SEQ ID NO: 22736 - DNA, 24 bp, Artificial Sequence
  Description of Artificial Sequence: Synthetic oligonucleotide
cagagcctacctggagggcgagtg

SEQ ID NO: 22737 - DNA, 22 bp, Artificial Sequence
  Description of Artificial Sequence: Synthetic oligonucleotide
ggcgcctcctccgcgggcataa

SEQ ID NO: 22738 - DNA, 22 bp, Artificial Sequence
  Description of Artificial Sequence: Synthetic oligonucleotide
gcgcctcctccgcgggcataac

SEQ ID NO: 22739 - DNA, 23 bp, Artificial Sequence
  Description of Artificial Sequence: Synthetic oligonucleotide
cgcctcctccgcgggcataacca

SEQ ID NO: 22740 - DNA, 25 bp, Artificial Sequence
  Description of Artificial Sequence: Synthetic oligonucleotide
gcctcctccgcgggcataaccagta

SEQ ID NO: 22741 - DNA, 25 bp, Artificial Sequence
  Description of Artificial Sequence: Synthetic oligonucleotide
cctcctccgcgggcataaccagtac

SEQ ID NO: 22742 - DNA, 25 bp, Artificial Sequence
  Description of Artificial Sequence: Synthetic oligonucleotide
ctcctccgcgggcataaccagtacg

SEQ ID NO: 22743 - DNA, 25 bp, Artificial Sequence
  Description of Artificial Sequence: Synthetic oligonucleotide
tcctccgcgggcataaccagtacgc

SEQ ID NO: 22744 - DNA, 24 bp, Artificial Sequence
  Description of Artificial Sequence: Synthetic oligonucleotide
cctccgcgggcataaccagtacgc

SEQ ID NO: 22745 - DNA, 26 bp, Artificial Sequence
  Description of Artificial Sequence: Synthetic oligonucleotide
ctccgcgggcataaccagtacgccta

SEQ ID NO: 22746 - DNA, 26 bp, Artificial Sequence
  Description of Artificial Sequence: Synthetic oligonucleotide
tccgcgggcataaccagtacgcctac

SEQ ID NO: 22747 - DNA, 25 bp, Artificial Sequence
  Description of Artificial Sequence: Synthetic oligonucleotide
ccgcgggcataaccagtacgcctac

SEQ ID NO: 22748 - DNA, 26 bp, Artificial Sequence
  Description of Artificial Sequence: Synthetic oligonucleotide
cgcgggcataaccagtacgcctacga

SEQ ID NO: 22749 - DNA, 26 bp, Artificial Sequence
  Description of Artificial Sequence: Synthetic oligonucleotide
gcgggcataaccagtacgcctacgac

SEQ ID NO: 22750 - DNA, 26 bp, Artificial Sequence
  Description of Artificial Sequence: Synthetic oligonucleotide
cgggcataaccagtacgcctacgacg

SEQ ID NO: 22751 - DNA, 26 bp, Artificial Sequence
  Description of Artificial Sequence: Synthetic oligonucleotide
gggcataaccagtacgcctacgacgg

SEQ ID NO: 22752 - DNA, 27 bp, Artificial Sequence
  Description of Artificial Sequence: Synthetic oligonucleotide
ggcataaccagtacgcctacgacggca

SEQ ID NO: 22753 - DNA, 28 bp, Artificial Sequence
  Description of Artificial Sequence: Synthetic oligonucleotide
gcataaccagtacgcctacgacggcaag

SEQ ID NO: 22754 - DNA, 28 bp, Artificial Sequence
  Description of Artificial Sequence: Synthetic oligonucleotide
cataaccagtacgcctacgacggcaagg

SEQ ID NO: 22755 - DNA, 32 bp, Artificial Sequence
  Description of Artificial Sequence: Synthetic oligonucleotide
ataaccagtacgcctacgacggcaaggattac

SEQ ID NO: 22756 - DNA, 31 bp, Artificial Sequence
  Description of Artificial Sequence: Synthetic oligonucleotide
taaccagtacgcctacgacggcaaggattac

SEQ ID NO: 22757 - DNA, 30 bp, Artificial Sequence
  Description of Artificial Sequence: Synthetic oligonucleotide
aaccagtacgcctacgacggcaaggattac

SEQ ID NO: 22758 - DNA, 27 bp, Artificial Sequence
  Description of Artificial Sequence: Synthetic oligonucleotide
atgggagccgtcttcccagtccaccat

SEQ ID NO: 22759 - DNA, 26 bp, Artificial Sequence
  Description of Artificial Sequence: Synthetic oligonucleotide
tgggagccgtcttcccagtccaccat

SEQ ID NO: 22760 - DNA, 25 bp, Artificial Sequence
  Description of Artificial Sequence: Synthetic oligonucleotide
gggagccgtcttcccagtccaccat

SEQ ID NO: 22761 - DNA, 25 bp, Artificial Sequence
  Description of Artificial Sequence: Synthetic oligonucleotide
ggagccgtcttcccagtccaccatc

SEQ ID NO: 22762 - DNA, 25 bp, Artificial Sequence
  Description of Artificial Sequence: Synthetic oligonucleotide
gagccgtcttcccagtccaccatcc

SEQ ID NO: 22763 - DNA, 25 bp, Artificial Sequence
  Description of Artificial Sequence: Synthetic oligonucleotide
agccgtcttcccagtccaccatccc

SEQ ID NO: 22764 - DNA, 24 bp, Artificial Sequence
  Description of Artificial Sequence: Synthetic oligonucleotide
gccgtcttcccagtccaccatccc

SEQ ID NO: 22765 - DNA, 26 bp, Artificial Sequence
  Description of Artificial Sequence: Synthetic oligonucleotide
ccgtcttcccagtccaccatccccat

SEQ ID NO: 22766 - DNA, 26 bp, Artificial Sequence
  Description of Artificial Sequence: Synthetic oligonucleotide
cgtcttcccagtccaccatccccatc

SEQ ID NO: 22767 - DNA, 27 bp, Artificial Sequence
  Description of Artificial Sequence: Synthetic oligonucleotide
gtcttcccagtccaccatccccatcgt

SEQ ID NO: 22768 - DNA, 27 bp, Artificial Sequence
  Description of Artificial Sequence: Synthetic oligonucleotide
tcttcccagtccaccatccccatcgtg

SEQ ID NO: 22769 - DNA, 26 bp, Artificial Sequence
  Description of Artificial Sequence: Synthetic oligonucleotide
cttcccagtccaccatccccatcgtg

SEQ ID NO: 22770 - DNA, 26 bp, Artificial Sequence
  Description of Artificial Sequence: Synthetic oligonucleotide
ttcccagtccaccatccccatcgtgg

SEQ ID NO: 22771 - DNA, 25 bp, Artificial Sequence
  Description of Artificial Sequence: Synthetic oligonucleotide
tcccagtccaccatccccatcgtgg

SEQ ID NO: 22772 - DNA, 24 bp, Artificial Sequence
  Description of Artificial Sequence: Synthetic oligonucleotide
cccagtccaccatccccatcgtgg

SEQ ID NO: 22773 - DNA, 24 bp, Artificial Sequence
  Description of Artificial Sequence: Synthetic oligonucleotide
ccagtccaccatccccatcgtggg

SEQ ID NO: 22774 - DNA, 27 bp, Artificial Sequence
  Description of Artificial Sequence: Synthetic oligonucleotide
cagtccaccatccccatcgtgggcatt

SEQ ID NO: 22775 - DNA, 27 bp, Artificial Sequence
  Description of Artificial Sequence: Synthetic oligonucleotide
agtccaccatccccatcgtgggcattg

SEQ ID NO: 22776 - DNA, 27 bp, Artificial Sequence
  Description of Artificial Sequence: Synthetic oligonucleotide
gtccaccatccccatcgtgggcattgt

SEQ ID NO: 22777 - DNA, 28 bp, Artificial Sequence
  Description of Artificial Sequence: Synthetic oligonucleotide
tccaccatccccatcgtgggcattgttg

SEQ ID NO: 22778 - DNA, 27 bp, Artificial Sequence
  Description of Artificial Sequence: Synthetic oligonucleotide
ccaccatccccatcgtgggcattgttg

SEQ ID NO: 22779 - DNA, 27 bp, Artificial Sequence
  Description of Artificial Sequence: Synthetic oligonucleotide
caccatccccatcgtgggcattgttgc

SEQ ID NO: 22780 - DNA, 28 bp, Artificial Sequence
  Description of Artificial Sequence: Synthetic oligonucleotide
accatccccatcgtgggcattgttgctg

SEQ ID NO: 22781 - DNA, 27 bp, Artificial Sequence
  Description of Artificial Sequence: Synthetic oligonucleotide
ccatccccatcgtgggcattgttgctg

SEQ ID NO: 22782 - DNA, 27 bp, Artificial Sequence
  Description of Artificial Sequence: Synthetic oligonucleotide
catccccatcgtgggcattgttgctgg

SEQ ID NO: 22783 - DNA, 27 bp, Artificial Sequence
  Description of Artificial Sequence: Synthetic oligonucleotide
atccccatcgtgggcattgttgctggc

SEQ ID NO: 22784 - DNA, 22 bp, Artificial Sequence
  Description of Artificial Sequence: Synthetic oligonucleotide
gacagcgacgccgcgagtccca

SEQ ID NO: 22785 - DNA, 23 bp, Artificial Sequence
  Description of Artificial Sequence: Synthetic oligonucleotide
acagcgacgccgcgagtcccaga

SEQ ID NO: 22786 - DNA, 22 bp, Artificial Sequence
  Description of Artificial Sequence: Synthetic oligonucleotide
cagcgacgccgcgagtcccaga

SEQ ID NO: 22787 - DNA, 23 bp, Artificial Sequence
  Description of Artificial Sequence: Synthetic oligonucleotide
agcgacgccgcgagtcccagaga

SEQ ID NO: 22788 - DNA, 22 bp, Artificial Sequence
  Description of Artificial Sequence: Synthetic oligonucleotide
gcgacgccgcgagtcccagaga

SEQ ID NO: 22789 - DNA, 22 bp, Artificial Sequence
  Description of Artificial Sequence: Synthetic oligonucleotide
cgacgccgcgagtcccagagag

SEQ ID NO: 22790 - DNA, 23 bp, Artificial Sequence
  Description of Artificial Sequence: Synthetic oligonucleotide
gacgccgcgagtcccagagagga

SEQ ID NO: 22791 - DNA, 23 bp, Artificial Sequence
  Description of Artificial Sequence: Synthetic oligonucleotide
acgccgcgagtcccagagaggag

SEQ ID NO: 22792 - DNA, 22 bp, Artificial Sequence
  Description of Artificial Sequence: Synthetic oligonucleotide
cgccgcgagtcccagagaggag

SEQ ID NO: 22793 - DNA, 22 bp, Artificial Sequence
  Description of Artificial Sequence: Synthetic oligonucleotide
gccgcgagtcccagagaggagc

SEQ ID NO: 22794 - DNA, 22 bp, Artificial Sequence
  Description of Artificial Sequence: Synthetic oligonucleotide
ccgcgagtcccagagaggagcc

SEQ ID NO: 22795 - DNA, 22 bp, Artificial Sequence
  Description of Artificial Sequence: Synthetic oligonucleotide
cgcgagtcccagagaggagccg

SEQ ID NO: 22796 - DNA, 22 bp, Artificial Sequence
  Description of Artificial Sequence: Synthetic oligonucleotide
gcgagtcccagagaggagccgc

SEQ ID NO: 22797 - DNA, 22 bp, Artificial Sequence
  Description of Artificial Sequence: Synthetic oligonucleotide
cgagtcccagagaggagccgcg

SEQ ID NO: 22798 - DNA, 22 bp, Artificial Sequence
  Description of Artificial Sequence: Synthetic oligonucleotide
gagtcccagagaggagccgcgg

SEQ ID NO: 22799 - DNA, 22 bp, Artificial Sequence
  Description of Artificial Sequence: Synthetic oligonucleotide
agtcccagagaggagccgcggg

SEQ ID NO: 22800 - DNA, 21 bp, Artificial Sequence
  Description of Artificial Sequence: Synthetic oligonucleotide
gtcccagagaggagccgcggg

SEQ ID NO: 22801 - DNA, 21 bp, Artificial Sequence
  Description of Artificial Sequence: Synthetic oligonucleotide
tcccagagaggagccgcgggc

SEQ ID NO: 22802 - DNA, 20 bp, Artificial Sequence
  Description of Artificial Sequence: Synthetic oligonucleotide
cccagagaggagccgcgggc

SEQ ID NO: 22803 - DNA, 20 bp, Artificial Sequence
  Description of Artificial Sequence: Synthetic oligonucleotide
ccagagaggagccgcgggcg

SEQ ID NO: 22804 - DNA, 20 bp, Artificial Sequence
  Description of Artificial Sequence: Synthetic oligonucleotide
cagagaggagccgcgggcgc

SEQ ID NO: 22805 - DNA, 29 bp, Artificial Sequence
  Description of Artificial Sequence: Synthetic oligonucleotide
gcataaccagtacgcctacgacggcaaag

SEQ ID NO: 22806 - DNA, 33 bp, Artificial Sequence
  Description of Artificial Sequence: Synthetic oligonucleotide
cataaccagtacgcctacgacggcaaagattac

SEQ ID NO: 22807 - DNA, 35 bp, Artificial Sequence
  Description of Artificial Sequence: Synthetic oligonucleotide
ataaccagtacgcctacgacggcaaagattacatc

SEQ ID NO: 22808 - DNA, 34 bp, Artificial Sequence
  Description of Artificial Sequence: Synthetic oligonucleotide
taaccagtacgcctacgacggcaaagattacatc

SEQ ID NO: 22809 - DNA, 33 bp, Artificial Sequence
  Description of Artificial Sequence: Synthetic oligonucleotide
aaccagtacgcctacgacggcaaagattacatc

SEQ ID NO: 22810 - DNA, 25 bp, Artificial Sequence
  Description of Artificial Sequence: Synthetic oligonucleotide
ccgggtctcacaccctccagaggat

SEQ ID NO: 22811 - DNA, 27 bp, Artificial Sequence
  Description of Artificial Sequence: Synthetic oligonucleotide
cgggtctcacaccctccagaggatgta

SEQ ID NO: 22812 - DNA, 27 bp, Artificial Sequence
  Description of Artificial Sequence: Synthetic oligonucleotide
gggtctcacaccctccagaggatgtac

SEQ ID NO: 22813 - DNA, 27 bp, Artificial Sequence
  Description of Artificial Sequence: Synthetic oligonucleotide
ggtctcacaccctccagaggatgtacg

SEQ ID NO: 22814 - DNA, 27 bp, Artificial Sequence
  Description of Artificial Sequence: Synthetic oligonucleotide
gtctcacaccctccagaggatgtacgg

SEQ ID NO: 22815 - DNA, 27 bp, Artificial Sequence
  Description of Artificial Sequence: Synthetic oligonucleotide
tctcacaccctccagaggatgtacggc

SEQ ID NO: 22816 - DNA, 27 bp, Artificial Sequence
  Description of Artificial Sequence: Synthetic oligonucleotide
ctcacaccctccagaggatgtacggct

SEQ ID NO: 22817 - DNA, 27 bp, Artificial Sequence
  Description of Artificial Sequence: Synthetic oligonucleotide
tcacaccctccagaggatgtacggctg

SEQ ID NO: 22818 - DNA, 26 bp, Artificial Sequence
  Description of Artificial Sequence: Synthetic oligonucleotide
cacaccctccagaggatgtacggctg

SEQ ID NO: 22819 - DNA, 26 bp, Artificial Sequence
  Description of Artificial Sequence: Synthetic oligonucleotide
acaccctccagaggatgtacggctgc

SEQ ID NO: 22820 - DNA, 25 bp, Artificial Sequence
  Description of Artificial Sequence: Synthetic oligonucleotide
caccctccagaggatgtacggctgc

SEQ ID NO: 22821 - DNA, 26 bp, Artificial Sequence
  Description of Artificial Sequence: Synthetic oligonucleotide
accctccagaggatgtacggctgcga

SEQ ID NO: 22822 - DNA, 25 bp, Artificial Sequence
  Description of Artificial Sequence: Synthetic oligonucleotide
ccctccagaggatgtacggctgcga

SEQ ID NO: 22823 - DNA, 25 bp, Artificial Sequence
  Description of Artificial Sequence: Synthetic oligonucleotide
cctccagaggatgtacggctgcgac

SEQ ID NO: 22824 - DNA, 26 bp, Artificial Sequence
  Description of Artificial Sequence: Synthetic oligonucleotide
ctccagaggatgtacggctgcgacgt

SEQ ID NO: 22825 - DNA, 26 bp, Artificial Sequence
  Description of Artificial Sequence: Synthetic oligonucleotide
tccagaggatgtacggctgcgacgtg

SEQ ID NO: 22826 - DNA, 25 bp, Artificial Sequence
  Description of Artificial Sequence: Synthetic oligonucleotide
ccagaggatgtacggctgcgacgtg

SEQ ID NO: 22827 - DNA, 25 bp, Artificial Sequence
  Description of Artificial Sequence: Synthetic oligonucleotide
cagaggatgtacggctgcgacgtgg

SEQ ID NO: 22828 - DNA, 25 bp, Artificial Sequence
  Description of Artificial Sequence: Synthetic oligonucleotide
agaggatgtacggctgcgacgtggg

SEQ ID NO: 22829 - DNA, 24 bp, Artificial Sequence
  Description of Artificial Sequence: Synthetic oligonucleotide
gaggatgtacggctgcgacgtggg

SEQ ID NO: 22830 - DNA, 24 bp, Artificial Sequence
  Description of Artificial Sequence: Synthetic oligonucleotide
aggatgtacggctgcgacgtgggg

SEQ ID NO: 22831 - DNA, 23 bp, Artificial Sequence
  Description of Artificial Sequence: Synthetic oligonucleotide
ggatgtacggctgcgacgtgggg

SEQ ID NO: 22832 - DNA, 23 bp, Artificial Sequence
  Description of Artificial Sequence: Synthetic oligonucleotide
gatgtacggctgcgacgtggggc

SEQ ID NO: 22833 - DNA, 31 bp, Artificial Sequence
  Description of Artificial Sequence: Synthetic oligonucleotide
ggagtattgggaccggaacacacagatcttc

SEQ ID NO: 22834 - DNA, 33 bp, Artificial Sequence
  Description of Artificial Sequence: Synthetic oligonucleotide
gagtattgggaccggaacacacagatcttcaag

SEQ ID NO: 22835 - DNA, 34 bp, Artificial Sequence
  Description of Artificial Sequence: Synthetic oligonucleotide
agtattgggaccggaacacacagatcttcaagac

SEQ ID NO: 22836 - DNA, 33 bp, Artificial Sequence
  Description of Artificial Sequence: Synthetic oligonucleotide
gtattgggaccggaacacacagatcttcaagac

SEQ ID NO: 22837 - DNA, 33 bp, Artificial Sequence
  Description of Artificial Sequence: Synthetic oligonucleotide
tattgggaccggaacacacagatcttcaagacc

SEQ ID NO: 22838 - DNA, 32 bp, Artificial Sequence
  Description of Artificial Sequence: Synthetic oligonucleotide
attgggaccggaacacacagatcttcaagacc

SEQ ID NO: 22839 - DNA, 31 bp, Artificial Sequence
  Description of Artificial Sequence: Synthetic oligonucleotide
ttgggaccggaacacacagatcttcaagacc

SEQ ID NO: 22840 - DNA, 30 bp, Artificial Sequence
  Description of Artificial Sequence: Synthetic oligonucleotide
tgggaccggaacacacagatcttcaagacc

SEQ ID NO: 22841 - DNA, 29 bp, Artificial Sequence
  Description of Artificial Sequence: Synthetic oligonucleotide
gggaccggaacacacagatcttcaagacc

SEQ ID NO: 22842 - DNA, 31 bp, Artificial Sequence
  Description of Artificial Sequence: Synthetic oligonucleotide
ggaccggaacacacagatcttcaagaccaac

SEQ ID NO: 22843 - DNA, 32 bp, Artificial Sequence
  Description of Artificial Sequence: Synthetic oligonucleotide
gaccggaacacacagatcttcaagaccaacac

SEQ ID NO: 22844 - DNA, 33 bp, Artificial Sequence
  Description of Artificial Sequence: Synthetic oligonucleotide
accggaacacacagatcttcaagaccaacacac

SEQ ID NO: 22845 - DNA, 32 bp, Artificial Sequence
  Description of Artificial Sequence: Synthetic oligonucleotide
ccggaacacacagatcttcaagaccaacacac

SEQ ID NO: 22846 - DNA, 33 bp, Artificial Sequence
  Description of Artificial Sequence: Synthetic oligonucleotide
cggaacacacagatcttcaagaccaacacacag

SEQ ID NO: 22847 - DNA, 34 bp, Artificial Sequence
  Description of Artificial Sequence: Synthetic oligonucleotide
ggaacacacagatcttcaagaccaacacacagac

SEQ ID NO: 22848 - DNA, 35 bp, Artificial Sequence
  Description of Artificial Sequence: Synthetic oligonucleotide
gaacacacagatcttcaagaccaacacacagactg

SEQ ID NO: 22849 - DNA, 36 bp, Artificial Sequence
  Description of Artificial Sequence: Synthetic oligonucleotide
aacacacagatcttcaagaccaacacacagactgac

SEQ ID NO: 22850 - DNA, 35 bp, Artificial Sequence
  Description of Artificial Sequence: Synthetic oligonucleotide
acacacagatcttcaagaccaacacacagactgac

SEQ ID NO: 22851 - DNA, 34 bp, Artificial Sequence
  Description of Artificial Sequence: Synthetic oligonucleotide
cacacagatcttcaagaccaacacacagactgac

SEQ ID NO: 22852 - DNA, 34 bp, Artificial Sequence
  Description of Artificial Sequence: Synthetic oligonucleotide
acacagatcttcaagaccaacacacagactgacc

SEQ ID NO: 22853 - DNA, 33 bp, Artificial Sequence
  Description of Artificial Sequence: Synthetic oligonucleotide
cacagatcttcaagaccaacacacagactgacc

SEQ ID NO: 22854 - DNA, 33 bp, Artificial Sequence
  Description of Artificial Sequence: Synthetic oligonucleotide
acagatcttcaagaccaacacacagactgaccg

SEQ ID NO: 22855 - DNA, 32 bp, Artificial Sequence
  Description of Artificial Sequence: Synthetic oligonucleotide
cagatcttcaagaccaacacacagactgaccg

SEQ ID NO: 22856 - DNA, 33 bp, Artificial Sequence
  Description of Artificial Sequence: Synthetic oligonucleotide
agatcttcaagaccaacacacagactgaccgag

SEQ ID NO: 22857 - DNA, 32 bp, Artificial Sequence
  Description of Artificial Sequence: Synthetic oligonucleotide
gatcttcaagaccaacacacagactgaccgag

SEQ ID NO: 22858 - DNA, 33 bp, Artificial Sequence
  Description of Artificial Sequence: Synthetic oligonucleotide
atcttcaagaccaacacacagactgaccgagag

SEQ ID NO: 22859 - DNA, 32 bp, Artificial Sequence
  Description of Artificial Sequence: Synthetic oligonucleotide
tcttcaagaccaacacacagactgaccgagag

SEQ ID NO: 22860 - DNA, 31 bp, Artificial Sequence
  Description of Artificial Sequence: Synthetic oligonucleotide
cttcaagaccaacacacagactgaccgagag

SEQ ID NO: 22861 - DNA, 32 bp, Artificial Sequence
  Description of Artificial Sequence: Synthetic oligonucleotide
ttcaagaccaacacacagactgaccgagagag

SEQ ID NO: 22862 - DNA, 31 bp, Artificial Sequence
  Description of Artificial Sequence: Synthetic oligonucleotide
tcaagaccaacacacagactgaccgagagag

SEQ ID NO: 22863 - DNA, 23 bp, Artificial Sequence
  Description of Artificial Sequence: Synthetic oligonucleotide
cctcctccgcgggcatgaccagt

SEQ ID NO: 22864 - DNA, 23 bp, Artificial Sequence
  Description of Artificial Sequence: Synthetic oligonucleotide
ctcctccgcgggcatgaccagtc

SEQ ID NO: 22865 - DNA, 23 bp, Artificial Sequence
  Description of Artificial Sequence: Synthetic oligonucleotide
tcctccgcgggcatgaccagtcc

SEQ ID NO: 22866 - DNA, 22 bp, Artificial Sequence
  Description of Artificial Sequence: Synthetic oligonucleotide
cctccgcgggcatgaccagtcc

SEQ ID NO: 22867 - DNA, 22 bp, Artificial Sequence
  Description of Artificial Sequence: Synthetic oligonucleotide
ctccgcgggcatgaccagtccg

SEQ ID NO: 22868 - DNA, 22 bp, Artificial Sequence
  Description of Artificial Sequence: Synthetic oligonucleotide
tccgcgggcatgaccagtccgc

SEQ ID NO: 22869 - DNA, 21 bp, Artificial Sequence
  Description of Artificial Sequence: Synthetic oligonucleotide
ccgcgggcatgaccagtccgc

SEQ ID NO: 22870 - DNA, 23 bp, Artificial Sequence
  Description of Artificial Sequence: Synthetic oligonucleotide
cgcgggcatgaccagtccgccta

SEQ ID NO: 22871 - DNA, 23 bp, Artificial Sequence
  Description of Artificial Sequence: Synthetic oligonucleotide
gcgggcatgaccagtccgcctac

SEQ ID NO: 22872 - DNA, 24 bp, Artificial Sequence
  Description of Artificial Sequence: Synthetic oligonucleotide
cgggcatgaccagtccgcctacga

SEQ ID NO: 22873 - DNA, 24 bp, Artificial Sequence
  Description of Artificial Sequence: Synthetic oligonucleotide
gggcatgaccagtccgcctacgac

SEQ ID NO: 22874 - DNA, 24 bp, Artificial Sequence
  Description of Artificial Sequence: Synthetic oligonucleotide
ggcatgaccagtccgcctacgacg

SEQ ID NO: 22875 - DNA, 24 bp, Artificial Sequence
  Description of Artificial Sequence: Synthetic oligonucleotide
gcatgaccagtccgcctacgacgg

SEQ ID NO: 22876 - DNA, 26 bp, Artificial Sequence
  Description of Artificial Sequence: Synthetic oligonucleotide
catgaccagtccgcctacgacggcaa

SEQ ID NO: 22877 - DNA, 30 bp, Artificial Sequence
  Description of Artificial Sequence: Synthetic oligonucleotide
ggagtattgggaccggaacacacagatctg

SEQ ID NO: 22878 - DNA, 30 bp, Artificial Sequence
  Description of Artificial Sequence: Synthetic oligonucleotide
gagtattgggaccggaacacacagatctgc

SEQ ID NO: 22879 - DNA, 32 bp, Artificial Sequence
  Description of Artificial Sequence: Synthetic oligonucleotide
agtattgggaccggaacacacagatctgcaag

SEQ ID NO: 22880 - DNA, 31 bp, Artificial Sequence
  Description of Artificial Sequence: Synthetic oligonucleotide
gtattgggaccggaacacacagatctgcaag

SEQ ID NO: 22881 - DNA, 31 bp, Artificial Sequence
  Description of Artificial Sequence: Synthetic oligonucleotide
tattgggaccggaacacacagatctgcaagg

SEQ ID NO: 22882 - DNA, 30 bp, Artificial Sequence
  Description of Artificial Sequence: Synthetic oligonucleotide
attgggaccggaacacacagatctgcaagg

SEQ ID NO: 22883 - DNA, 29 bp, Artificial Sequence
  Description of Artificial Sequence: Synthetic oligonucleotide
ttgggaccggaacacacagatctgcaagg

SEQ ID NO: 22884 - DNA, 28 bp, Artificial Sequence
  Description of Artificial Sequence: Synthetic oligonucleotide
tgggaccggaacacacagatctgcaagg

SEQ ID NO: 22885 - DNA, 27 bp, Artificial Sequence
  Description of Artificial Sequence: Synthetic oligonucleotide
gggaccggaacacacagatctgcaagg

SEQ ID NO: 22886 - DNA, 27 bp, Artificial Sequence
  Description of Artificial Sequence: Synthetic oligonucleotide
ggaccggaacacacagatctgcaaggc

SEQ ID NO: 22887 - DNA, 27 bp, Artificial Sequence
  Description of Artificial Sequence: Synthetic oligonucleotide
gaccggaacacacagatctgcaaggcc

SEQ ID NO: 22888 - DNA, 27 bp, Artificial Sequence
  Description of Artificial Sequence: Synthetic oligonucleotide
accggaacacacagatctgcaaggccc

SEQ ID NO: 22889 - DNA, 27 bp, Artificial Sequence
  Description of Artificial Sequence: Synthetic oligonucleotide
ccggaacacacagatctgcaaggccca

SEQ ID NO: 22890 - DNA, 27 bp, Artificial Sequence
  Description of Artificial Sequence: Synthetic oligonucleotide
cggaacacacagatctgcaaggcccag

SEQ ID NO: 22891 - DNA, 27 bp, Artificial Sequence
  Description of Artificial Sequence: Synthetic oligonucleotide
ggaacacacagatctgcaaggcccagg

SEQ ID NO: 22892 - DNA, 27 bp, Artificial Sequence
  Description of Artificial Sequence: Synthetic oligonucleotide
gaacacacagatctgcaaggcccaggc

SEQ ID NO: 22893 - DNA, 28 bp, Artificial Sequence
  Description of Artificial Sequence: Synthetic oligonucleotide
aacacacagatctgcaaggcccaggcac

SEQ ID NO: 22894 - DNA, 27 bp, Artificial Sequence
  Description of Artificial Sequence: Synthetic oligonucleotide
acacacagatctgcaaggcccaggcac

SEQ ID NO: 22895 - DNA, 27 bp, Artificial Sequence
  Description of Artificial Sequence: Synthetic oligonucleotide
cacacagatctgcaaggcccaggcaca

SEQ ID NO: 22896 - DNA, 27 bp, Artificial Sequence
  Description of Artificial Sequence: Synthetic oligonucleotide
acacagatctgcaaggcccaggcacag

SEQ ID NO: 22897 - DNA, 27 bp, Artificial Sequence
  Description of Artificial Sequence: Synthetic oligonucleotide
cacagatctgcaaggcccaggcacaga

SEQ ID NO: 22898 - DNA, 27 bp, Artificial Sequence
  Description of Artificial Sequence: Synthetic oligonucleotide
acagatctgcaaggcccaggcacagac

SEQ ID NO: 22899 - DNA, 27 bp, Artificial Sequence
  Description of Artificial Sequence: Synthetic oligonucleotide
cagatctgcaaggcccaggcacagact

SEQ ID NO: 22900 - DNA, 27 bp, Artificial Sequence
  Description of Artificial Sequence: Synthetic oligonucleotide
agatctgcaaggcccaggcacagactg

SEQ ID NO: 22901 - DNA, 27 bp, Artificial Sequence
  Description of Artificial Sequence: Synthetic oligonucleotide
gatctgcaaggcccaggcacagactga

SEQ ID NO: 22902 - DNA, 27 bp, Artificial Sequence
  Description of Artificial Sequence: Synthetic oligonucleotide
atctgcaaggcccaggcacagactgac

SEQ ID NO: 22903 - DNA, 26 bp, Artificial Sequence
  Description of Artificial Sequence: Synthetic oligonucleotide
tctgcaaggcccaggcacagactgac

SEQ ID NO: 22904 - DNA, 25 bp, Artificial Sequence
  Description of Artificial Sequence: Synthetic oligonucleotide
ctgcaaggcccaggcacagactgac

SEQ ID NO: 22905 - DNA, 25 bp, Artificial Sequence
  Description of Artificial Sequence: Synthetic oligonucleotide
tgcaaggcccaggcacagactgacc

SEQ ID NO: 22906 - DNA, 24 bp, Artificial Sequence
  Description of Artificial Sequence: Synthetic oligonucleotide
gcaaggcccaggcacagactgacc

SEQ ID NO: 22907 - DNA, 29 bp, Artificial Sequence
  Description of Artificial Sequence: Synthetic oligonucleotide
gattacatcgccctgaacgaggacctgag

SEQ ID NO: 22908 - DNA, 29 bp, Artificial Sequence
  Description of Artificial Sequence: Synthetic oligonucleotide
attacatcgccctgaacgaggacctgagc

SEQ ID NO: 22909 - DNA, 28 bp, Artificial Sequence
  Description of Artificial Sequence: Synthetic oligonucleotide
ttacatcgccctgaacgaggacctgagc

SEQ ID NO: 22910 - DNA, 27 bp, Artificial Sequence
  Description of Artificial Sequence: Synthetic oligonucleotide
tacatcgccctgaacgaggacctgagc

SEQ ID NO: 22911 - DNA, 27 bp, Artificial Sequence
  Description of Artificial Sequence: Synthetic oligonucleotide
acatcgccctgaacgaggacctgagct

SEQ ID NO: 22912 - DNA, 26 bp, Artificial Sequence
  Description of Artificial Sequence: Synthetic oligonucleotide
catcgccctgaacgaggacctgagct

SEQ ID NO: 22913 - DNA, 26 bp, Artificial Sequence
  Description of Artificial Sequence: Synthetic oligonucleotide
atcgccctgaacgaggacctgagctc

SEQ ID NO: 22914 - DNA, 25 bp, Artificial Sequence
  Description of Artificial Sequence: Synthetic oligonucleotide
tcgccctgaacgaggacctgagctc

SEQ ID NO: 22915 - DNA, 24 bp, Artificial Sequence
  Description of Artificial Sequence: Synthetic oligonucleotide
cgccctgaacgaggacctgagctc

SEQ ID NO: 22916 - DNA, 25 bp, Artificial Sequence
  Description of Artificial Sequence: Synthetic oligonucleotide
gccctgaacgaggacctgagctcct

SEQ ID NO: 22917 - DNA, 25 bp, Artificial Sequence
  Description of Artificial Sequence: Synthetic oligonucleotide
ccctgaacgaggacctgagctcctg

SEQ ID NO: 22918 - DNA, 26 bp, Artificial Sequence
  Description of Artificial Sequence: Synthetic oligonucleotide
cctgaacgaggacctgagctcctgga

SEQ ID NO: 22919 - DNA, 26 bp, Artificial Sequence
  Description of Artificial Sequence: Synthetic oligonucleotide
ctgaacgaggacctgagctcctggac

SEQ ID NO: 22920 - DNA, 22 bp, Artificial Sequence
  Description of Artificial Sequence: Synthetic oligonucleotide
agctcctggaccgcggcggaca

SEQ ID NO: 22921 - DNA, 22 bp, Artificial Sequence
  Description of Artificial Sequence: Synthetic oligonucleotide
tgcagcgcgcggaccccccaaa

SEQ ID NO: 22922 - DNA, 21 bp, Artificial Sequence
  Description of Artificial Sequence: Synthetic oligonucleotide
gcagcgcgcggaccccccaaa

SEQ ID NO: 22923 - DNA, 22 bp, Artificial Sequence
  Description of Artificial Sequence: Synthetic oligonucleotide
cagcgcgcggaccccccaaaga

SEQ ID NO: 22924 - DNA, 23 bp, Artificial Sequence
  Description of Artificial Sequence: Synthetic oligonucleotide
agcgcgcggaccccccaaagaca

SEQ ID NO: 22925 - DNA, 22 bp, Artificial Sequence
  Description of Artificial Sequence: Synthetic oligonucleotide
gcgcgcggaccccccaaagaca

SEQ ID NO: 22926 - DNA, 24 bp, Artificial Sequence
  Description of Artificial Sequence: Synthetic oligonucleotide
cgcgcggaccccccaaagacacat

SEQ ID NO: 22927 - DNA, 25 bp, Artificial Sequence
  Description of Artificial Sequence: Synthetic oligonucleotide
gcgcggaccccccaaagacacatgt

SEQ ID NO: 22928 - DNA, 26 bp, Artificial Sequence
  Description of Artificial Sequence: Synthetic oligonucleotide
cgcggaccccccaaagacacatgtga

SEQ ID NO: 22929 - DNA, 26 bp, Artificial Sequence
  Description of Artificial Sequence: Synthetic oligonucleotide
gcggaccccccaaagacacatgtgac

SEQ ID NO: 22930 - DNA, 26 bp, Artificial Sequence
  Description of Artificial Sequence: Synthetic oligonucleotide
cggaccccccaaagacacatgtgacc

SEQ ID NO: 22931 - DNA, 27 bp, Artificial Sequence
  Description of Artificial Sequence: Synthetic oligonucleotide
ggaccccccaaagacacatgtgaccca

SEQ ID NO: 22932 - DNA, 27 bp, Artificial Sequence
  Description of Artificial Sequence: Synthetic oligonucleotide
ccctgagatgggagccatcttcccagt

SEQ ID NO: 22933 - DNA, 27 bp, Artificial Sequence
  Description of Artificial Sequence: Synthetic oligonucleotide
cctgagatgggagccatcttcccagtc

SEQ ID NO: 22934 - DNA, 27 bp, Artificial Sequence
  Description of Artificial Sequence: Synthetic oligonucleotide
ctgagatgggagccatcttcccagtcc

SEQ ID NO: 22935 - DNA, 28 bp, Artificial Sequence
  Description of Artificial Sequence: Synthetic oligonucleotide
tgagatgggagccatcttcccagtccac

SEQ ID NO: 22936 - DNA, 27 bp, Artificial Sequence
  Description of Artificial Sequence: Synthetic oligonucleotide
gagatgggagccatcttcccagtccac

SEQ ID NO: 22937 - DNA, 27 bp, Artificial Sequence
  Description of Artificial Sequence: Synthetic oligonucleotide
agatgggagccatcttcccagtccacc

SEQ ID NO: 22938 - DNA, 27 bp, Artificial Sequence
  Description of Artificial Sequence: Synthetic oligonucleotide
gatgggagccatcttcccagtccacca

SEQ ID NO: 22939 - DNA, 28 bp, Artificial Sequence
  Description of Artificial Sequence: Synthetic oligonucleotide
atgggagccatcttcccagtccaccatc

SEQ ID NO: 22940 - DNA, 27 bp, Artificial Sequence
  Description of Artificial Sequence: Synthetic oligonucleotide
tgggagccatcttcccagtccaccatc

SEQ ID NO: 22941 - DNA, 26 bp, Artificial Sequence
  Description of Artificial Sequence: Synthetic oligonucleotide
gggagccatcttcccagtccaccatc

SEQ ID NO: 22942 - DNA, 26 bp, Artificial Sequence
  Description of Artificial Sequence: Synthetic oligonucleotide
ggagccatcttcccagtccaccatcc

SEQ ID NO: 22943 - DNA, 26 bp, Artificial Sequence
  Description of Artificial Sequence: Synthetic oligonucleotide
gagccatcttcccagtccaccatccc

SEQ ID NO: 22944 - DNA, 27 bp, Artificial Sequence
  Description of Artificial Sequence: Synthetic oligonucleotide
agccatcttcccagtccaccatcccca

SEQ ID NO: 22945 - DNA, 27 bp, Artificial Sequence
  Description of Artificial Sequence: Synthetic oligonucleotide
gccatcttcccagtccaccatccccat

SEQ ID NO: 22946 - DNA, 27 bp, Artificial Sequence
  Description of Artificial Sequence: Synthetic oligonucleotide
ccatcttcccagtccaccatccccatc

SEQ ID NO: 22947 - DNA, 27 bp, Artificial Sequence
  Description of Artificial Sequence: Synthetic oligonucleotide
catcttcccagtccaccatccccatcg

SEQ ID NO: 22948 - DNA, 28 bp, Artificial Sequence
  Description of Artificial Sequence: Synthetic oligonucleotide
atcttcccagtccaccatccccatcgtg

SEQ ID NO: 22949 - DNA, 28 bp, Artificial Sequence
  Description of Artificial Sequence: Synthetic oligonucleotide
ttgtggtcatcggagctgtggtcgctac

SEQ ID NO: 22950 - DNA, 27 bp, Artificial Sequence
  Description of Artificial Sequence: Synthetic oligonucleotide
tgtggtcatcggagctgtggtcgctac

SEQ ID NO: 22951 - DNA, 27 bp, Artificial Sequence
  Description of Artificial Sequence: Synthetic oligonucleotide
gtggtcatcggagctgtggtcgctact

SEQ ID NO: 22952 - DNA, 27 bp, Artificial Sequence
  Description of Artificial Sequence: Synthetic oligonucleotide
tggtcatcggagctgtggtcgctactg

SEQ ID NO: 22953 - DNA, 27 bp, Artificial Sequence
  Description of Artificial Sequence: Synthetic oligonucleotide
ggtcatcggagctgtggtcgctactgt

SEQ ID NO: 22954 - DNA, 27 bp, Artificial Sequence
  Description of Artificial Sequence: Synthetic oligonucleotide
gtcatcggagctgtggtcgctactgtg

SEQ ID NO: 22955 - DNA, 29 bp, Artificial Sequence
  Description of Artificial Sequence: Synthetic oligonucleotide
tcatcggagctgtggtcgctactgtgatg

SEQ ID NO: 22956 - DNA, 28 bp, Artificial Sequence
  Description of Artificial Sequence: Synthetic oligonucleotide
catcggagctgtggtcgctactgtgatg

SEQ ID NO: 22957 - DNA, 29 bp, Artificial Sequence
  Description of Artificial Sequence: Synthetic oligonucleotide
atcggagctgtggtcgctactgtgatgtg

SEQ ID NO: 22958 - DNA, 28 bp, Artificial Sequence
  Description of Artificial Sequence: Synthetic oligonucleotide
tcggagctgtggtcgctactgtgatgtg

SEQ ID NO: 22959 - DNA, 27 bp, Artificial Sequence
  Description of Artificial Sequence: Synthetic oligonucleotide
cggagctgtggtcgctactgtgatgtg

SEQ ID NO: 22960 - DNA, 29 bp, Artificial Sequence
  Description of Artificial Sequence: Synthetic oligonucleotide
ggagctgtggtcgctactgtgatgtgtag

SEQ ID NO: 22961 - DNA, 29 bp, Artificial Sequence
  Description of Artificial Sequence: Synthetic oligonucleotide
gagctgtggtcgctactgtgatgtgtagg

SEQ ID NO: 22962 - DNA, 30 bp, Artificial Sequence
  Description of Artificial Sequence: Synthetic oligonucleotide
agctgtggtcgctactgtgatgtgtaggag

SEQ ID NO: 22963 - DNA, 29 bp, Artificial Sequence
  Description of Artificial Sequence: Synthetic oligonucleotide
gctgtggtcgctactgtgatgtgtaggag

SEQ ID NO: 22964 - DNA, 29 bp, Artificial Sequence
  Description of Artificial Sequence: Synthetic oligonucleotide
ctgtggtcgctactgtgatgtgtaggagg

SEQ ID NO: 22965 - DNA, 31 bp, Artificial Sequence
  Description of Artificial Sequence: Synthetic oligonucleotide
tgtggtcgctactgtgatgtgtaggaggaag

SEQ ID NO: 22966 - DNA, 30 bp, Artificial Sequence
  Description of Artificial Sequence: Synthetic oligonucleotide
gtggtcgctactgtgatgtgtaggaggaag

SEQ ID NO: 22967 - DNA, 31 bp, Artificial Sequence
  Description of Artificial Sequence: Synthetic oligonucleotide
tggtcgctactgtgatgtgtaggaggaagag

SEQ ID NO: 22968 - DNA, 30 bp, Artificial Sequence
  Description of Artificial Sequence: Synthetic oligonucleotide
ggtcgctactgtgatgtgtaggaggaagag

SEQ ID NO: 22969 - DNA, 30 bp, Artificial Sequence
  Description of Artificial Sequence: Synthetic oligonucleotide
gtcgctactgtgatgtgtaggaggaagagc

SEQ ID NO: 22970 - DNA, 31 bp, Artificial Sequence
  Description of Artificial Sequence: Synthetic oligonucleotide
tcgctactgtgatgtgtaggaggaagagctc

SEQ ID NO: 22971 - DNA, 30 bp, Artificial Sequence
  Description of Artificial Sequence: Synthetic oligonucleotide
cgctactgtgatgtgtaggaggaagagctc

SEQ ID NO: 22972 - DNA, 31 bp, Artificial Sequence
  Description of Artificial Sequence: Synthetic oligonucleotide
gctactgtgatgtgtaggaggaagagctcag

SEQ ID NO: 22973 - DNA, 25 bp, Artificial Sequence
  Description of Artificial Sequence: Synthetic oligonucleotide
caggaggggtcggagtattgggacc

SEQ ID NO: 22974 - DNA, 25 bp, Artificial Sequence
  Description of Artificial Sequence: Synthetic oligonucleotide
aggaggggtcggagtattgggaccg

SEQ ID NO: 22975 - DNA, 24 bp, Artificial Sequence
  Description of Artificial Sequence: Synthetic oligonucleotide
ggaggggtcggagtattgggaccg

SEQ ID NO: 22976 - DNA, 26 bp, Artificial Sequence
  Description of Artificial Sequence: Synthetic oligonucleotide
gaggggtcggagtattgggaccggaa

SEQ ID NO: 22977 - DNA, 27 bp, Artificial Sequence
  Description of Artificial Sequence: Synthetic oligonucleotide
aggggtcggagtattgggaccggaaca

SEQ ID NO: 22978 - DNA, 26 bp, Artificial Sequence
  Description of Artificial Sequence: Synthetic oligonucleotide
ggggtcggagtattgggaccggaaca

SEQ ID NO: 22979 - DNA, 27 bp, Artificial Sequence
  Description of Artificial Sequence: Synthetic oligonucleotide
gggtcggagtattgggaccggaacaca

SEQ ID NO: 22980 - DNA, 27 bp, Artificial Sequence
  Description of Artificial Sequence: Synthetic oligonucleotide
ggtcggagtattgggaccggaacacac

SEQ ID NO: 22981 - DNA, 28 bp, Artificial Sequence
  Description of Artificial Sequence: Synthetic oligonucleotide
gtcggagtattgggaccggaacacacag

SEQ ID NO: 22982 - DNA, 30 bp, Artificial Sequence
  Description of Artificial Sequence: Synthetic oligonucleotide
tcggagtattgggaccggaacacacagatc

SEQ ID NO: 22983 - DNA, 26 bp, Artificial Sequence
  Description of Artificial Sequence: Synthetic oligonucleotide
ggctactacaaccagagcgaggacgg

SEQ ID NO: 22984 - DNA, 27 bp, Artificial Sequence
  Description of Artificial Sequence: Synthetic oligonucleotide
gctactacaaccagagcgaggacgggt

SEQ ID NO: 22985 - DNA, 27 bp, Artificial Sequence
  Description of Artificial Sequence: Synthetic oligonucleotide
ctactacaaccagagcgaggacgggtc

SEQ ID NO: 22986 - DNA, 28 bp, Artificial Sequence
  Description of Artificial Sequence: Synthetic oligonucleotide
tactacaaccagagcgaggacgggtctc

SEQ ID NO: 22987 - DNA, 27 bp, Artificial Sequence
  Description of Artificial Sequence: Synthetic oligonucleotide
actacaaccagagcgaggacgggtctc

SEQ ID NO: 22988 - DNA, 27 bp, Artificial Sequence
  Description of Artificial Sequence: Synthetic oligonucleotide
ctacaaccagagcgaggacgggtctca

SEQ ID NO: 22989 - DNA, 27 bp, Artificial Sequence
  Description of Artificial Sequence: Synthetic oligonucleotide
tacaaccagagcgaggacgggtctcac

SEQ ID NO: 22990 - DNA, 27 bp, Artificial Sequence
  Description of Artificial Sequence: Synthetic oligonucleotide
acaaccagagcgaggacgggtctcaca

SEQ ID NO: 22991 - DNA, 26 bp, Artificial Sequence
  Description of Artificial Sequence: Synthetic oligonucleotide
caaccagagcgaggacgggtctcaca

SEQ ID NO: 22992 - DNA, 26 bp, Artificial Sequence
  Description of Artificial Sequence: Synthetic oligonucleotide
aaccagagcgaggacgggtctcacac

SEQ ID NO: 22993 - DNA, 25 bp, Artificial Sequence
  Description of Artificial Sequence: Synthetic oligonucleotide
accagagcgaggacgggtctcacac

SEQ ID NO: 22994 - DNA, 24 bp, Artificial Sequence
  Description of Artificial Sequence: Synthetic oligonucleotide
ccagagcgaggacgggtctcacac

SEQ ID NO: 22995 - DNA, 24 bp, Artificial Sequence
  Description of Artificial Sequence: Synthetic oligonucleotide
cagagcgaggacgggtctcacacc

SEQ ID NO: 22996 - DNA, 25 bp, Artificial Sequence
  Description of Artificial Sequence: Synthetic oligonucleotide
agagcgaggacgggtctcacaccct

SEQ ID NO: 22997 - DNA, 24 bp, Artificial Sequence
  Description of Artificial Sequence: Synthetic oligonucleotide
gagcgaggacgggtctcacaccct

SEQ ID NO: 22998 - DNA, 24 bp, Artificial Sequence
  Description of Artificial Sequence: Synthetic oligonucleotide
agcgaggacgggtctcacaccctc

SEQ ID NO: 22999 - DNA, 23 bp, Artificial Sequence
  Description of Artificial Sequence: Synthetic oligonucleotide
gcgaggacgggtctcacaccctc

SEQ ID NO: 23000 - DNA, 24 bp, Artificial Sequence
  Description of Artificial Sequence: Synthetic oligonucleotide
cgaggacgggtctcacaccctcca

SEQ ID NO: 23001 - DNA, 25 bp, Artificial Sequence
  Description of Artificial Sequence: Synthetic oligonucleotide
gaggacgggtctcacaccctccaga

SEQ ID NO: 23002 - DNA, 25 bp, Artificial Sequence
  Description of Artificial Sequence: Synthetic oligonucleotide
aggacgggtctcacaccctccagag

SEQ ID NO: 23003 - DNA, 24 bp, Artificial Sequence
  Description of Artificial Sequence: Synthetic oligonucleotide
ggacgggtctcacaccctccagag

SEQ ID NO: 23004 - DNA, 26 bp, Artificial Sequence
  Description of Artificial Sequence: Synthetic oligonucleotide
gacgggtctcacaccctccagagcat

SEQ ID NO: 23005 - DNA, 27 bp, Artificial Sequence
  Description of Artificial Sequence: Synthetic oligonucleotide
acgggtctcacaccctccagagcatgt

SEQ ID NO: 23006 - DNA, 26 bp, Artificial Sequence
  Description of Artificial Sequence: Synthetic oligonucleotide
ctcagatcacccagcgcaagtgggac

SEQ ID NO: 23007 - DNA, 26 bp, Artificial Sequence
  Description of Artificial Sequence: Synthetic oligonucleotide
tcagatcacccagcgcaagtgggacg

SEQ ID NO: 23008 - DNA, 25 bp, Artificial Sequence
  Description of Artificial Sequence: Synthetic oligonucleotide
cagatcacccagcgcaagtgggacg

SEQ ID NO: 23009 - DNA, 25 bp, Artificial Sequence
  Description of Artificial Sequence: Synthetic oligonucleotide
agatcacccagcgcaagtgggacgc

SEQ ID NO: 23010 - DNA, 24 bp, Artificial Sequence
  Description of Artificial Sequence: Synthetic oligonucleotide
gatcacccagcgcaagtgggacgc

SEQ ID NO: 23011 - DNA, 24 bp, Artificial Sequence
  Description of Artificial Sequence: Synthetic oligonucleotide
atcacccagcgcaagtgggacgcg

SEQ ID NO: 23012 - DNA, 23 bp, Artificial Sequence
  Description of Artificial Sequence: Synthetic oligonucleotide
tcacccagcgcaagtgggacgcg

SEQ ID NO: 23013 - DNA, 22 bp, Artificial Sequence
  Description of Artificial Sequence: Synthetic oligonucleotide
cacccagcgcaagtgggacgcg

SEQ ID NO: 23014 - DNA, 22 bp, Artificial Sequence
  Description of Artificial Sequence: Synthetic oligonucleotide
acccagcgcaagtgggacgcgg

SEQ ID NO: 23015 - DNA, 21 bp, Artificial Sequence
  Description of Artificial Sequence: Synthetic oligonucleotide
cccagcgcaagtgggacgcgg

SEQ ID NO: 23016 - DNA, 21 bp, Artificial Sequence
  Description of Artificial Sequence: Synthetic oligonucleotide
ccagcgcaagtgggacgcggc

SEQ ID NO: 23017 - DNA, 21 bp, Artificial Sequence
  Description of Artificial Sequence: Synthetic oligonucleotide
cagcgcaagtgggacgcggcc

SEQ ID NO: 23018 - DNA, 21 bp, Artificial Sequence
  Description of Artificial Sequence: Synthetic oligonucleotide
agcgcaagtgggacgcggccc

SEQ ID NO: 23019 - DNA, 20 bp, Artificial Sequence
  Description of Artificial Sequence: Synthetic oligonucleotide
gcgcaagtgggacgcggccc

SEQ ID NO: 23020 - DNA, 21 bp, Artificial Sequence
  Description of Artificial Sequence: Synthetic oligonucleotide
cgcaagtgggacgcggcccgt

SEQ ID NO: 23021 - DNA, 22 bp, Artificial Sequence
  Description of Artificial Sequence: Synthetic oligonucleotide
gcaagtgggacgcggcccgtga

SEQ ID NO: 23022 - DNA, 22 bp, Artificial Sequence
  Description of Artificial Sequence: Synthetic oligonucleotide
caagtgggacgcggcccgtgag

SEQ ID NO: 23023 - DNA, 22 bp, Artificial Sequence
  Description of Artificial Sequence: Synthetic oligonucleotide
aagtgggacgcggcccgtgagg

SEQ ID NO: 23024 - DNA, 21 bp, Artificial Sequence
  Description of Artificial Sequence: Synthetic oligonucleotide
agtgggacgcggcccgtgagg

SEQ ID NO: 23025 - DNA, 20 bp, Artificial Sequence
  Description of Artificial Sequence: Synthetic oligonucleotide
gtgggacgcggcccgtgagg

SEQ ID NO: 23026 - DNA, 20 bp, Artificial Sequence
  Description of Artificial Sequence: Synthetic oligonucleotide
tgggacgcggcccgtgaggc

SEQ ID NO: 23027 - DNA, 20 bp, Artificial Sequence
  Description of Artificial Sequence: Synthetic oligonucleotide
gggacgcggcccgtgaggct

SEQ ID NO: 23028 - DNA, 20 bp, Artificial Sequence
  Description of Artificial Sequence: Synthetic oligonucleotide
ggacgcggcccgtgaggcgt

SEQ ID NO: 23029 - DNA, 20 bp, Artificial Sequence
  Description of Artificial Sequence: Synthetic oligonucleotide
gacgcggcccgtgaggcgga

SEQ ID NO: 23030 - DNA, 20 bp, Artificial Sequence
  Description of Artificial Sequence: Synthetic oligonucleotide
acgcggcccgtgaggcggag

SEQ ID NO: 23031 - DNA, 20 bp, Artificial Sequence
  Description of Artificial Sequence: Synthetic oligonucleotide
cgcggcccgtgaggcggagt

SEQ ID NO: 23032 - DNA, 26 bp, Artificial Sequence
  Description of Artificial Sequence: Synthetic oligonucleotide
cacccagttcgtgaggttcgacagcg

SEQ ID NO: 23033 - DNA, 26 bp, Artificial Sequence
  Description of Artificial Sequence: Synthetic oligonucleotide
acccagttcgtgaggttcgacagcgg

SEQ ID NO: 23034 - DNA, 25 bp, Artificial Sequence
  Description of Artificial Sequence: Synthetic oligonucleotide
cccagttcgtgaggttcgacagcgg

SEQ ID NO: 23035 - DNA, 25 bp, Artificial Sequence
  Description of Artificial Sequence: Synthetic oligonucleotide
ccagttcgtgaggttcgacagcggc

SEQ ID NO: 23036 - DNA, 25 bp, Artificial Sequence
  Description of Artificial Sequence: Synthetic oligonucleotide
cagttcgtgaggttcgacagcggcg

SEQ ID NO: 23037 - DNA, 25 bp, Artificial Sequence
  Description of Artificial Sequence: Synthetic oligonucleotide
agttcgtgaggttcgacagcggcgc

SEQ ID NO: 23038 - DNA, 24 bp, Artificial Sequence
  Description of Artificial Sequence: Synthetic oligonucleotide
gttcgtgaggttcgacagcggcgc

SEQ ID NO: 23039 - DNA, 24 bp, Artificial Sequence
  Description of Artificial Sequence: Synthetic oligonucleotide
ttcgtgaggttcgacagcggcgcc

SEQ ID NO: 23040 - DNA, 23 bp, Artificial Sequence
  Description of Artificial Sequence: Synthetic oligonucleotide
tcgtgaggttcgacagcggcgcc

SEQ ID NO: 23041 - DNA, 22 bp, Artificial Sequence
  Description of Artificial Sequence: Synthetic oligonucleotide
cgtgaggttcgacagcggcgcc

SEQ ID NO: 23042 - DNA, 22 bp, Artificial Sequence
  Description of Artificial Sequence: Synthetic oligonucleotide
gtgaggttcgacagcggcgccg

SEQ ID NO: 23043 - DNA, 22 bp, Artificial Sequence
  Description of Artificial Sequence: Synthetic oligonucleotide
tgaggttcgacagcggcgccgc

SEQ ID NO: 23044 - DNA, 21 bp, Artificial Sequence
  Description of Artificial Sequence: Synthetic oligonucleotide
gaggttcgacagcggcgccgc

SEQ ID NO: 23045 - DNA, 22 bp, Artificial Sequence
  Description of Artificial Sequence: Synthetic oligonucleotide
aggttcgacagcggcgccgcga

SEQ ID NO: 23046 - DNA, 21 bp, Artificial Sequence
  Description of Artificial Sequence: Synthetic oligonucleotide
ggttcgacagcggcgccgcga

SEQ ID NO: 23047 - DNA, 22 bp, Artificial Sequence
  Description of Artificial Sequence: Synthetic oligonucleotide
gttcgacagcggcgccgcgagt

SEQ ID NO: 23048 - DNA, 22 bp, Artificial Sequence
  Description of Artificial Sequence: Synthetic oligonucleotide
ttcgacagcggcgccgcgagtc

SEQ ID NO: 23049 - DNA, 21 bp, Artificial Sequence
  Description of Artificial Sequence: Synthetic oligonucleotide
tcgacagcggcgccgcgagtc

SEQ ID NO: 23050 - DNA, 20 bp, Artificial Sequence
  Description of Artificial Sequence: Synthetic oligonucleotide
cgacagcggcgccgcgagtc

SEQ ID NO: 23051 - DNA, 20 bp, Artificial Sequence
  Description of Artificial Sequence: Synthetic oligonucleotide
gacagcggcgccgcgagtcc

SEQ ID NO: 23052 - DNA, 21 bp, Artificial Sequence
  Description of Artificial Sequence: Synthetic oligonucleotide
acagcggcgccgcgagtccga

SEQ ID NO: 23053 - DNA, 20 bp, Artificial Sequence
  Description of Artificial Sequence: Synthetic oligonucleotide
cagcggcgccgcgagtccga

SEQ ID NO: 23054 - DNA, 21 bp, Artificial Sequence
  Description of Artificial Sequence: Synthetic oligonucleotide
agcggcgccgcgagtccgaga

SEQ ID NO: 23055 - DNA, 20 bp, Artificial Sequence
  Description of Artificial Sequence: Synthetic oligonucleotide
gcggcgccgcgagtccgaga

SEQ ID NO: 23056 - DNA, 21 bp, Artificial Sequence
  Description of Artificial Sequence: Synthetic oligonucleotide
cggcgccgcgagtccgagaga

SEQ ID NO: 23057 - DNA, 21 bp, Artificial Sequence
  Description of Artificial Sequence: Synthetic oligonucleotide
ggcgccgcgagtccgagagag

SEQ ID NO: 23058 - DNA, 22 bp, Artificial Sequence
  Description of Artificial Sequence: Synthetic oligonucleotide
gcgccgcgagtccgagagagga

SEQ ID NO: 23059 - DNA, 29 bp, Artificial Sequence
  Description of Artificial Sequence: Synthetic oligonucleotide
agatctacaaggcccaggcacagactgtc

SEQ ID NO: 23060 - DNA, 28 bp, Artificial Sequence
  Description of Artificial Sequence: Synthetic oligonucleotide
gatctacaaggcccaggcacagactgtc

SEQ ID NO: 23061 - DNA, 28 bp, Artificial Sequence
  Description of Artificial Sequence: Synthetic oligonucleotide
atctacaaggcccaggcacagactgtcc

SEQ ID NO: 23062 - DNA, 27 bp, Artificial Sequence
  Description of Artificial Sequence: Synthetic oligonucleotide
tctacaaggcccaggcacagactgtcc

SEQ ID NO: 23063 - DNA, 26 bp, Artificial Sequence
  Description of Artificial Sequence: Synthetic oligonucleotide
ctacaaggcccaggcacagactgtcc

SEQ ID NO: 23064 - DNA, 27 bp, Artificial Sequence
  Description of Artificial Sequence: Synthetic oligonucleotide
tacaaggcccaggcacagactgtccga

SEQ ID NO: 23065 - DNA, 26 bp, Artificial Sequence
  Description of Artificial Sequence: Synthetic oligonucleotide
acaaggcccaggcacagactgtccga

SEQ ID NO: 23066 - DNA, 25 bp, Artificial Sequence
  Description of Artificial Sequence: Synthetic oligonucleotide
caaggcccaggcacagactgtccga

SEQ ID NO: 23067 - DNA, 26 bp, Artificial Sequence
  Description of Artificial Sequence: Synthetic oligonucleotide
aaggcccaggcacagactgtccgaga

SEQ ID NO: 23068 - DNA, 25 bp, Artificial Sequence
  Description of Artificial Sequence: Synthetic oligonucleotide
aggcccaggcacagactgtccgaga

SEQ ID NO: 23069 - DNA, 24 bp, Artificial Sequence
  Description of Artificial Sequence: Synthetic oligonucleotide
ggcccaggcacagactgtccgaga

SEQ ID NO: 23070 - DNA, 25 bp, Artificial Sequence
  Description of Artificial Sequence: Synthetic oligonucleotide
gcccaggcacagactgtccgagaga

SEQ ID NO: 23071 - DNA, 25 bp, Artificial Sequence
  Description of Artificial Sequence: Synthetic oligonucleotide
cccaggcacagactgtccgagagag

SEQ ID NO: 23072 - DNA, 25 bp, Artificial Sequence
  Description of Artificial Sequence: Synthetic oligonucleotide
ccaggcacagactgtccgagagagc

SEQ ID NO: 23073 - DNA, 26 bp, Artificial Sequence
  Description of Artificial Sequence: Synthetic oligonucleotide
caggcacagactgtccgagagagcct

SEQ ID NO: 23074 - DNA, 26 bp, Artificial Sequence
  Description of Artificial Sequence: Synthetic oligonucleotide
aggcacagactgtccgagagagcctg

SEQ ID NO: 23075 - DNA, 25 bp, Artificial Sequence
  Description of Artificial Sequence: Synthetic oligonucleotide
ggcacagactgtccgagagagcctg

SEQ ID NO: 23076 - DNA, 25 bp, Artificial Sequence
  Description of Artificial Sequence: Synthetic oligonucleotide
gcacagactgtccgagagagcctgc

SEQ ID NO: 23077 - DNA, 25 bp, Artificial Sequence
  Description of Artificial Sequence: Synthetic oligonucleotide
cacagactgtccgagagagcctgcg

SEQ ID NO: 23078 - DNA, 27 bp, Artificial Sequence
  Description of Artificial Sequence: Synthetic oligonucleotide
acagactgtccgagagagcctgcggaa

SEQ ID NO: 23079 - DNA, 26 bp, Artificial Sequence
  Description of Artificial Sequence: Synthetic oligonucleotide
cagactgtccgagagagcctgcggaa

SEQ ID NO: 23080 - DNA, 26 bp, Artificial Sequence
  Description of Artificial Sequence: Synthetic oligonucleotide
agactgtccgagagagcctgcggaac

SEQ ID NO: 23081 - DNA, 25 bp, Artificial Sequence
  Description of Artificial Sequence: Synthetic oligonucleotide
gactgtccgagagagcctgcggaac

SEQ ID NO: 23082 - DNA, 26 bp, Artificial Sequence
  Description of Artificial Sequence: Synthetic oligonucleotide
actgtccgagagagcctgcggaacct

SEQ ID NO: 23083 - DNA, 25 bp, Artificial Sequence
  Description of Artificial Sequence: Synthetic oligonucleotide
ctgtccgagagagcctgcggaacct

SEQ ID NO: 23084 - DNA, 25 bp, Artificial Sequence
  Description of Artificial Sequence: Synthetic oligonucleotide
tgtccgagagagcctgcggaacctg

SEQ ID NO: 23085 - DNA, 24 bp, Artificial Sequence
  Description of Artificial Sequence: Synthetic oligonucleotide
gtccgagagagcctgcggaacctg

SEQ ID NO: 23086 - DNA, 24 bp, Artificial Sequence
  Description of Artificial Sequence: Synthetic oligonucleotide
tccgagagagcctgcggaacctgc

SEQ ID NO: 23087 - DNA, 24 bp, Artificial Sequence
  Description of Artificial Sequence: Synthetic oligonucleotide
gcggctcagatcacccagcgcaag

SEQ ID NO: 23088 - DNA, 24 bp, Artificial Sequence
  Description of Artificial Sequence: Synthetic oligonucleotide
cggctcagatcacccagcgcaagc

SEQ ID NO: 23089 - DNA, 24 bp, Artificial Sequence
  Description of Artificial Sequence: Synthetic oligonucleotide
ggctcagatcacccagcgcaagcg

SEQ ID NO: 23090 - DNA, 24 bp, Artificial Sequence
  Description of Artificial Sequence: Synthetic oligonucleotide
gctcagatcacccagcgcaagcgg

SEQ ID NO: 23091 - DNA, 25 bp, Artificial Sequence
  Description of Artificial Sequence: Synthetic oligonucleotide
ctcagatcacccagcgcaagcggga

SEQ ID NO: 23092 - DNA, 25 bp, Artificial Sequence
  Description of Artificial Sequence: Synthetic oligonucleotide
tcagatcacccagcgcaagcgggag

SEQ ID NO: 23093 - DNA, 24 bp, Artificial Sequence
  Description of Artificial Sequence: Synthetic oligonucleotide
cagatcacccagcgcaagcgggag

(The sequence listing continues in the following parts.)

What is claimed is:

1. A method for human leukocyte antigen (HLA) tissue typing, said method comprising:
   (a) contacting a cDNA-or cRNA-containing sample under hybridization conditions with a plurality of capture oligonucleotides specific for HLA polypeptides, wherein said hybridization conditions facilitate hybridization of at least a portion of the plurality of capture oligonucleotides to complementary sequences present in the cDNA or cRNA;
   (b) detecting a hybridization pattern for said cDNA or cRNA; and
   (c) assigning to the sample, based on the hybridization pattern, an HLA tissue type;

wherein the capture oligonucleotides are from about 17 to about 60 nucleotides in length and each capture oligonucleotide with respect to its exact complement has a melting temperature of about 64 degrees Celsius;

wherein said capture oligonucleotides comprise subsets of oligonucleotides that collectively target classical HLA polypeptide-encoding nucleic acids ("classical HLA oligo subsets"), each classical HLA oligo subset targeting a different classical HLA polypeptide-encoding nucleic acid;

wherein each of said classical HLA oligo subsets comprises a set of overlapping oligonucleotides that cover every single nucleotide position in each of the full-length coding regions of mRNA sequences coding for the classical HLA polypeptides from 5' to 3' and are sequentially shifted by 1-5 nucleotides from the 5' end of the preceding overlapping oligonucleotide, and wherein said classical HLA oligo subsets comprise the sequences set forth in Table I or the normal (indicated by "HPN"), extended (indicated by "HPE") and truncated (indicated by "HPT") sequences set forth in Table X.

2. The method of claim 1, wherein said classical HLA polypeptide-encoding nucleic acids encode HLA polypeptides selected from the group consisting of HLA-A, HLA-B, HLA-C, HLA-DR, HLA-DP, and HLA-DQ.

3. The method of claim 1, wherein said capture oligonucleotides further comprise a plurality of oligonucleotide subsets that collectively targets non-classical HLA polypeptide-encoding nucleic acids ("non-classical HLA oligo subsets"), each non-classical HLA oligo subset targeting a different non-classical HLA polypeptide-encoding nucleic acid;

wherein each of said non-classical HLA oligo subsets comprises a set of overlapping oligonucleotides that cover every single nucleotide position in the mRNA sequences coding for the non-classical HLA polypeptides from 5' to 3' and are sequentially shifted by 1-5 nucleotides from the 5' end of the preceding overlapping oligonucleotide.

4. The method of claim 3, wherein said non-classical HLA polypeptide-encoding nucleic acids encode HLA polypeptides selected from the group consisting of HLA-E, HLA-F, HLA-G, DM, DO and MIC.

5. The method of claim 1, wherein said capture oligonucleotides further comprise a plurality of oligonucleotide subsets that collectively targets nucleic acids encoding accessory molecules important in HLA-linked peptide presentation and/or processing ("accessory molecule oligo subsets"), and said method further comprises the step of assigning to the sample, based on the hybridization pattern, an accessory molecule phenotype;

wherein each of said accessory molecule oligo subsets comprises a set of overlapping oligonucleotides that cover every single nucleotide position in the mRNA sequences coding for the accessory molecules from 5' to 3' and are sequentially shifted by 1-5 nucleotides from the 5' end of the preceding overlapping oligonucleotide.

6. The method of claim 5, wherein said accessory molecules are selected from the group consisting of LMP2, LMP7, LMP10, tripeptidyl peptidase II (TPPII), bleomycin hydrolase (BLMH), leucine aminopeptidase 3 (LAP3), transporter associated with antigen processing (TAP) 1, TAP2,β2-microglobulin, TAP binding protein (tapasin), calnexin (CANX), calreticulin (CALR), protein disulfide isomerase family A member 2 (PDIA2), protein disulfide isomerase family A member 3 (PDIA3), ERp57, endoplasmic reticulum aminopeptidase (ERAP) 1, ERAP2, proteasome (prosome macropain) subunit althap (PSMA) type I (PSMA1), PSMA2, PSMA3, PSMA4, PSMA5, PSMA6, PSMA7, PSMA8, proteasome (prosome macropain) subunit beta (PSMB) type 1 (PSMB1), PSMB2, PSMB3, PSMB4, PSMB5, PSMB6, PSMB7, PSMB8, PSMB9, PSMB10, PSMB11, proteasome (prosome macropain) 26S subunit ATPase (PSMC) 1 (PSMC1); PSMC2, PSMC3, PSMC4, PSMC5, PSMC6, proteasome (prosome macropain) 26S subunit non-ATPase (PSMD) 1 (PSMD1), PSMD2, PSMD3, PSMD4, PSMD5, PSMD6, PSMD7, PSMD8, PSMD9, PSMD10, PSMD11, PSMD12, PSMD13, and PSMD14.

7. The method of claim 1, wherein said capture oligonucleotides further comprise a plurality of oligonucleotide subsets targeting killer-cell immunoglobulin-like receptor (KIR) polypeptide-encoding nucleic acids ("KIR oligo subsets"), and said method further comprises the step of assigning to the sample, based on the hybridization pattern, a KIR polypeptide phenotype; wherein each of said KIR oligo subsets comprises a set of overlapping oligonucleotides that cover every single nucleotide position in the mRNA sequences coding for the KIR polypeptides from 5' to 3' and are sequentially shifted by 1-5 nucleotides from the 5' end of the preceding overlapping oligonucleotide.

8. The method of claim 1, wherein said capture oligonucleotides further comprise a plurality of oligonucleotide subsets targeting blood group-determining polypeptide encoding nucleic acids ("blood group determining oligo subsets"), and said method further comprises the step of assigning to the sample, based on the hybridization pattern, a blood group phenotype;

wherein each of said blood group determining oligo subsets comprises a set of overlapping oligonucleotides that cover every single nucleotide position in the mRNA sequences coding for the blood group-determining polypeptides from 5' to 3' and are sequentially shifted by 1-5 nucleotides from the 5' end of the preceding overlapping oligonucleotide.

9. The method of claim 8, wherein said blood group determining polypeptides are selected from the group consisting ABO (ABO), Chido Rodgers (CH/RG), Colton (CO), Cromer (CROM), Diego (DI) (band 3), Dombrock (DO), Duffy (DARC), Gerbich (Ge), Gill (GIL), Globoside and Pk, H (H), I (I), Indian (IN), John Milton Hagen (JMH), Kell (KEL) and Kx(XK), Kidd (JK), Knops (KN), Landsteiner-Wiener (LW), Lewis (LE), Lutheran (LU), MNS (MNS, Glycophorins A, B and E), Ok (OK), Raph (RAPH), Rh(RH) and Rh-gp (RHAG), Scianna (SC), T/Tn, Xg (XG), and Yt (YT).

10. The method of claim 1, further comprising the step of deriving from the HLA tissue type assigned in step (c) donor/recipient transplant compatibility.

11. The method of claim 3, wherein said non-classical HLA oligo subsets comprise the sequences set forth in Table II.

12. The method of claim 5, wherein said accessory molecule oligo subsets comprise the sequences set forth in Table III.

13. The method of claim 7, wherein said KIR oligo subsets comprise the sequences set forth in Table IV.

14. The method of claim 8, wherein said blood group determining oligo subsets comprise the sequences set forth in Table V.

15. The method of claim 1, wherein the cDNA or cRNA in said sample was detectably labeled during its synthesis, and said detecting step (b) comprises detecting the detectably labeled cDNA or cRNA.

16. The method of claim 1, wherein said cDNA or cRNA-containing sample is obtained from a human subject.

17. The method of claim 16, further comprising the step of diagnosing or predicting the likelihood of an HLA-linked genetic defect, disease, inadequate or undesirable response to a vaccine, biologic treatment (recombinant protein, biosimilar or equivalent), or infectious organism, or condition in said subject, wherein the step is based on at least the classical HLA tissue type assigned in step (c).

18. The method of claim 16, further comprising the step of determining the likely response of said subject to a particular treatment regimen selected from the group consisting of: bone marrow transplantation, immunosuppressive regimen, antiviral drug regimen, antiviral drug resistance, antiretroviral drug regimen, and autoimmunity drug regimen, wherein the step is based on at least the classical HLA tissue type assigned in step (c).

19. The method of claim 16, further comprising the step of determining whether the subject is likely to develop antiretroviral drug resistance or cancer drug regimen resistance, wherein the step is based on at least the classical HLA tissue type assigned in step (c).

20. The method of claim 1, wherein said capture oligonucleotides further comprise at least one set of negative control oligonucleotides.

21. The method of claim 20, wherein said at least one set of negative control oligonucleotides comprises two or more of the nucleic acid sequences set forth in at least one of Tables VI-IX and Table X.

22. The method of claim 1, wherein said classical HLA oligo subsets collectively target all known classical HLA polypeptide-encoding nucleic acids.

23. The method of claim 3, wherein said non-classical HLA oligo subsets collectively target all known non-classical HLA polypeptide-encoding nucleic acids.

24. The method of claim 1, wherein said capture oligonucleotides are immobilized on a substrate.

25. The method of claim 1, wherein the detecting step (b) comprises the use of labeled detection probes, wherein the labeled detection probes hybridize to the cDNA or cRNA that has hybridized to the at least a portion of the plurality of capture oligonucleotides and are detectable such that the hybridization pattern of said cDNA or cRNA can be determined.

26. The method of claim 17, wherein the step of diagnosing or predicting the likelihood of an HLA-linked genetic defect, disease, inadequate or undesirable response to a vaccine, biologic treatment (recombinant protein, biosimilar or equivalent), or infectious organism, or condition in said subject, is further based on one or more of a non-classical HLA tissue type, an accessory molecule phenotype, a KIR polypeptide phenotype, and a blood group phenotype.

27. The method of claim 18, wherein the step of determining the likely response of said subject to a particular treatment regimen selected from the group consisting of: bone marrow transplantation, immunosuppressive regimen, antiviral drug regimen, antiviral drug resistance, antiretroviral drug regimen, and autoimmunity drug regimen is further based on one or more of a non-classical HLA tissue type, an accessory molecule phenotype, a KIR polypeptide phenotype, and a blood group phenotype.

28. A method for human leukocyte antigen (HLA) tissue typing, said method comprising:
(a) contacting a cDNA- or cRNA-containing sample under hybridization conditions with a plurality of capture oligonucleotides specific for HLA polypeptides, wherein said hybridization conditions facilitate hybridization of at least a portion of the plurality of capture oligonucleotides to complementary sequences present in the cDNA or CRNA;
(b) detecting a hybridization pattern for said cDNA or CRNA; and
(c) assigning to the sample, based on the hybridization pattern, an HLA tissue type;
wherein the capture oligonucleotides are from about 17 to about 60 nucleotides in length and each capture oligonucleotide with respect to its exact complement has a melting temperature of about 64 degrees Celsius;
wherein said capture oligonucleotides comprise subsets of oligonucleotides that collectively target classical HLA polypeptide-encoding nucleic acids ("classical HLA oligo subsets"), each classical HLA oligo subset targeting a different classical HLA polypeptide-encoding nucleic acid; and
wherein each of said classical HLA oligo subsets comprises a set of overlapping oligonucleotides that cover every single nucleotide position in each of the full-length coding regions of mRNA sequences coding for the classical HLA polypeptides from 5' to 3' and are sequentially shifted by 1-5 nucleotides from the 5' end of the preceding overlapping oligonucleotide;
wherein said cDNA or cRNA-containing sample is obtained from a human subject;
wherein the method further comprising the step of determining whether the human subject is likely to develop antiretroviral drug resistance or cancer drug regimen resistance, the step being based on at least the classical HLA tissue type assigned in step (c); and
wherein the step of determining whether the subject is likely to develop antiretroviral drug resistance or cancer drug regimen resistance is further based on one or more of a non-classical HLA tissue type, an accessory molecule phenotype, a KIR polypeptide phenotype, and a blood group phenotype.

29. The method of claim 28, wherein said classical HLA polypeptide-encoding nucleic acids encode HLA polypeptides selected from the group consisting of HLA-A, HLA-B, HLA-C, HLA-DR, HLA-DP, and HLA-DQ.

30. The method of claim 28, wherein said classical HLA oligo subsets comprise the sequences set forth in Table I or the normal (indicated by "HPN"), extended (indicated by "HPE") and truncated (indicated by "HPT") sequences set forth in Table X.

31. The method of claim 28, wherein said capture oligonucleotides further comprise a plurality of oligonucleotide subsets that collectively targets non-classical HLA polypeptide-encoding nucleic acids ("non-classical HLA oligo subsets"), each non-classical HLA oligo subset targeting a different non-classical HLA polypeptide-encoding nucleic acid;
wherein each of said non-classical HLA oligo subsets comprises a set of overlapping oligonucleotides that cover every single nucleotide position in the mRNA sequences coding for the non-classical HLA polypeptides from 5' to 3' and are sequentially shifted by 1-5 nucleotides from the 5' end of the preceding overlapping oligonucleotide.

32. The method of claim 31, wherein said non-classical HLA polypeptide-encoding nucleic acids encode HLA polypeptides selected from the group consisting of HLA-E, HLA-F, HLA-G, DM, DO and MIC.

33. The method of claim 28, wherein said capture oligonucleotides further comprise a plurality of oligonucleotide subsets that collectively targets nucleic acids encoding accessory molecules important in HLA-linked peptide presentation and/or processing ("accessory molecule oligo subsets"), and said method further comprises the step of assigning to the sample, based on the hybridization pattern, an accessory molecule phenotype;

wherein each of said accessory molecule oligo subsets comprises a set of overlapping oligonucleotides that cover every single nucleotide position in the mRNA sequences coding for the accessory molecules from 5' to 3' and are sequentially shifted by 1-5 nucleotides from the 5' end of the preceding overlapping oligonucleotide.

34. The method of claim 33, wherein said accessory molecules are selected from the group consisting of LMP2, LMP7, LMP10, tripeptidyl peptidase II (TPPII), bleomycin hydrolase (BLMH), leucine aminopeptidase 3 (LAP3), transporter associated with antigen processing (TAP) 1, TAP2,β2-microglobulin, TAP binding protein (tapasin), calnexin (CANX), calreticulin (CALR), protein disulfide isomerase family A member 2 (PDIA2), protein disulfide isomerase family A member 3 (PDIA3), ERp57, endoplasmic reticulum aminopeptidase (ERAP) 1, ERAP2, proteasome (prosome macropain) subunit althap (PSMA) type I (PSMA1), PSMA2, PSMA3, PSMA4, PSMA5, PSMA6, PSMA7, PSMA8, proteasome (prosome macropain) subunit beta (PSMB) type 1 (PSMB1), PSMB2, PSMB3, PSMB4, PSMB5, PSMB6, PSMB7, PSMB8, PSMB9, PSMB10, PSMB11, proteasome (prosome macropain) 26S subunit ATPase (PSMC) 1 (PSMC1); PSMC2, PSMC3, PSMC4, PSMC5, PSMC6, proteasome (prosome macropain) 26S subunit non-ATPase (PSMD) 1 (PSMD1), PSMD2, PSMD3, PSMD4, PSMD5, PSMD6, PSMD7, PSMD8, PSMD9, PSMD10, PSMD11, PSMD12, PSMD13, and PSMD14.

35. The method of claim 28, wherein said capture oligonucleotides further comprise a plurality of oligonucleotide subsets targeting killer-cell immunoglobulin-like receptor (KIR) polypeptide-encoding nucleic acids ("KIR oligo subsets"), and said method further comprises the step of assigning to the sample, based on the hybridization pattern, a KIR polypeptide phenotype; wherein each of said KIR oligo subsets comprises a set of overlapping oligonucleotides that cover every single nucleotide position in the mRNA sequences coding for the KIR polypeptides from 5' to 3' and are sequentially shifted by 1-5 nucleotides from the 5' end of the preceding overlapping oligonucleotide.

36. The method of claim 28, wherein said capture oligonucleotides further comprise a plurality of oligonucleotide subsets targeting blood group-determining polypeptide encoding nucleic acids ("blood group determining oligo subsets"), and said method further comprises the step of assigning to the sample, based on the hybridization pattern, a blood group phenotype;
wherein each of said blood group determining oligo subsets comprises a set of overlapping oligonucleotides that cover every single nucleotide position in the mRNA sequences coding for the blood group-determining polypeptides from 5' to 3' and are sequentially shifted by 1-5 nucleotides from the 5' end of the preceding overlapping oligonucleotide.

37. The method of claim 36, wherein said blood group determining polypeptides are selected from the group consisting ABO (ABO), Chido Rodgers (CH/RG), Colton (CO), Cromer (CROM), Diego (DI) (band 3), Dombrock (DO), Duffy (DARC), Gerbich (Ge), Gill (GIL), Globoside and Pk, H (H), I (I), Indian (IN), John Milton Hagen (JMH), Kell (KEL) and Kx(XK), Kidd (JK), Knops (KN), Landsteiner-Wiener (LW), Lewis (LE), Lutheran (LU), MNS (MNS, Glycophorins A, B and E), Ok (OK), Raph (RAPH), Rh(RH) and Rh-gp (RHAG), Scianna (SC), T/Tn, Xg (XG), and Yt (YT).

38. The method of claim 28, further comprising the step of deriving from the HLA tissue type assigned in step (c) donor/recipient transplant compatibility.

39. The method of claim 31, wherein said non-classical HLA oligo subsets comprise the sequences set forth in Table II.

40. The method of claim 33, wherein said accessory molecule oligo subsets comprise the sequences set forth in Table III.

41. The method of claim 35, wherein said KIR oligo subsets comprise the sequences set forth in Table IV.

42. The method of claim 36, wherein said blood group determining oligo subsets comprise the sequences set forth in Table V.

43. The method of claim 28, wherein the cDNA or cRNA in said sample was detectably labeled during its synthesis, and said detecting step (b) comprises detecting the detectably labeled cDNA or cRNA.

44. The method of claim 28, further comprising the step of diagnosing or predicting the likelihood of an HLA-linked genetic defect, disease, inadequate or undesirable response to a vaccine, biologic treatment (recombinant protein, biosimilar or equivalent), or infectious organism, or condition in said subject, wherein the step is based on at least the classical HLA tissue type assigned in step (c).

45. The method of claim 28, further comprising the step of determining the likely response of said subject to a particular treatment regimen selected from the group consisting of: bone marrow transplantation, immunosuppressive regimen, antiviral drug regimen, antiviral drug resistance, antiretroviral drug regimen, and autoimmunity drug regimen, wherein the step is based on at least the classical HLA tissue type assigned in step (c).

46. The method of claim 28, wherein said capture oligonucleotides further comprise at least one set of negative control oligonucleotides.

47. The method of claim 46, wherein said at least one set of negative control oligonucleotides comprises two or more of the nucleic acid sequences set forth in at least one of Tables VI-IX and Table X.

48. The method of claim 28, wherein said classical HLA oligo subsets collectively target all known classical HLA polypeptide-encoding nucleic acids.

49. The method of claim 31, wherein said non-classical HLA oligo subsets collectively target all known non-classical HLA polypeptide-encoding nucleic acids.

50. The method of claim 28, wherein said capture oligonucleotides are immobilized on a substrate.

51. The method of claim 28, wherein the detecting step (b) comprises the use of labeled detection probes, wherein the labeled detection probes hybridize to the cDNA or cRNA that has hybridized to the at least a portion of the plurality of capture oligonucleotides and are detectable such that the hybridization pattern of said cDNA or cRNA can be determined.

52. The method of claim 44, wherein the step of diagnosing or predicting the likelihood of an HLA-linked genetic defect, disease, inadequate or undesirable response to a vaccine, biologic treatment (recombinant protein, biosimilar or equivalent), or infectious organism, or condition in said subject, is further based on one or more of a non-classical HLA tissue type, an accessory molecule phenotype, a KIR polypeptide phenotype, and a blood group phenotype.

53. The method of claim 52, wherein the step of determining the likely response of said subject to a particular treatment regimen selected from the group consisting of:
bone marrow transplantation, immunosuppressive regimen, antiviral drug regimen, antiviral drug resistance, antiretroviral drug regimen, and autoimmunity drug regimen is further based on one or more of a non-classical HLA tissue type, an accessory molecule phenotype, a KIR polypeptide phenotype, and a blood group phenotype.

54. A method for human leukocyte antigen (HLA) tissue typing, said method comprising:
(a) contacting a cDNA- or cRNA-containing sample under hybridization conditions with a plurality of capture oligonucleotides specific for HLA polypeptides, wherein said hybridization conditions facilitate hybridization of at least a portion of the plurality of capture oligonucleotides to complementary sequences present in the cDNA or cRNA;
(b) detecting a hybridization pattern for said cDNA or cRNA; and
(c) assigning to the sample, based on the hybridization pattern, an HLA tissue type;
wherein the capture oligonucleotides are from about 17 to about 60 nucleotides in length and each capture oligonucleotide with respect to its exact complement has a melting temperature of about 64 degrees Celsius;
wherein said capture oligonucleotides comprise subsets of oligonucleotides that collectively target classical HLA polypeptide-encoding nucleic acids ("classical HLA oligo subsets"), each classical HLA oligo subset targeting a different classical HLA polypeptide-encoding nucleic acid;
wherein each of said classical HLA oligo subsets comprises a set of overlapping oligonucleotides that cover every single nucleotide position in each of the full-length coding regions of mRNA sequences coding for the classical HLA polypeptides from 5' to 3' and are sequentially shifted by 1-5 nucleotides from the 5' end of the preceding overlapping oligonucleotide;
wherein said capture oligonucleotides further comprise at least one set of negative control oligonucleotides; and
wherein said at least one set of negative control oligonucleotides comprises two or more of the nucleic acid sequences set forth in at least one of Tables VI-IX and Table X.

55. The method of claim 54, wherein said capture oligonucleotides further comprise a plurality of oligonucleotide subsets that collectively targets non-classical HLA polypeptide-encoding nucleic acids ("non-classical HLA oligo subsets"), each non-classical HLA oligo subset targeting a different non-classical HLA polypeptide-encoding nucleic acid;
wherein each of said non-classical HLA oligo subsets comprises a set of overlapping oligonucleotides that cover every single nucleotide position in the mRNA sequences coding for the non-classical HLA polypeptides from 5' to 3' and are sequentially shifted by 1-5 nucleotides from the 5' end of the preceding overlapping oligonucleotide.

56. The method of claim 55, wherein said non-classical HLA polypeptide-encoding nucleic acids encode HLA polypeptides selected from the group consisting of HLA-E, HLA-F, HLA-G, DM, DO and MIC.

57. The method of claim 54, wherein said capture oligonucleotides further comprise a plurality of oligonucleotide subsets that collectively targets nucleic acids encoding accessory molecules important in HLA-linked peptide presentation and/or processing ("accessory molecule oligo subsets"), and said method further comprises the step of assigning to the sample, based on the hybridization pattern, an accessory molecule phenotype;
wherein each of said accessory molecule oligo subsets comprises a set of overlapping oligonucleotides that cover every single nucleotide position in the mRNA sequences coding for the accessory molecules from 5' to 3' and are sequentially shifted by 1-5 nucleotides from the 5' end of the preceding overlapping oligonucleotide.

58. The method of claim 57, wherein said accessory molecules are selected from the group consisting of LMP2, LMP7, LMP10, tripeptidyl peptidase II (TPPII), bleomycin hydrolase (BLMH), leucine aminopeptidase 3 (LAP3), transporter associated with antigen processing (TAP) 1, TAP2,β2-microglobulin, TAP binding protein (tapasin), calnexin (CANX), calreticulin (CALR), protein disulfide isomerase family A member 2 (PDIA2), protein disulfide isomerase family A member 3 (PDIA3), ERp57, endoplasmic reticulum aminopeptidase (ERAP) 1, ERAP2, proteasome (prosome macropain) subunit althap (PSMA) type I (PSMA1), PSMA2, PSMA3, PSMA4, PSMA5, PSMA6, PSMA7, PSMA8, proteasome (prosome macropain) subunit beta (PSMB) type 1 (PSMB1), PSMB2, PSMB3, PSMB4, PSMB5, PSMB6, PSMB7, PSMB8, PSMB9, PSMB10, PSMB11, proteasome (prosome macropain) 26S subunit ATPase (PSMC) 1 (PSMC1); PSMC2, PSMC3, PSMC4, PSMC5, PSMC6, proteasome (prosome macropain) 26S subunit non-ATPase (PSMD) 1 (PSMD1), PSMD2, PSMD3, PSMD4, PSMD5, PSMD6, PSMD7, PSMD8, PSMD9, PSMD10, PSMD11, PSMD12, PSMD13, and PSMD14.

59. The method of claim 54, wherein said capture oligonucleotides further comprise a plurality of oligonucleotide subsets targeting killer-cell immunoglobulin-like receptor (KIR) polypeptide -encoding nucleic acids ("KIR oligo subsets"), and said method further comprises the step of assigning to the sample, based on the hybridization pattern, a KIR polypeptide phenotype; wherein each of said KIR oligo subsets comprises a set of overlapping oligonucleotides that cover every single nucleotide position in the mRNA sequences coding for the KIR polypeptides from 5' to 3' and are sequentially shifted by 1-5 nucleotides from the 5' end of the preceding overlapping oligonucleotide.

60. The method of claim 54, wherein said capture oligonucleotides further comprise a plurality of oligonucleotide subsets targeting blood group-determining polypeptide encoding nucleic acids ("blood group determining oligo subsets"), and said method further comprises the step of assigning to the sample, based on the hybridization pattern, a blood group phenotype;
wherein each of said blood group determining oligo subsets comprises a set of overlapping oligonucleotides that cover every single nucleotide position in the mRNA sequences coding for the blood group-determining polypeptides from 5' to 3' and are sequentially shifted by 1-5 nucleotides from the 5' end of the preceding overlapping oligonucleotide.

61. The method of claim 60, wherein said blood group determining polypeptides are selected from the group consisting ABO (ABO), Chido Rodgers (CH/RG), Colton (CO), Cromer (CROM), Diego (DI) (band 3), Dombrock (DO), Duffy (DARC), Gerbich (Ge), Gill (GIL), Globoside and Pk, H (H), I (I), Indian (IN), John Milton Hagen (JMH), Kell (KEL) and Kx(XK), Kidd (JK), Knops (KN), Landsteiner-Wiener (LW), Lewis (LE), Lutheran (LU), MNS (MNS, Glycophorins A, B and E), Ok (OK), Raph (RAPH), Rh(RH) and Rh-gp (RHAG), Scianna (SC), T/Tn, Xg (XG), and Yt (YT).

62. The method of claim 54, further comprising the step of deriving from the HLA tissue type assigned in step (c) donor/recipient transplant compatibility.

63. The method of claim 55, wherein said non-classical HLA oligo subsets comprise the sequences set forth in Table II.

64. The method of claim 57, wherein said accessory molecule oligo subsets comprise the sequences set forth in Table III.

65. The method of claim 59, wherein said KIR oligo subsets comprise the sequences set forth in Table IV.

66. The method of claim 60, wherein said blood group determining oligo subsets comprise the sequences set forth in Table V.

67. The method of claim 54, wherein the cDNA or cRNA in said sample was detectably labeled during its synthesis, and said detecting step (b) comprises detecting the detectably labeled cDNA or cRNA.

68. The method of claim 54, wherein said cDNA or cRNA-containing sample is obtained from a human subject.

69. The method of claim 68, further comprising the step of diagnosing or predicting the likelihood of an HLA-linked genetic defect, disease, inadequate or undesirable response to a vaccine, biologic treatment (recombinant protein, biosimilar or equivalent), or infectious organism, or condition in said subject, wherein the step is based on at least the classical HLA tissue type assigned in step (c).

70. The method of claim 69, further comprising the step of determining the likely response of said subject to a particular treatment regimen selected from the group consisting of: bone marrow transplantation, immunosuppressive regimen, antiviral drug regimen, antiviral drug resistance, antiretroviral drug regimen, and autoimmunity drug regimen, wherein the step is based on at least the classical HLA tissue type assigned in step (c).

71. The method of claim 69, further comprising the step of determining whether the subject is likely to develop antiretroviral drug resistance or cancer drug regimen resistance, wherein the step is based on at least the classical HLA tissue type assigned in step (c).

72. The method of claim 54, wherein the detecting step (b) comprises the use of labeled detection probes, wherein the labeled detection probes hybridize to the cDNA or cRNA that has hybridized to the at least a portion of the plurality of capture oligonucleotides and are detectable such that the hybridization pattern of said cDNA or cRNA can be determined.

73. The method of claim 54, wherein said classical HLA oligo subsets collectively target all known classical HLA polypeptide-encoding nucleic acids.

74. The method of claim 55, wherein said non-classical HLA oligo subsets collectively target all known non-classical HLA polypeptide-encoding nucleic acids.

75. The method of claim 54, wherein said capture oligonucleotides are immobilized on a substrate.

76. The method of claim 69, wherein the step of diagnosing or predicting the likelihood of an HLA-linked genetic defect, disease, inadequate or undesirable response to a vaccine, biologic treatment (recombinant protein, biosimilar or equivalent), or infectious organism, or condition in said subject, is further based on one or more of a non-classical HLA tissue type, an accessory molecule phenotype, a KIR polypeptide phenotype, and a blood group phenotype.

77. The method of claim 76, wherein the step of determining the likely response of said subject to a particular treatment regimen selected from the group consisting of:

bone marrow transplantation, immunosuppressive regimen, antiviral drug regimen, antiviral drug resistance, antiretroviral drug regimen, and autoimmunity drug regimen is further based on one or more of a non-classical HLA tissue type, an accessory molecule phenotype, a KIR polypeptide phenotype, and a blood group phenotype.

\* \* \* \* \*